United States Patent 9,328,346 (POLYCOMB-ASSOCIATED NON-CODING RNAS) - sequence listing, part 42

SEQ ID NO: 7409 - RNA, 88876 nt, Mus musculus
gaaaucauucgaacgcagacagaugcgcagcauucuuguaacuagccuaugaugaggacauucucuguuguuaauguugagacuuaucugaugcuccaaucauuaaggauugcuccuggguaaugguaauggugagucugauucuauuucucuaccccacacucuagaagcgugccaaucauuugguaacuuuugaggagaguuuagaguauguuguagauauguucagggcagugacuggcguugucugagauaauaauaauaauaauaauaauaauaauaauaauaauaaaacacuaaaaagcaacaccggagaaaaagcuuccauccucgcagcaaagagcagagagacgcagagauucuggucaaccccucuuagcgcugcaguuucuaguuauuuaaccuugcuuaaggaauggccagcagccagcaagcauugcagccuuacaauauuugcacacaacuuauuuaggucggcucuauaaauuccucguuuugcggauuucggaggagaaaucccagccguguguguguguguguguguguguguguguguguguguguguguguguguguguguguaugucuagcaacuuggaguacgguuaaaaggaaucaacccgugucgggggccaagugguacuuuugugcgagggucacgugagaccaaggccgacugggggaggcagaguaggguugaauggaugaagggauuccgcagggacuuccaggcggagggugacgucucugcagcccagcgcggggcaucuggaggccgccggcugcgcggaccugucccuuuaaggggccggucuccgggccccucuggccgcgacgcccggacgugcggagccgccccgccccgaagccgcccguuuccugcggggcggcgcgacggcaccugagcuacugcggcggggccugggagcgcgcugaccaggagguagagcucgcgccgcugcaucgucccggccugguacccggcugcgcagggugaggagcagggccggggacuccagggcgcgcgggcgcggggcgcagggcggggggcugcgcucgcgggguaggccucgcacggaggucgcagugugcagcguccgcccaggccgcgccgccgccggcccgcuccgaggauccgccugcggguucgggcuccaggguucuggcucggcgaucuccccguggcugcaagguccgaucccagguccgcgaguggccggagcuccccggccaucuccucugagggcgaggucgauccgccagggccgcggggugaccgaggagccuauuuuuagcugggcucgcaggccccagggcgggcuggcggauuaaggcucugaugagggugaccagagggagcgccucgccucgccucgggcgcccugggcucgggcugggccacgcgugcgccaugcuggagcggcucuccccucgcuugucccggagcgccgccccucccaccacccgguccugggaguuaggggaaauccugcgaaguucucccucucucccagggguguguccgccuugguguccaacaauagaauuuggggugucccggaucuggccgcuuuuggcguaagggagcagaguucggccauccgagaccggggcuugggaagcagcguucucuucuuuguccggcugccucucgguuuaggucaaaaagugcgcuguuuagugucuucggguccuucugggaggaggcggaaacccggauucuaacagcagggccacugcuagaaguggauuccuuagcagcuauguggauuagcauagcuucagaagcugcgggccgaauagaauaguucaaaguuuuggaguguucugagaaauugacagcuccacacccagguaaagaggagcuccccaaaggugaacuagacauugaguuguguagcaggugacuuaggggugauuuaacuuuuuuuuuuuuuuuuugccugaauuagguugcacuuguuuucuccccucacccgcaagcacuggcagcaguggcucugguguggguaaaagcauuuggugaugagaccugagauaaucuguccaugcugcccuggggcauuccggcugaccuguguucuguaugugccgcgguagccuuucauaucugauguguugcuugguaaauaagccucuuucccauuccaccuuucuuuuagagaccuuacacgaaauagcuaggcuuaauuauguagguucuuuccccaugccaacccugaguuagaaacgucucugaauuuuguagcccucaguagacauacaugucuuaauuaucaggugcauuagagaauaagguguucuacauuacugagacacacacucaaauauaucgggaaaauuccucaaguguauuaaacacuuuaauaucacaaaggauacccaguauauaauccuuucuugauucauugucagcauuauggaaagccguugguuuguuuuauuuuauugguauauuucuaugaccucccuaaguauuagcagccucuuucucugauauaguuucccccuaaacaaaucuaauaagcaaaauccacacaaaccccucaccccccgagcaguguacaggcuugcuaguuuguagguuuugaucuuuuguuagauuuugauaaagaccuaacaaguaaagggcuuguucugaggcucagcuucuagaggacgcaugguaagauugaccgucagucagucuuuagcuggaauuuuacuugaacucuuuggaggauguaucguuuuuccagggagggacucacuggggucagccagaaacuugagcaugccauauauacuuuugacaccucuagcccucgaauauguauuuuuguuuguaugccuacuaugcuuuuuuuuuaauggccaaauuuuuaauuaaaaagauuuuuucaauacuuuguaaaaaauaaaaauuaguaaacucagugguuccaggagaguuugcuuuaggaaucugaccucauguguaauaaggaauggcaggaggugggggcgggggagguacaaauguucagguguuugaaaguaaccucuuacgcaugugguuuuaaaggucucugaaggcaaauccagaguaucccuagagaccagaaguaacuguccagaagucgcagugaccucucauguauaaauggacugcaucccccaucauugcugcuccaguucuaagggacagagucugggguguucugaugaaaaagauacgauguauuuguuagcagcuggggaaaauugguuuaagauuaugaaggauaugguuccuauaaauagaaacuuagggggaaacuuuaggugccaggaaccagaguuugaguaacuuaagccaucacuaaagucuagaagagaaaaguaauaauuuacaaguguuugucaagugcaugaauuggugcugacagccuuaaauugcuuuuaagccuuuucaguuaaaaaaaaaaugcuguuugucaugauagugucuuugaucacucccaagggcagagcagguggaucucggacagaccaaaguaaaaauaaaaaggguugugagcuuuagccuugaaaugauuuccuccuacccccuuuaaaagaaaggguccggucucuaccauggagauuauuuguaucccauguucauucacuauagcaaagaguuggaaucaaccuaguugucuguuaguggguaagugcauaaugaaaauuaggucucucuguaaaagaguacuauucaccucuaaagaaaaaugauguaaaaacauuugcaggaaaauggacagacuuggaauguaugcuaauaaucaaggucccucaaucucagaaggaauuaacugaguguucucucuccuaaguggaguccaaacaguuguaucuguguagacguaaacuagugcauaugcaggcacagccaacaugaagaaaagagaacaagaaaagcuaaauauaaggaugaggaaggacugcgugcagguguuaggugaguuuaggguuaagacaugauugagguuauaaggccaauugcuuuucuuguucuaagucugucaugguuuugguuuuuuuuuuuuuuuuuuggucuuguuuugucuuugauggugguuaauggugguuaagugcauaaaauguauuugauaccgaaaguguaaaauuuaaugugaaacuucacaacuuccauuucaaaaugucaauauuaacuauagaaguucauuaaguuauauagacuuuggcugugguuaauuuuggcauuugauguuuuugcuugaaaaaguuuuaaaaaaaguuaaaguuuauaaaauaaauuaauaaacacuuugguacuaaaaagaaaggugcugaccgcauaggucugaccuggguuucugccacugccucuugaacaguacacccgacuccuuggggcuucugccuaggucugaccuggguuucugccacugccucuugaacaguacacccgacuccuuggggcuucuaacugcuuuuauauucgaagaagcaagacaaacuuucaauuaaaaagaguauuuuuuuuuuuuuuuuuucugagacaggguuucucuguguagcccuggcuguccuggaacucacuuuguagaccaggcuggccucgaacucagaaaucugccugccucugcuacauuagaucacauucuacuacugugcauuucauuuacccuuuugacuccaggccccauggccugaauuugcaaccucgccccauucuuccucgcaguaugggauuguaaguauaugccaugacaacugauuuuuuuucuuuguuuaacccauguguuuaaggcagugucuggcucauaauaggugcuaaguaagaaguugucaaaugaauuaagccuguaucuugcaguuccuuuucuuugguggauauugcauucuggauacacguagcuacuaguuuguuccuuuccuaggaauuuuuagagaacagaagagagugccagggagucucuggaaaccuuuugguagaggaaauaauguuauacugugguggggacugaguuacucacgccauauaauuaaaaagguacuucaaacagggacuuaaaacacauaugugccuuagucagguguaguggcaucugccuuuaaucccagcaacucagggggucuggguagagagaagaagcagguagaucuuugaguuugagguuagccuggucuacauagugaguuccaggacagcuagagcuacauaguaagacgcugucucaaaaaagccaaaacccagacuccaccaagacaaaacauacauucaauauuuguguacuuaaggaauuuaacauuaaucuguaccuguaucuuuuuauuuagacuaaucaauuuucuuagaacuaguuuucugauuuuucuucuagagauuguauuauaaaagcauuaucuauaacuucuuuuaaaauuaaaaaaaauuuuuuaaaaagauuuauuuauuuauucgauguauaugaguacaccuuugcaccuuugcucucuucagagcacaagagagagcaucagaccccauuacagaugguugugaaccaccaugugguugcugggaauugaacucaggaccucugcgagagcaguuggugcucuuaaccgcugagccaucuuuccagccucuauaacuucuaauauuguuuuuuuaaaaaaacuagaaugaaaauguugguaacaaaauccuggagcugggcgugguggugcacaccuuuaaucccagcacucgggaggcagaggcaggcggauuucugaguucgaggccagccuggucuacaaagugagguccaggacagccagggcuauacagagaaacccugucucgaaaaaccaaaacaaaacaaaacaaaacaaaaaccaaaaaaauauccuggaguuuuccaauccuucaaaaggucuugguuuuauuuuccuauauuuagcuuuugucagacauuagucaucuuuuucagaagaaggaaaugcaguguauucagggguuggucaugguagcaccaucgugaguaaacuugguaguaggccuaggucuccacugcuagggagaaggaaggcuacuuguccacauuuucucucucucucuuucucucucucucuuucucucucucucucuuucucuuucucucuuucucucuuucucucuuucucucucucucucuuucuuucuuucuuccuuucuuucuuccuuucuuccuuucuuucuuuucuguuuucuuucuuuuuucagaggggauaugagauucagugggaacauugucuaucaggacacacauucauaugcuaccugcucacuggaaaugugggacaguucuuuacucuuacccaggaacuaggugaguugccauggaagcagugauucucugggugcugaaaggagaccugcagguuuucggccuuggucacccugaggguuauggaaguucuuucuccuugucuguaacugcaugccuucagugaugcucuggagagcgggagaaggaccgguggcuuuaauccagccuugcugcuuuaccaccugauuucuccccucagcuuccucacuccccuuucagugcuuucaggcuugccuguauacuuugcucuuaagccauuuguuuuguuuuguuuuguuccuuuuguccucuuccuuuuuuaagugggacucuuugucugaauuuauuugaaacuuccuuuccauucagcuuuguagaugagggacuuacucuuagggacuuacuuuuauugcuauacaaacuuuuguaugauugauuguugcguuucugagacugguugcuaagacugaccuugaacugccacaccugguuuagguuuaaauuuuaaauuaauaucuuuuuuuuuuuaagauuuauuuacuauauguaagaacacugcagcugucuucagacacaccagaagagggugucagaucucauuacagaugguugugagccaccaugugguugcugggauuugaacucaggaucucuggaagagcagucagugcucuuaaccacugagcaaucucuccagcccagguuuuauaaauuaaaaaggaaaaacuuuuuuuucucucucuuaagugauuuuuuuuuuuuucauuuauggauucuugcaaaauagaaacaguuauuuugggcacuuuuuaauuacaaaguuaccuugucuuguaagugguugcaccugugucuauauugguuugaguuucuccucugauugaaggcacaguagggauguccuuugagaaaaacaggaacucauuuucuacacuggccucaaacuucccguacacccuccaaguggugguauuauaggcaugugccuucauacccaugguccugaaccuauuuuaaccauuuauuuguuuugaauuuuugauugcuuuucauuauuuuccucuuucccucuccucgagcuagguuuuuucuguguagcccugguuguccuuguauuuuguagaucaggcuggccacaaauucacagagauccaucugccucugacuccaaagugcuagaaguaaagacccgagccaccaccaccaccacuguauauuuuauuuuuauuuugugaaaauccuaauucauauuuauucagucacuuuuauacuaacugcuuuuuguuaauaucugucuuaguaagguuuucuguugcuguuguaaaauaccaugaucaaacucaauauggggaggaaaggguuuauuuuauuuauuuuauuuuuuuccuuuuuaaaauuuuuaaaaauauuuauuuauuuuauuauauguaaguacacuguagcuguccucagauacuccagaagagggcaucacauuucguuaugaaugguuguaagccaccaugugguugcugggauuugaacuugggaccuucggaagagcaguuggcgcucuuaaccacugagccaucucagcagcccagguuuauuuuugaauguaaaugaagcuauggccuucccuagguuugguugaggagguuuuuauuguagacuggagggagaacauccagaggcaccuggaaagguucaggcugagcauggccagcagacuuacccaggggcaaagaagugcuuggaggagcggcagggacugagugagagaccuggcccagguuucucugggaccuaacaguuucaucuuuccaggaagucagcacagaaauccaggcaggaaccuggaggcaggaacugaugcagacauuguggaggggugcuguuuacugcuugcucuccucaugacuuucucagccugccuucuuaauagcacacgugaucaccagcccaggcgugggcuugcccacaggagaucuggugaggauaguuucucaguugagguuucuuuuugcaaaauggcucuuggaucuuucaaacuugacauaagacuaaccuguacacuguucaugaugugacauuuucaugcacagauaucgcauauuuugauuauaugcgugcuccuguuaccugucucucugucccucuguuccucugucccucccuggacugcccuucuuaggaggagaaauaagaaaggagaaaauacuugauacuuuaugugucugguuuauuccacuuaacacgguugucucuaguucaucuguguccuccagaagagaugguuuccuucuuuauugccgaaugaauucccuauugguauuugccacguuuucuuuaucaguugaugggcaccugaguugauuccauaaacuggcuacuaugguuguuggugcagugagcauugauauguaagugucuuuacuguaugcugcuuuggauuccuuuaauguuuacuuaaggagugauagggcaggaucauaugcuagcucuauauuuuagcuucauagggucucauauauauuuccacaguggcuccaccauaucuccacuaauaguauauagugcacccuuucccagcacccagcaugagcuuuugguguuaguggcuuuuuuuaagucauugacuaaguucuggaugcuaauccucuguugaaugaguagucuguagagauuuccuugaguuuuuuagcugucuuuuucacuguuuccuugcucuguagaagcauuuuguuugcuacaaucucauuugucacuuacuaguccuucuugagcaguugauggaauguauagucagccugugccugugucaguaucuugaugucuucucuguuagcaguuucagaguuacagguccuuggcuuguuuugaguggauuuucagauaaggugagagagauggcucuaguuucaguguugguugucugguuuuccuagcacagaagaaggcugccuuuucugcaguauguguuugugcaccuuugcggauggauggcuguggauguuccgguuuguuucugacaccuuaagcuggcuccacaguuauuucuauucaaguaccgugcugcauuuguuacuggggcuucuguacuucuaacaggcauugugaucauuccagcaacguucuuuuugcugagccuugguauugucuuuggauauuuuggccacaguaauaggcauugcuuaucaauacagcauauugccuacaaaugaaccauuuuucuuaaaaaaaugcauuugccuuuaaaaaaaguaacauaagauuagggacuguagucuguuuggaaugcugguauuuaggcucggugaucagauuacagauuguguuuaccaggauguaaugagcuuguuugcuguaggccucacagcucauuguccauugaauagaaugcuuaugggcucacucaugaacaugugcaucuuuuaaagguauauucauuuaguuuuucuguuccauuuuuuuuuuauauagugaaggaauuuaauguucuuagauugaaaauuaccugaauuuggauaguuuuuuguauguggcauuguuguuuggugaauguacaaaaaugggggcaagaaccacuuuuaguuuguuuagucuuguguuuugauauuuuuuuccccaauuguucuuuuguuuuguuuuguuuuucaagacaaggcuucucuguguagccaaggcuggccuugaacucgagauucaucugccuccugcccugccauuaaaggcauucgucaugggcuggagagauggcucacucagugauuaagagcacuggcugcucuuccagagguccugaguucaauucccagcaaccacaugguggcuuagaaccaucuguaaugagaucugauauccucuucuggugugucugaagacagcuacaguguacucauauaaauaaaauaaauaaaucuuuaaaaaaaaaaaagaaagaaaggaaaaaaaaggcauuugucacaacugccuagcuuccaauuguucuuuuaaaucauccagaugauauaauuuuauuaaguguaguaccaaaaagaauaaauaaauaaaauaaaaguagguauguuaguagaugcaggaagaagugaacauggcaguaagcagagcgaguucagagcucauccucuuaugugagcucuaacaguauuugaugauaguuuuucauucugccagcagaaaugccggguuccuucugaaccuguggguuuuucucucucacagcaaagcccuagacuauauauuuguaaaauauuuauuuuuaugugcacugauguucuaccuccugguaugucugugugaggguaccagagccucuggagcuggagucacacacgguugugagcugcccuguggcugcugggacuugaacugaggucuucuggaagagcagccagugcuguuaauggcugagcuuucucuccagcuaugggcaaacaauuuuuuuauuucuguuuuuaguuuuauaaguauaacauagcuaaguauguugauccauaccaacaauuccauauuuggaaguacgaggacagccugagcugccuccucuaagaucuuaucuaaaauaagcauaaugcaguacauuaagagugaugccuagccuggcauaguggcucacgucuuuaauccuggcacuugggagacagaggcaguuuaaucuuuugaguuggaggcuagucugaucuaaaaagcuacuucaggauaaccagggcuaaaaaacccccaacaguucuuguuuuuuuaugcauagucucaguuuauauagcuguuauguucaauauaaaugcucuaauguauuuuuucuuuucuuuucuuuuuucuuuuuuuuuuuuuuuuuuuuugguuuuugagacaggcuuucucuguguagcccuggcuguccuggaacucacuuuguagaccaggcuggcuucgaacucagaaauccggcugccucugccuccagagugcugggaguacgccaccacaccgggcucuaauguauuuuuucugcaucacaaucuucacucuguuaauuguauaauguuucuguagauaguucacauugaaauaauuuguuuuccuauuaaaaacagugaaauccaucucucuguguauacacaguacacuuuuaccaguuaaguaguuugauugaaagucuuaaaauuacuuuuagauuuaaauauuuucagccaggcuuugguagcacaugccuuuaacacuuggcuggcagaaacagguguaucucugugaguuugaggccagccugguuuacagaaugaauuucagaacugacagagaacucuugucuuggaaaaccaagcuaaacaaaccaaaaaaggaaaccaaaacaaaugaauaucuuugggacagaucuuacugaaugguccaguuggccucuucccugauccuccuuucucagccuaaaagugcuggucuucagccaugaaucgccacauugcucuaccauuauuuguacuauacauauaccuaauauaaccuagcauuugugcccuuuaaggcauguauacaauucaauuuaauucggugacauagcucaguuuuuguaagagaacauauauaucuuggaggacaaguugauggaauuuaagagcaagaugguuaucaugcauaacacagacucugaaaugcagcgucugaaucuuguuucuccaucuuuuuuucauuuuguggcaucuuuguuuugugguguugugggauucauguaugccaggccugugcaccaccaucaggugacucuuuccucuagacugcuaacuuaauauuuucgcaguucuuuagaugcacugcaggguucaaaucuuugauucuuacuuagagcaaaguuuuugugcaaaaauguguggcccuugagaguaucugaaaauuauuuggaaacaaaagugggauacuuuuuuuugguaguaaagauauagucaguguauuucauaaauuucuugaaggaugugcuuggagcaaaguuuaagcuugauuucuuuugaucuugugcacauugcacuccugauuguuuacccuuguuggcuguuugcagcauucagauuagaauccauuaaaacuuguauauaauuauaugcauguugaaaagauauugauacuccaugccuaauaaggggacauaggucacuuuugcuaaauuuggccgagacagaacccucugcuagucucucuguuaccaauuugacauacauacugcauuguauacagugggcuuagacaaauuuaaagaugggauuucugucaacuacagcuaaguuaacuuugucucaacccucuuucccauuaccucaucaugggcuaaguuccuuucuucuccacuuuuuuccugaauucucuuuuauuuuguucugagccccuuauugccagcuuucccccuucguauauaacuguugccuauagaugcaaugugaauuuuagguauaccagugaauaaaauauaugcuuauuuauuaaacacuuaccugaaaccaaaacggaacugaacauuuuguaaccuuuuuuaagucaaagccuaacaucucaaggcaaguggcucuuauuguguucuuuccuuauuucuaguuacuaaauuuaucauuaaucauacaaaauuaggauuuuugacuuuaguaaaauagaauuuaaacaaaagucauaguacuuagggcuuuuuguuuauuuauuuuuagauagucuuauguaacccaagcuugcuuugaauuuguacuagaauacccaguuuaaacugauuggaacuuugugcaggcaagcacucuaucaaaugaguaacccccaaguacuuguagucuuaauaguuaaacucugaguugaccuugaugcugaguguuuuaugucuucaguuuuuauguuaugcugcuaugugucuuaauauuguggguccucuacauauauacagaaugacaugaacauugaguacaagcaaaaggaaauucaaguuuugagggaaugccauuuggaaacuuuggguuuccauuaugaagaaacaucaugaccaaggcaacucuuuaaggaacauuuaauuggugacaacuuaaaguuugagagguucaguccuuuaucaucauggcaggaagcacugcagugugcagguagacaugaugcuggagaaguagucuuaaacugaaggcagccaggaggggacugucucuuccacacugggcggagcuugagcacugguaacccucaaagccugccuacacagugacacauuuccuccaauaaggccacaccuccuaauagugcuauuaaccaugggccaagcacauucaaaccaccacacccaugaaaauccaaaggaagacagcaccauuccuucagguuugugggaucuaaaaacagacauagaaacucuacagacccugagcagaaccccagggagaguuucagaucucuguggucugguguuuggucuuugccuugggcacuuggugccuuucauuucugucucggugaaccuggucaguaugaucacagaggaagaucuggaagucaucaugcguauagauguacagguguagcuuauucuuuuagcuucugugucugcugcaaaguaccuuagcuuguuuuccuaaggcaaaacuuugacauguguaucaccuuauuuuucuucugacuccaguguccuggcguaggauggauauuuauuuauaucuauaucuauaucuauacacacacacacacacacauacacacauccauccauccauccauuguuuacuuaaaaacaaaaacaaaaagacaaaacaccgaucguuaaaagcaucucacuugacgaguagcuaacuuaggcaaacagaacagagagugcuuaauugacauacagauuagaugaguuaucagaaaagaucaauuccaaaccucucacuggcucuuaaaccuuccuaaugugauccauuaacacaguuccucauguuguggugacuccaaccauaaaaugauucucauugcuacaucauaacuguaauuuugcuacuguuaggaauuguaaauaucuguguuuucugauggucuuaggcagccucucugaagggguuguaaccccaccccaaaguguuuaugacccacuugagaaccacuaaguuaacauguguucuguuucucccuugaacuugugaaaucuuaccuuaguaaauugcuuguggaaaguuaauuuuagucagaaagauuaauauugugucuguugaacuauuuuguuugcagaauguguuucaauuuuagauguaggccauuucagguauaacuugaauuaagaaugcacuguguuuuaaaaugagcuaucaauuaauugaaagacaaaguagauuuuaguagcuuaaagcugccugugauuaccauauccagucuuauccauuugguuuggcaauuuacagauagacaugaacagcucuuuuacuacacacacacacacacacacacacacacacacacacacacacuuauucauucagagauugaaucuuauauggcccagguugaguuucacuucacuucaugguccuccuucucagccucccaaaugccacacugucccaggucccuuuaugucaucuuguaaauauuggaaauuuguuaaaauccucugcuaaagcaaaguucuaaaaugacuauaagaacaauggcuccacauuuaaguaguuuuuuuuuuuuuucuuuuucuuuuucuuuuucuuuuuuucuuuuucuguccuggaacucacucuguaaaccaggcuggccuugaacucuggguucaacuucuagcaguacuugucaugacugucuuucaccugcuaccuugccaaaaagagggagggcaguggagaagacacacccuccccucgccccuacccccuuuuagggucuugucacauggugugagaagggaagggucuguuacacuucucacuaacuacccacuuccccuuauaguauaguugaggugcaggcaacagccaugguuuaaacagcugaccuguuuuguguucugaguaagaugggauuaaaucugaagugcuaacugucagggcagggugcuagcaguuuacuuauuuauauaauugacuguuuucucugucauuauugccuccucauuuagauucugcacaggcucucguuaagagaagacuauggagcuguacgagucaacguauuuuguuguccucaucccuucaguaguuauuaccgucauuuuccuuuucuucuggcuuuucaugaaagaaacauuauaugaugaaguucuugcaaaacaaaaaagagagcaaaaguugauuucuacaaaaacagauaaaaagaaggcagaaaagaagaagaauaaaaagaaagaaauccagaaugggacccuucgugaaucugauucugagcacgugccucgggacuuuaaauuauccgaugcuucucccgcggaggaugaacaguuuguaccugcuccacugaauguggcagaaacuuccaguaguguuagggaaagaaagaagaaggagaagaaacaaaaaccuucccuugaagagcaggucaucaaagaaagugaugcaucaaagaucccaggcaaaaaaguggaaccuguccuaguuaccaaacagccggccccacccccaccccucgaagcagcugccuugaagaagaaagcagggcagaagaagucuaaaaauggaagcgguacauaaucuuuuuaacucauugcaugauuauaugaagcgacucugaaauagauccuucaccucacugauugcuuuccuuagcaggaauugguguuaaaaauuaccaggaauagacacuuuaaauuucaucuauaacuauauaaaauauucguuggaaauuuauaaaccugagguugguggcuuauaagggcuuguaguuauugacagggacauauuagugaacacuuuguaaucagugugauaggaguugaaaaggugaaacauuguuucucacuuuugauucaguuuucaaacuguaagcacugggccuucagagaugagucacauagcagcuguagaaacuagcauaacaagucaugaugguggaaaaagaucacaugaucugggucucaggacuucaaaggucacuuggagugugcagagccaggcauuaauuccaaagcuugguaaagugcuggcuaguugucauauuuaaaaaaauguacauacauacauauauaugcauauauauacacacacacacaaacauauacacacacauauacacccauguauauagguacauacauacauauauguauauauaaguaaguauuggauugaaaauacuugaaaaaugaucgugucuguggaaguauaugaaagaaugucuguuuuaaauauggacaguuaaaauaaucauuauuuucuaggcaguacaguauaauuauuuacauagcauuaacuuuauauauuauaaguaaucucaagguguuuaaaguauacaggagaagucuguggguuauacugaaauacaugucauuuucuguaagggagcugagcagucucaggcuuagguauagguucuagaacguguuucccuccuggaugucagaggacaaguguacaguggaaaguuucugagaaaugucacaugguauuagagcugcagagaggugguaccauagcaagggacugaaauccguuguguguucuuauauacaguguuaaugauuacauuagacuuaaaaggcuugcuugcagcucugaccacauaugcuaccagagaagcaauagugaacacugcaugccuuaggaaggagaguguguaggucagugauaaaaugugauuuauauagaugaauggaagaaauaauauaagugcagaagccaaagcaacaguaauucaugaaauucguggguaaaggguuuacagaggaggccaugccuaagcugucuuuagggcugagucacuuuacaaaguaaauacugggucucacucuguguggacagaaagcuauuuguuagggcucaggggagauauguggcuccagaguacuauuaagaguguacugaacaaagcuggaaaggucaugaugggucuucuaaaccaccauaggaaaugcgucuuagguuaguuacuauuggagaguuuagucagguuaauacagucagauucaucugcugguuggcggucugucugucugucuuaucuaucuaucaaguauacuauagaggaauggugauuugagggauguuugcauuuaacuuuuauguguaauauauacauauauacauauaauuuauucuuauuuuaugugccuaugaauaugaauauuuggcuacaugucugucuguauaccacuugcauuccuggugcccucagaagcuaggagagggugucagauuuccuggaacuggaguuucagaugauugugagccaucauguggguccaggggacagaacccagguucucugcaagagcaaaaagugcucuuaccuccugagccaucucuccagccucuguuuagauuuuuauuuuuauuuuuuugguuuuucgagacaggguuucucuguguagcccuggcuguccuggaacucacucuguagaccaggcuggccucgaacucagaaauccaccugccucugccucccaagugcugggauuaaaggcgugcgccaccacgcccagccuguuuagauuuuuaucuuagaaagaguuuuuggaaagaauuugugagaacagauucuauggggcauuuucauauaggcagaaagacguacacuucagacagugucccagaguuacucagggccggaaugugguagagaggugcacaaaauaagaaugacaagaccaaccccauagcggugugggggauaaggaaggucagaacaaaggggacugggauucuacguuagauuagguuugacaaacugcagucugagcuaacucauccugacuuguguugccaaggauggccuuguguucacagagacccaccugccccugcuuccaagugccaucaugcccagauggaaaaaaauuguuuuuaaagauuuauuuauuuaugucaugaaugugaguacacuguugcugucuucagacacaccagaagacgguuuguuuguuuaguguucugccugcgugugugucugcaguccagaagacagcaucagaucccauuacagaugguugugagccaccaugugguugcugggaauugaacucaggaccucuggagagcagccagugcucuuaaccucuugugccaucucuccagcccguaaauuuuuuuuuaauugcaguaaaauuugggacaaaguugagauaauccuuuuuuggaguggacgagauaacaauuaggcugcaauuaguggucuguagaaaugaaaguaccgguuauuuuuuuguccauauagaaaggaauggauauggagugugggaauugcuccaguagggaggguuuuuaucuuuaaaaugauaggugaccauacugugggcugggaauggcucugagaugagagaaaagggccacauacauuaaagacgauauuguagaguaagaaagcugggaugagaugcuuguagugacagagauuaaauauaagauaaacuuuuuguaguuaaagcauuguagaaaugauuaauuuauucuuuucugguguguucauuauuugcugugaugauuuuuccccccacuuauauuuaauaaagaagagcaagauaaaaagguggaaaugcugauggcaccuucaaaagagcaggacguguugcuuucccaucaagacacuaagcaagaagguggacuaggaaagaagaaaggcuugucaaagaagcaaaagucagaaaauggugagauguguggauguguuuuaugaaugcuaauuauagaguggugugggcaguagcccugugcucuuuaauucccgccuuugugugcacuguggccacugggaugcuaauucaagucuaaagugcucugcaaucuuguaguugcauugcuuuaguagauaugcuacgaacgcuuggguuuaaaucuguaauuuaaaaagggcagaauauuuguaauauagguuugaaaaauaaguuuguacaagcuauauagaauaaaaguauuucccaaauacuuacacuuaaauuuuuccaaguaucauauuuuuuauuauaauuacuaaccuguuaaucaaacacacuaauaauuuuuuuuuaaaguuauuuauuuugguguuuugacuccugcugcucaggccguuuucuaacucaccauguaguugauuugaggaugacagugaacuuccgguuuuccugccuccagcuccccagugcucuguggggugugaucaccaaaccugggugguuggugugcuagaugagcacucuccuaacugagcuaugucgccagccaggacagggcuuccauguaacaugcucacugugaaguucauguauauuuauuuauauguuaaugucuguauaucucugugucccuuugaucauauauaucccuuccaucuuuccuugucuuaaugucucuccuuauucucuugcucucuuuccucuuccuuuauaguugugcuucuacuuucaaguuaguuuuuaaaaaugagagaauacauguaauauucaugcuuuuaaaauaucaguugaaaauaauucacauauguuagaucugcauuacccugcauuucuuaaucuuuccuauauaacauuugcauguguugauggcaggcauccaguuaaaagugacaaaacagucugcuauauuucagaauuuaccagagaaagccugacucuaaauugauggagauuaaauagaaguacuuucacaaacugugcugggcugucacauuacacaguggcuagaaaacuuaauuuagaaagagaaauaaugaaauuugauuuacauuaaaauuaugauguaucagacaaguuaugagacaguauuacuugcauauauuugauacaauuaaacuucaccaacuuuaaguaauacaaauccagggcccucuauaugcaugcuagguaaaugguuuaccaccgggcugcauccucaugcccaaaaguuugguuguaaaggaauguagugagauuuucaucucaguauagauauuuguuaucucugaacaacauauucuuaguagaauuucuuucuuccuccuccuccuucuucuucucccccuccccacuccccccucccccucccccuccccucccccaccccucccccuccccucccccaccccucccccuccccuccccuccccuacuucuccuccuucuucuuuuccuucuucuccuccuucuccuucuccucuuucuccuccucuuucucuuccuccuccuccuucuccuucucccucucccucuccuucuucuccuucuccuccuccuccucuuccuccucuuccuccuccuccuccuccuccuccuccuccuccuccuccuccuccuccuucuucuucuucuucuucuucuucuucuucuucuucuucuucuuuuuuuuuuuccaagacaggauuucucuguauagcccuggcuguccuggaacucauucuguagaccaggcuggccuugaacucagaaaucugccugccucugccuugugagugcugggauuaaagucgugugccacuaccuccuggccuuaguagaauuucuuacacugggagaaaauacaacauugagaguagaaucuguaggcuucccuccauuucuucuccuuuauugaggacaagaacuguguaaccuugguuuucuuggaacuuacuauguagaccaggcuggcuucaaauucagagaucaucugucucugccuccggagugcugggaucaacugcaugugccaguguaucuagcccuuccugugcucuugauaagcuuaguaaggugugcuguagaaauuaaaggcaugccuauuggaaggagaaacuauugcaagcaaaaacaacugaguuuauaccuaacauaggaaagaaauugaauuuaaaacgaucacguguaggcuggaaaguguacagaaagcugugguuuaauccucagaaauaccgaaacucgacauggagaugggcgccuggguaaucagaaguaucaucauaaauaaaaauggacuucuuaagagugcuaaugcagugauauaggcuaucguauguccagacagaaacauggcuuggugguguagcacagcuauaguuucaucucucagaagacugaggcauggcgauucuguguucagggucauccugaggugcauagugacaucucaucucagaaagauuaaacaagaguuaaguagcuaaaggacagauugaaacauuuucaacacuuauuagagaagauacacuacccauuuaagaugacuugaaugauuucagaguauuaaacugauauguuaaaaaucauguuaaaugugaagugggaauuagaaacuaaauugagcuaauaagagauuuuaggaucaaugcauuuguaauuagauuuaaguguuuguauauuguuuaauuacuucauuuuaacaacucaguaacuaugauguucuuucuuaaguugcagucuugguagacgagccccuuauucaugcaacuacuuacauuccuuuggauaaugcuaacucaaaucucaugauggauaagagagaaauuauugauaugauuaaaccugaucauguugaaggaauccagaaaucuggaacaaaaaagcugaagauugaaacugacaaagguaguaugcaaaguguugugaucuguuguguuguaaaauuaggguuuugagucuuggccugaugcacauuuucucauaagaucaauaagaucuugagguaggagacuuaacugugguucccuaguccagggcuucugaacuuuuaaacacuuaaccaucuuuugcuugagaaauuuuuaugcaauccaagguauauaaaauugguauaacaagaaaacauuuauuguuaauaaaucaaaggaauuuguuucaaaacaauucuugguauacauauaauuuuaccauuuguuaaaguuauaggaaauuuguauucuaaugagauggauaggcuuguuuauuuuuaacuuuuuuuaugacuuaauuuuaauuuuaugugcuuugauauuuugccaaccugugugucugggugaggguuuuggauccacuggaguuacagauaguugugaacugcuauguuguugcuggggacuggacccugguccucuggaagaggaaccaauguucuuaaaugcugaaccaucucuccagcccagacuuguuuauuuuuacauaaagaauuaaguguuaauuaaguauuuguuauucagaacaucuguaucuuuuucuguguugauauuuugauuuuuaaaaucuucugugcugaagaguuguuucauauaaauauguaguacagaaugauagaaguacauugagggucauuucagaaaugauugaaaauucuaucauaauuuuaauccauaauucauuuaacauuaaaaaaacaaaacuagccgggcggugguggcacaugccuuuagucccagcacucgggaggcagaggcaggcggauuucugaggccagccugguuuacagagugaguuccaggacagccagggcuacacagaaaaacccugucucgaaaaaacaaaaaacaaacaaacaaaagaaccagacauccuaacaaugcgguccugagauagacugcuuugaugcucacuugcugaagaaugauuaauagcaaaguaccagccaucauuuucuguaauuaaacuauuguuucuauaagagcagcgaaguuuauauguaccguaaagacguugcaguuuguuucagacacugcuguucuuuugcuuuucuguuaauuggacacaagcuagcaucauuuauuuaggaaggacccucaguugagaagaugcauccuuugucagacuguccuguaugugggggagucuggaguuucuuccugauagaucuggacaggcccagccuucugugggcagcgaugcccugggcagauaaggcugaacaagccauagggaaaaagccaguaagcaacuuuucuccugacuuccuucagugauagacuaauguagaaguuuguaaaugccagaagaagguauaugaucuccaauaacuggaguuacagaugacuuugagccugcaugugggugcugggaauugaaccuuggcucuuuggaagaguagcuggugcuuuuaacuucugagucaucucucuagccccuauaauaaguagacuguuuuagcuggacacauuccuguacuuguaguacucugcagagugagaaagaggguucuaaguucaguacuaaccgggggcuacauaaagagauacugucucaauguauauuuaagagcaguuuuaaguucaucucaaaacugaguaaagaggguuguagggaugacucguuuuuuaagaauauuuaagagcaguuuuaaguucaucucaaaacugaguaaagaggguuguagggaugacucguuuuuuaagaacacuggcugcucuuguacaggacccagguucaauuccuagcacccacaugccagcuaaaaggucuaacuccaguuccaaggcuucugcuacccucacucagacauacaugcaggggaaacacuaaugaacauaaaauaaauuauuuuaaagaguugaauagaaaaggcagaguuuugcagcugacauguaaaacaggcuuaggcuggcugcuuugggucuggggagaaguuccuugaggaaagggaguuucuccaggggcccuggaggauuagaguaggugaggcuaagagauguuuuaaggcuagcacugcuuuauaguugaccagaagcagacugcauuguuaucauuaucccagacuuauuucucaucuguggaguuugguuuacucagucaggauuaauaaggaaaugaggcuauugcaagcaccugcuccaggugcuaguaucuacuaaaugcuuccaugguuuuaagagugaggguaggacuagugagguagucuuaggaggugaaggcgcucgcugccaagcuuggcaaucugaguucaagcccugggacucaaggcaggagugaaccaucucagacaagcggucaucugauauguaugcuccgcuccgcucccaaacaaacaaacaaacaaacaaacaaguaaauggaauaaaacauaagagcauauugguauucugcagucugggaaaacuuuuagcuaauguaauuuuuccacguuacagaugauaaguacuauuuuuuuccccuuuugacuaaaguagcuauuguuacuugaccuaaagucuuuuuuauguuuacauuuguucaaauuauuguuuguguuucuaauucuaacuuugccauccuuuuguuuauaauuaagaaaaugcugaagugaaauuuaaagauuuccuucuguccuugaagacuaugauguuuucugaagaugaagcucuuuguguuguagaccugcugaaggaaaagucuggugugauaaaagaagcuuuaaagaagguaagcagcgcugggcgugguggcgcacgccuuuaaucccagcacuugggaagcagaggcagguggauuucugaguuggagaccaaccuggucuacagagugaguuccaggacagccugggcuacacagagaaagccugucuuggaaaaaacaaacaaacaaacaaacaaacaaacaaacaaacccccaaaaacccaaaaaagaaaaaacaaaaccaagaaguaaaacuaauguuuucuucgcuuagacauucuauguuuuuaaaggacugagacguaaaagguagugaagacaggugaaggagagcuaauguuugccugacacagugauuucaggucuuucagggacacuauagauaauguaguaauucacuugaaaacgaugaccacagagguaugcugugugcacacucuaauagaacuacaguguacuagaguucagggcucccucugaccacgccccucacgccugccaguucaggcagcaggagaaagcugcagauaaacacuguguauugucuguaugacaagaguguggagucaggcucuguuuauguggagaauaguaaauaaauaauugaaggaagggagucacguuaaucucacuaaacugucacucaaguccacagucaccaaaucaggacuuuagucugacaaaaccuuggaaguagaguuuucaugaaaauuucuugaaaacucaaacacagcuguggccaagaaguuuaaagaaggaugguggcacagccaaggccugggccacuguuuauccacagagccaacacuaagaguguggaggcaggcaggaguuaccgggaauauauggcacauagaaguggcugccaugaacugaggguggaggaggagggaggagaaggggaaaggaacugcucugaugcauccaguguggcucuucccucuuccguggggucuccuuucuugcauggucuuugugcugggugcgaauggugaauuugugcagugucgucuuuggggcuguucaggccgugaggucuuugacccauuuggacuucccagguugugacucccuccucccaccucugcucgcuguguucuuagaauaguaaaguugaugcaguuucuucaucuucucuuuuccuucauauagguagcucuugacugucuuccaagaaaguccucgccugaaacugcacuuguuucucaugucaaaugggacauugugauuuuguuuuguuuuguuuuuucauuugggaauagugcuuccugaccucagagaacggcacugguggcaucuuggcauguugugacagaguuguugagcaccguguccaauugucacugcucuguuggucuucccuguacuguguuuugaaauugcauauggcugcuucuuggugagaggucauguaauuucauagucucuuaauccuguggaaaaguaaggagggaaauugcuuguuuugacuuuugggcuuauaaguguuaguucuguacuucuuuguuaaaguaugcugcuuuguacccuacuaauauucacuguccgagugacuucucugauuuuauuugacuaguguguggcagucauuuuauuuuagacguacaucuucuugacccgugggcucuucauaguagcuguuucaugcucacagcuucuuugggucauuucgacuuacucauuccguccugauuucucaauuacagucgaauaaaggagaacugaguggucuucugcaucaacuucaggagaaggagaggcugcucucugccaugaaggaagaugcugcugccucaaaggagcgcuguaagcaguugacucaggugaagacauucuucaguucagggaugcguuuccugaguuggaagcugugagagacuuaagcaccauaugccuuaacaucuuaauuuaauuuuuauguaauaaauuuauacagagcaaauuuauauacaguaaaaauaguuuuaagauuuucauauggaagacuuguagucauucaugauauaacaaauaaaauaaaaauauuuauuagucuaaugagaauagcaaaaccauugugcucagaacacaggaauuuguuuuacguggaugugauguggaucuguucuucugagaagcauaauguccauuuacucaugugaagccuuuauuacuuauauguggaaaguuuugugauaacuacuuauacuuuuaaauucugcuucuuuaaaacuuuacacauuuuagucugagggguaaaaaucuaaccccaaacaaaccuuuuuaaaaauaucugugucgacugagagaauagaaguggagcucuggagagaauuuguuuccuccauuagauagagugguauagacaagcgugugugcgauuucaucaccaccccacagggaugcaugacucucaucucaguguaaaccuuuaugugagcuugacuaauaagaaaagucagugcaagcacaaaaaugcuauaagccugcuuccuuauaguuaacuuuaguauauuugaugugaauaucauuuaguacuguuuuuugaaguuuaaaaaaauagguuguuacuuuuugcuguuuuguugugagcauacccuuuaaugguucuuuacagcuucaacccaugugucaucguccuguauacuggggauguguauacuugguaacuaagucaaauagcugcauaaaauguacaucugagugacuuaucuucaaaauaaaauucuuuuuuuuuuaaaccauauuuuauauggaguuuaauagagugcagaguuuuuuccccauaguuuuggaacagucuuagguauuccaggcuggucuaaagcugauucuauagcugagagugaccucguacuccugagacccucauugcaccugcaaugcugggauuguacaugauugccagcauaacuggcuuuaguaugacauuucuguaaaaauacauuuaauguaauucucuaaaaauaaacuguuacguguauuguaugucaguauaaaagcuuucaaauauaaaucuaaaauaugaaauguaaguauauaaauaauaaauuacauaaaagcuucaguucugucacaguuucuuaaagcagggauguauucauaccugcagauaaccaacauugcuuguuuucauuugcuuggauaauauuuguucuaggaguuuauauuuuaagauuugaauuagaaagauaauaagucuuuguuuucuaacuuagcuauuuuuaacuuauuuuuugcuauagauauccugcaucucuuccucuaaaagacaggccugucuuugguuccuauucuaacaccuuucuuggucuuuucauugaacuccaaaggagagugagaaauaaucacuguuuugccuuaaaauauuuuuucuuauaaucacauuagcauguaggauuuaugucaggcucacagccuuuauaaugauugaaucaaaaggugcauuuuagauagaaacaaucuggacaguguuuguaaauaaacaucgaguggagaguaggccugcgggagacucuuuguuucuuuuuuuaaccuuugacuuugcuuuguacagcagcccugauggagcauucaugauauguuacuguuagaacauugucuugcuuugguauugucauaauaaguucuucauauauuucuuuucugguuuacuauucuaggaaaugaugacagagaaagaaagaagcaguguuguuauagcaagaaugaaagaucggauuggaacacuagaaaaggaacacaauauauuucaaaacaaaaugcaugccaguuaccaagagacucagcagaugcagaugaagguauguuuggagucuuggaaaguaagaugaauuaugugcguuuguuuaacuucuaaguccuuugcauggguugagccauugacguauaguggcuagcuaaacucacuucucuuuauucugaaguacguaaauauucuguguagggauaagaugggaagcugaaagcugauaggggggcaauacaccaggccaguggaggugagcaugaugugcauugaaguggugggguuggaaaaguugggaaugaacucauaguagauagaagaguuguuagacacggugcucaggcuguguugcaccuucugaaucaacacuguccagugaagcugaaggugugggugggggguugguuguaagaguuauuacuuggugagcuucuuuauucccaucuguguagauaguggggucacugacuauauauuuugggaaugcagaauuuugugagaaauacaauacaaguuguaagaauugggagccaagguuauagugaaauagagauuuggaaauaaguauagauccauuagagugucucucagaugccugaagacuugucagucuuugaaugaauuuagggaagucagcagagugaucuguuuuaauuuuugauggucacuggucacuguggcagcaaguauggagagggaaugagggguaauguuacguuugcaggaacucaaguccgagcacuuggauccugguaaugagaagaugguggacuagucaauccacaggggcuaggauggggccuggugucugaguagagauggaugagagugacgccugggccacucaaggcaucucuacaauuuucuucagucucugauguuccagagaucugguucuuacagucuuuucuaugcaucauucauuuuaaggauuuuaauuaggucaggaccagugaaguuuugcuuuccuccucucccuuuuuucuucugucccuugaugaacaaagcuuggaguugucagucgagauuuuaaucccguaauagaauucuucuaaauuguuacuuucauuugcuggcugaugcuuuaguucuaaaggagaguacagagcugagauuuaacuuuauuaaugucaaguucuuacugaucaaguuuuuguuuuuguuuuuaaauuuccaauaguuuaaaucauuuucuuuauguugaauccuuugacuuuuaucuuuauugguuugaaucuuagagauguuuuauauaaaauucgagacaggcaaauauaaggauagcuuagcagccugggacuggacuugguucaggcugggcucauacuccuuuccuaagaaugcaccuagaaaccuacgacucuuaccugcuuugaacugcauguuuaucccacuucaccuacagcaguagaguaaauucucuaacauccuucuugugguuaauuucuaguaaacauauuuugggauuuguccagguacaggaggcaguaggcccauccugucuaccuagcuuuggauguaugaguggucagacaguguccucuuaguaaauagggaaaaaacaaacaaaccaacccuauuuaccuacuguagcuuuaauuuuuucgaagccuacuuuuuuuuugagauuuuuaaaaaauuuucuucauuuacauuucaaaugcuauccugaaaguucccuauauccucccccgcccugcuccccuacccacucacucccacuucuuggcccugguguuccucuguacggggcauauaaaguuugcaauaccaaggggccucucuucccagugauggccgacuaggccaucuucugcuacauaugcagcuagagacaugagcucuggggguacugauuaguucauauuguugguccaccuauaggauugcagaccccuuuagcucuuggguacuuucucuagcuccuacauugggggcccuguguuccguccuauagaugacugugagcauccacuucuguauuugccaggcacuggcaaagccucacaggagacagcuauaucaggguccuuucagcaaaaucuugcugguguauguaauagugucuguguuuaguggcugauuaugggauggauccuuugguggggcagucucuggauaguccauccuuucgucaaagccuacuuuuuuuuuuaaauuuuuuuuuauuagguauuuuccucguuuacauuuucaaugcuaucccaaaggucccccauauccacccccccccaauccccuacccacccacucccccuuuuuggcccugguguuccccuguacuggggcaucuaaaguuggcaaguccaaugggccucucuuugcagugauggccgacuaggccaucuuuugaucaaagccuacuuuuaaugauaguucuuaaacauuuuaacaacuuccccucuaauccaccacccaccagagguaguggaaaagaaagguuaggauauggggguaguggaccuguuuagaaaugggucuguggagcaaaucccaucugugaugugaggaaauuagcaguucaguucauaggucagcagagguaccuccguccacucccagacacuuuacugaugauacaucagcaguccgguaaaacccagaucagcagcagugaugugaccuagcaggaacagccaggccucagcugcaucagcacaaaucaagagggauuaagaccagcaggaacaucagaaguuccucgugccucucaaggaagugaaggucagagaagaugagacccaaggagcuagcuauguaaacuagccaagcccagccuccaucacugucuauugaguccuauuuauauaccuuccaaacgaguuuugccucaccaugagucucaccucagcacaagagucugagucuguaucagcugacaucacuccgcugauccgcccaaguuuguguaaucgucgagaggccuuucuauggaguccugauaaaaaagaagcucaacuaugcauguaggguggaccaauacauacgugucauuaguggagaaucuuuuaucaugugucuuuucacaugccugcuuuagcaaaauaauccugucauuuguguugcuucagugaacuguuuguuccuucaugaguccaccuuagcgaaacuucuuuucaccuuugcucgcuuaaggagacacuccuuccaguguuugucccagcaaaacaccaucugaccaaacaacuaauucccaaagaauccuuaaaucuccauuucuucaaccuaccuucuaucugagcauaauuggguaugcauagauuaaaaguagaugcaucacaggaagggacaggcauagcaaacaagguuuacauaauugaaaacagaacugcugauauuugcccuuagcaaccaacucauucuccuagaugccauaaacaagggucccagacaguagccagggaucuuaagugcucuagcucgagaagacacugcacacuugcaguguuaucugcgguuuaguuuuacuucucaauaguuuccuugccaguuugcuguuugucaguguuuugauuaagauguuucagguuuccaagaaccuggaaacaccuaguucagaugguaacugaccaagccagcucugucagucaauggucucaagggagggaaugaggauuaaaggaaaaagagacaauuagauaacauuuuaacuugaccccagcaagugcugaagcgaguuuuuuuuuuuuucagucugcuuuuauaccauuguagguauagaaugcaaguauaugcaaauacaugcaaagaauaggguuagcucuaggucaaagacuaaguagucaaugaacaaacaaacaagacauaaaggauuacuguauucagggacuuaacaagaagaucaagauacaaagaacacauuccucaguuguauccauuuuugacuucuuuguccuagcccaaugucagauucuuaccugagcccacucccuugucuuagcccaauguaaauguucuugccaauauucuugaaucagcuguaccaagaacucuccauaaguaacccugauaauauauuuauucuugaauucaguucuuagcuuagcuauauauagaauuauauauagaauacaguccuuacuacuauauuuuuguauucuaacuugugauuaguuucaguuuuuuuuuuuuuaaagauuuauuuauuuauuauauguaaguacauuguagcugucuucagacacuccagaagagggagucagaucucgauacggaugguugugagccaccaugugguugcugggauuugaacucuggaccuucggaagagcagucgggugcucuuacccacugagccaucucaccagccccuaguuucaguuuuuuuuuaaauaaaaaaaauauuuuuuugccaggcagugguggugcaugccuuuaaucccagcaguugggaggcagaggcaggcagauuucugaguucgaggccagccuggggucuacagagugaguuuuaggauagccagggcugcgcagagaaacccugucuugaaccgcucccuacacaccaaaaaaaaauuauucuuuacgccuaacaaaguucauuguuacucacagaaauaucgcuaauaagagaaaugagaggcauugcuagguucucacuguccacuguuucuaguguuugcuuucuucagucuucuuguucccaagcaauuugagacagucaagaaccgaucuucaacugacuucaguuuuuuuaggacaaguucuuuuuuuacauuuuuaaaaacauuuauguuagaugucugagucuuugccuacauuuauguauguguaccacaugcaugcuuagagcccucagagguuaggggauugugugggacuucugggauugcaaaugguugcgaaucgccauguugugcugagcauugacuuggguccucuauuagagcaacacaugcucuuaaccaguggguccaacacauuggaaacauguuagaguagccucucaggucgaaggugaaagguuaguugaugcacucacucugcuucugauugauguuuuguagaggccaggauguauaaaucuauauauggaguucauagaauccugugaaaacuagaaauacauacuuuuaaaaaaauuuuuauuagauauuuuuuuuuuuacauuuuaaaugcuauccccaaaguucccugugcccuccccugcccuguuccccaacccacccacucccgcuuucuggcccuggcguuccccuguacuggggcauauaaaguuugcaaaaccaaggggccucucuuaccagugauggccgacuaggccaucuucugauacauaugcagcuagagucaagagcuccgggguacugguuaguucauaauguuguuccuccgauaggguugcagaucccuucugcucuuggguacuuucccuagcuccuccauugggggcccuguguccauccaauagaugacugugaggaggaaauacauacuguauuuuguuaguugaauuguuaguauuuguuucucauaaaggaauaauuuauguaguaaaggaagacaaguccuuauaugacuguaagaauuagugcuuauugucugauuuuauaauucugaaauuaaacaauuagaaguuaaagaaauguuauaguagugauuguaguagucgaggggugaacaugaguuaguuaggaaucaugugcaugagugguaaugcuggccguagggcagaagggauaugcuuagugccauugaacuuuguacauauggaaaaggugguaccagccgugguggcucagugagcuugcugccaagcccgacgacuugagaguuccugggacucagguaguagagagagaacuaauuccauaauguuuccucugaacacauacaugcacacauucaugugugcucacacagcacacagcaaacaugugaguaaagaagaucguggcucgaugguacauuucaugucacuuaugaaauaaaauuguguuacuuagcacaguaaaaaaccccaguguugccaaugucuuucaaguagauuuuaugaugucucuuaguuaugcuuaauuuauaacuuuauaaaugucugugcauauuuauaauguuuaaacuugggauagccaaacauuuuggagguauggguucuccauuuguuguccuagguggucuguaacuugcuauuuagagcaggccagccugcucuaccuguuucugccucccacguaccaccucauccaacuuaaaacuuuaaaagucuuguuaauauaauauugacauauucuggggucagaacaggacguguguguuggguuugaguuccaaaucguaucuuaguucugaaacgugaugcauguucgcuaucuuaccucagagggacuuuagcuaaugagcuuguuagguucugagcuggacaguuugcacuucaccucaaacuuagaaauccgccugccucugccucccugggauuaaaggcgugugccaccacgcccggcuuguacuucgcauuuauuaauaagcaguuuuugaagucucuucauauugacaugaaaaagaugguuuguauuucauuuucuuggugcuuuuuacucuuuuauuauagugcaauuucucuuaaaggugacuuuguugaucuuuguuuccuaaucuuuuauauuuuuaaaauaguuucagcaaguucaggaacaaauggaagcagagauagcucauuugaagcaggaaaaugguauccugagagaugcugucaguaacacuacaaaccaacuggaaagcaaguacguauccagaugccucguucuccaccggaugacagauuguuuaccucuguccuaaggagguguuggguaguuacuggcuugagcuuugcuuccuccauuugccucgaaucuugaguuacuuuucaggaacaacuguuuuccuugugugagagcuggcucuucugaguagugcagacugccaagcccaugagcaucaggguugccagugaaguagcacacaugcacugaagcugcccuccuccagccuagcacugcuuagauuucauuauucucaggagcaccugccauacugauuuucaaacguauggucuugacccuccugaccucuaguaguucaugaucccagggguccagguggcucaugggggacuuagagacacugguagucuuucacaaauuaagcacuggcuauuauuugcaguaaugaaguaaaagcuuccucguuagaauugaaaauguucucucccuuuggauagcaggccaaguccaguuacaauggcauugguauuaggaggguguuguuuuugaaaagauuuauauuaugugucuugaguauuuugccugcaugucuguguaccacauauuugccugggaggccaggagaagcugucagaugcuuuagaacuagaaguaaggauggcuaugagucgcauguggauaauagggccaagcaugggccuuccacaaaagcaacacaugcucuaacugcugaaccuccucgcuagcguccguauuaggaacuuuucaggucaguucagugguagcaacaugucuguuccugcuuuugaguauuugcuuauccauuuuuucugacauuuuauagugauuguuuggauuuaagauuauuuuauuuuauauuacuaucguuuaugugccacaauauguguuuccuguuuuguucuguggaguauauauggaggacacagcagcucugggaguugggucucuccugccacugugaaauuuggguuggcucaaagguuuuugagcuugcauagcucuuacucucuuagucaaccuuucagcacuauagugguuuuuagaguuugccaucauuugaauuguuuaagaguacacccgggaucaauauuacuacuuagucauguucccuuacauuugccuguaagugggguuauuaguucagcauaauuaacacagaagauguugugcuugugaguucuuuauguguauaacaaugcaaaaccccuaaucuagucacuguuugcaggcaauccgcagagcuaaauaaacugcgccaagacugugggaggcuggugagugaacugaacgagaagacaggaaagcugcagcaagagggaguccagaagaagaaugcggagcaagcugcuacccagcucaaggugacccucccugccucuuuguaccauucuguaaaugugacgaugcccacuuccaugacauaguguguauauagguuugagaaaucuauugugaaguuuaauuagacccacauucuaaggacucugccuuuucaaaguuguguuuugaugaacauugauuguagggcuagguuugaagcuacagacugagauaagaaaaaugaagccaaaugauugacaaguaaggguugaauuauuuuauguguguguauguguguguuuuauauaugccuacacauguaaggaaaaaugauuuuagaaaccuuuagcauucaggaaccuuuagcauuacuuuuaucgucuauaacuuaagucagauagagccccucucagccuuggcacccccagcccccccaagggccccuccagggcuuucaccagagccuugguguacaaacccuugguguuuccagaccccggguggcagguguguggugaagcgaagcgcucaugcucucaugagacguggagcguucucaggcugccugaggaggagcagaaucacucccuuacguuacaugaacuugggaacuuagacguuuagggaugauggcuaccuguuccuccuccugaggagaggauuuucuaaaaauagauaguucaauuuauagaggguauaggcaaccugacuguuaaucccucauccacacugauagauaguauaccuugaggccaguuccacacaguuuuauaacuuguuuuuucuuuuucuuuuucaaauguuguucaguacuuugugaaagugaugucagugucuucccucuagcacugggguucccaggggauuuccugcugaccuggauagaggagugugauaagcggcaucacaguuaauuacccuaagaaguguuuuauaauauguauauuuuaaaauauguaaagucuuagguucuuacugagauuuagcaauagauucugucuuguuucuuaauagcuuaggaacuuaagaaugguuaaugaugaaaaauagcuucuagcucagugggucagauaaguuuguaggagcagcugucugucaugaucuaauguccgcagagcugauguccugggguguuggagaagaugguggguguggccgacagagaaauggcucuuuuuuacaguugaaucuuguugggguugauuuuuauuuuuuccccuuucucucucuuuuuuuuaaaggacuuugcauugcauuuuuuaaaacuuauuuauuauuauagcugucuucagauacaccagaagagggcaucagaucucauuauggguaguugugagccaccaugugguugcugggauuugaacucaggaccuucagaagagcagucagcacucuuaaccccugagccaucucuccaaucccucucucuuuuuuaauaucaagguucaacugcaagaagcugagaggcgcugggaagaaguucagagcuacaucaggaagaggacggcggagcaugaggcugcccagcaagguaaagagagcaccuaugcagacugggacacuuccacucugcugucgggggagaaagauuauuuggcaucuagcagacauauaaaaauagauuuuuguccuuucagauuaucuuauuucuucaacauuuguuagguguaaaauaaccucguggcuuugucugcagugauacugcaggagaauuagcaucuacugggcuguuaagaucagggagccgggcgugguggcgcacacuuuaaucccagcacucaggaggcagaagcagguggauuucugaguucaaggccagccuggucuacaaacugaguuccaggacagccugggcuauacagagaaacccugucucgaaaaaccaaaaaaaaaaaaaaaaaaaagaccagggccguggcccuguuucccuguggcuugccuuuggucuuggugguacuuguagccuucugaagagacaguugcuuccuuggauccgccugccuuuacagacaugaacguugccugcucauuugacugggacauucacugugcugcuuucaccucugcuguucccuucugucucaggguuucucuugauguggcagacaccaugaccaaaguccaucuggccaggaaacgauugagccaucuuagagcuuguaguccaucaugaugagaagucagagcaggaacgcaaggaaggagucuggaggcaggaaccgaagcagagaccaugaaggaagcugccuagcucccuagcucggucugcauacuuagggcacugcccuggacccucccacauaaaccaccagucacgaaaaugccccaccagugugucuacaggccagucaucuggagacagcuacuugguuaaaauuucuuuuucuuagaugacccaaccuugggucaaauugacauaaacacuagccagaaugucuuucuaaacuugacuauggcuccauguaggauaaaucagaguuugacuuguuagcucuuugguuuccucugauuagcccuuuugucaacaacaaaauaagcucaggguacuuuaagacuucugcuuuuaugcaaagacguuauuuaugcuaagauacuuuaacuuauuuaaauguguaguguuuuauauguuaugagugaaaggcaggggucuugcuagaaagcucucaguauaaacccaguaguuauagagaguaaagcggcaaucuuuucucuguucuuuuaggcuuauuucuuucaucuuaugcaugugaguguuuuguaugcaugccuguauguccauugugcaugugugccuggugccucaagaggucaggagaagguauggaaccccugggacugcaguuacagaugguugugagcauccaugugggugcugggaagcaagccugggucuugcagugcucugacugcuaagccaccucuccagccuccagcccugcuccuucgccuuuacucuuaguggcuuaccccagacugugcucucgcugaccaugucuucuuagaccucagcaguuuacucuauauuucuaaacagacugaauucugguucuuaaaaaagugaggcgcuauguuuuguuuuguuuuguuuuuguuuuguuuuguuuugguuugguuugguuuuggcaguuucucugcauagcccgguaucucacuauggagacugaguggguguugaauucacagcgauacacuugccucugccuucuguguagugggauuaaaggcaugagccaccauccagcugaagugaaucuucuuaaaaaauaaacuuuauuauauuaaaagccaagcuuguaaaccauccagacccaauuuuauaaucucagcgaccuauacgguuagaguagccaauccaaagucauggcgcuuaacauggccucuuacucguucaccgaaauauauuuuuauguauuaguugccaccaaaaaaugggaaauccaugacggaguuuuaacuagaaaagcagcuagucuuuucauaacucaugucuaucgcuggcauuugguccucccucucgcccacgcccuagugguuagcuucuguucuuuuccuuauguuacguuguguccaccuaccuguacguuuguuuacauauaugcauguggcuagagucuguguaagagaauaguacuguuaaacauuucuuaauccacuucucaacaucuucaaugcuagacuuuccucauggccccucccggaggugucgucuucgugcuuguucuaaugcucuaaugcuuguuacuuccuguguccuucgacucucuuccucucugccacucugucugcucuuugucaugccucauucuccuacacuggauaaagcuuuguucuuuuccaccagcugcauaugaguauucauaugaguaugagaaguguguuuguggaggccuuauguaaucuaaaaauguuuuuaucauguaagauugguucaucuggagauugagcuauaagucagcaaugauuucaucuaaagaauuuugacaucauggacuuaauggguuuuuuguuuguuugcuuguuuuuuuaaagauuuauuuauuuauuauguguaaguacacuguagcugucuucagacagcuccagaagaggacaucagaucccauuacagaugguugugagccaccaugugguugcugggauuugaacucaggaccuuuggaagagcagucagugcucuuaacugcugagccaucucaccagccccgaacuuaauguuuuaauuguaacuguugguaauagauauuucccuucugugaguucuaaucccagauauguccauuauuacaugcuugguuuucagcaguucuuccugaguuauauugucuuauaaaugugagaacuuaaccuuucuuaagauaaggacauacuaagacacaugcgcagcuacuuuuuuccgucugugguaauggcuucccucugaacugugacuuguucuugguaugggacagggugaugauucucgugcugccaguggugugcugucauuagucuuuugauuuagguuuuccuuucucuuuucaaccaaauuaaugauugucuuuaaauucacguugucuucauuuauugcaauuuugagcuuauauauauacacuuuuucuuauuuacuuauuuauuuuuguguguguaggggguguuaccuguaggaaggaagaaaggaaacaaguuauccuucauuucaaauuauuuaaauaauauuuuaaaugucagcuuugagauaauagauuuccuuggcaucucucuguauaggagaguucaaggaauuuucaucaaaguuguuaacauauuauuaagguaucuuuugggaaauaaagagugcuuucaagaaaugguagaaacauuuaaaaaccuuuauaucucauuuaguuaaugcuuauugaguaugcaguauugugcuaagucuugggcacagcucuggauauagagagacaacgcagacucugauccagaagaacucacucuuauggcaagaggaauuagacaggugguuggcauugcacagagagcgugagccgcugagacuguagaaggagacaguggaucugcgcaaguguuccagagagggcaacgcguacacugaggaacgaucgaggcgaagaggagacauuuuguaagauguaguuuuuuuguuuacuccagauuuacaaaguaaauuuguggccaaagaaaaugaaguccagagucuacauaguaagcucacagacaccuugguaucaaaacagcaauuggagcaaagacuaaugcaguugauggaauccgagcaaaagagggcgagcaaagaagagucucugcagauccaagugcagguaucuguuugucuuuauguguuuacaugugcuacaguaauaauuaaaaauaacgaauuugagagggagggagaggagccaucggggagguugaguggaaaugauuuaauuauaauuuaauuaaaaaauuacaaguaaaaaaaaauucaaaaccuaugucuguaacuacauuaaguuaaguucaauaaacuuccgguucaguguucaaaucauuaagaaaaagaaauuaggauaaguguggaaugugcggauucauucucucucucucucucucuccccccucucucccccucuccccaccucucccucucucucccccucucucccccucccccucucaaguuuauuuauuuuauguauaugaguacacugucgcugucuucagacacaccagaaaagggcauagaucccauuacagaugguugugagccaccaugugguugcagggacuugaacucaggaccuuuggaaaagcaaucagugcucuuaacuacugagccaucucuccagcccauauguccuaauuuuuaauggugguaaauaauuaacauuuaaucuuugagcauguuaaagaugagcucauccacuuccuuaggacuucuugugauaggaucaacgacaguaaaccagccuugaugucugccuuguaaaugaacucaaaauagaaugccaaaacgcuuuaaauaaagaucauuuagagauaucaagaauauguaaaucuuuguguucauguauacuugaguauuuuuuaaugacaccuuuguccucucuuuuuguuugcuguugaugaaaggauauuuuggaacaaaacgaggcuuugaaagcucagauucaacaauuccauucccagauagcagcucagguaauggugcuuuuuaauugauuaccguuaaucauagcuuuccagccguuguaacaguuaucugaccguuucuauagugccaaacuucaguaguugggagacuagucaaugagucaguuuguagugguacaaaguuucagccacuaaauaugauaucuaauauugggcagcacugagaaccccaaaucuguguuauuagaagggguaggcgagaacacucacuccuggggaaggcucugaacucugucacaaaacaaaagggcuggccaguguaagggcaggcuagggcuuauggggugguugaugcacugucacggaaagcugacuuugcucaggaaucccacacaugcacagcggggagcuggcuuauuugcagaaggcucaguuugaaauguauaauuccguuuaguuaguagcaaacauugauaccauugcugcuuuccuugauugauugacugauugauugauugauuaauugauugauaggcuuuguaauauaaaugauaggacauucagaaaaaugugaaggcuuccacaaauacauauacuauaaauuucaauuucaguugaauguuaaaauuauaaaaauuauuuauagcagcaaguacuagaaauuugacucuuggacuacggagauggcucagcaguuacauguaugugcuugcugcugguucagaggaccagaguuuaguucccagcaccugugccaggugauucacaacugccucaacaucaacuccagggacucuaauggccuccucugucacugcacucaugucaugugcacaugucccccauugcuuacacauauuccaaauaaaaacaaaucuuuaaaaaaaaaaauucgcuuuuacauaauaaguaauuuuaacauuaaaagguaauuuuagaguucaaacuuccaaagcuuugugcacauaaaugguuuuuccuaguugcuuuuuuguagagaugauacuguaaaauuagcugggggagaaccaucuaaucagcaaaauggagcuguauguuugugaguuaccaacuccacuuagauugggaucuuugucagcugagcgguaguguuccagcuugucagaaugccugagugugcugagaaccucaguaguggagagacaucacugacaggcuccucacugucugaucaugaaggggauccugucagacacuuuugcugaggaagagacgcacagggcuagggauggccucugugguugucucugccccuuauguacuugcugcuugucauuauuccgugauguguuguguuaauuccuuaauaguggcuguuggagaucagauaugcuuucagaaugauagcuacucaccauagaccagauaugucuuuaacaacuuuauauguuaauuucucucucuuuuuaaaagcucuguuuugauuauuguacagcuuuuaagcuuuuucucaaaugcucuuauguugauaauguuuuucuuucucagaccuccgcuucaguucuagcagaagaauuacauaaaguguaagcuugccauuccacacuucucuuauaauugauaaccacuaacagaugccugcuugauucaauacacaauuaauuucauucucuuaccuguuuggaaaauuacccuaaacucuauuuugaucuucucuucuaaccugugucuguuuaguccccaaacauuacacuuuguuuuuguuguuguuauaauagagcugccuaacuuuccuucauuugcaauauugguaacgauguagaagaggcacuugugguuucagaguagugaaaggaaauuagugcuuaaauuugcuuuguacuugugguucugcugugucuagcccugugacaguaggccauacacucaaaguaaauuugcauaguuacauaacuauacagauauggggcaguugugugcagaugaccuauaaucugguuuugauaccagacuuuucaauguaaguuaacuucuuugacuuaaguuuuaaauaauggaucuguuugucuauccaucuguguaucuaugauuuggggccucauucuguagccuagacuguccuugaauuuguggugaucuuccugccuuugccuccugaguacuggugugaaugaccauccugccauaaaauaggggauauuuggggguagagaaaggcucucauugucaagccugauugauguaaauacuauacccuggucucacaugcuggaaggagggagcaaacuuuugcaaguucguucucucucucucucucucucucucucucucucucucucucucucucucucucucucucucugucaucaugcuuuaugaugcuuacuaguagacuaaauaguaucucaagaaagagaaaguacaguuauaggagaaacuuacuuacuugagaugauccuuuccguguaagacuuuuaaauccuguuuguaaaugcuuuuguauuuucuugaaggauugcagaaaaggacaagcagcuaaagcagacugaagauucauuagcgaaugaacaggaucacuuagcaagcaaggaggaggagcuuaagguacaguagcucauauagcuugcuguaggauuuuauaggacucaaagcugaauuacccuaaagauuauagccaguaugcauuuguaugaaggaugaaaaauacucuagaacucauggaaaaugcuuucucuuuucugaacuguaaagaaggauacuucuuaagcucuaaaaggaaaagcccagaaggguucuuuucacauaaugccuuccauaacaauuccagaaacuugccaaauaacacaaaugaaugauauauauaugauuuaggcaauuuauaaucugagaccuuuacuuaacucuuaagcagaaccuugccacaaguucaguuugaauuauaugaaauauuuuaauccuguauccuuuuuuuuuucuugcucuaggauguacagaauaugaauuucuuauuaaaagcugaagugcagaaauugcaggcccuggcuaaugagcagguaaauaagucacuuuuccuuuugcuuauuuaucugaagacguuugaugugucuuuuuuuugagucugugagccucgguuuucugugucuaugcugguuacuuauguuuggccgugggauauuacugagagcuaaugcacagacugcuuagaugucauugauucauauuggaauuaauguuugguacagugacugaaccacuucugagauagaagagauuguuaaaacagucgcagcauuuuaacccauuuggauuuuuccaucuaauguguaaagggaaaaccuuaauuagagaaaauuggccuccaagaaguuaaaaauaauggacaauaaaacagagaauaccgccagugugguggcgcacgccuuugaucccagcacucgggaggcagaggcagaggcagaggcaggcggauuucugaguucgaggccagccuggucuacaaagugaguuccaggacauccagggcuacacagagaaacccugucucgaaaaaccaaaaaaaaaaaaaaaaaaaaccaaacaaaaaaaaccccaaaacauagaauauauaguuuguuauaguuuuaauccauauguauggaaauacaaguuuuuauaugaauaaaugaauaguuuagaugguuuccuaagaugauaagauucuuauuuuauucugaauacaggcugcuaccgcacaugagguggagaagaugcagaagaggcgaguaauguauuuugugcagagacuccugcauguguguuuaugugcagugauucuuccagcugaggcuugugcagacagcccugaaaaccuugacugucucuucuucucguaguauucacguaaaggaagauaaaauaagacugcuugaggagcagcugcagcacgaaguugccagcaaaauggaagaauugaaggugugugagcuccgccuuuccagacagcuucauaaaaguuuaauuucaauggcacugaaugugcuuuaaaaaaacaaucauuuguauuauuucccuaguuuauuuggugucuuaugugaagagugaauuuuuacuagacuuuuugccuaaauguacuuuaucugaucuuaaauuaaauguuugaaauagauuuuuccccaagcaucccuuggcauuuuuauuuuugaaaguaaauucuuuuuuuuuucuaagauuaauuuauuuauuauauuuaguacacuguagcugucuucagacaauccagaagagagggagccagaucccauuacagaugguugugagccaccaugugguugcugggauuugaacucaggaacuuuggaagagcagucgggugcucuuaccuacugagcagccaccguuggcauuuuuuaaaugaguauuuuacauuugugaauauuuuugcugucuuuacuguugcugccauguuaauccuuguccauugagcucugaauuucuaugucuguauggaacccuucagucucuuaugaacaccugaagcaacaguguggguuugcuucauucaaaaaucgagucaaugauugcauuauuaccugcuccuucugaaaaagucguacauugggcuucuuucuuccagauucugagugagcagaauaaagcauuacagucggaaguucagaaacugcagaccgcuguuucucagcaggugagcuuguguggguaguguggaaagagcccgagggugagaaggucugagcacaaaccagcugauggagagugugcucaaaguuaggugcgccuuucaacuacccuguucauuuuaugcuucaaacauuucuuucaaaauuaaaguuuuaugucucugagaagaagaaguuguuaaucuucucauaagcauuuuguagaaaagaaggaaaggaaaaaacguucuguucugggagccuuacccuuacaggcaguuuguuguuuuucuaaaacaaagaauggguuugaaacuuagggguggggugccucagaguugguuucccacucuccuaaucagccucucacaccaggauuguauguaaggauuucuagauuugaauggcaaaacuugaauauauugcuuagucuagagcuuugcacaccuaaaugauuucuuaagaauauauguguauauucuaauuguauguauuuaugauauugauaguacauaugcgauaaugaagacacacacacacacacacacacacacacacacacacaccccuuuguaagucaguaaagcuauugcagucuugaauggucagcagcuggagcuccuguuguugccuucacguuuucucacauaagcccuuccagucccacuguuagaaaguguucugaaguuguuucccaccaauccugagugugauuucuggggacuacauaauggaaggggaggaccgccucccacaccugcuuucuggcauccacauccacgugcccaaucacaaucacaaucacacacgcucugucaaugagcaagcagaucaauguaagaggguuuagagcagaguagucgagaaacucuuguuguugcauguuccauuagaauaucaacuuugcauguuucccucauagucagguuuuggaaaauuuauuggaaaugauagcacauccuuuagagauacuuucauucuuuauuuuaaaauucacaauuaagcaaguauauuauugguguaagcagcuguugcuugaaguauuuguuaacaucaguuuaucaauuuacaucuuccuucccuucugugaaaugcaaugccauguggaauuuuuauuacuuuguauauguguaaaguaaaaguauaaauauucucauuugugguauuauagauuaugagugauuaaguacucgagaaauuacuggauccaagcccaaaugaccaucuuugaaacuuggcugucuguucuaguuuucagcuauaguuuugcuggcagcauuuuuauuuaauuauuuuuuaagauuuauuuauuuauuuuaugagugcacuguugcugucuuuagacacaccagaagguggcaucagauccuauuacagaugguugugagccaccaugugguuucagggaauuaaacucaggaccccuguaagggcauucagugcucuuaaccacugagccauuucuccagccccaaaauuugaaucuuuaagaccuccuuuuaacuuacagggucuucaaauaaaacacaaaugaggaaaugaaaacaaaauaccuuugcuuauauuugucaaauauauucaacauuuuaacaaaauauuugucaauagaaaaaaacguaaacaauaacuuuauaaacuucuguuuucugccaaacugaaguuuucuaaccuuauguaacuauuaaaucaccaggcuaauauuuuccuaauagauccuaugaugcuuucaaauaugcuuuucuguuauuuuauguaagauuuccaaucacacuuguggaaauaauuauuuuugaaaaaauucuuuuuugucuuuuuuuguuacucaucuuucuauuugauauucuauacacuuuagauguucuguuaaaugacaucugguaguauggcauagacuuuucuuauguucugaauaaauuuuuguagucacaauuuucuauuuaaaaagaaucaaggagaugggaaagugauguuuguggggcuaauuuuggucugcuauuggguaauuguccucuaguuuuggaagaacaaugaaauaaaaggcacauaugaaugguuuagauagguucgagacaugcccgagacccuuugucauggcaaaucaaaaaaacuuugucuuucuuuugauuguucuuauaaauuuaucauuauauagauauuuuggggugugugaguucagaggacagccugcgaugugguuuaggaguugguucuccacgguggguucuagaggcuucaacucugaucaucaggcauagcaacaggcaccucuacuuccugagccaucuugccagccuugcuugcuggcuuguucucuagucccccuuuuuuuucugagacaggguuucucuguguagcccuggcuguccuggaacucacuuuguaguccaggcuggccucgaacucagaaauucgucugccucugucucccaagugcugggauuaaaggcgcgugccaccacugccuggcucuagucaccuuuuauuguuauuguuagugaaauaagagauaaaagucaguauaccuaaguuucuuuucauuuccaacuuucuuuaaccuccuuuuuccuauaaagcaguuagaauuccaaaugacaguuaagagaacagguuuggggcuggugagauggcucaguggguaagagcacccgacugcuuuuccaaagguccagaguucaaaucccagcaaccacaugguggcucacaaccaucuguaacaagaucugaugcccucuucuggagugucugaagacagcuacaguguacuuacauauaauaauaaauaaaaaucuuuaaaaaaaaaaaaaaaaaaaaaaaaaaaaaagagaacagguuugugauguaaaaauuucaggucucuugccagauguuuuuguuuucuuuuuuuauacuacauuuuauccccuucccacccaccccccacauccccuacuuccuccccacccccaaccagaugguuuuauuaaggagggaaagguugaacuuacugaagcaggaacuggcaaugcugccaugucgguguuucuuuagcuguagcaagaaucgucaggugugaggcuguccuuccacacagggaggaugacugugugcucuuaguaggacuaguaagccuuugcuuaucagcagaaaccuccucuggcuggacuggcuggcuagaagcugagcagcagccuuuauuuuugcuccaguagacuuuuaagagucuaucauugggguuacucaguaaaaaccaugggaaauugcuucucugccuaacaccgcuuucugauccuacugacuuaggaagauuuagguuuaucauccugacagaagucauaggauuguauuagguugguaacuuguaguaaagugaaaacguuggccaguauuugaguugaagaaccagaguaaacacuaaacaugaagaccagcaaggggaauugaguuugaguguuuguugaguauacauuaggcauuuacuucuuagcugaggcucuggaggugaguaagacuugauucuaugugggauagauuaguaaagugugaugauuuaaauuccugaacuauguauauguuuacauuuagauuuuguuuaaagaguagaaaggugacacaggggacaacuuacccaucaauuugcuaaauagugaggggcaguccaggcugagagaaaaacuugaguagcuuggcgugguguugcacagaauugacguacauugagaacauucuaagcuauuguuuaagugcaaagacaggguguagggccagugaaagaucuccuagggucucacuaggaggcuuuguuuguuguauagagccugugauggucuaacugugaggagcauuguaaggaugcacaaaagucacaguggcgacugggagucaguggaauuuaggaguuagagaagcagguaggaucgaguggaaagcuuagggcagcugaguaguuaugguuccaguaagcuggacucgagagugucucuugugggaugggauucacugaagcacauauggauuaaaaacugucuucaugagaguuuugaguuuauaaacagcaacuuccauaugaguuguuaguauacuaccagauugacgaaauacauuuugggaauguuuuucucuccuuuuuuaugauggggcaguuuuccucaucgggucacucuuccugugcaauucacaaagcaguccuuauggucuacagacacaggauuuaaggcauugccaucuuugagaugcguaaagcugaggaccggaauguaugcgugacgagaagaacuaauucugacauauagaggagguggaauccuaagacucagacuuaguaauggaagcauuaguuuuauuuuugaaaaaugauuacaaugagauaagguaaaaaaaaaaaucagaaaauagcaggaauaggaaauugguuuaugagguguugccagaagacuccacaccuaaggguacugaauugucuaagggucugagaaugcuggggugaaaccuuugcuuccagcuacacagcaacccugguggcucuuguguguggguagauuuuaggaccaaaggccaagggcauggggucaguuuuuacaucguguuuuccaugcuucaccaggagcuguauucgugagcugcugcagugcacucgcacuuuaguacagucucugcuuuggucugguagcauuuucaugugucuacauguucaaaauccauugacuauaaacaagauauaugcaauuguguuuauuuuagacuucaguguaggagaaacucaguugaaaaaaggguaaggccucuugugaccuccuaccuuaaaaguugugaaauuuguauauuugaagaaauguuuccugucuucuagguaacuccagauauccuuaaguuaagaauuggggugagggcaaguccaguuagcuagugccauuuuccucuuguagccuguauguccauguucuuuuuuuuucucucuuuugaauaagaaaauuaaacuugugagcaguucucaaguaaggacuaaauuuuggaacuauuuagaauccuaaacuaagcuaauuuuuaucuuaugcaaacuugguagaauuaaacacuucuugauguuuuuguuuuuuagccuaauaaagauguuguggaacaaauggaaaaaugguaagaguuuaauuuuuuauauuuuggugaaacauauuugacauuuucauauuuucucucaaauuugugguaacagaauugguagcgauaguaaucuggauucuuaaaguacuauuggcacuuugugauagacaagagcauucugcacuguggaucagccggaguuaccuuaugguaugguuuuggcugucauuugucacugacugacuugcugaggcugcugucaguccguacauuaccugugcaaauuuuccuuacugcugaggaguucaccuuaacgccaugagagauuuuucuagaauuacaguuucauaaugaaugagggacagagaggguaguccauguaaaauucuuaggagugauauuuaccuugaccaagccauucauauauaugccuuauauuuauaaucacagcauucaagaaaaagaugagaaguuaaggacuguggaagaauuacuggagacuggacucauucagguggccaccagagaggaggagcugaguguaaggcguugucuccaucguccccuugugcucacucugccagucuggaaaggcuuggugcgauuguguccacagcugggcaccagugcucuaaguuagacuguuuucauuugauuuaaauucuauuucuuuggaaauuggcccugcgaugaggaugauucuagugucaggcgucagucaguuagauaccaucgcugcaguguguaguauggcuguuccuccuggaaccauguccaaacugugagcagugauccucaccgcucucccuuaccaaaguagcgcggacuucugcaaaaguaaguaagaguuguaauugacaggugacaagggugucuuucagggugucagcauuucaauuacaguguauauagugauaacugaguuacaaaaugguugucuaauuauaaagacuauagggaaaagggcagaggaggaagagcgggcuugcuuaauuugaucuagcuagugcuucaagaauaaaaaaguguguuaugcuucuauauuuuugaaaaaaggccauaagaacagagaacuccacccugaccagagaaguucaagaguugaaggcuaagcagagcgaucagguagcguauuguugcuccuacacgcuucuucucacaguaggcagaaggcacccaagucauucuuuuuuaucaaggcugaauuuucaauuaaacuuuuaaucaaugaaugauuacugacuugaguagcugcaauuuauucaaaacuauuugcaugcuggguaggcauucugugaacaacuccaaauaaaauuucauucuuuuuguuuuucuuuaucuacuuaaauuauuuauauuuuauguguaugaguguuugccugcauguaugccugugcaucauauauacauacaguaccuacagaggccagaagaggccaucaaguuccuuggcucuggaguuugaagaugguugugaguugcuaugugggugcuggguacugaaccugggugcucugaaagaguagcaagugcuuucaacuauugagccaucucuucagcccaauuuauuuauuuuuuauuuaugggaguacacuucagcugucuuuagacccacacuggaugagugcauuauaucccauuacaggugguugugaaccaccaugugguagcuggaauuugaacuuaggaccucuggaagagcagucggugcucuuacccucuaagccaucuuuccagcccagcaguauacucucuuuauguauguauguuuauguacauuaguguuuugccuuaauauauguuagugugagggugucaguccccuggaacugaaguuguagacaguugugagcuaccuugaaccuggguccuuuggaagaacagccaccaagccaucucuccagccccaagcuaaggcaucccugagugggcacgaaccagucuuuuauuuuaaguuguaaaaguuuuuauuguuguugcuguguguaggauguaugaagguacacauauuucauggaucguucuguagaugucacaggacaacuuaggagugccucugccuucuacuuccacacugauguaggauugaacucagucaggucaucaggcuugcauaacaucuugcuggccauuuucuuuuuuaauaauacagugaugaaagguuucgacuacacguacaaauugagucucgauggcaaaaaaggcuacgugaaaugaagcaauuucuuagauguaauuucuccccugguuagaaugaaugauuaaguaacuugagcauuugucuaaugauuauucuuuuagacuuguacuuauagguagucucauuugcuuacuuucaaaaugcugucccuuuucaccauuaugacauuacgaacaucuagaaagaauuucuggguguacuuuuucauuuuugauuuuuauuuuaacaaauucagggauuauguauuucuauuucugucucauucaauuuuaagaaguacuaaguaaugcaucuuuuuuuguguuucuagguuucuuuugugucucuaauugaagaucuuaagagaguguaagugauaacauuguuacaaauuaagguuuuguuuugacuuguuuuguuaauacaauuagauggaguuuaccauuuauuugggagaguugguauacauuacacaucuaucuaucuaucuaucuaucuaucuaucuaucuaucuaucuaucuaucuaucuaucuaucuaucuaucuaucuaccuaccuaccuaccuaccuaccuaccuaccuaccuaccuaccuaccuaccuaccuaccuaccuaaccuauaguuggcacacauuacuucccccuauuuccuccugcucgcugcuucucucccucccauucuuucuaauucagucuggccagggcuuuccugaguacccgagacugauugacaucuuaccuccugacacuccauccugcccuuccugaaugcugagauauuagcguauaccacacuuggauuaguuggacuuucauucuagaauauuucaucaguggacuaagggagauuagcuaugcuucccaaauucaaaggcuuuuaucuuuaacuuuuuaaaaauccauuuucauaauugauucuauuuuuaugugacaucaaauuguuaacuuuaugaguuuagaagaagguauuagagaugacuuuauguugcacagagauaaguuucaugcaugucuguccccuuuugaaguaccugucauccuugaugacauauuguguaauaaacuuaaaauucuguaguucaauguuauugaauggaacucaauuccuccugguguuaguauucuucaugguucaaacaguagauuuuucuguguauuuuugaaacacaccaccggcuucuuguaugcauagauuuuaguaguugcugauuaaauucuuauugaaaaggagcuuuaguauuucucugcuuuugucugugaaguugaguuacugucacacuuuaaaugcaagauggcuuggagaaccuucucauguggugcugucuuuaugcuuaguuggugaaugucccugauuucuagucagguuaauacuugauuuguuuauuuaaggauccaugagaaagauggacagaucaagucuguggaagagcuucuagaaguugaacuucucaaaguugcaaauaaggagaaaacuguccagguauaggagagagaacagugucuggccuuccuguuuaucaacuugaguuaaaccauuugauuucauguguuuguauguuacauucuuugucaacucaguguguuuuccauuguccaaucuugucuguuuuaucauugucaaggcuuugaaacaggaaauagagguucuaaaagaagaaauaggaaaugcccagcuugaaaaggcucaccagguaaagcucccagagccaaagcgugacagaacuagugcauaugguauuugugagcuacuugaaaauuuuuguuucccuuguuauuuagaaaauaauucuuuaguaguuugguacaaguauauuuguuuauauuuguuuuucaaccuuuuauuaaguaagcccuuuucuggaaaaaguuuucuauauuaaugcuuuauuuuagucaguuuaaaaaugcaaaaugcaacacaaacugcauggauaagaauguguuguuaaagaguguauucauccucugacuguagaaaaaaaaaguuucgcuggagaucuuagaaguagacguuuccuauuagguagguggguuugaugagauuuaaucugaaaagucuucauuaaaaggcuagauuuagauuguacaggagagaugauuuguucaucuauuggauuaagaugacagcagcucaucaaagcccuguccaguguuggagugagugugcuuagugacugauacuucagaagaggcuccucccaagagcugccaugggacacaggcugagaggaagcgggaucaaugcuagauugccucugacuuccuaagggcugaggagauggcucagcagggaaagugcucacuguguagcuugagggcuggaguccagauauccagcuccuguguaaagggccaggguggaagcacguagcuggacccugagcagggagguagaagcaggaugcucuuagggccucacuggccagccagguuaacgagaucagagagagagcuucagguucagugggagacuuugucccacaacaucaggugaggaacaguagaagagucuagaaucccagugauggccucuggccuugcacauuuaugcacacaugcacacacacacauuuaagacauacaaaaccacaaguaaauauguauaugaacaggaaguuaagacacuagaccacuguggagcagguguucgugaagacugcacuagaacauucugauacuguauggagguguguggggaguuacugaaugaaggcuccuguucucuccuguagagauuccuuccaccugaugcaggccauuuauagucaucugcccuaccuugaccccuccuuguuacuuuuacugucacuggaaaagaggaggugaaaugcaagcacaucuuguuuuggcauaagaguuagcuugggcuuucaucuuuugaaauguacacaugauaaagauuuaccugaggcucaaucggcuuaggaaagccugugaacugcuuucucuguccuuuauguuucagcugucugucacuucucaaguccaggagcugcagaacuuguaaguagccuuugucuauuuuccuagaaauagcucuucccuacaaguuaaagugagugaaaauuauggcuuuuuuacauuugauuucaguguucuggaaaauacauuucaaaagauuuuagguuuuuaaaaagucccuuugguucucauauuuuaacaacugcuagguuuuguuuuuuuguuuuuguuuuuguuuuuguuuuuguuuuuguuuuuuuguguguggacaggagauagugugagaacgcucauucuuuugauuuauuucuuaguauaccuuaauuggagauguugcuucuugcuuauguaaaaccugcucugcauuugacaccuaagacaugugcauuuacugaugcugcugccuaggugggcugacaugggguaaggguagaacugcgcuaaucaauccacugucuguccagugauggguaacuuucuuuaauuggugucucaaaucucauauuccuuauauugaaaugguuuguagaaauacuuauuuguacaauagucaaauggacuuggacuauaagaacacuugagauauuuuacaaucuucaguacuuuugcuuuuuauaaugauguaaaauuuuucuuucucucuugucagauuaagaggcaaggaagagcaggugaacagcaugaaggcugccuuagaagacagggacagagaccugagagggagagggacgugcgcacaggugagacgcucagucagaacacaagcgaaagcaacccucgccccgauagcugaggauccguucacaucugcucuuuuuaaggauagucaggaagaaaauuaaucuuuaaaggcuuguguucaggagguagcacagccuaguaugccagagguacaguaugcacggacagcagugugcuucuuacgaaguugccguucuguguaauacucuaggagguaagaagguauauguucucgguuucucuguucugccauaguuuaguuauugcuguuaaaguaaguagacuuuuauuacugucaaaccaucuuuaauggccagauuugucaagcuaauaguguacacauuucuuuuuccuuccuuuaucaaauucacuccaggcuuaugcuuagcuguuuauuugcuauaguaaccugugguccuuuagaaagacgcuuuaauaguuagcuaugauaaggaaaauucauucacuacaggugauggcucauaucugugacuuccucuuuuggaaugcugaaguaaaagggucacugugggcuugaggccugccugggcuacacaaugaacuccugauucaaaaaacuaggcaaaggaaaauggaaagcauugcauuuuuaaguaaauaaccuaaucuuaaauuugccacauaacuauauuuuuauuuuaugguugggugguucugcauguauauuguaauacguggucuguuuugauguuaacauuaaaaaggugaaucuguuucuuagguguguucgacaccacaauuugaagaacuugaaaguguguaaguauguuuuuagcuaacaucuugaugaaguguaccagaaugugcuuaaaauuaauuuuuauggauuucuaaaaggccauugauuuuaugguuaaguacuaguuauagucaagagacgagagacguuucuuauuguuguaugauaacgcaggggccccuucagugcuuuagaauguguaaagacuugcccauuuccccaguauuuucugcaaauacagacuuuuuuucaaauuauacaauuauuauaaagagaaaauuaauagacuuccauauagucagggucaaucacagccaugacaaauccugcacauaucauaaucauacuugcuuauaggaaacagggaucuugucacgucaguucugugcugaguaauacaaaugucaccacuaguuagcaucauacagaucugcuuucucaggcauucauacuacaacacuguuuuuaauccugcaaaaguuauuuuuuuaaacagagucucauuuuguugcccaggcugguagauuggccucacacugacccugaaccuauaccuccuccuuccaacuacuggaguacagguauaagccaccaugaucagugucuuaguuagaguuucuguugcugagaaaagauaccaugaucaaggcagcucuuacaagagaagacauuuaacuggggcuggcuuacagguuuggagguucaguccauugaccuuacuggcaggaagcguggcagugugcaggcagacauggcgcuggagaagggguugggaguucuacaucuugaucugaaggccucuaggagaggucugucuguuuccaggcauccaggaggaggaacucaaagcccacccccaaagugacacacccacuccaacaaggccacaccuccucauagugugacuucuugggccaaguauauucaaaccaucacagucagcaaacagugauuuuucuuaaacuacacaaaguaaagauggaaaaguuuuuugagaauuaacuuuaaacacauuuuuuuuguauaugugcgugugaguguuugagccacaguguauguguauaggcuggaggacaauuugugggcaucaguuuucuccaaccauguuggccuguggauugaauugagguugucaggcuuggugucgaaugcuguuacuugcuuaugagucacgucacugcucacugaaagucugucuggccaggaugcccaucagcacugauugauuuuguuuucagagcugcccuuuugggagcuggagagagauggcucagcaguuaugaacacugaccaucugguuauuuucuuuuuaaagacagggucucacuguguaugcagccuuggcuggccuggguuuaaaggcaugcucccaccacccugcgggaaauucugucuuuuaaaacaaauuauaaguugauagaauacaaaaagaaaugacagauggguauuguuugugcugccuuuuuauuaggaguaauauuggaguauguuucuuucuuuuccauguacauuaguaaaguaaggucuuuguaaaaauccuagguugaaagaaaaggacaaugaaauuaagagaauagaaguuaaauuaaaggacacggagagugauguuucuaagaugucagagcuauuaaagguaagugacuacuaaaauucuuuauugcaggaguuacugucuuugguuguuuuagaaaccuuuuaacuccuauaaaaggcaacagugcaacacgagccauuacuguagggugugcgauuguuaucaaaggugccugcuagguggucugcuucuguccuuugagaaagcagguccccgauaaguuccaguguucagacuuguauagaagugccucucuacucucuaagcuuuguuuugugcugaucaaauucaaggaacccaaggccuguguccuccaaacagugcucuguccuuuacuuacaguaaguagucguuaaggucuugagguuuuugacagcaucuaguuacauuagcucagccuggccuugaacccagacuaaccucaagcuuaugguucuccuguuucugagauugaauguuggaguuaaaggugugagucaccaugcccaacuauuuuuaguggucuuuauugcauuauauaagcaauuccagcugauaaaguuaccuaguauauuuagguuuguucuucaguuaaaaaauacacucucagaggcugucuuuacauauguauuuugaauacuauuugucuuauacuuuccuagaaguaaaauuuuuuguuaaugguuuauacaaguuugcuuuguguucugagcuauuaauaguucaaagugaagcucugaucuuauucauguaguuacuagcaaacacucacaggacgacguugaccugaaggggcagcaaauguguagcugcauacaguaccuucaagcagccuggcucauacuucaugcucuagggcgaacaguuguaucacauucccucucugccuuaaguacauuacaguuagcuuuguuaggccaugcagauugcuccuuguguguguucuuuguuauuuacauucuugccaaaguccugauuccccuucuuguccaacacuggcuaaaggugagaaggcuuguguucuguugcuuuaggcugagggagguggggguggggagguucuuaguauguuuaagucauuuguacauuaauuguuauucuauuuuuguucuacaguuuuucuucugggacaacuuuuuaaaaaccuaauuuaugcuaccauuuuauguaauuauguuaaguuugacuuccuuugcauuccaucccugcuucagaaaacugagucuguuuaucuccucagauaugagcgagguccuguucuuagucucaggagaaagaaugcucauuuugugauuauauuuuuguuuucuuuuuuuuuuuuuaagauuuauuuauuauuauauguaaguacacuguagcuguccucagacacuccagaagaggaagucagaucuuguuacggaugguugugagccaccaugugguugcugggauuugaacuccugaccuucggaagagcagucgggugcucuuacccacugagccaucucaccagcccuuuguuuucuuuuuaaguacaguuuuuacuuacauauauuuaguucauauguaauuuaccucacagaguugugagagcagcauucuaaccuuaggaaaggaaagggguuuuaguaaacugccugucaguacgccuuggcucugccccugagggugugcacuugcuaaugggagcagcagaugucucagugugucugcacgucuuuggaaccugucuauauuaccagaaggcacaagagccaucgcaaaugcugcaguaugaaaccuuucuugcuagaugcaugccacccugcacuagacaccggggccaugucaguucauucucccaacacauacccugucaagacuggaacuaaauacaauuacuaucauuuauguuuuaauguggcuuaauccagccuuuuaaaaugguuacuauuuuggaauauuucuagacuguaugacauuuaaaagcuuauauaaaaaaaucauaacuguguccagguauugauguuucauuuuuguuuaaauaggagguacaagaggaaaauaaauuccuuaagugccagcucagucaccagaagcaccaacagguaggcgccgcuccgugucugccaccucucgcuauuuacagucccguggcacauuugcagguccccagagaggaaaauagucgaucauuuauuuaacaaauuccuuauuaaagcauuuuauuaugcaguauauaagauaaaauaauguauaauuuauaaaauaugugcaagaaauguuccagcuugcuuauauacaugugugugcucugaucaauguuccagcucuacugugugugcacauguacauaugugugcucugaucaguucuccagcuccaucacgaguguaugugugcucugaucaaaguuccagcuuuauuauguacauauauguguguauauauguguucugaucaguguucugguuuuauuauauacauuuuugugugguuuucugguuaagguuccagcucuauuauauacauguaugugccuguauacucugauuaguuacaguuauagcuguaacuaacacacacacacacacacacacacacacacacacacacacacugaucaguguuccagcuucauuaugcccagaucaauguuucagcucuguuacaauauacaugugggugcuuguacaugcugauagguguuccagcuccauuauaguacacaugugugugcguauguauucuaucagugcuccagcuccguuauaauauacaugugugugcagagguauuuugauuagugcugcagcucuguuauacacacacaugcuagugugcuugcauaugcuccuccuaucuuacauaaugcuuuucuuagaaagucagcuaauaucuuguagaggucuauuuaaaguaugucaauagccuuucuucuauccuuaaacaucaauaauuggaaagaaauuaauacauaggaaagauagauacuauaaauaaugggauagcauuaaugugcccuuuaauagguguuucugcuugguaaaaacaaaaguauaauguuuaagaagauagguauauaugacauacacauauuuuucuauuuuggagguugaacccagggacuuuguccaugcuagccaaguguucuuucacugagcccuacccuucauuuuuaugaagauguauggguagaccagaguggauuuugagaaacaauccagacucccuguugacaagcugcuccuggugaucaaguuugacuaagucaucauacuauauauccuauaugcgaaagcuguaccuuugcauauuauuuaaaaaaaaaucacuccuuugguuggaugugagaaaaucagcucuuaauuuauuuguugguuuuauuuagauaguuuuagaagucaauauaaaaagcaccuugaugcucaacaguaugaaguuuguaaguucuuacuaaguaaacacuuuauagagggacagugaaaauuuguuuuacuacucauuacacauaauacauuuauauauacuuuuauuaaaacuacuuuauuaaagucagaugugaugacauaauggaguauaugauauuuuuaacuuuauugacuuauuuccaagaaaaauuuaauuuuuuuauguucuagaaaccuuuauugugaacuaauauuuaacucuuuuaauaggcaucuuuucccucucaggaagaauuacaaacaguguaaguaauucauugauucagaguuugcuguguuauaaagaguuaaaugcugaguuacuuccagacaaguaauuuccugucaucacaagcgcugguguaaacccagcaggugugucugugugcucugggcugcaggcugugugcauagcugugcccgugcuuucgaguggaggcugcugcucucccaggaucuuguugaggggcaguuggggcugcuuuccuccucuugucuucuggaggcauugagaggcucgaggggauggagcugauggaggcagcacagggcagcacagccccagccccagugcuuguucuucccacugcugcacuuuugggagaacuguuguuaugcuucucuuuuagagaguuuuuauuuuuuuaagaaacugaaauauuaagcugggcagugguggcucacaccuuuaaucccagcacuugggaggcagaggcagguggauuucugaguucaagaccagccuggucuacagagugaguuccaggaccaccagggcuacacagagaaacccugucucgaaaaacaaaaaacaaaaaaacccaaaaaacaaaaaagcugaaauacuguuuuuuccuaguuggccucuuauuucucuaagaggcuacuaauuaaaagucauuucugcuuauaguuuauuucaaaauacuaaaugccaaccauauuaaguauaucaauagaugacaguaguuuaaauguuguugcaucuuggcuuguuuaagcuugcccuuuuaguaggcuaggguuguuuguuguuuuagcugagucuugaguuugacuguaugaaguaagagugcaaacauuuucuauaauaagcugauaguggcuucagagaccauacaagccucaguuuugucuuguuacucuguuuuauguauaugugggcuuuauuuuauuuuauuuuuauauggaugugugugugccugcuugucuguaugugcaccaugugcauacaaugccuauggagucagaagcaaauauuguauucccugaaagcagaguaaggaguugcacuuggccugagccaggugcugggagcccaaguuuuguugucugccaaagcagcaggugcucucuaccacugagcugucugucacucuaccccagucuuaauuuuuaaaccguaguauuacuauguacaucauaccuaauauugugacaggauguuuggcaguucguugucauuagcuuuacugacucugggcuguaacagggagaagaggauuuuaggacaccacuugggagggucugggcugggaauaagauacauccagugauccucugcuagucauaacauuuuucaugugggugcuaucaggccaauuucaaaauagcaccaccaccaccaccaucccacaagucauugugaggaagcacuucauuucuaaaauaaaacaaauaacuuuaaaguucaaggaccagauuggcuguuugugauuagacauucuacucaaguauaacacaaaugaauuuugaaauuuugccuuuucuuuuugcauuucugggaaauaacuuaaggcauuagacagaacaagaugaaaaacaaagagaaaccaaagccacaaauccaaagauuggauaaaaacaagugaauuccaggucacuuuaauauauuguuauauauuauuauauauauauuguuguugguuuaaugaaucaaauaguuauagcuaauuuaauugccuuaaaauaaauguuuguaaagacugucuuuguauugaacucacccccagccccuuauuagacauuuacauaacccaggcuggccuugaggucacuguagugaggauagccuugaauuucuggucugccuccgcuacccaggugcuguuccuguaggaggcaagcaugggcucugcgugcuggggauagaaagcagggccuucugcacacuaagcaagcacucugccaagaauuucacaggaugggcucucugagccaaacaguagcugaucaauaauuacauuuuaaaacugucaccugcuuuuauuuugcuuuaaaaauauugauauguaggucugaaugguauuaccauuuaccuaauauauaaguuauauuauuguuuauuuuagaugcuguuuaccuaaaauauauucacauucugauuuagaauuucagaaaaagagaaagaaauaacugaucucugcaaugaguuagagucuuugaagaaugcuguugaacaccagaggaagaaaaacaauguaagccacuacugaugagcgcuagacuuugcauuauagaguguuagugaggaaagaugggggggucuucuuuaugucuauuuuuauuuuagaucucuugaucugugugagagcacuuuugguuucuuugugucugcgggcauugcuagaguaaaucauuuuauuauaaugcaauuuuaauaguagaaagauagauuuuuuauaauggaaaauagcagaauggagcuuuuaaagaguuuucugaaauaaaagaaauaugguugacuucauguuaaaacuuguuuagaaaaauaagucuuccaauauuguuauuuuagaaacaaagacauuucuuuuuucuuuuaaauuauuauuuauuuauuuauuauauguaaguaugcuguagcugucuucagaucccagaagagggcaucagaucucauuauggaugguugugagccaccaugugguugugggauuugaacucagcaucuucggaagagcaaucaguacucuuaaccgcugagccaucucuccagcccgacauuucuuuuuucuuaaucugggccaaugugugugugugauagacuaaaagaaauauucguuucagucuuuguaaucaaucuugagaagccuucuguaaacuacccuuuuuuaaagugagaggcaguacacauauugguaauuaugucugcuagggucuuagaacuuggauagauuuauacuaggaugggaauggcugacucuuuaagaacuguaaaccccccccccccccaaaaaaaagaacuguaaacccuuaccaagcagacaaagaguagaugcagcuggauuuuguaaaucucucuuaccaaaagauaggaauuagaggaguccuaauauucuugcuaggaaaguguuuuucauauaaacgaaugcuugucuugugaacaaaucaaauguuauuaaugauagaauauugauaauaaauguguauuuuucaauguaauuuaaaucuuucaaaguuuaaauugcuaacuaacauguuggcauuuuccugcacccugaauuugugauaauuugguaugugaauugcucuuuguguguuaugcaauauuaauuaguaacagcauuacuuagcacaacauuugguaugaauauuccaauguauuucuaacauuguaacuaacugucuuugcugagacucugagguaaggagggcacagaaauacaguucauucacucagcccagcggugggguggugauggugguagcacugugggucucuauuucaagucuuuguaaagagccaggauaguggaggccggcagggugcagcuucaacccaugcauacacguggccagauuucuuuaacucucagcugugguuucccauuuauaaagugggaauaaaaaucucaccaauuguaaggacuaaugagaauuuguguagugcugaguacaggauuuggcaucuaaauugacaauaaaugguaauuauuggcuuuuuguuuauguuaagauucuuaauuguggagaugaauuacagcaucuuguuuuuauuuguauuugccaaagaaaugcuuucuuucaaagcucacuuuuaaauggcccccguuucuucuuaacgagaaugugaauuauaguuucucugccucagucgcuucagucagcugucgaguucaguugugucugauugcuuguggcauccauguuagagcacagaggguuagguucuaacuagaaaugugcuaauuuuaucuaaaauagaguuacagggaaaauguuacucaguaaaguccugugagggugacgcugggccuagcuugagaaguaguuuguaguacuguguacuugcucuguccuuagcuguagugcuugaacuugaagucauaauuguaguccugguugguguguuuaccuucaaaugcuuucuucuuugucacaugugcccaguuaauuguuuuuuaaaacuggcauauuuggugugaauacuaaaucaugagaaguggacauccuuauuuucucauucaaacuuguaaacauuauuuuuauuauuuugcuaauacacauuuuccuauugaaauaauuuugcaauaacuagcauuuaaaugcagugcaaaauauugaugaaguuaaaggagaaaccuuuuaauaauggauaaacugaaaucauucuuucuaaaaaugauuaggaccuucgggagaaaaacugggaagcaauggaagcuuuggcaucaacugaaaaaaugcugcaggacagagugaacaagacuuccaagguuguaauuaacucccagaacugcccaccgcagagucugcagccuguccacaucagacuaaagcgcuccguuuugcuucagucuaaaccauuuaaacacagcagcucccugucacccacauuaccauccucacagucugccuugcaucuucucucugagacuugaguuggggcacucugugcuggcaugacccugcuguugcuguuuugaugugcacagcuuuaggggaaagaucccauaagacuccaugcugugugugcaggucuuuccgugucaccuggugugccacuugguguaguucggagaacuucgaugagguucccaaaucaaagaaaucagagugaauuaauggaacgaauuaaaaguguagcauguguuugggaugcauaguaaagugggguucccagagcguaccaggagauucagacaagggaggaaaacagcaaaaccuucaacaguacagaagaaggguccauucagagggugcuauggggaugauucugcaggagacagagccugaaacuuaguacuuuggaguugcaggacaguaguugcaccgugucuguuccguguucaguauuaguaugaauggaugaugagacuguaaguaccucugaugcguauguccccuuuaucuuaaagaaugaaggacauccuucuuguacuuacaggcaguggggagcagggucauaauggaggagagauagaaagguuaggacagcugagugugugugcaacaugaacauugggguuuugaagccagguuagugaguguaccaaauuaauuuccacauucugaaaugugugccaagauaaaucuauuacauuuuaauuucaaaaguauuaaggauauuuguaacaauuucuuaguagaaugcaauuuuaugauuugccaauuuuauauauauaguuaugguuccucuaauacaauagauucauacuuaaauuuucauuaagcuuuaaguugagagaguugauagcuauuacugccagagggauuuaugccagagacugugaggcucagguccuguuuaauugugaagggcuccuguugcauagucaucucugucagcaaggggacuccuaguaugggcuuuucaguguuuggaguuaaaaggcuuugugcaaggcaucguugcauccucuaauguacagggagcuccaguaugugcacgguggcuugcagagcuaaugagcugcaggaagcucauuagcgaacugagaauccuuucuuagcaugaguguaaaugauacugauuuaccaaguuccacaaauugugauguggcugcauaaagaacuguuagcguuuuagguguuagaaauaguuaaacuggguagcauacuauuuuuagaugguuaguuuuuauuaaugaguuaccucccccccccccgagugugugugugugugugugugugugugcgcgcgcgcgcgcgcgcacgcucuguacauuugagguccuccugcuucagcuucccaaguccagggauuacaagcacacccccaccaucauaucagcuucuggaaaguuuauuuuauuuuuucuuuucagacagggucucauuauguaguagacuuggauagccuggaacuagcuaauuagaacaggauagcuucaaauucugccugccugccugccugccugccuguacucugguuggguaaaggcuugaggcaccaaaccuagccugggguuacuuuuaaaaccugggguuacuaaauacuuguuagaaacuguaaugauagacuuacauaaaagguauuuuacauauucuaaucaauggcaguacuaaggaaauaaucuaguuucuaacguuagauauuuuuuuaguuguugaauagaaccuguuguuugguuguacuguuuacaaccaaauuuaugucaaauauaaacucuagcuaaaacauuuuauagaaugaaguagcuuacggggcggcuguugauuacaaacaauugagugcuucugugcuuccaggaugccucuguuccacaaugucuucuccuuuaagauugcucugcauaucuguagucaagugauagagugaucucuugauuccuucugaaauagcaguggccuuccagugaauauacuuugugcaauuagguauaugccuacaaguuuguggacuuuacuaaauuauugaaaauaccucaguaaaacagcuauccucaaauauugccacuaaucuuuaauaauauauuagcuuuuagugugcauaaauaugaaauuuugguuucuguuguauaaauuuagauuuucuugugauuaaauuuuuuuuacacugaaguguagguaucuuaaaccaguaccagguuucacagagcagagcaugugugagaacugagguggcgcucucucucugcgccccuccucugugacugaguaggagcggagugguuguguugguagguuuugcuguacauuuuuuauaggugucuuuauuucuaaaaaaaucuuguagaaauacuuugaucauuagauuugaggggauaugugugcaugugaucaaauuuugucccucauuuugacaaacauacuucugaacuuacaguuggaguuggaguuaaaaaucacauauuuagauugaacauuaguaauaguugcaauuuauagcucacugugucagaagucaucuuauugagcacauggaaacugaauuagugaagagacgugucucugcccgccuucucccugugucuacuuccuaucacaauugguccuuucugcuuugucuaacagaaauccuuuguucuggccuuggaaagcagacuaggaaagugucaauguuuccucugugaaccguugcuggucaggaaccguugucucagggcagacacacggcagucaggagucagggcagacacacgcgcagucaggagucagguccucugagguuuggcugauggggaaggguguuugugauugaaguguuacuggaauggcaggucccuuuacuucuaaugccaaagaaaauucauauugucagauacuacuuugguuugauuaagauauuauuugcuauuuaugccuuaagagauuugcagauuuuugucuuuaaggaaguauguuuuaaugccuuaaaaugagaaaaguugauacuuuucaauauuaaaauaaguuuugaaauuugacuuuuucuuccuuuagaacuuaaaaggucauacuguuuuuuaauguuccucuuugaacauugucuuaugucguaaguuugaucucaucuguccuuugcauuaggaaagacggcaacacguggaagcuauugaguuagaguccaaagaccuucugaagagguuauuuccaacggugucugucccuucuaauuugguaagaugaaccucuuuaacauuuaaccugaaguuauguggggaguuggugguaacagcauuugauuucugaauuugguuuguuagcaugcugaacuucucagugucuccauaacuaaugugcuucucaguagucagacaguaacuuaguucaaagccccuuugccugaaccugaaacuucugcuguauucuaucacacugaauggcuuguaaauguauuuggaaaacagguugguuuguuuguuugauuuugaauggguaauaaaaccaauaauaauugguuuaagugauuacuucuuaguuuaaaaauuguccuuuaaugugcuauaaauuauuuuauauauuaaaaucaugauuuucaucuauuguuuaccccaaauacuagagugcagcuggcuugagguugaacaugguucaaguaggauagaagagugacuggcucagaucagcagccaguauuccagggcaaagaggaucagggaaugugccugaauuuccucagaggaugagauaggccuucuuuaaguuuuaguaaaauaauguguauauauacucacaaguaggcaauggaauaaugaucacaggacccacuucgugaaccuccaugaaugcuuuuguuauaaugacuuucuuacccuuccuguccuuccgaaugcgguggcccuuuaguccaguuccucaugugacccccagucauagcauuauuuucauuucuacuucauaacuauaacuuugcuacuuuaugauuuguaacaugaauacuuuuggagauagaaguuugacaaaggacgugcugcccacagguugagaaccucugcguuagauccuccugaaggaacccaagcaucagagcauuuauuguaaagauuucagcacaagagaucaagagauaaucuuuuauuuaaaaaaauauaccuuuaauuauauacauuuaaucauuucccuaauuuucauauacaguccucaugcuaauuaaauaacaacaagguaguuuauuuuauaaucagaacccaaaauaagaccaacaugugauugcugccugcugagcaagcgugcuguggccuacccuuuucccucccugauuugaagccuagagguguccuauugcagucccugacaguuuggauuuagcugacuguauuccucugcccuuuguauaacucauaaauggacacccagacuuaucugauccagcgucaguauuucaagguaguggugggcacuguugucuacauuugucgugaugucugcuugucuggguuaguggagugaucugcuuuaggcuggcugugacguccuuugguagcucuugugccugugcuguaacaagacguugaaguuaagauacaguuaaagcuucaagcauggaauggcuccuuucuccgaggaguucagucuccuccaggugugggugugggaggcuggcuguuuucuuucuuuaguuuguguguacaugugcccuacuguuggccacucuguuucccuuggggcugugggaggcuuccugggcuugaacagcaggugaucacuuuuaccugagcugaagaagugucuuguguuagacagagagaugaugcaggggaagggggcugcuaauuuauuuucugucuuuuucuuuuguggccauuaucugauguuguuucuacuguguguuuuauucauugauuuacuuaguuugacaauauuucaugaaccaagagcacugaagagcugcaguuucucuuauucaaaaauggccagcaacaguuuucuuuucuuucuuucuuucuuuuuuugguuuuuugagacaggguuucucuguguagcccuggcuguccuggaacucacucuguagaccaggcuggccucgaacucagaaauccgccugccucugccgcccaagugcugggauuaaaggcaugcaccaccacgccuggccaacaguuuucuuuuaauguaacaaauuuguucuuuuuuuguuuguuuguuuuguuuuuacuugauuguuuggggauauggucuugucauguuguagcucaagcuggccuugaaugccugauuacaggugugugccaccaugccugguuuaauuaccuucaauaacuaaacaugcauggcucugaaacaauuuguaaaucauguaagacauggaaaguauucuauguguuuuguucacauacuuguuuaaaguugauuucaugugcuuuaaaauacuaagcucucacgugccacuuaagagauuaguauucuagauuuuuaaaaagaauuacuuaauauagucaggcaugguagcacacaguuuuaaucccaguacaagacagacaaagguaggcuguccuggucuauauaucacgcuaguaggacuauauacaagagaaaagaaaacaaaauuaaccuaaaccucauuaggauaaauuaacacaacuauuaaauauacaaggacucuuacaaguuuuuauugcuugcuauugccaacguguauggcagauguagagagaaugauuccaucuggguuuagucuguauuggaucccaguauuugaaguuuuaaguaguuuguuaguguccacuguuuugugagacucuuuuacucuaaauaggggcuuuuaaaucagcauggcaguguggggugaucucugccccaccaugugaugcuuggagaauauugagauacaguagcagaacacguuacaccauagagucaguaaacaguuuguuuucuuuauuaaugaaaccaaaaauauaagaagaaacuugauuuuaaaaauauaaaaacuuguuaacaguuucaaguuuaguuaagaagcuucaaaaauuuuuaaugauuuauucuaaaguuucagauaauggcuuaaacaauauauguauuauuuucuucacuuaaccugcaaacagaaaccaguuuuguguuguagauaaauaaaugugugcuucucacucccuuaagauuuaaaauaugcuuauaaugcauuuuuuugaaugaacuauuuucagaaaguuuuggaguaccuucaaagaauuuaaaaucuucugaacagaaugccucuaguuagaauuuuuaaauucuaaauacuuguguuuagaaguauuuuauguggaaaaguuuuugaaauguuccuuauucuagaucuugaauuuuuacaaauuaagcuuauuagccuguugcucaugaauacuucucauaguguuaggacaugaauuuugagcuuaggucuacugccuuugaguccaaaacucaguugcaaauauuuuguuauggauaaaaagcacuuuaucuugauacuaauaugcauuuaauuucuuuguacauuaaacuauuuauuuacuuaucuauuauugcuggcuaugguugcauuugucuuuaauucuagcacuuccagacuugugucaaaaagaauuguuuggucuuuuuuccccuaagauaguuuucuauauagccuagguggccugaaacgcaccguguaacugacguugguauugagcuaguuaucuuucugcucucccuucugaggcuguggagcuacaggcgugugccaccauuuggguuuuaguguuucuuucuuucuuuguuuuuuaaaacugucuggguaaguaugaugacaauguauguaggcuucuuuuauaaucaucugauuuggugcucuuaauuuuuuuuuuuuuuaaaucagacuuuuauggaaaccaauaacugaccuuuccuccacagaauuacagugaaugguugcguggcuuugaaaagaaggcaaaagcgugcguagcuggaacuucagacgcagaggcggucaagguuaguugacaaacugagaguuggggcacaccagaagcugcucucagaaacacuggggugacagaggaugcauuauuagcuguguacuagaaagaauauggugccuucauuucuaaaacuaaaugacuaguuacucucaucaccuuuuagcuuaaguuuucaguguaagucaaacuaagaucuguagccauuuucacuggcuugcccagauaaccucggcagcacucacaagcugacuuccuucuuguccuuggccaccgagagagugcagaucccuggucgguuugaauccugguggcaggaguaaagucuuccucaugugugucguaagcauuguaauguuuacuuaugggucuccuuacaugccgcccgccacaugugcagagucaaacccuugcuauaaacgccugaugacauuuguuaggacuuaaaaagagcuucacaaggggacagcaugugaccaaaaggccucaggcugcgcugcugcuuaggaugugguauucuguuaaaaaucauugaauccguuuacuacgucaugagauauugaaacuaaugugaaguacaacccucucauuugucauuuuucucuuauucuuugcagguuuuggagcacagauugaaagaagcuagugagaugcacacuuugcuacagcuggaaugugaaaaauacaagucgguccuugcagaaacaguaggauauggcuugaauuacauuuccauuuuauuuuuaaauuauuggcuuauuucuuccuggcccaugugauuuaucuugaaaacaauaauugaaaaucaaaaaaauuucagaacaauucugccuuuguccacaggaagggauuuugcaaaaacuucagcgaaguguggagcaagaagaaaguaaauggaaaauuaaagcugacgagucucaaaggaugauuaaacagguauuuaaggguggguuuacagcggcugagcuuucagucccaccauugucaccugggaacacaguguagaugcauccuaggccacccguguccuacauguguguggcagggaagcaggucuggagucugagguggucuugauguugacccauuugaaagucacucaucugagugaccagagggugauguagcaggcagagugcuuugugagugauggcacuacauauucuauagcaagauccagaaccccagguucgaaacaagcuacccauaucauacugcauuccagaaaaaguuaaguccugcuucuguucaugugacccgugcacugcugggaagucuguuuuucugccauuuucacagauguuguuaagaaauucauggaucuuuugcaucgaugugugcaggcaggcuguagguugcuggccuugcucuguguuaauacccuuggagaguaaauauagugauuagcuauugcuaccaaaauuaagugauucuagcuggcucuuaauauaggaucaguacaaguggguaggaucugaucauuacuuaaaugaagucacaugugagacuaucauuuuuaagagcuuuaauugacaaucaguaugggcuacauuugaaaccucuaaaugggguuggcaaagggacuugcuccaaccugacaaccagauccuauccaugguggaaggagagaacuguccugcaaaucguccugaccccagaugcacuguggcuuguauuugucccucuuucaaauacauaaaaauuuaaaaagcaaaacuaaaaaccuccauaaccaauccauggcccaggcuagagaugaauauggcccaaccacuuauagaccgugccaugucacaacuccgaagcuagguacucauuggaguguaacaugucugcagcccacaucuccagugcucccucaguggcucucucuuaauguugucucacauuucagaugcaguccuccuucacagccucagagcgagagcuagagcgacuaagacaagaaaacaaagauauggagaauguauguguucugauacuuagacucgcaaccugugaacuuagucuuagcauuauggguugcucaaacaucugugcuuuaaaguuacuuuuaugucucauauguuuuuaucuugaguaguuugaguugauaacagcuuuaaauucauaaguauucuaacauucuauuaugggaaaaaccauggaaggaaaauguaaauggcuuaacugcccuuuguuguguugacagcugagaagagaaagagagcauuuggaaauggagcuagagaaggccgagauggagcgaucgacuuacgugauggaagucagagagguacuuagacauuuuucagaccugcuuuucaguuuaguucaguucaguugagacaggacauuaaaguaauucuguuuaaguuguuuguagaagagcuuccgaguagcugcaaaguauggguuaucaugaagaccaaucuuaaacuuuaaacuucauugcagcugaaagaucuguugacugaguugcagaaaaagcuugaugauucauauucugaagcaguaagacagaaugaagagcuuaacuugguaagaagcuuguccuccacugaguguccagucggcucuggagacacgcgugcuggugugcaggcuccaccagccuucucguccuggcuaaccaccuuuagcuuggcacuuuccuuagguuagagaucaucuuccuccucugaugucuccaaagaugguucuucuuuucuuagcuccuaauaauggcauguuuggcuuccaacucuauuucaaaguguucugcuuuuuuuacaaccuaauuucuugaacauuauuacuuuuuggugaauaaagaaacaaaauuugauaggaggaguuguaaagauugucuucuugaacuaucauaguuaacuaggauuucuagguuuuuuuguuguuguuguuuaguuuuguuuuucgagacaggguuuucucuguguagcccuggcuguccuagaacucacccuauagaccaggcuggccucgaacucagaaaucugccugccucugccucccaagugcugggauuaaaggugugcaccaccacugcccagguagggauuucuaguuuuguagcuuacagaugcguguuauucauucaagacauaaccccaaccaaagcuaacuagucuuucuaaaaguaaauuucagaacauuuaaaaguaauuucuguacuauuuguucuuuugagacaaggucucuuaugucggcuggucucaaacucacaguaaugcucagacuuuuagcugggauuauagauaugagccaguguucauuaucaguauggaaucuaacacuuagcagcccuagcccacagugacugacugugacugaaccgaucccuuccucccuccccucuccucccuuccuuccuugagguucuaggaauuaaaccuaggaccucaugcauaauaggcacauuuucugucuaauuucauccucaguccuucuuuuuccuuuuccuuuugauguaaggccuugcuaaauugccuaagguagcuuugaguuuuguagcccuggcugccucagccucccaaguagccccaggccuuagucucagcugaauuuauuaagaugugagauucuuugcauuccuguucuuguaauuuuuagggauuuguacugauugcugacaugcugaccuguuagcuagauaguuauccuguucuguuuuguacacuaauuuuauccuccugggauuuaaaacacuuuauaacauuaacuuaaaaaaaaaagugugugagcauacucaaagaauaaaguaaguuucucgugauuuuacauuaaugcugcuaguugagaguuguuucaguuagcaccacacauguacacagagagcuugcuuacccuauucuuucucauuccugaucacucuuuguuacagcaguuauuacuuuuuuuuuuaauucuacuguuuaaaaacuuuagguuagcauauaguacugaguuucaccauagcaucuucauauauacaucuugaccauucuccuccuccacaccuaucccugcuucucuuguuuccccaccugcuucuuccuucuugauugggguauuugguggcagcuuggcuauauaaucccgccuagccuugaacuccuagcagucuucccgcuucaguucacagagcuuugagauucauugagauuugcaggugugcaucacgaugcccuguaugacaggugauuauugggaauucguuuuuagaguuguaugaggaauagaguacugugugcaugcacaugcccccauauuuucaauucuuguugcauuuaccagugcuuuguuuuagcaauacccauuuccagugcaauauaagacgaguuuucugcauguauuugguguguaucacacugacuaggucugugauacuccaaaguuguaugccuauagaauguuuuggaagaaucuuuguuuuuuguuuuguuuuguuuuuuuaagacauggucucucucuuuagcccuggcuguccuagaacucacuuuguagaccggacugaccucgaagugagauauccaccugccucugccucccaagugcuggauuuaaggugucugccacgguuccuagcuuuguuuuuguuuuugagacaggguuucuuuguguaaccuuggcuauccuagaacuaccucuauagaccagacugcccucaaacucaaagagaucagcuugccucuacuuccccagugcuggguuaaagacuugugccacuacugagcagcuaacagauucauuuuuaacuagagaguuuucuucuuaguuuuggugcuuagagcugacucagcaguuguagccuuugugccagaucuguaggcuggugguuaccuccauuuuguugguuggccuguguuaauuacccuucugcuaucaggagacagcuuuaaguaacaauuucuguuuuucuuuccugucuugugauuguaauaguuacuuuauuuuuaaauaaaaugaauuugcugggccauccaugcacgcuguuguaugguggucuucaccagagagaacugagcucucucagcuaaguacagaaggcggcagaagcuuuagccauuuaguguccuuccccaagugagucggccaagcgggaauccccgccauuuuaaauucuacuggacuuauuuguuuguuuuauuuauuuauucaucuacuucuuaccuuuuuaagauuccaaaaguuuuuugaaagucaugccugugguugggaggcaaaaaucaguaacacacacauacacacacacuuuucaaaacagguuucuccguguugcccuggcuguccuggaacucccucuguagaucacacuggccuugaacucaagagaucugccugccccugccucccaaaugcugggaucaaagaugugugccaccaugccuggcauuaacuuuuuagacagugugaauaguuuccuuucuauuuaauuggaacaguugugagaaagagguauugugcauggacacuggggucauauacagccugguuuugacaauuuggcuguugagaguucuuucucaauauuuuuaaaaacaaauauuuuaugucuaugaauguuugcaugcauguauguaucuagugcccaccaacaccagaacguuggaucuucugagauuggaguuacgaaucuauggccgugagcugugugggcgcugggaaaugaaccuuuggaauugaacagagguccucuggaagagcagcaguauaaccccucgacauuucuuguuggugcaguuuaggcuagaaugaccuuacauugcuguuuucaaaguuacuuuguuggguuuuuaaacuuuucacuggcuuaaaguaauaacuuuuuaaaaauuuagauuuauuucaugugcauggguauuucaucugcaugugugucuuugaguuaaagacagcuauauuugggugccgagcaucaaaccaagguccucuccuagaacaaguccuuuuaaacaccaggcuaagccuucaaccacccucaucucccaauggacuuauacaaagaacucuaggucaagggaguguuuuaaagaugauuagaaauuuuuauguguuccuuuuaauuuguaauagucucaguaacuaugaacaguaacuauuaaaggcucucagugucugacucugguuugggguuaaagucuucuacacuaaacucuaguucauucucuugcaucucuuagguucagcucugcagguuggaccucugcugccagcuuuucuguaccucucgucagcugcuagcuaauccacugugcaucaugugcaucauggcuccuaagaguccauucuuucauagccacucuucauaagcaaauaacucaaucguucuguuccuuuuucuacagcucaagacacaguuaaaugaaacacacucaaaacuucaaaaugaacaaacggagagaaagaagguagcugaugauuugcauaagguaagacacugcuugacuuggagaaagugaguguccccaacccauguccugcgugcaucuuaagcagacacuguaaaaccgcuccuguccuuuuggguccuuagauguguaggcugcugguuguguaaucacuuuuuugguaaauaacaacagcaacagcaacaauaaaacccuuugacuuguuuccucauuuggaguuaaaguuuuuacuuuuucuucaguuuugaaaauccuuugaaauuauuugguguguguguguguguguguguguguguguguguguguguguguguauguuguauguuuuguuggcauguaugucugugugccacauguguacuuaguaccucuagagacuuuggaucuccuguaauuggaguugcaggugguugugagcuacaugugggugcuaaaaauugaauucagaucuuauucaugggguuaaaguaagugaauggucuucacugcugagcccccucuccagcccucuaaaguuuucaaauaagauuugccauugucacugucuuaguuaggguuuccaucgcuguaaacagacaccauaacaugccuuacaaaggacauuuaauugaggcugguuuacagguucagagguuaaguccauuaucaucaaggcggguaggguacauagugguguacauuuuaguuuguuuaggaaaugaaaaaauauauaaauaauuucagacguuuguuccuuucagucaguguuuuguaccaauauauguuucuuuuccuuuccucucucuuccuccuccucuuccuccuccuccucccuuucuuucuucuguguagcccaggcuaaccuuaaacucaguguuguagccugacugcuggacugcaacugugugccaccaugcggagcgcaaaugguuuuuuuauucucuuacucaaauuguugauuucuuuaggauuguguuucugauucuuuucauuugguuaacaggcuguuugucguucugaugugcaguguuuuuaguucuuguuguuguuuuaacgcagagcuaugcaaguauuugugggagauuauaguuaucagaaaaauuacacauaucccuuucuuggaauugcauaaucaaggauuuacauaacuuagauuuugauaccuauaucaauuacuguaaacauuuaaauauuaauauaauaacaucuuuuacauuucuuauuuaaauauggcauguuuaaauaucauacaugaaaguuauuuuuguugugcauacuuagagcuuaugauuguuauuaauaaaaagacuaagaauugagaaauucuugaacaauuucagauuauuuaaaaacagauuagauguuaaaugugaauucagaaaauuuguguuagaguaccaaguuuuuuuguuuugucuugagauggggucucagagccuuaguuggccuggaacucucuguguagaccagcuggccucaaaugcaugcagcugccucuggaguugggauuaagugugugccgcccagagaggacaucucuuaagguugagacguguauuauuuaauuugguguguuacuuuaaguuuuaacuucggaaucaaaacagaaaagauguaauuuuaguauggcagugcaguuccucagacaguauggguguaguuaaaccaugcaugucuguggcggaagugucagugguaggugacgcucuccugccugcagacaguaggaaugcucaauuggaauucagaugcacauaaguguguuuuaccgaguuaacaaacuuuguaaacugaaaguauaggcugcagagauggcccagugguuaagaguacuaauugcucuuccagagguccuggguucaauucccagcaaccacaugguggcucacaaccaucuauaaaaugagcugaugccuucuucuggcaugcagguuuacaugcagauagagcacucaugcauauaauaaauaaauaaaucuuuaaaaacaaaacaauguuggagcccauucauaaaacauuuucugcuaauuuucucuaaauaugcuuuauguucaaaaaagguuccagaucaggaguuagcaaacccagacuaguuuaggauuagugguccacacgugauagacuuacauguuucauucaaaaacaaaaacaagagaggccaaguauugguggugccuacuguaauacuguaauccaagcacuugggcagcaggagcuagaagaucacuaguucacuauaagcauugucugucuacauaauguguucaagucagguaugagcuaccaggcuaucucaaaaaugccaaacuuuguuaaacacagugaaacucuguggagagagcucagugguuaagaacauugacugcucuuccaaaggaccuggauucaauuccuagcacccauaugguagcucacaacugucuguaacuucaguuccaggggauucaacacccucacacagacauauaugaaggcaaaaaacuaauacacauaaaauuaaaaugaaauaaaaaacaaaacuaaaaaccauaacacccauucuuagaugugagcugucaaaaaucagauuguggguaggaguuggcagacuuguagucuaggcuaaaacuuaaauuuaccagugugcuuauuucuagcuuuaauuuccuuauucaguucccauguuugaccugcugaaaaugugcacacauauuguuauaaauuggugggagaugucacuguuuucauuucagugacaaaauuuuuacaucacauguugagaggagcuuuaauuuuguacagaauacauauuaaguuacuuccuuuguguguuuugauguaucuucuccuugugcuucuguuacaggcucaacagucccugaacucuauccacucaaaaaucucacugaaagcugcuggagacacuguuguuauugagaacagugauauuuccccagaaaugguggguauuuccuucagccucaacuuucuaggccuuguaaacucugaagagcaagcauguucuuuggcuccaaacugugcuuccuuguuugggggaugggagccaacuuugggauggaacccauggccuuguucauaugacacacgcucugccucacugagcuaaccagcaccagauauaguacucuuaacccaaagcuguuuucucucccgagggccgcugcguucuugcuacugguagucucacuuuagcuuugugagguccuguaguaacuguagugugucuauggagagguguaugcauuagugccuuggcauuagaguguagaugguugacucugugcccugcugcuuacuaacuucauuuguggcugucacucugcuucaguaaaggguacuggcagugucaccuguccuguaggguuauuagaaggaacaacugaguaccauggagaccuugaguagagggggguaucucuggcacccaguaagcagccauguguugcuccugggcugguggaggcaugcugcccuuugcuggacagguuguuuguuuuguuuuuuaaaacauaauuguuuucugaaaggaaaaaaauacauuguuuacaacauucacagauuauagaguuuuccuuuaugacauuuuaugcagcauaguuuucuuuggugccagcuaguuugugccacuaaucugcaaacauuuuuguaugugauuuuuacuguugcuaacuuuguuuuacaaauguuuaggucauuucccuuuuuugguugcacauuguugucuuuguguuuggaggcuuuugaaguuauuaucccuuccaccuucuuuucaggagucuccugagaaagagacgaugucuguaagucucaaucagacugugacacaguuacagcaauugcuucaggaaguaaaucaacaacucacaaaggagacauaauccagguguggguacggacacucagagcugcugcuuccuuaugcauaaugcaguacagaugacauuacucacuggaaagugagcuacauggcacucaagaaauguuccuucucacaaguucuagguggcagcuuugaccuuucuuguuuuguuccuuuuaugcacacauuuugaagucuuuugguuuagagggaaagaacuauagcauaguuacugcagucuccugucaggaagccugguugugacauggcuaccuggguuggucuguuguaggcuguaauugccuuuuaguugauucuaguccuacuuuagggcaaguaucuaugggcauuuccgucuuuuuaugacugguugcuuuuggcuuuguuuuaucaagguuggacuaaaaaauaaagucaucauaacuucauaaugcgaaaagaacauacagaauuuauuguauaccuaaagauaggaguaguagauuucuguaauuucugcugauuagagcuggcuuggugguuguuuuguuuugaggugacuugcucaggcacuguuuggccuggaaugugcuagaaucacgguggcgccauaccaaguugguguuuugaguuuccuuuuguagaugaccuaagcaauuuacuccuucauguuugaagugagggguuuggguuaggagaaauaagaaggccaucauuagaucauguugugugcucuuguugcuuacaugacugcagaaaagccuaagucuaguagcacuuaaaaaugcuucguaugacuuaaauuauacugcuaaggugagaacaguuuugaauauacaaagaauaguucagauauuuuucuucugaggcuccuugcuccaaaauuauugugugaaaagggcaaggcaaacugccauuuggaaccuauaccaauguuccuaugacugacagccagacagaaggccagggguagguuaggcacauggagaaguugacagccuucucuggugauguggcagguacguaccguggacgcuuucuguucaggagagccagccuuuagccuaccuaagugcaugcccucaacagugcugacugucucucagaagacuggacgcagugaacccuggucugucgcuacggucgggacagaagcgcucgcucggcucaguugucuguucuauggaagucauguuucuggcacuucucuuccccagauuggcagaugacuuugauuucucuuuugcagagaaauucuucuccucgucccagggcugcagccugacuguuccucuuucagagccuuucuuaaucuuguuuuccuucauguugucagugcuuaguuucacuucucuccuugugucuaucucuuccuccuguaguuucuaugucuccucuaggguacuugcuaacgccauuugccagcaucgugagugacuugcugacacuucucugcauucaguagugcagucacagaaaggcuggacggauaugcccagucugcugccucggagcuacggaagggcuuaauuauuagagagcuuuaagacugagacugagucugacugccuccugccuuagacuguguuuguucuuacagaugggcuuuguaaguuucagccugguccacuuugcuccuuggguuugcauuauacugagcaagaccuaauaagaguggcuucucaggguugucauuucaaaaucuuuaccuaaaggcuucugaguccugagguguccucucgugugaucaccaucaguaugaggggcuccgggugccacugaagcgccaggcugggucuugugaacuguguguggggugcgugcucguggguugcuucucuuaccuuguucuaaauagaucacuuucuucucuuuugcagagugaaguaauugggaaauuacucguuagaaguuaacagaaggcguuguauuguauuuugccaaauuaaagccuuauuuauguuuuacccuuucuacuuugucagacacuggacaguuuugucuuuucuaauccuuguuagacuacugacuuaaagagaaacacuuuaaaaagccaacucuguagacaccuucagaguuuaguuuuauaauaaaacuguuugaauaauuagaccuuuacauuccuaaagaugaaguaaauguaaacuuuuaccuuauuuugcucaauuaaauuguucagaagaucaaagugguauagacaaugugaaauuuaacauuuuaauacugauguuguacacugcuuuacuuaacauuugggaagaagccgccucugacaucaacucaaggaaacacuuuuuguugcuauuauaaucagcaaauaaagggacacuuauuauucaacaugacucacucugauugucguugaguuucaacaaguuucacuagcgcuucagaccgcuguuucuaauugcagccaccaaacaagacaagucuuguugcuucuguaacuuccugacuagaccuuugugucuucucugggucaggacugugccaagucccacagcgugggugauggcaaggugcaggcguuugagucccauucaccgcggaggagagcucugcuuuauuuuugcugcuauuacuacuguuucaaguaacaccuguuaagucucccucuucagagaguguguuaguacagguuacauguguucucuugucuguuggaagccgugugucugugugugugucugugguauuaagaacacugucuucuuuagaugaaaaguauccugugccaaagaauauuaaaguaccuuuuaguauuauugcuauuuuaaauuuugauuuugauuuuaagugcaugagugguuugcuugcauguauguaugugcacuaccugcuuauaaugccccuggaggccagcagaucguauugaaucuccuagaagaggaguuggcagacuuaugagcugcuuggugaaugccgggacuccaguccauggaugucuccuggaaguaagcucuuuaacuguugugggauccugccagccccuauugcuuucuuggacaaagcagucauguuucugcacaaaggcuuuguagucuguauuucuuuuguugagagccuuuugauuuugaagcaggucuaguggauacaccuguca

SEQ ID NO: 7410 - RNA, 2559 nt, Mus musculus
aguagaggcaagaggaccaugagcuagaagguagccugggcuacaaagcgagacucaaucacagaacacaaauggccucuuuuguucugaaugucaccucagucuuucaucugcacccuucccuccgugucacaaccauacacacucaugcaucauacacaacacugcucaucccgacauggggcaugaguaacuuuuaaugauuuccuauacgaaacccuauuauaugucccuauauaauccuauuaauguuugucccuaguacaucuaucagucuagccagcuucuucacuuuggaguaauauagggaaagcuaaccgugcucccauucagcaaugguucaguugggcagcuguagcucugcgcucaggcucugcccuuagguuaaacgucccuagagcucaguuguaugaguggugaagguuuuaccagcugcuuugccuucuggucccaguguucaucuuucuacugucuuacaagaggugcauuugggaacagacuuguugauacuccaaaagagaaugaagagacauggaagggagugauggaaaugccacgaaacagcccauuccucuuggugugugagaguucaucaguuuugcagaagucagggcacuguguagaagacuagguaucagcugucuuugcauaguucacaagagagcacaguagcugugcugcccacagcacugaagccaugccaguacugugaggacucucuuggaugguaugucauggauaugaaacagagcucccaucucccuaggucugugugaagacaugguuccccaguuggugacacuccugauaaacgauuguaucauaaagguucuaaccucuaccacacauucacguuaccaugauagucugucaggugccaagcagugaaggcagccaauaauggauugaaaccauaauccaaauaagucccucuugaaauggauuugcucagguccaccaauagaagguguaugggaggagcagaggccaccaggagaaggcugccaggagugcccucacacagaggcuccauuaucuaggugcccagagacagcaaggggaggacugaaaaggacagacagucccagauuguaccacuagugcccgagcuugggugcugacuguguuauaaacugaagcuguggggcgugaugaggguuugcacaacaggugagggaagucccacaaagcaaaacuacugccgggauuggcaaagaagucuuagguuuaggcuguugacagauuggugguagaccuauguuucccuaggaaaguugaccauuucguguucauugguagaguuccauuauauagcacugucauguguacauuucaucauaggcgaaauaucuuaaaaucauuuaccugaauuggacacuuuauuauucacuagauugaggcaggaaaggaauauacucuacccuccuuuucauuguagauacggaaacugaggcacagagaauaagucuccuaccuagucuuggcuacucaggagagccaguauucuacuccugagccugaaacaucuggcuugggacugacucaugagcauauacauaucuacauauauguuucuguaauuauguguauguaacuagcuagagaaaaauagaugguuguguagaaaaagaguaauuuuuaaaagaggaauuuguugcgguacuacuuugucuuucucauuuucucuugauauuuucugagggucugucuaccucugguuuuuagacguguaugacacauagcccucuuggcgucccccugaccuuugauuucuagagauguugaagguuaaaacuacuuucauaagauacuauagccugcucuuuucacucuguugucaucugugcugccccagggaaccacaacagacacaacagggcugacucacaugggaacucacagggacuggcagcaccacauauucaagucagauggggucccagcacugcuaggggaaggagacacccacucuuaccccuuaccaagaagcuaccugcaguagaaacuccucggcaaaggaaaagcuugcugcaguggcaucucccugaguaucugaaccacccuucagggcaggcucucugccugggaggagcugcccagcaugaaauaacccagguguagugugcagaacuuugcuuugaguucguuugaaugugucuugguuuaguuaaugaguuuguuuguuguuuguuuguugguuuuagaggccaugaguuggguggguguugaaauggggaggaguugggggaggggagaccauaaucuuguauguuguaugaaaaaagcuuuaacauuuuuuucuugguuuuaauuuuaguacauugaauauugauagaaauaauaaagucuuuuagaucuaaaggaacuccuuucuuuugagaccaaaaaauagagagcuccuguuuuugcacacuguuucuuuucaggaguuuuaaugacaucuggcaacuauccacacuuuuaaaaauaugcaucuuguucuauauuuuuauaauuuucaauuguucuuugauaacauuuguauaaaauuuguuuuuaauaaauucauuuuagacugua

SEQ ID NO: 7411 - RNA, 2278 nt, Mus musculus
uaaacuauuaaaaguauaauuuauuauuauuacuauuauuauccaugccaauguauacacuaagccccguaucaauugcugagucaaacaucuucacuuggcucaguaggacccaggccucugccuaaaacgcucuuucucuugugcuccugagacaguagcuggaaagaagcuccuggcagucuugcugcuaccauaagaccagagucugugcccaugcauccagcacagcggggcacggaguugagggccacaguggagugaugcuccuagauccggcugcaauggaagacagucuggcugagacguuuugacguuguuguuuugucuucuguuuauuuucuaucuucauaugcuacacacaugauuuuggugacucuaagaugcuuuuaggcauaauccucauuaacuggagauuuuagcaucuuguguaauuuaguuugauuucaucuaaugccuguucuggcuaaaagugauagauagcauuuauuuguuucuuaauaaacacucugagguuaauuuccuuacauaugugaauuaucuuuuaaagacucuugagauaguauuagcuuccucucugggugccauaaccggguugaauccagaaucuagaauccagagauagaccauuugccuagcucagcuggcagcuaggcaaagggcauuuuguaggugaggcaucucggguaaaucagguugugggcacuccucugcuuacauuaaauguaugagucaccaaaccguugaggagcuugcccagugguuucccacaugcagaucauuacuuaauuuuacauagacuacaggagaaaaguaugccaggggaaguuuacagucgaucuugaacaccaucaaaggugaugaguggcagucaggacagcccuucccuucccuuccacuggaguuugcagauugcauauuuacaugcaugcacgagugaaugugacucaguuuugagugaauacaugugaaauugagauaguuccauuucgcagaaagaaagagagagagagagagagagagagagagagagagagagagagagaaggaaagaaagaaagaaagaaagaaagaaagaaagaaagaaagaaagaaagagagagagagagagagagaaagaaagagagaaagaaauguuaagguauuaucugagaagcacacucuuagagcuuuugacagguaaugaacaugcagacugggaaauauacauguugaugcugugaaguuguucauggagucagucaucagagaggcuauaacaggaaacaccaacuuacugucauucauggaaggcgaaagagcaggacuuguacuacccagacuuugggaaugucucaggaauccuguagugugagauugugucuucacaugaaguggcagaguguucagagacacgaaggcccuacauguaugaugucagagccaggcagacgcuagugucuguguggauggccacuguucaggugcauagagcaaugguguugcagagacacuugaaguggcaacagccuauggguguccuugaaaagaaguaaauggucuagagaauugggagacugcagggugccagguguggggaaauaaaagggugggagaaaugacccucguccgggccucuggguggguggacucaggagacugcugcaggaucccacauaacuccugagagacaggcauugggccguguuaggccacuggaccccauuccaugagguggggaaggcgcagucucggcucugacucucuggcaccacagaccauugaguacugcggaagagucagcucuggggucucugggccucacggaggccaaagacaacagguucacagucucagacaucccagaugccacuugaugucauguaagagcugagaaaaaagugggggucccgggggcugcucagucagccccagggccaaagggagaaggggcagcggggaaggugguuucugggugggcaagagucuggcuagcucaggcugucuagcuccgcaguuggcuuggguugacugguggccauggcuagagcucaggaaggccucccagcagaagguuagacaugcaacucguuagagggaaaccugcuccauugcuccaucccagcggauccugaugagaagagacgguccaugguuucaagguguuuacuguagaaaggcagagagagggagacaaguagguaaguagaagccagccauggccauguggaaagagggaagaaaaagggcgaaaggugagaguaagagcaagagcuuaagagagagaagagacaagaga

SEQ ID NO: 7412 - RNA, 681 nt, Mus musculus
ugaguugguuuucuuuccuuuauugauuacuuuaauuagcguaauuacaguauuuuggaugaguuauucuaaacauuaaauccuggaggguuuaagaaucuuagcuaacaaaagcaucuggaauagcugucaaauguaaguucucauugagguuccuugccuagcuuccgucuuccucggucccgucuccugagcugugccgagaggcagcggcuggcgacuaaccugacugaacugagaauccugcucccucaggcuuccacauggacagcucucacccaggauggccaagugcauggcggaggauucuucaggcuuuuaagggucgccuguugugcaauaagagagcgagcagaagcuugagacgagggaggaaccccuccugcaucuuguagguucaggacucccgguagaccagaagaaacuccucagcauugcagugaggggcagguggccgcuuggaaagcaagcucgaguacaugcguugucccugucaguggcuuugggagguaagaauauaguacaguuaccaaacacuucaggccuucggaggccguggagagcuguucugugcuggccaagaaacaaacaggcagaauguaucuguggugcugugugguuuucgggggucggggacagcuuguuuucuacagagaagccaguugugacauccacaaugca

SEQ ID NO: 7413 - RNA, 9970 nt, Mus musculus
cucccccuguuguguguuuuuauuauuuucccucuggcuuagaugugucaaucauucucucccugccauugguuggagaguuugcgucaaaaaguugccagagaggcgcuuucucagcaaaucucccugagagcggaaccuuccucagcuccaacucagccuccacuguuacuaaaaaauaaaaaucgcuagaggagcucagucgccaccucuacuuuguauguaucguagacggacacaagccuguuuacaacucuggccacuucauuuuauguuuucuuuuaauuguuuuuuuuuucugguuauguuugacuuuuuauggaaaggugaagacuacaagguuuuuaacugaaugcucuugauuucuuuuaggauagcuggcuauuuggaauuuugaaggauaauuugauuuuuuuuucuuuucuaacguccaaugcggcuguaagguaaguguccgucugucuugucuauagcgauaucuuuguguucccccaguccgcagugaccuccgcuccuccaaugugcaacucugcggacguggaacuuccuugggugggggcgggcgauguauuuuauuuuucuaaugagaauuuugagacgaaauaaugaccauuaggaaaaaauuugacgaucuguagaagagggagggagugggagggagcgagagcgcgugcuccugggggucgcugcuaccgaagaacgucgcagaaauccuaggagucuaaucugggaguuggggagggguuuuguucuuaugcccacgcuauucauggcuucuccucgcgagcuuugcauuuuggccccuagauugagcuggaguccuuagguuugguuccaagggcguauuuuagaauccaugacaaaauaaugcuuguguaauguaccuagguugguaaauuaaaacaaagauaauaagguggacgcuuccgaaagacggagcucccgaaggccggcucuccauuaucggcgggggccucgggcugccucuagacuccucgguuugcaacgggagccgaaaucggagcggauaaccgaggaggcgacagcgcuggcgucuuguuacucccgcgccgccucagcuccuguuucucguccucacuccccaagcuuaaugccccucugcucuccgccucuucucaaagccgcuagggcucuugaaucuuuuacaacucuccuccucuccaucccuaggggugcggcucccccaagccccagaacuguacacugaaagucggggcuucugggccagaucgccaggccgaggccgcuaguuggacagguuuuaaaggcgacuguggcuagugugguucagggcacgcgcgccucagccucugcgcgcaacugggacagccagaccugagggugggcgccuggaugcuccuggucagagaccccggagucccucccuaggaaggacuucgaguucuuaguuguuuugugucugggguagcaucguggcccguuaagcacuucuguacugccuuuucuggcuuggggacaaugaagugucguaggucaaggcugaccuuauacggaggggcucgccgaggcccagccccugcucucggccugcccccaaaacgaacuauuagaagguccccgcugacacccggccugggcgacgguucgcgcggcaaacuccgaagaaguggcgguguugaugcguucaagggacuauugaaagccaguguccgauuucacuggaaaaucugaaaaccuuagagccccaaaccgauuuggucuuuuggagggagaaggguguauggagagagaaagaaggcccagccgcguggaccacuuuggguggggaccgagaggaguugcucuuccuuggaaacugugcccuccauuccagagcuugggggggggggggugucaggauuucgucuguucaccucgggacuuuuuccggccacugaaaguuauuagcacuagaguggaguugggcgcaaacuccucccccagagaaagguagacacccaggccucuccuuccagaccuaacaccggggcuucuucgaacuauaauuaauagucaagagcaacccuuuggcacauuucuuucucccucccucgcggguggugauguugauuccccgaggccagaaacuuucacucgaguuggcgggccuggcgccggcuguuuuccaaaugcccgcguaccuccuucuuccuuucccuccggcucucgguccucuccccugccucaggccgagccgccagucagcgaaguuuuguuuccuuucuaucaugcagaaaauuaaucagccaggacgagaagcagagcugagcacgacggccuguaauuaagggacgugugccccucggauuaucucguuaguuuaucaagaaaacauuuauuauaauuaauucucggacgagguaauuauuauugagcgaggacacagcaacugguagaugggcuucuuggaagaaggggaaaaaaaaccaccaaggagggggggcgaucuggagggggaagcgacagauugcacgaauugaccguuagauauaaggcugugcaggccggcgcaggcaguggagacggggcuugggcaucagagcugcugaucugccggacugcagggcagagacgccggacccagucgcuugcuccuggaggagagagcagucggggagucgccgcgcuaucgcuauuugcuccuagguaugagcucucggaagccaucucuccucgagagcggucaccuuaacucuugugucuuagaaagaguccccacccccauuccccuuugcacugugcguggagaggaagcuagaauggaauccuuagcaagcggugaaaguuagguggaagggccccgcagccgucuuuauuaucuauccguguuuauuaucuaagcucgcuguggagaagugaccgugguuuggguuuugguuuuccuguuuuguuuuuguuuuguuuuauuccgcccacaucuccaggaggaaaagugaaaauaguuuucccugacaauuugagccguuuugacucuccaagaaggaccucgccccgaacuuucuguuacugcuuuuuauccuggaacaugccgcuuuuaucaaaugaucuguuuaggcgaucuaauugggugagagcuagacuaguaaauaaauacaugcccaucuuaacaucauauauaacaggucagaacuguccaagggaauaagaguguauuuucaaagaauuccucuuuagaggguauuuaaauaaggaacgacuggguuuuuaaagaaucuuacguucacaguuacaaauagcuagaucuuggaagaaggaacacagaauauaaaguguucuucgcaaaaguaacuaguuucacucguuaacaauccaguucucuuagaaggacauuuauaaaaaucacauuuuaggguggggaaauaagacuuguguucugaauguaaaucuggaagaaaucacagcuguugaguuuuguuugugaagcuuugccuuugucucuuaagcaagguaaauaugaaaaccuaaggucuuaauuuuuucauuaaugaacuuuaugaagugacagagaacucagucuuguauccgccauuuugaggaaguuucucagagugucaaaguuucaaagcagagagagagagagagagagagagagagagagagagagagagagagagagagagagagcgcuuuaagugccuuauuuuuggaaaauaaaagccagccuuacacacauugccugccuguauuaacaucgauggggggagggguucagcaaaggaacacagaugacuuuucuuuuucuccccccacccagcuccuuuucuuacaaaauuguaggaaauuuaaaaagcagagagaagugcgguuaguuccauugcuuuggauguuuauugacuucaaaccuaaauauaugggaaagguggcucccguugcagcccccucuccccccaacccaaaauccaagaaaaaguguuucccgcuggaucuguagccuccugacauaaaaaacauggaagcggcuugcuguaggaaugcaccccucuggacuugcaaaaugugggggcagcaguuuaucugacuuuacuucaguuaggauucuaacuuaagcauuucugucaagcccugugcuagucuugaagaaaagacuuuuuuuuuucccucucaguauguuuaaauuaaauauuugaugggugucgcuuaaaaguuaaauaguuguuuguuuagcuauaguucuuuagacacauguaaucaaacuccuccaaaacccuaauaaaucuguuacuuacuucgaaaucuaauuauccagacuacuaauuaggugaaaaugauuacuggaaaugacuucaaaugugggauaauagugauugggcaguuuucacaaguuuguuguucagcaaguugguguuuuaaauguugaaugcguuuacauuuuagguucacagcaguugaaagugguaauaauuuaaaaaaaaaucagcuaagauaauuaaaaucucugccagggaaaggcaacagucugggaagagguagauuucuugaauuguuucuuuguuucucaccaaugggcuuuguuaucagcauuauuuauuuagccaaagaguucuuugucucugcaaauggccccaaucaaguuuuguuugagacaauuagcuagugccagccaaugaguccuaugcaaauguuggguuaggaauguagagcgugcauuuggaggcgugggguuuuguucuuggggaaggcagauuguaauugcuuuccucgggucgguuuucuuucuuucuuuuuuuaaguuuaggguggggguggggaagacagguuuaucuggucucacuccauccccucuaguuuuggagcugcuggggggugggggggacggcgggggugggggacgcaucugcaacuccuuuaaaagccugugcccagcgucucccggguucuuuuuaguuagugcuggaacguggaggaagcugcucccuccgaagcaguaaaccagcauuucuguuuguuuguuugcuuugcccuuaguuccgucacuccaaaucuacccaccaaggacccugacccuguccacuccaggcgaaucgagaccguccggcuggguccccccaauuugggccgacuuugcgccuccaaacaaccuuagcaugaugucuuaucuaaagcaaccgccuuacgcagucaaugggcugagucugaccacuucggguauggacuugcugcaucccuccgugggcuaccccgguaagugaguccgcggccuucuagacgcccuuccacacgcccgccccucuggagcuccgagguuggagggcgcgcuguccucacucaagcucaaggcgggguucccgauguauuuuccuugcuaccaaacugccgagugccacagagcauuuacugacccaagagggaacaagaggcugggaagaggcgaaucuggggucugcagaaguaacagagaaucacaccgcuccauucuuaacucgaguggcuuggcgacauucauugggcuaggucguggaagguuguugaccuugucacuugagcacgcucuugcguacguuuccacguccaauuccuagcuauuacuucccugggagcaaccgaauucucuccccuacugucccuuccaguuuucccuggccaggggcuuccagggguuuccgguacgucgaugcccugucccuuuaauccuuagagguguggcuucccuccaggugccagacaauuuucuuuucuagucagauuccucccuccccccaaccaaaaacucauaaaaguaugaacuaugucccauuuuaaagauaaaagaacaaacgucccugugguguuaaaauaccgugggaacuggcucggcguucgcugcgucauucugaaccuuugguccucauagagccuuuaacuuuacuagucagccuuuucuggugaugugugugaucuagagguuguuauuugcuuguucguuuccagaacugggcguggggaugggaauuguggcuccuuguuuuauuuuguuaguuccucaaguaauuuguagcuggcgucggggggggggggguuggaggggaccgcauuacacugggaggucguguguccugugaggcucuggaagggguggggauacuggguaacgcggugagaggagggaggucggggagucugaggaccgaggcaaaaguccugugacugagaaacugcucccccacccuaaagggcccugggcuucuuguccugcagccaccccccggaaacagcgaagggagaggacgacauuuacuagggcacagcucgacguucuggaagcucuguuugccaagacccgguacccagacaucuucaugagggaagagguggcacugaaaaucaacuugccagaauccagggugcagguagggcagauguagacacuuuucaaucuugguuuauacugaugacccaaugaggccuugucccagaccaaagaagggcuugaaauucuaaacccucaggagccaggggacuuuuuacuucccuuucucuuccuguuccuccuuaaucauaugaaccagggucuuuuagccugguuuccaaggcuggaagcagcacuucagcugcaaugagaaagucuuagaaccuguaggucgcaagagucccuacaguuggagaugcaacacagggcagauuucaaagguagucaugugguccuuguguggcaauccuuuuuguggacuuuuauguugagggagcaggggcguggagcuuaguuccuggacaguccaaauuuuaaacacacacacacacacacacacacacaaacacacacgaagaaacaaagcagaugacuuuaucaaggccauaccuaauuuggugacagaaucagaaaaggugcucuuagcaaauaaguugacaaaaaaaaaaaaaguggugugucuguuuguggaggugacuucuggaggacagaacucaguuuucuagcucugccacuuagcagacuacucacaguaucugugcagauacucucguuccuuauucuaauuauccccauaguugauucugaaagggagaaagucuaccucucgacuggagagcaagcccuauauggaacucuuuggugcuuggccccucauuccucccauuuccuccccugacacgcccacacaugacacccuuccuuuggguaugauaugguuuugaaggugccagacaucagugugaacuacaaagcagaaaacuggauuuuucaaaguggcuuggaaaaaaacuuuaguacuuguaagucuugacccaaagccuucacgagaaauaaacuggcuccagauauuuacugcuacugagaccagcccuggugggagggggaaacugcuuuugccauacuuguaagacccaaacuggaaaacuccuucaacagaguaaucaaggaccuguagccaauggccgagugugguggguuuucaccuuagcacuagggaggcagaggcagguggauauuggaguucuaggcuagccuuaucuacaaaguuccaggacagccagagcuaugaagaggcagaaccuguagcuaggucagaucucaguuccuagcauaagcuccuacauggcagaggaugcauaaggcugcugcuaaagagaguuuucagauuggcaggcugaguuuuaaucagugaauugauguagagaacagaguacguugugcgugaaucugaaggcaccaacuugaaucuugaagacagauauugaggucugucuuugagcucaaagcagaaggcauacgagucaguucauucacuacaaaggggcuuucagcagacacuggcucagaucuccucuccacaggagcaugucuucuuggagauuucuuuuaugagucuaggagagacaaaauguuaggucguggaaccagccuccauauuagcuauugcuuccuggacagugcaauguaaacuguuugaacuuagucugcucugggugacaugcaacaacagaauacuuccuucuauaagacauagacauagucaucccaaaauacagugaguucucuucucucuucucucucucucucccucucccucucccuuccccgcccccgcccccccccucucuguguguguguguguguguguguguguguguguguguguguagaggaaacgaaauagaaagcaaaguggagaauuucuagcuuacaauuaagaguaauuaccuuacauuuucuuguuaugaacuccgcauaagguggacuuucccacaacaggagaaauagaggugagaggguuuuaugaguagucucuaagcagcaaaggaaauugucugauuauuuagccaugugaucugggaugacucuggaguuguguccauguuaaagaaguuucuuucccuuucaagguaugguuuaagaaucgaagagcuaagugccgccaacagcagcagcagcagcagaauggaggucagaacaaagugaggccugccaagaagaagagcucuccagcucgggaagugaguucagagaguggaacaaguggccaguucaguccccccucuaguaccucagucccaaccauugccagcagcagugcuccagugucuaucuggagcccagcguccaucuccccacugucugaccccuuguccacuuccuccuccugcaugcagagguccuaucccaugaccuauacucaggcuucagguuauagucaaggcuaugcuggcucaacuuccuacuuugggggcauggacuguggaucuuauuugaccccuaugcaucaccagcuuccuggaccaggggccacacucagucccauggguaccaaugcuguuaccagccaucucaaucaguccccagcuucucuuuccacccagggauauggagcuucaagcuuggguuuuaacucaaccacugauugcuuggauuauaaggaccaaacugccucuuggaagcuuaacuucaaugcugacugcuuggauuauaaagaucagacguccucauggaaauuccagguuuugugaagaccuguagaagcuauuuuugugggugauuuuuaaauaugcugggcugaacauuccaguuuuagccaggcauugguuaaaaaaguuagauggaacgaugcucucagacuccugaucaaaguuaccgagaggcauagaaggaaaaaggaaggggccuuagaaggguccaucaaccagcaaccugaaauggacaaaccaaucuacuuaagauucuguuauaguucuagaucauugguuuccugauuugcaaaugauugaucaaauauauucuagcgacaugcaaccaaauaccacucaaaacaaaaauccagcaaaacugaguugugagggaagggagggaaggucauggccuucaaagcagaggugauccgguguuuuagccaaucuuugguugaaucuuaggaauggacaaugucccaggcucauucacguuucaugaccaacagguaguuggcacugaaaaacuuuucagggcuguguggauugugcgacugauuguccuagaugcacuacuuuauuuaaaaaaaaaaaaaaagauaccgcucauacggagucaauauguaguuuaagagacaaucagugugugucuuauauaaaugguacaucugugguuuuuaaucugugcuagacuucaaaacugugaucuccuguuauuguaugcaaccuugaacuccaccuccgcagggguucuucugugauuaaauagguuauaauuauaagcaaaauucagagcaacuggauacugaucuagaaagauuaccuugggcuggaggugagcugcccugcugucucuggacaaggaucgagaagaagcaaaaggacccuaauucacccguaauuuaauguugguaagccuggcaguuuaaaaaaaaaaaaaaaaagacauuggucaauugcucugacccugaugacuuuuaagcugagaucauugucauuaugcuugcagauguuaacuggaaguuauauaugcauaaacccuuccuggauuuggcagauauguauaauuauauuaaaaugguucuagcacaac

SEQ ID NO: 7414 - RNA, 587 nt, Mus musculus
cagaaggcuggaaagcagcuagcauggcagaugaggaggaagaccccaccuuugaggaggagaaugaagaaauuggaggaggagcagaagguggccaggggaagagaaagagacuuuucucgaaagaauugcgcuguaugauguauggguuuggggauggccagaauccuuacacagagucaauggauauucuagaagaccucaucauagaguucaucccugaaaugacucacaaggcagugucgauuggaagacaagguagagugcaaguugaagauauugucuuccuaauucgaaaggauccaaggaaguuuucuagaguuaaagacuuacuaugaaugaagaauugaaaugggcuagaaaaacuuuugacgaagccaacuauggaucuugacaccguucguacuucccgagauuuugguauuuucuguagaagccauacauugaaguuguugucuguaguaacaugauagcucgguaugcaaugaaagaggucuucaacuugagccucucguugccugucuuuaucugaccuuaucugaauugcuuccuggcuuuaauaacuccuaaguuaaagcauugcaaac

SEQ ID NO: 7415 - RNA, 56385 nt, Mus musculus
agcucacuggagaugcucgcucuuccgggugaggugacucaagucucccggucccuucaagagauuaaaacacuccucagaaggucuuaagaaccuacacccggaaucucaagggacuggaauacucuucucgcccacuuccgggacggcggcccgcgaggcucaagacgcgucacccugucgcaaacgagcgccuccgcggcccgcucgccgcucgcuccuuucgcccgccccgcgaagucggccgggcgcgcgcagccccacuuccggcgugcgaggcggugacaaugggagcggcgcgggcggcgccgggaggcagcugacaggcgucugcggcuccgcuucauggcugcucucccucucugccuucgcugugugaggaccggggcagccagcagcggugcgcagcccgggccggaggcgguaggccgagcugggacuggugagcggcgccgcugaggcgcagcaugugaagcggagacggccucgagcgcggggcgagccucucagccggccggcauggccacgacggccgagcucuucgaggugggucccggggcucggcgggcggcggcggcggcggcgggggaggggcggguggcggcgggacgcugggccggcucggguggcagggcggccagacgucccggagaccggacgggcagugggcagggcugacuccggagcccagggccggcgagccgggucuugcugugcggauccucgcgacggugcuacagggggcaucugaauggagacucuggggggcuccucggugccgagguuccgacaagcucagaagcggcccuggggugccugccgucuuaccuuacagucgaaaaggcugggaggauucuuuuaaggacaauaaaggccuacuuagccucagcacggaagggaagcgacacaucuuacugcauuuaauugcuguggaacccuccgacugcuaguuaaaggauccuugggcugugagaagcugugggagcguucaggugcauuuucuugaguguuucaauauuuaaacuugacaguuggauuuuguggcgugucagugucagaagcggugagguuugagauaauggaaugggguuacaagacaaugaaacaguaucuucuuguguggaaaaaaauagaaguagucauaugaagaaaaaugaggaauacaccuucucccccgcuggggcgugauuacuccauagcagcagaaguguaaguuguagagaacacugcaguucacaguuaagaaugucaccauaggugaaaauuguauccauugagcaucagcguguucuguggcgugaauuuuaaaugccauuguuuccauuaaaaaaaaaaucuaacuuuucaguuacuuuuuuuuguuacugaacguugacuugcagucauuccuagcauagauacugcauuuguuuagagaaauagcaugccuaaauuguaaguuguaaugaaagugauuugaguaaaaguuauaauuacaccuaggaaaaauuuauugcuguuccucagauguaaaugucuggagauauuauaacauuugcuucaccagucauaaaauucugcucauuuacuguguauccuuggucaagauacuagguaauucuguaauuacuuguuucaauuuuuauaucuuacaggcuuugggaucuuuaaauaauacuuucaugacgagcuacuuauuaacagaaaaacaguauauuauccuacuguuauagugaauucucuuuaacauccacaauuuccucuuggauggaaaauuauauuuucuucuuuagacguauaccaagaugucuucaguaacuuauucgaaaauguguuuucuuucucagggaugaagaaaguggggguggggggaaggggugaagaaauuuguauuuuguucucuaagucuugucauuuaguggaguuguuaaaguuguuuagcuuagugacagcaguucuguaggagagaaacccaaugaugauacaguaaucggaagauucguagaacacacaggcauauugauaggucucauaacuggagugaucccaacucugucauuuguaguuguuguuucaucaaaaucagaaacauaauaauaguuacaaugaaguagugccaguuaugcauaauuaagucuguuuguccuuuccugugagucuaacccugcacuagguucugcuugugaauaaaccuucauucuccaagugaaaaguuaccuuuuuuuuuuucuaauagaaagggaagaaggaaaaaggcccccagugucugcugccauuuccugcagcuacugcuacaaauauggguugcagauuaagucaggcugugucuuucucuccuacuucccauucuaagucacagcuggagagcaagggaaacagggcaggauguagucaaggauauuuuguuuuuaugcauccugguuuucauguacuucuaaauagaauuggacuuccauuuuccacaucagagaaauuaaguggaaacaaaguugagcuuugaauuuaugaaauuucauugcuaacucugcuuuuuauaaaaucuuauuacugguuuggugacucauccuuuuuuaaacagacaacuucugacaauaaaaucaaacuguaaaucuuuacucaguugacgggaugauuuauuacuaggugacucaguuauuacaauaauguauauccuggaaguugcccagaauaccuucuuaauuucauuccucguugacaggucuuucugaaggaaucugucugugguguuuuuaaguaauaaacucaggauggccuaucugaacugagauuccucagugguuuggauagucagcauauuaaaacauggcuugagugguaaauucuucuguugcugccuauauugcucuuuuucuauguaccaccgaagauacuuccuucuccuuuguugacugucucuccugucauucuuacugauucuucacauuucucuugguagguuacauuuuauaggagaguucuuuguuaaaaacuagggccaguuauucauucaguaaauauuuuugaguacuuaucaacuucaagauaaacugcuaaaauuaacaguauugaaugucucaucagacaugccacagaaaagucuauucauugguuaaaagauccugaaguaaaaaauuauaguugggguagacagaugaguuaacugauaacauggugcagaggaaggucagacuccuucuccugggguaauuagggaaagucccacauacuaauaguaucccaaguuagguguuaauagaugagaguagaaacuucaagcaggaggguaacuccagcuuguaaggggaaggguagaccaguuuggucuacagagugaguuccaggacagccagggcuauacagagaaacccugucucggaaaaaaaaaaaaaagaaaaaagaaaaaaaaaagaaagaaagaaagaaagaaagaaaaagaaagaaagaaagaaagaaagaaagaaagaaagaaagaaagaaagaaagacugagaagagggaagagggcaguguguguguuucugugugugcgugugcgcgugcacguuugugugugaagaaaguagugguucaggacaaguguuugagaggagagggagaauuugaggaaguuuuaagaaaguuuuuguagaucauguguaaaggaguugaugacuuuuuccuaguaggcuuacaugagucauaagacuuuaauguuauugugaauaaugacuuucaguguggauuauugauaucugucauuguuacuaauaacuguucuugacauuugucaauccuuucaaauugucuguuuuugauuauuuaaccuagaagguaaaauucuuaaacuaauuuauuggagacagaaagaugaggauuugggaaggcauuuuggaaaagaacaaagagaauuugguuacagaggaguuaguuuauguguguucaugaaguugggaaaggaggugguugaugauacaugaaccagagcaaagaaaacauaauuguguguuaaggagagaaggaauauguuuuugucugucuguuuguuuguuuuuuaaaguauaugcuaggcuggaucuaguggguggucuguaaucucaguuacuuuagagaccacugcaggauugcuaguugaagacaauaugggacaauuuagauucuugucucaaaauaaaaagcaagaaagacugagguucuagcugagugcuugacacucagggcacugaguuaaauccccaauguugcaaagaggaggaaaaauguauagauuaaagcuagggguuguagcacauaccuguaaucccagccuuggaagguggguagaauuaggaguucaagauauacuuggcuauauucaaaacccuaaaaauaaacaaaacuacccaacuaguuguagcaguuuugaaauuauugcuuuauauagagaauaaccuaggccugggaaugaauggcaccccucagcuauacgucucagcagcuggaugggggagcaaacuaccuaucuccuuugucucugcauucucucaucucauagcauggcuaagagaauaaucauuucuacuucagaagaagguuauuuugaagauuacuuuauguuucuaucuagggguagagagaaugaagaguuaccuugaauuugacaaacuacuuagaagaauacaguucaaagaaugguagccacuuggaauuuaagugaauuaauaggaaggagggaccuggcaggguaguacauacuugugauuauggaauugggguugcagaacaggaagagugugaguuugaaggcagcuugagcuacauggugagguguuaaaaaaaagaaggaaaaaugagauugagggucucuuagcuuuuuagaggugacugaagucauccuagagauagugguagccaacuacagugagagagacuugaagaagugacuggaagguuauagucauggugucuacaagauuugucacccucuaacacucuuucuugugggucuaugccuuuucaugaguuugaaaguugaagacaggcauuuauugggugagaggaaacacacacauggcagcagacacacagaaagacuucucagagcagaagcggacucggaaagccaaaucuccaggauguuuuaaacucaguaauaaaacaaacuuggaacuaacuucucugauauucucauuucuuggaauugaaaucaaguaagaugagaugaaagaguugagcuauggugauauuuaaagaucauucuugcuuuaaaauuuuaaaucgaauucugugacucucuucaaucauguaaaagauaccauuacauucuuuacuuuuucuuuggaaccugaaauaucagauauuuuucagaaauaaagcauauucucucaugggaaagagauuuuacuuaauauaaccuaaaaaaauugaugcauuuuaacuaccaccauucagucuuuuaaaacauugauaccuccuucaagacugaaucuuguauagguaguuuacaaaaaacauuuugaaguuugucuugauuuuguauauuaaugggcuuuauuuuucugccuucccguauuaguuugagauccauuuuugcaaucugagaaggauuuuauagugcuuuuuaaauaaucaauaauuaauagaguuuauuaauuuauagacaauaggacuggagagauggcucagagguuaaaagcacugacuacucuuucagagguguugaguucaauucccagcaaccacaugguggcucacaaccaucuguaaugggauccgaugcccucuucugguaugucugaagacagcuacagcguacucaucauauaauaaauaaauaaauaaauaaauaaauaaauaaauaaauaaauaaauaaauaaauaaaauaaaucuuuuuuaaaaucguagaaaauguauagagaauaucauuaaaaauugaauggaaauagagaggaggacaaaaucauucacuuacaguguuauuauugguuaggcucauauuucuaauauaucuuguauauuauauauuguauauuagaccaugcacacacacauaauagaaggcaaaaauggaugggugagagaagagagacugaaguaagcauguaauauugguuaaugaacucccauccucaagcuccuuuauaacuggaaugaaucuauucaugaagguagaguuuucgugaucuaaacacauucaguuauaccuaaucgcacaacacugcuucauagaggauuacauuuccaacacauuuugggaaagagucaaagcuagaaguuguguuaauaggaagaaggcauccuguagaguaaguuacaugaccacaaguuagguagcuggaguggugugaguuguagucugcugaaaggcugaugggagucugacuauuuggggaaaaagaaauaagggugaguggcucaagaugagcucuaaagcucacagagaaugugaacucaauugggauugcuuagggaaguuucugaauaaaaggaaggaagcaauguuuugauaauuucuuggcagaaauaagcauugcaaauauaagggaaauaggcaacaggcaggaguugaauuuacaguuuuguuggccuaaaagaauaccaaaauacuugacugaaaauuucuauucuuucaccuaaauugugggggaauuacucugguuucuuugaguguaugggucguuugcacauuauauugaucuauuuuggagguagugguguaggaaaauuaaaguugauuggauuuguauucuugauuaaaagagauaauuuccaagagauuuucaguagggaugagcaaaauugcuuugcuuugucuuucaguugcuaauguuuacaccguagucaauuauguggaauuaaauauaaugugauagcacauaguacuuugacuuuuauugcaguuuugcugaaucaaaaaaauuuacuauagccaagcaaaagguauaauauaaaccuuuacuauucuuaugaaauucuaaaagguuguuuucuuguucauuuuguuuguuuugugagaagccuuuugggagcacauggccuguucuuuuucuguaacaccaaccuggcuuuuuaacuacaugcuuuauauuucacucugauaccuaaugaacaucuguaguaugauacauccagaacaaaacucuuguuuccuuucucucuuacccaucuccuucccugguuuuuuccaacucgauaaaaaguacugcuacaucuuuguucaaaccauaaaccuuuaagaaaauucuguuucccauuuccuccuuucucuuuacuuccauuccuuuagcaguauauaaaugccucccuuaagacuauaagaagccaugucucagcacucggggggcuuucugccacuuucaccucuuugacaguauuauugguugcauccucuuuuuuuuuuuuuuuuccucuuggauauuuuuucuauuagauauuuucuuuauuuacauuucaaauguuauccccuuuccugguuuccccuucgaaaaccccuaucucuuccacucucccacugcucaccaacccacccacucccacuucccggcccuggcauuccccuauacuggagcauagagccuucacagaaccaagggccucuccucucauugaugaccaauuaggccauccucugcuacauaugcagcuggggguccuuccauguguacucuuugguuggugguuuagucccugggagcucuggggguacuggcuaguucguauuguuguuucuccuauggggcugcaaaccccuucagcuccuuggguccuuucuuuagcuccuccauuggggacccugugcucaguccaaugguuggcugagagcauucaucucuguauuuuucaggcacugguagagccccuuaggagacagcuauaucaggcuccugucagcaagcacuuguuagcauccacaguagugucugaguuugaugacuguauaugggauagauccccagguggggcagugucuagauugccuuuccuuuagucucugcuccacauuuugucucuuuuaacuccuuccacagguauuuuguucccccuuauaagaaggaccuaaguauccacacuuuggucuuccuucuucuugagcuucauauggucugugaauuguaucuuggguauucugagcuucugggcuaacauccacuuauuagugaguauauaccauguguguucuuuguguuucgguuaccucacucaggaugauauuuuucuaguuccauccauuugccuaagaauuucacaaauucauuguuuuuaauagcugcguaguacuccauuguguauauguaccacauuuucuguauccauuccucuguugagggacaucuggguucuuuucagcuucuggcuauuauaaauaaggcugcuaugaacauaguggagcauguguccuuauuacauguuggagcaucuucuagguauacucaggaguaguauugcugaguccucagguaguauuauguccaauuuucugaggagccacugaacugauuuccagagugguuguaccagcuugcaaucccaccagcaguggaggaauguuccucuuacuccacauccucaccagcaucugcugucaccugaguuuuugaucuuagccauucugaaugguaugagguagaaucucaggguuguuuugauuugcaucucccugaugacuauaaauguugaacauuucuugaggugcuucucagccauucgguauuccucaguugagauuucugggugccauugcauuuggagcauagauguucagaauugagaguucuucuugguagauuuuuccuuugauaaguuugaagugucuuuccuuaucuuuuuuuaugacuuuugguugaaagucaacuuuauucaacauuuacuccagcuuguuucuugggaccauuuaccuggaaaauuguuuuccacccccuuuacucugagguguguuuccuguaugcagcaaaaugcuggguccuguguacauaugcagucuguuagucuuugauuuuuauuggggaauugaguccacugauguuaagagauauuaaggaauagugauuuuugcucccuguuauuauugauguuauuuuuauguuugugugguuaucuucuauuggguuuguugaaagaaaauuacuuucuugcuuuuucuuggcuguaguuucccgcuuugucuuggcauuuuccaucuaucauccuuuguaggguuggcuuuguggaaagauauuguguagauuugguuuugucauggaauaucuugguuucuccaucugugguaauugagaguuuugcugguuauaguagucugggcuggcauuuguguucucuuaaggucuguaugagaucuccccaggaucuucuagcuuccauagucucuguugagaagucugguguaauucugauaguucugccuuuauauguuacuugaccuuuuucucuuauugcuuuuaauauucuuucuuuguuuagugaguuugguguuuugauuauuuugugacaggaggaauuucuuuucugguccaaucuauuuggaauucuguaggcuauguuuaugggcaucucuuucuuuagguuagggaaguuuucuucuauaauuuuguuggagauauuuaccagcccuuuacuuugagaaucuucacucuucuauaccuauuauccuuagguuuggucuucucauuguguccuggauuuccuggauguuuuggguuaggaucuuuuugcauuuugcauuucuuugacuguuguaucaauguuuucugugguaucuucugcaccugagauucuuucuucuaacucuuguauucuguugaugaugcuugcaucuaugacuccugaucucuuuccuagguuuucuaucuccaguguugucucccuuuuugauuucuuuauuguuucuauuuccauuuuuagauccuggaugguuuuguucaguuccuucaccuguuugguuguguuucccuguaaguuuuuacagggauuuuuguguuuccauuuuaaagucuucuaccuguuuaccuguguucucuuguauuucuuuaagggaguuauuuauguccuuuucaauuuccucuaucaucaucaugagaugugauuuuuaaaucagagucuugcuuuuuugguguguugggguaaccagaguucacuguggugggagaauugguucugaugaugccaaguaguccuggcuucuguugcuuauguucuugcacuugccuuucaccaucugguuaucucugguguuagcuggucuugcugucucugacuuuggcuuguccuuccugcaagccugugugucaguacuccugagagaguaguucucucugggaggaauuuggguaugaagaacugugguacagggucagcucuggguugcagacagagaccagaaggauccuguacccagcuuauccuugguuccuauguccugaugacucugugaguguuccucuugggccaggaauuugaggagaugugguggucuuaccugggcuugcaggaauguaggcacuccugggagaccagcucucuccuggcaguauuuguguauguaucucuguggcacaggaucagcucugggcacagacagagaccagaagacuccugucccaggcagaccuguguuccuguguccugaggguucugagcagguuccucugagcagcaguggagguccuaacugcacucacaggccugcccacacuccugggaggcuugcucccucuuggugcuauuugaggauccaguugcauccucuuaaaaacaaauacugagacaguuuauuaugcagcacauuuauuuggagguaccugugcuuugaagagguaaggugaggaaguaaaauaggacauauggagaagugaacaucuguggcccugugugauguugguaacaccugugugaaaaguuacaaaauuaaaaugaccugccacuuugucugguuuugaccagacagaucaugucuuucuuuguaugcuuaucucagucauuggcaucauguuacauuaagauagguaugauauucagugaaaugccccucagcaccugaggggaucucugagaacacuaccagguaaaagcacuccuaccagcucaagucccuuuuuucagggagaacuggagggcaacaucacuuuccacaacaggccagucuuguguuacuagauucuauaccauauucauuugacuaacagauccuccagcaaucuaauucauucucauggaggaaaacuagaagauuauuaauagaauaaauuucggguaucccugugguagauagaugguuucaaauugcaucugaaccuauaucuuuucucugugaucauucugauuccagcuuacuuuuagauaauauuuuuacuaguuuuacuguuuaaacuaguuaacauagucuucuuaggcuauggugacauuuauugauugagggaauugaucuucccaacagaauuguuucugugacaccuaaaauacuacuagucauugcuguagccuaauagaaccucugcuuccuuuugagggccacagugauugcuccugccaaagguggaggccagaagggggcaucagaucccuuggaacuggaguuacaggcaguuaguugugagaucccugacacagaguccucuggaagaacagugagcagucuugacugcugagccaucuuuccagcacaugcaaugcaguuccuacuuccuuuuggcuuagacaaagcauuucuccuuugguaccaugauaucuuucacugaagacaugaguugagaacaauuagcagauagaguaggcaggggaguuuguacuuuacuuuuuauuccuaauccuaauaacuuuucuguuaagagaucaacauuaaagguuuuuuauuuggacuauauccugcagcuuaagagacagagaguaccgccucugaacuggugcuuuuguuacaucugaguguaggucuaguuggauuauuauaauauuauaauaaauuugaguccucugucccauguuuaucuuaucuuuugccuggccauuauugagagaauauaguacaacacauuaaagauaaccuuagaagcuguguugauguuuuauuaaggaauaaaaacagcaccuucuuuuuggguuaauuugaccaagagugagcccaaauuucaauucucugcuuuucuccccaugucuguagucugguuacuggccuacuacuuaucuguaaucuuucugucccuguuacuugugucugucuuguccccaaaucugugccugucccuaacaaggggcuuuguuccauauuuauugaaaagcacaggaaacauggcaugugaacagaaucagagauacuuucauagaaaucuuuaacagaguauuacaagagaaguuacuuuacuggcuccagcugacucuugaaaacacuacugcaaacagacaucauuaagcuauauccagauugcuuccaacauuuauggugguuauuggaugcuuccaacgucuuggcugcuuucagcaaaugauuaucacaaacacaugcacaaauauauuacuuuggguaaggguagaagacuucuuuguucacuuauuuuuguguguauucuauagaauuuuguuuuuauuaugaggcuuguguuugaguucuuaucacacucuaguuuaaauuuauaucagcuuaaacucaauaaauuacuaacaguguucuacacucaucucauuuaucguugguaucacaaaauuacauuuacauauuguaugccccaaacguaagcuuauaaccuuugaaauauguuaaucgcuuacauuuuguaaaaaacaaaauaucaaguuguacccaaaguuauuuuuuagacuaccuaccuguuaauuuaccuuuauuagaacuuuuauuucaugucuuagguuauuagcgcccauuuauuucaccuuauauucugggcaggucuagugguaauacacucuuaucuaucuaucuaccuaucuauguuuuaaaucuagggaauuuuaaaaaagauuuauguauaugaguacacuguagcugucuucagacacaccagaaggcggcaucagaucccauuacagaugguugugagccaccaugugguuguugguaacugaacucagaaccucuggaaagcagccagugcucuuaaccacuggcccaucuuuccagccuuuaaaucuagaaacauuuuaauuucuccuuugcuuuugaauaccgauguugcuggguauaagauucuuugacagcuuuuuguauagcacuuugagcugauaagcaucagcuuccaaugugauaucaaacccugcuaaucaucuuaggggaccccgugaccucauuuuuuucaugcugccuucacaagucuuugcccuucagaaguuuaaaagugcugggauugcaggcaugcaucauugccuaacaugcauauuugcucguuugauuggaccuucuacuucaguaacuuaaacaguuguaauauaauaaugcuuucucugagaaaauuuaauaugcuuguuaucaguguauacauguuuucuuguuucauugaauguugcuuuauguguuuuuuuaauaaaacguagcuucucaucuaaguuuaccuacuuuguuaagugcaguuucauuaaauauuuauguaaguuguuuucaguauuacacacaauacauaguuauuccaaaaucuuuuguuuauauauguauuuccuugaaauuuuauuuaauuuuaauuacugauuacaauuuugagacagggauugcaaugcaaccaagacuggccuugaauuuguuaucaugcugccuggaucuccaagugaucggagaauaaaauuaugggguuaaugcucugagcauuuauaacacuguugauuuuaccaaaagaccugccagcugucuucuuaaaagguuguaucuguuaacauuuuugacaguaaugaaagugcaaauuucaguuuacuuucuuuuggccacauugagcucuguaauuaaaauuauauuucuugcuucuuagguuaaaaaauaauaauaacuugcuggaugucauguggcaugggucuuuaaucccaccagcacuagcaaggcaaagacagcaggaucucugaguuuaaggucaaccuggucaucauaacaaguuucagaccagccaaggcugcauagugauaagcuaugccccucauccgcacccccccccccgaaaaaaagauuacuugacuuuguuuguuaauaaagcuguacaugugcuuugguuuugguuugggagguugguugguugguugguugguugguuuuuuuuuuuuuuuaaauaaauugccuccuauguucuuucaucguuuucaauuugguuccuccaacuaaucaguaaaaacuuuuaaaaaaauauguuuauucugugaaccaggagccuuuuguggccgaugaauacauugaacgucucguguggagaaccccaggaggugguucuagggguggaccugaagcuuuugauccuaaaagguaaacuuggaaaaaaaauccauaguuccaauauaguacuaaaaauuguguugagaauagagauggcugaauuggaauuacuuugaguauucacugaaaaugauuuuaauuaacaguuuguucccaccucaaaaaaaaaauucuuaacagcauuagaagucugaaauuguguuuuuccuuaagcauguuagccaauugaauaaaagaauuuuauccuuuauuaagaauuugauuuuuccauuuaauauuaaauuagaaaaggcugguuauacuucugaaguuacaagaugguuggguauaguaguguauacaugcaaucucaguacuuuagaggcugaggcaggguucugaguuggaguuuagccuagaauaugugcaaaacccugacucugaauaagcaaauuaauaauaauaagcuaacuacauucuuuuaaauuuaauagcuguaaaucagggaaacagagccacuaaaaucuauaauauauacaguuuuuuguuguacauuagucuucuugaauuuuaaauaaaguagagcuuguuuggauauuuaauggggauuguugagguuuuuauuuaccuuagagauaauccacugcaaagucaauaacaacuggcugaauuucuaagugcuauguauugucaaagucacgugaccuguucaaagugaaaagaaaguuaggacauuaaagaaauugcaacaagaugcuguaaagaaaaugaauaugcaugucccucucucaaaggacccuuauuaaaaccuucauaaaguuugucuguuccuuaugguuacuggcaggcaaguugguugugcuauuauuuuccucuauuagguuauuagaagaauuugugaaucauauucaagaacugcagauaauggaugaaaggauucaaaggaaaguggagaaauuagaacaacagugucagaaggaagcuaaggaguuugcuaagaagguacaggagcuccagaaaagcaaccagguaugcauuuggcuaagaacgaggaguuuaauagacuacaccauugccauuuuccuuagagaauaguaucuucauuccuuuuuagcuuuaggcuuuuuaagagucgugccaaauuacaguaacuucuaacucucugguccuauggaaaaaaaauuaaugugcucuuacugccuaccauuggcguugguguuggcauuggcguuggcguuggcuacuagauaaguucagaaucccagugcuaccuuuuucagguuagggguagaugcuugacagugacccuugcuucaccucuuauuaaauacgcuuucacaagacugacuagaccacagcccugcauuuuaagaaacaccugguuaguauugcuauuuaaguaucauuuuaauucuguuuaaucauaaauaagacuagaccuggaucaaguuauuccuuagagugguaguuuuuaaaccuuccuaaugggacccuuuaauacuguuucucauagcauguugaccuccaaccguaaaauuauuuuguugcuacuucagcuguacuauugcccuuguuaagaaucauaauacaaauauuugacauguaggauaucugauacaugacccccaaagggguugugaacugccaguugaaagaaauuugaaaguaguuucacaaaagucauuaggauaugccucagugaggguucuacucugugagaaaaacagguguacaucucuccucaguccacuuuccagaaacaccaagccacuagucugccccaggucuaugcuugacaacuucuuaacuccucuuagguccugacauucaccugaaugucugaaucuuccacuggcuugguuuaauuuggaauugaucuuuguuaaguguuguuuggagagcauugcugagcuuggcucacucucaggccggucuucagauucuauggaacuaguaagcuuguuucugcuaaugugucauuuauguauuugguuaaagaagucaauaauuuauguaugguaaguguuuuugaauaaccauggugacaguuuccuuauacuucuaauaaagcuuugcuuuuaguaauaaaaaauaacguuaauaguugagguaacaaacuagagccagucugugugaguuugaauuguaaccugaccacuaagcuaauuguauaauuucaagcaauuuaacaucucugagcuuccuguuuuuauguauaaaauggguugugauaacuaaauaaguaaauauauuaauaguaauauguaauugauauauauacauauauauaucaccuaugugauaagugauauauuuagaauaguaucugaugcaaagcaaguccucaguaaauguuucagcuuuucccccuuuaagaguagaacaaaagaauccuguugaauuaucagcaguuaucaauugucugcuauugacaaaucuaagggauucauugcauuguuuuuaauguguuguaggacaaaggaaagaaaaugcugaaaguaaaauaguuuugcuuuaguaaaauaauugcuauagucuaucuuguuuucaaaacuuggaaaaaacaauguuaucacaacuauuagugucacuggcauuuggaaggaaguauuaagacagucuugcuauguauuguagcucacaguggccacucccuugcauuguuuucuuaucucagugucccaugugcugaaauuauagcauguaucaacacacccagcuuagcauugccuuuuaaauauuuuuuaauguuaauuuuuaaaucaauuucuuuuaagcuucuaauacauuuuuuaaaaaauguuccaauuugguaacaagaguguucuuuaaaaguacaauuccaugagcuggggagguggcucuggauaaagugcuggcuaugcaagcaugagauccugaguuccuaaaaagcuggguucagugucugcauggaucuguaaccgcagcagcggggaugaggugaagagguggacaacaggcaggcucccuuugagcuugcauguugaaauggcagcaagcuguccaaguucagagagucccuguucacaauguaagguggagcauaagguggagugcaguagaggaaggcuccugauguugaccucagaccucuacacuguauugcauaggugcuuguacuuccccacaugcauacgugcccuccuccagaacuaguccucugauacuuaauuguuuucacagccauuuaggacuuuugggugucugugguaucaaaguuagaagcuugguuaagaguuuuuagauuguguugugcuagugaguaugaauuguuuugugguccucuuauaaaaguuuuguuauuguuaguaguggugagguugguaugugaucuaccauuaaugcccugagcugguaguuuacuuuuaguagguauuauauuacaaacuuaauucucugauuguauuuuuucugugcacaaauuccuagguugcuuuccaacauuuccaagagcuagaugagcacauuagcuauguagcuaccaaagugugucaccuuggagaccaguuggaagggguaaacacaccuaggcaacgugcaguggaggcacagaaauugaugaaauacuuuaaugaguuucuagauggagaauugaaaucugauguuuuuacaaauucugaaaagguaagcauugccaaaagaaauaaucaaaauuuaauugguuugccuuguacuuuucaaaagaucuauucauauguggggaugcacauaccugugcacaguugccuugcauuuuuaugaaguuacaauuaguuuguaaaugcugaaguaacuguauuuuuaaguauuucuuuauccuuuaacuauuaaugaaauguauauagucuuuaauaguuauauauuauuaggcgauagaucucaccuaaagugauaaugagcugaaaagaauuaaggcagcuuagaucaugaucauugaaaacuggguugguuauguuauuccugucauaacauagucaccuaaucgucaucuaaagcugugugcuguuggcuggucuacaaucuccagagaaggcaacuuggcuugcuuuccuccccuuaggggaaaaaggcauccucgugaaucauggauccuccuuguacuauuacccacucacgucuugaauacaguuuuaauccaaauuuacugcauacaacauuagauuauaagauguuaaaaacuaaguauuaagaaccuuugcuuugaauuaagcaauguauuuuuaugauuaggacucuauaaagccaaaggauuuauaauuuuuagauuaaaaaaaugguuucaugucuauagauaaucccucuaaagaaaagacaguguuuagaagauugaauuucaagaauuauagaauaguccugauaguaucaacaaaaguguaaugcuuaaggauuuguuaaauacuaguaguauuguuuuauauuuauucaaggguauauauuggacuugaacaguaaauugcaugucaggauaggucuggaauuuuaaagcuuuuuuuccuagauauuaauaaguauaacauaaaaguaccuauuuaaaaaguaaaaauucuguuuuauauagaaacaguuggcuauaguaaggccaguucuucagauuacuucugauuauaccuguugggucauaugcuccaaacaaaauacaaguaucuuaaucaauuguuggccuguuguuuuguuuugaaaauauuguuuuaauacaguauauucugauuaugguuuuucuuccuccaacuccuuccagaucauccucauucccccagccaccaaguccacgccuuuucuuucucacucauuaugauaucagcaggcaucuaaaaugauuauaauaauaaaauaauuauaauaauuguuauuuuuauuauuguuuuuauuuuauuuuuauuuucuaauuuaauaauuauuuuaucuaauaguaauggcuuauuauuauuaucauuauuauuauauaaaauaaaagcaagcaaaccacaguaagacaaaacagggaaaugagucaaagaaaaagcugaaaaaacauagaugcagaaaacacacaaucacacauagaaaucucauaaaaauagaaaacuggaaccauaauauauauacaaaggaccuaucagauuaaaaaacaaaaggcccuuacaaagcauuaugagacaaagaaccuuucaaaugcuauugaguucauuugucuuggccacuacugcugaacauggggacuggccuuaagaaugguauguauauccagugagacuuauuuagagaaagguaauuuuucauuugcaaguaauugucaauuggacauagcuuuuugguaggaugugggccuguguucacuucccucucaacacagggaacccaucaggcccagaugugggccuguguucacuccccuuucaacacagggaacccaucaggcccagaugugguccuuguaugugcuauuguaguuucuaugaguucacauguggaucagaccugcuaugucuagaaggccauguuuccucuggcuccuaagaucuuucugccucuccuucaggguuccuugggggagggaaaugaugagaacacucauuuaggacaguuauccaaggucuuucacucuccucagugucccguuguggguauuaguugucaucuaguguaggggaaaacauccaugcaugauggcugagugagaugcugaucaauggauuuaccagaacaucauuaggcaccauuucauugcuaugauccuuuugaagcucaggaugauaauuuagaaucuuugaacgaaguaucuauauuuagauugacugacuuuuuuuuuuaaaaaacuggcuuuauacuuauuugaauguuugcucuuuaaacuuuaaaauuuuuaaauuacccucaacuaaucacuuagcuuuugauguuacuguugucugcuaaucucuucagguuuuaguuaaaagaaaauagccuuuccauuguuaauaucuuucuggguuacuaaauggucuguaauuggagacucacgguguguaaguuaguuucucuccuuugcuucacucucauuuguacccugguuucuguuguuuuuaucugguguaaucuauaguuuauucugcuuuucccacuugccuuguuuugauuugucucuugguuacuguuuaauaaugaagagucaucauucuuugacuuggaauugcuacagcugccauauguuaagaaugcauuugugggguugugagaguugccuuagugguuaauaaguuugugacacauaguuugucuuguagaagacaaaaguucuguucccagcauccacaugaguggcugacaacuauucauauauccaguuccaaggaguccaacacccuuuucugaccucugugggcaccaagcauacauguaguacauauacgugcagaaaaaggccauacacauaaaauuaaguaaauaaauaaaauuuuaauucauauguggccuuagauugaaaauuaucaagugaauuucuagcuaucucaguuucaggauuuuugccagccacuuucccaauagaaagaaaagggaaaucacccacguagcucuagggagauuugacuguaggaggaauucgaaguagaugaaaugccaagcacaucauauuacuuuuuucuucuugucuccgugugugugugugugugugugugugugugugugugugugugugugugugugugugucccucccuuauucuuuuuuuuuaaauauuuuuuauuacauauuuuccucaauuacauuuccaaugcuaucccaaaagucccccauacccucccccccaacuucccuacccacucauucccauuuuuuuggcccuggcguuccccuguacugggacauauacaguuugccuguccaaugggccucucuuuccagugauggccgacuaggccaucuuuugauacauaugcagcuagagucaagagcuccgggguacugguuaguucauaauguugauccaccuauaggguuguaguucccuuuagcuccuuggguaccuucucuagcuccuccauugggggcccugugauccauccauuagcugacugugagaauccacuucuguguuugcuaggcccuggcauagucucacaagagacagcuauaucuggguccuuucagcaaaaucuugcuaguguaugcaauggugucagugguuggaagcugauuaugggguggaucccuggauauggcagucucuagaugguacauccauuugucucagcuccaaacuuugucucuguaacuccuuccauggguguuuuguucccaauucuaaggaggggcauaguguccacacuucauucagucuucauucuucuugaguuucauguguuuagcaaauuguaucuuauaucuuggguauccuagguuuugggcuaauauccacuuaucagugaguacauauugugugaguuccuuugugaauguguuaccucacucaggaugaugcccucucagguccauccauuuggcuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccuguaaucccaccaacaauggaggaguguuccucuuucuccacauccacgccagcaucugcuguuaccugaauuuuugaucuuagccauucugacuggugugagguggaaucucaggguuguuuugauuugcauuucccugaugauuaaggaugcugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaagcuuuggaguuucaugaggucccauuugucaauucucgaucuuacagcacacauuaaacaaaguuuucagucuuguagggauauuaucauuuuugcuuuaaaaaaaaaucuguuuuauguuuauuucuuucuuuacauguauguauguauguauguauguauguauccuucuuuuccuuccuuaagacaaguucuccuguagugcaggcugucuauacuacaugacugaauuucugaucucccuucaucucuuaggugcuggguacaggugugcaucaccacacugguuuuuauaggaugcuggggguagaaucagggcuuuugccugcuaagcaaacgcucuacagauugagcuacaccuuacucucacauaguaucuuagugcuuuguuuguguauaagaccugauaaauauuguaaauuguuuuaaacugcuugaaugcaaacuguuuaugagguguuauuuugguaccuuuuuguauuuauugaugcauauuuuaagugauauuguaaucuagagggcuauauauacuuuagacaacucuuaccaaacaguuagcacugaggauucaauuaaaacaccuuuuaaagaacagaaguaugguccuucuacuacuacaucaagcacacuucccgaaaggaguaagagcagcuagaacccugaugaaagcagagcuggauauuagcugugcucugaaaagggugcugaugagggaaaaugaugggcaucacuagucacacugcauggcauggaggauauugagucuggaggauaccuguacucaugugucagggugacauugagugaccugcugagucgucagacagggagagaucugaagcaggaauaucacugugcacugucacauggaauaagcaagagaaagcccugccaggguuaacauaagcgcuuagagaagucuauacuaauagucugaguccuucuuuuaugguucuuagacucuuauuuuuguguauaagaguaugauucaucacaaagaguuauuguaccaaaauaaaguacuaaauugcaauuuaaaggaagaaguagccccuauuugacuuccuguacuguuucauaaauaagcauaaaugucuauacuuaaagaauuuuagaaaccuugccuaaguuucuuuguucaacuugaaaguauauacacauuucuauacuauauuucacccaagacaucauauuaaacugcugucuuugcuuuuuugugcguguguucuaaguuuauaugguuacuaaccauuuuguuaucauuuuauucauucagcuuaauauaugcaacagcauagucuaaaucuuaaguuugucuauucuguuugauuuuauaaacuuaguagaaacuuacacuuuacuuuugacaaacaaagaguuuuaauuuguucagagugaaauuaaacugcagauuuuguugggaagaauaaugguaucaauuuuuuuuuuaaaaaaagaaaaaccucaauauuuuaaguaccagaaggauacauacuuggguuuugaguuguuaugguauuacccacaaaguuuuaaagaaaaguguuugggccugcuguuaugacuguauguaaggagguauuaaucuuuuuagcuauacucuuaaauuuugaaauguaagagguuuuguuuuauuguuccuuuuacuuauuuuuaauagauaaaggaagcagcagacgucauucaaaaacugcaucugauugcccaggaguuaccuuucgauaggcaaguuuauaucucaagagcuuacuuguaaauacaauuuaugggauaaaauuguauuuuuccuucucauugaggcaacaagaauuuauugagcaccucauuuguacaagauacaauguaauauaaugauaaaccuagaagcagauacauuucuuugguuuuugaaaaacaaaauugauggagaucuuuuaaauugacaaaguaaagauguugauuuuucugcuuggaacuuuaagaaccuggcuguacuuggcuauucaacuccguuuuuguuuuuccuauuacuagacuagggcuaaauuaaaggguucugaucaucuuugaaaagcucgugaaagcuauauaguuucgucaagaaauuaggauguguacagauuguuguauauaauuguauggaguuuuagacugcucauagaaccuauccuagagaauuuaaguuaagaaugcccuuuuaaaugcaagguccuggggcuaucacuaacuagacuuuacccuaaaauaaacuguccacugagaaagaaaugcuuuucaugaucucaacuaguuauggaaugcugaaguccuuuaaugaaaucucaaaagaagcaauuccuucaggugauagucugaaagaaagccaacuuucugcauaacagaacaugguuuucuguugauauguaaaggucuucagauauagcuacaaugugaauauauguuguuauacuuaaagcuugaccuuauuuuccuagcauauagcuaaccaucucccauauauuuauuuuacucccaacccuaucauaacagaugagcaguaauaguauuuuaaucacccaagaguuggaccauuacuuaaauagauaaaguaucugggucaagauuacguggauguuaauaauuggcuguauucucuauccugccuuacauucuguuuuuuccuacuagacuguuaacauuugcgccuguguuuaucuguuuauccucuuuauuuucugugugugggggguaaggggguagagaaugugugugugugugugugugugugugugugugugugugugugugugugugugucucgggguggucaaaaaaguugugaauacuggugaaugaauccagauccugacacauguuaggcaugccucugugccaagccucagaguuaugugaguauguuuguauguauauauguuucuuaaucagaucuaauguauucacauagaucauuggagcauuucuguugucuaccuugacucuuauaauguuuuuguguagcacuauaaaaguauaucuuuucucaccuucuuuuagcaucuccuguccucaaaugaugaauuauauaggaucuuucaaaaucacuuucuuuuuuuuuuuuaaagcaguaguaauuuguguuuuuauucuucacauaauaauauuccucuaucacauaauauaauauaaauugaaauuagauacauaaauucauauuuuuuccaauuaucuuuuuuuaaaauuuuuuauuagguauuuuccucauuuacauuuccaaugcuauaccaaaagucccccauacccacccccccuacucccauacccacccacucccccuuuuuggcccugguguuccccuguacuggggcauauaaaguuugcaaguccagugggccucucuuuccagugauggcugacuaggccauuuuuugauacauaugcagcuagagacaagagcuuccagguacugguuaguucauauuguuguuccaccuauaggguugcaguucccuuuagcuccuuggguacuuucucuagcuccuccauugggagcccugugauccauccaauagcugacugugagcauccacuucuguguuugcuaggccccggcauagucucauaagagacagcuauaucuggguccuuucagcaaaaucuugcuaguguaugcaauggugucagcguuuggaagcugauuaugggauggaucccuggauauggcaaucacuagaugguccauccuuucaucacggcuccaaacuuugucucuguaacuccuuccaugaguguuuuguucccaauucuaagaaggggcaaaguguccacacuuuggucuucguucuucuugauuuuccugcauuuagcaaauuguaucuuauaucuuggguauccuaaguuucugggcuaauauccacuuaauauaucacuuaugaguacauaucauuugaguucuuuugugauuggguuaccucacucaggaugaugcccuccagguccauccauuuggcuaggaauuucauaaauucauucuuuuuaauagcugaguaguacuccauuguguaaauguaccacauuuucuguauccauuccucuguuacuuuugaugcuuaauauuagaaauguuuuaguguauauuaugguuuucaguuuauaaaaauugaugguuauucucaugggcucaucauugaauucucuuguggucucuuucauuuuucuaguuuuagaauaauuuauuucugguuuuuaucauuugugaauacugaauuaucauauauggucuuuuccuuuuuuuuuucuuuucuuuuuuuuuuuuuuuucuccaagacaagguuucucuguguagcccuggcuguccuggaacucacucuauagaccaggauggcgucgaacucagaaauccaccugccucugccucccaagugcugggaacugccuggcauauauggucauuuuuaaaaugacuuaaaaguuuauguugugauuauucuucacaguagccaagugaauuuaaaacaaguaaggacaaaaucgagcauugagauuggcuggguuguuagugccucaaguggaacucuuucuuuaacaaaggaauugguuauuccauguaaauuuccuaaauaagaaauagcaauuucauuugaacugucuaauuucaguaccuagcauguuuccuuucaguauucucguccacagcuuuaucuuuccuuuuauagugacauuuuacuuuuauaauaaauuuauauuuaagaaaaguuagaaagauaauacagaguccauauacuucaccacccccaguuucccccugcuuuguauugucuuacauuauguuaucuuugccacaaccucaucauugacuuucuguuuuuuagguuuucagaaguaaaaucaaaaauugcaaguaagugcagucuauuucuuaaguacuuuuuuuuaaagauuuauuuauuuuuauguaugugaguacacuguaguugaacagcugguugugagccuucaugugauuguugggaauugaaauuuuaggacuucugcuugcuccagucaaucaauuccacucgcuuugacccaaagauuuauuuauuauuauaucuaaguacacuguagcugucuucagacacaccagaagagggagucagaucucauuacgggugguugugagccauguacuuguugggauuugaacucagguccuucagaagagcagucagugcucuuacccacugagccaccucaccagcccaguacuuuuuuaaaaaagaaaaaaaaguuguacuuuaaaaaaaaaaaaaaaaaaaaaacaaaaaacagcugaugaggaagcgggggcaauaccaauuaauucuucccguccuagaguuugcguccuuucccucaaaauacccaaccucugcuuuguucuucuaggaccgugugugaguguguguguguguuucuauauuuuaaauaaucgugaacagguaccuuuagacuuuauauuuaguuuaaguuuguauuuuuagagauuauguucaguuauauaucucugaaaaggguuuuuguuuuauuguggagacaggagcauuuaauucuuauuuagcuauuugacuccuuacauguuuauaguuuauaauuucggguuuguuuucaugagacagggucucacuauauaucucuggcuauccuggaacacacuauguaaguaaaccaggcuggccuguaacucacagagaucugucugccuccugagugcugugggauuauaucagucuuuggguuguguuuuaagcuauauccaugcuucugguaaaaaaauaaucacuguaauuuuacuaagcuucacccauguuaacuguuuggcaagccauuucgcagaaagccaaccacaugugucuuagaauaaggacauguaaagauauuuggauucccucagaauauuuguaaucacuauaaauuaaugcaagguucaaauaguaaauaagaacuauaauagacuugagaauaugguauuaaaucaaaggcuacauacuaucguaggauaaaauuugauggugaaucagcuguuauucacaguagaaguaccugacuucuaguaaaagcuuuuauaguucuuauuccuuuccaaagcuugagauuaaagauuaaagguuuuuuuccccuauauuuugucaucagaauugacaucuccuuuuucuuucauuuaaauauguagucaccuuuugguuuauguaauaauuauaaauggcuguuaaauucugaagaguuuuaucagcuuacuaguuuauaaguuuuugugucuugaaauacagauuuguguacauuaguauauuguaugagcuaaagucacuguuuauaaucucauguuuuuguaauucuuccaaaagaagauagacccauaaccacuauaaauuuuuauaaucuuuguagacuuagagagcuguaauaaguuguauacuaagauugucuugaugcaguuggaugcuuuucuuuuuagguaaauaccaugacuuagaaugccagcugauucaggaguuuacaagugcccaaagaagaggggaggucucccggaugagggagguggcugcaguccuccuucauuuuaagguaaaugguaagauuuuuaacuuaugaucagcuucgagguucugaagauuucauauucuaugucccucaauuucccuuauuauugcauaaguauauaacagaguaacuuuauugauguuguuaaguguuauuuaauauuuaauuuuauggugcucuuaauauuauaauaaggaauuuaaaauaguucaggaaagaaaaucaugucaucagccuucuugcuuuuuaauguaccauuuucagucagaaauacuuguaaguagaaagaacaccugacuguaaauaucuguuggaagauaagaagcgaagacuagaugcacugugaguaggaaucugggagaucuugggugcggaagacggauauguggauuauggcgcugucuuccuggaaucuacacuggaaagaaaaaucucacugaaaauuccuuuuaauuuaaucauggaaaauaggacaagauacauauguuaaguuauuggauucuucucuagcauuuauuuuauuuaugucuaaugguuauuguucauccacugggauacaaggcauaguuuaacuacauauauagcacuuuuguugugauucuuauuauaguagaaacagacaaugcuaacauuguuucuucuuuauaggguuauucccauuguauugauguuuauauaaagcagugccaggagguaauuuuacaguauacuuuauuacauuuuauuuuauacuaauuuguauuuugaagccauuuaaaaauaacacauuggcaauguaaaauaacuuuguuguuuagggugcuuacuugagaaaugacauauuugaagaugcagcaauacucugucagcgagugaacaagcagguuggagacaucuuuaguaauccagaagcagugcuggcuaagcuuauucagaguguguuugaaaucaaacuacagguaacguuaaacgcuaaugaauuaaauaggcuuuagggcuguguguaugugugugugugugugugugugugugugugugugugugugugugugugugagaguguguguguguguguguguguguguaugugugugugugugugugugugugugugugugugugugugagaguguguguguguguguguguguguguauguguguguguguauguguguguguguauguguguguauguguguguguguguguguguuccuacaagauuuucaaaauuuauauuuauuauuuuaaauuuuuuuguuuguuuuguguguauucauacaugaggaaugcaggcacccacagaaaccagacacguuagauccccuuggagcugauugugagccaccugaugugggugccaggaacuggcucugcagcccucuacaacuccaugccacauguauucucucccccucucaguuucucaccuccccuaaggucucuucccccucuaucuccuugcuaguguuaugacuuauacacaacauacucauguaaucuuaucucuaggcuucacagacaagaaacauugugcuauuggugcuuugacauuugguuuauuuguuuaagauaaugauccugagaaauuaauacaauuuaauauuugcuuaaccaaauguuuucucuuucagaguuuugugaaggaucaguuagaagaauguaggaaaucugaugcugagcaguaucuuaaaagucucuaugaucuguauacaagguauauuauuaucucauuacuuuuuuauuaccuuuuuggagacagaaucucacuguaccuagcuagccugaagcacacuguauagaucaggcugacuagaaacuccccgagguucaccgcuugcacagcauggacaaccaugccuucuuaaguacauuucagauuuuucucucucauuuuuaaauuaaaauagaaaauggaaaguauuuaaguauuuugucagauaguagugugccuuuuaguauuaaaugcauccuugaauagacuagaguugaaugcaagcagaauuuuuauugaacuaacaagaccuugcaaaaacugacuuaagaauuuuguuucuaauuucugagcuaauuuuuguacgaguuuuguugguggaguuuacuuuuaagaauuaggacaguuauuucugaguucgaggccagccuggucuacaaagugaguuccaggacagccagggcuauacagagaaacccugucuggggggggugggggggggaauuaggacaguuacauuuaucugcagccacuuuguuuugggagaaaguucaccuuaauaacagcaucaauacugucucagcauccucaagcauccacacugacaaagacagaaaugaugaacagacaguagaauuugucauaccauuuggguaccuuguagaugaagacuuuagagcguacauuaggcugcucuccacucuugccauuucuacauuguuucacagucuuuuuuccuaggucauuucuaccacuuaaugacaguuuuauagacuauauauaauguuauuuguaauuuucauauauaacuuuguaagcuguuuucuauauccuaaguagucucccauuauuuaagaaaugaugguuugauauaaacaaugguuugauauaaaccauuaaaguaccuuuauaaauauauacgaucuuuaauguuauuguuguaucuaaaauauacaucuuuuucucucuguuuccuaugaaaagaaccaccggucuuuccagcaaauugauggaguuuaacuuagguacugauaaacagacuuucuugucuaagcuuaucaaauccauuuucauuuccuaucuggagaacuauauugaaguggagauuggauauuugaaaagcagaagugcuaugauccuacagcgcuauuaugauucaaaaaaccaccaaaagagauccauuggcacaggaggguagguuucuaaaaauuaaauauaguuaaaaauguuaacaacauucaguuugggcaaacuuaguacauauuagcugucauuaagauuugcugugaauagcucuucauauuauaugugcuauuggccaaacccuuucuuggaucacaugcugaaauggccccaaaacaugauuaaaauguaaauuaaauacuucucaaucaaaauaauaugacgagaguacuuguaauauaaagaauucuguagucucaguuccuucacugaguuacucugaguuacugacuaagacuuccgucauuugugugaaacugugaagaaagaggggcuacuuuacacuuucagcagcccuggguugagcuguuuuguuuuuuguuuuugucauuuauacauaaaacuauuaaauuauguuuuaaagucucagauaauuugcuuauaagaagaaaagaguuugcuguaaaguugguaacauuuaguuguccagauugucucccgauugggacccaguagauucuaggaggaggacuagccucuauggugccuuguggaaaguagaguccacacuugcacacccaggccuuucuuguaaugauuagaggguacaauaauaaauaaagguaagaucuuaauggcauugaaagucuuaaguuggugacauggcucagcugguaaaacuacuuccugugugaggcuuuauaauccaaauuccauucccagaauccacgauaggagaauagacucugaaaaggugcccucugaccuuuguguaccugcaugcauacauaucuaauaaauuauaaaaaguuccugaguucuuaugccaaaucaaaauuuuuauuucaaaaagcuaaaaccuaaagaguaaucauaagacuuaaaaaaaggaguucauagcaaaaauaguuuaaccaagagauaucuacauaauaaauguuccaagugauccuuagucacuaagaaaagcucagguauaguuaauaaaucuaguuuaacagagugaaggcaugagcagugugagccuugggaacauugggagcaggauccauaggguuuacuggcugccagccuugcuccaggugcaaugaaagacccugacuaauggaacgguggugaagaaugaccaagcaagauucgugacaucaucauuuggcuuacaugcacccagacauacuugugcacauacucagcaaagaugagaacuccaaauuuacccuuuuuugaugaaagucauuuaaaagcuaauacuuguaauuagaauuucagucucuugguuauugguucauuuuggguuuuggcuuuuucuuuuuuguugauguaugcuaagguugagaguauuugcaguuaaaaaucuaaauguaguaaccacuuuuuucauuuguuuuuaugguguacuaguauucaagauuugaaagaaaggauuagacaacguaccaacuuaccacuggggccaaguauugauacacauggggaaacuuuccuaucucaagaagugguaguuaaucuuuuacaagaaaccaaacaagccuuugaaagaugucauaggguaagaauaauaaauuaauuuuaagauauaguuguauaauucaaguuuuacuucauuuauggaaaaaauuaggaccaaccaauuuuuuaauauagauuuuuaauuaauacgguuuguacaaauugcauauacuuauagguaccauaugaaguuuugauagaaauuauaugaguaauguuauaaucaggaugaguauauguauucucaaacauucguuucuuugugguaaaaacauuuaaaaccuaaaaggacuuguuauauuuaaaagucuauagaacauuguuaaucuguugucauccuacugggacaguaaaccaccauagucauuucucuucccuaguuaacaguacuguucugcagccuuuccucauucucucucucuucccauuccuuccuuagccgcuacugaccguguucuacugaccaugaaauucucuucuuuagauuuggcauaugagcaagaucaugcaguauuuguuguucuaagacucacuuaucucacuuaacaugucuuccaguuccuuccccauugugcaaacaaaaggauuuuaauggcuuuucauagcugaaaacuguuccuuuguguguguauauaccauauuuucuuuauccacuauuuaauggauucuuaaauugauucugucuuuugacuauugugaauauuguugcaauaaaauuggaauguagagcccucuuuaaacaaguagauuucuuuuccuuuuuuguauaccaaguagcgggacuauugggucccacuuuuuaacuuuuuuuuguuuuguuuuguuuuuuuguuuguuuuuuugagacaggguuccucugucuagccuuggcuguccuggaacucacucuguagaccaggcuggccucaaacucagaaaucugccugccucuuaacuuuuuuuuuuuuaaagauuuauuuauuuauguuauuuauaugaguacacuguagcugucuucaaacacaccaguagagggcaucggaucccauuacagaggguuggugauucaccaugugguugcuaagaauugaacucaggaccuguggaagagcagucaaugcucuuaaccacugagucaucucuccagccccucuuuuuaacuuuuugaggaaccucucucuacaccauuuuucacaaccgcuguuuacauucccaccaggguguagaaauguucucuuuuuuucccauaaccagcauguuaccuuuugucuuuuugccuuccuaacugaaguaaaaugauuguuuucacuguguuagugccuuauauguucuucauaugaaccuaugauuguuagauuuuauaauuauacauauuuucuccuuauucuguaaguuuucuuucauucuuugcuguuuccuguacuguguagaagcuuuauaguuuaguguaaucuugucugcuuuuacuuuuguuuccuuugcuuugggggucucagucaagaagauuuuauccauuccaguguuauaaaguauuuucacuauuuuuuguauuuucauaauuuuagugguuauauuuaagacuuuaauuugaguucauuuuugucugugaucagugauaguagguaccugcauacuaucccacaccaaaugaacacagucuuucucuaauuugucuuaacauuuuuugucagaucaaaaagaaacuuccuguggccaaacauggggcaacaccaaucuauguauauaauguaacucuuuaguggguaguuuaauaauguguccauuuagccacauagaaacaguagguucaccauuagggucuguuaccuuggccauggccuuugaccaaguucacaguacuaggccugaacucacucauguggaacaagcuucagaucccauuaaaaccuaguugguugcuuccauaacugccaugcacacuguucugccagcuuaguacucauuccugaucaguuuagguuuucugcuccuuuaugauaagguauguguccuggaauuuacccauuucuucuagacuaucaaagucguugacauaucuuuauucaugauaaucuguaauccuuugcauuuuuauaguuuucauuauaauguauacuuuuucaucuuugauuuacuuauauagaaauuuuuguuuuuccuuuuucugaaagggucuuacucuguagcccugguuggccugggauucacuaugucacuauguugaccaagcuggccuggaaucgacaaagagccucugcuuccagaguguugggauuaacacuguucaugaucauaccuagcucuuagucuauuuguuuuaguuguucgucuauuuauuuugagauuauaauguaauuacauuauucuccaucacccuucuuuauucuuuuaaauuuauagccucuuuuuauuaauuauuguuauauucuuaaauucaugaauacaaccuucucaaucuguauaauguuacuuguauguauguuuucauaaccaaguugacaugcuauucccuggggaaaguuguuucuccuguccucagcauuccuuaguugccuguaguccuuuguggagggcugaagccuccaguucuccccaaccccauguuagcauagcuuuuguuguccuuguucagcucauguguuguuggugggcuuaugaauguagcuucugacauuucuaggagacauacucucaaagcaaacuugaaaucugaaaaucaaaaguaguaauaacuaaaugugaaaugguacauuuuuaaaaguccauguuccucuugcucuuguaaucuuuuucuccucuuccauaaccaucccugagccuaaggugaaguaauugugugguagcuguauuugcugagacuuaagucugcuuuuaaaaacauaguuauuugucucuguaaacuucuugccagaacugcuucaucaacaagauacugguuauuuccauuauuguguauaucaagaaaaaauuccuucuuuauugauuuuugcugauguaguuguuuaauuuccaugcauuuauauaauuuccaaagauuuuucuuguuauuaauuuauuuuauuuaggaaaauacucaacuuuuaagaauuuauucaaauuuguuuuaugucuccuaucaucuauaaugaaaaauguuccaugugcuguugagaauauauaugccccucuaagggaccuuauuguauuggaacauaucuuucccuuuaaacuuguuaguguuugcauauuugauuguucuaauauuagguaauuuuaguuguuaguuccuuuuguugaauuaguucuaucauuauauaaugucuuauccuugucacuuuuuagcuuuuauuagauuuaaauaauuccugcuuuucauuuggauuucaauucuauaauauccuuuccuuuucuuucuauaauauacaauugucuuuagaggugaaaugggucuuuuguuuauauaaguaguauauaguugaguccuugauuccacucagccaugcagagaauuuaguccauuuacauuuaguauaaucauugauugguaagauuuuacuacugccaauuuuuuugcuuguuuguuauuuuuguuuuguuuucuuugcuuuuuuauuuuuuaguuucuuucucccuuuuacaguuuuucuuuguaauuaaaugauuuuuaucuacuaguguauauuaauagaucuauauuuuauaguuaugacguuacucaaacaacuuucaauuauaacaagcuguuuuaaacaacaauuuaacuacuauaggauaggagcaaaaaaagaaagaauaauaaaaacuuuucuacagcauuccaauucucucuacauuuucaauuuuuuaaugucccacuucacuuuuaguguaguuauuacucuuguguuuuagauuuuaugaaaguguuauacuuuuuuuuuauguacuaaagcuuucuggaauuuauuuguagugucaauucuucucagggaguuuaguaucuuuagauguuuucaucuuguuagcaucucauuuuuuuaguuuggcgaacuccguuuaaacauauguuuugggguuguuuuuuguuuuguuuguaagagaaaugcgaaagugauaaauauucucggcauuugucugaaaaugucuuaccucucuauuucuaaaagcuaguuuugcugaguuggcauuccugguuggcagguuuugguuguugggcugcuuuuguguucuuguuuuucccuucaauguguggguaucaaguuucugccacucugcaauugaaugacagaauagaguuuuagguugcuuuguuuauuuguuuuuaaaagacucagauacauaguacuggaagggaaccgaagaagccacauuuugccucuaaagacagauguauacucucaaucucguuaucugcuguucccuuuuuuuguuuuuuguuuguuuguuuugcuuugcuuuuagaaccuuuucuuuaaccuuugacauuugguuauggcucuuuguaguauaaauucucuauucuuuuuuuuuucuuuugagacaggguuucucuguguagcccuggcuguccuggaacucacucuguagaccaggcuggcuucgaacucagaaauccgccugccucugccucccgagugcugggauuaaaggccugugccaccucuuacuuuccuauccuugcaucccuauagcccaaguauuaacucuuuuaaugcuuuccuacaggucuguaugcuuuagauauucugauuacuuuuuucuucucccuaccuguuuuggggggagggguggcugauucuucagcuucuuucugcuauuuauauuucgauuacuuuuucauucuauuuacuauucuuuuaauuucaggauuucuuuuugguuuuuuuuuuuuuuuaauuauugcaacuuucuuuggcaaauugcagaauuauuugcauauguuuucuugugguuucuagaauaucuuuaaaacaucuccuuugaguuuucugugguucuggugccuugcuuuugguccuuauuggguucuugggaacucaggaugcuuggugaccuacagcagugucugcaugcugaaagauuagguguuaauugccagcguaguaauuugccuuugucuauguauauucauucuuccagaauaaucuguuuauuauuuucacuaagaccguugucacugucccuguuuuaacacuagauggcacccuaaauagagauuuuuuuuuuaaccaacucucugguucccuagcugucauuucaacaguagagagugccucaaagccccagucugucauaaauccauaaucauccuuuaaagcugacauugcaggauagcaggaaagaccuagacauuaggagcuccuuagaaagguaggucaugcuguuuaugcaucuuucuccugagccagggugggcguauuagugauccaaaagcuguuuccacaguuacuggucuguguucagcacugcaggguucuuucuuagcacuccacagccuugcucugggaggccugguccauaguuccaaaguaaaaacuugcauucaucacuuucuucuuucuccaaaugaaguuaucuauguuugaugucacaucaaucacaauacuugaucuuacucaaaguucauagucuaucaaaaugaguauagcacagggauaagacaaaggcuuacacuguuauggucugcccagugcuguggucuguuuguagccucugaccucuaaagaucuggaggugcuuuugucuggcccacucagacugucauuuccgccuuguacacacggguauaaaggcuccaacugugggcacugggcucaagagaaggccuauuggguugugucugauauuaacucuuaccauaauaggccugacauucaguuccaaggaaaacuuguaugcuuaauuuccuuuccuccuuuuagcaaauaaaaucuugguacacauuguucaggucuauaguagcaugauaaaaaacucuugguugccauuacugaaccuaagcugaccuguaccugagacuuguggcugaaggaccugacauucauuaucuuagacauuuauucaaggacuaagcugcaguugguaguggugugggccugagcucaggucuguguuguagguuucugcuuagccaguccagaguccauccauagagacuggcuuugggccagcgcugaggcucugcuugguacuguacuuuauagcgcguucugcuaacuaaucuaaccacuugaaauguugcacauuaacuuaucuaaucaucauaaagaccuggugaugauucuuacaguuuuccgguggaccacuauagcucuuacauacuagaaucaaguauuuaauuccuccauaaacugagggaaauguaguuuauuuauaugcauauauuauuucuacauuuugaaugccaauccauuaauauaaacauuaguagaaauuuucaaagaauauauacugacucugcauguuuccaucaguugcugggugaagaagacuccugucugcaagucuagcagaauaucuugaauaguguuaggagugggcucccucugaugugaugggucucaucuuguauuuuauugguuucuaggagagaaaaguuugguuuugauuggaauaauagugaaucuauaauucuauuugggaagaacugauacauauuuuuuauuguaaaauaaaagaugacuuuuauuuuguucuuguguccuguugcucuggccaggcuucuaguauagugugaaauagaagugcagagaacaaacacucaucuuuauaccuuuccuucaggguacagcauguagucuuugaucucuaaguaugaugcugacuauaggcuuuuuauaaauaaugccuuuuaguuucagcaaagucuuuuauacuaguuuauuuaaguguaguguuaaguuagauauuauuugauccuaguacuuggaaagugagaucuugaguauagcucucccacauaugcaaaguuggauugaaaccagcuuuggccacaggagaugcguaucacacaguaagcaaagcaacaaaauaaaacaaaggauugcguguuacaguuugguauaugcuuucucuuuauucuuuugggagaauugugcuaacugauauuucagauguuaaggguugcuaaauuuaaaagacaaaacaaaacuuuuuaaaaaacugcauuuauuuauaauuugugggcaugcauuuuggaggucagaggaaaacuuaaggaaguugguucucucuaucuucaaaguagguccaaggaguuaaauauguuuuaucagacuuggcagugagcuuguucagcucugagcaaucuuggcuggcccuuguaugcuaaauuuuguuacaagauuuugcaaaagugucuaugaauacuguuugccuuugaugucuuugucauguuguaguaaugaaaauaaugcuauacccauaggaugauaagccgaguacuucuguuuccccuuucaguuguuugugaguauagacgauggcccuucuguauuaaauguuugcuguaacucaccaggaaagugauuugagcuugugguuuucuuuguaaggauuuuaaacuaaaauuucagcuuauuuauuauauacagaaacauucagguaaucuaauuguaagugagcuuuggcaguuuugucugucuaucugucugucugucuaucuguuaucugucuuucagacagggucucacaauguagaccaggcugaccucaacuucccgagaugcauccaccuuccugugccuccuaagugcugguauuaaagguguacaaaacucugaccaccuaguguauaucuuuuaaagacuuuuauauuuuuacagaaguugcacuuauuugaauaaaguuaugacacuuucuuacauuacugucuuaccaguuuuuguggaagcuauaguaauaauuagcuauuuuauucccaauaucagaaauuuguuucacagauuuuuuccugaacaaaugaaaaaagauuuauuuauuuuauaaauguguacacuauuguuauaugugaguacacugucacugucuucagacacaccagaacagggcauuggaccccauuacagaugguugugagccaccaugugguugccggaaauugaacucaggaccuccaggaagaacagucagugcucuuaaccacugaaucuucucuccagcccacaagguguauugauuuuacugauuuuaccgagaaccauuuuuuuguuucauuagucucuccaccccuuggguuucccugauuuuuguucuuuauuguuaccuuccuucaacuugcuuagguguuauuugucccuuuccugguuguuuuugucuugguuuggucuuucgguaaaagcagagugugcugaucuuuuccagugugugcauuuaacuacauuucucucuuaaguacuguguuaguugaaaacugaguuguuuaauauguuuuaauucauuucaaaauauucuuuaauuucucuuugauuuuuuuuuucuggcccuaauaugauaaagaaauuguguuauuugguugccaaacauuuggagacauacuagaugccuuucuguuaaugauuuuggauuuuauuccauuguagucagugggaaaacuuugcaucauaaugccaaucccuuuuaaauuuauugagaugauuuauauuauaagauacagccugauuaagguugucuauacacgagagaauuguauauucacauucuguaaaugucaggccuuauucuuugaugucuucuauacuuuuuuuaaaaucaguuuucuguuuaucucuucuauauguuaugcauggauuuggggauauaaggaggagaaaggugaaaacuuaggcuugguuuuuaugauuuaugaugaagguaacgguaucuguugaacaucaaaaacaaacaaacaaacaaaaagaauagagagauugguaagaauuaauggucagaguaguauuuaagaaauccuuacaagugggaauguauaaucacugggguuuuaaaaugguauaugaaauucuucauaaauguacuuuaaacaucaggcuuauauuguuacauuagaauuuaguguccuuaauuugaaacuucagaaucuucaugcuccaaaauaaaaaauuuuugaccacuaguacaaugggacauuggaaaguucuacucauggccuuaaaguuuaguaaaaaauacuauauuaaguuguccuuaugcuauuuguauaagguguucauaaaacauaaauaaacuuuauuauuaaacuugaccucauuauaaauuuguaaauauuucaaaauccaagaaguccaauaguauuaccuugaaaguugggguaaugcuuuaaguaguuuuggcagagacagaaaguaguucauaaauuauauagaacacaguuaauacuuuuuaagaagaguucauuuuucucagcauaacugcuaacauuucuuuaaauagucuaaugguagcaacaccaaaguaaaaagcgagagcuuaguguaaaucaaguuugcaauuuuccuauuuuauuucagccuuaagauuaaggagaaaugcuguuaauguuaguuuaucuuauaugaggauauuacgacuuggugaaauugaauaaccuucuaaagacuuacuccaccaggauaugaugaguuaaauuugauuuuguuguauuuuuauuacuauguauauuaauugacuucauagccuaauuccacaaguaucuuuuguuuuguuuuguuuuguuuuguuuuguuuuguuuugaguuuuacuagaacagccuaaguuaguuagagguccucaaauuucuuugacugugauccuggcaauucaaaaugcaucccacauuguuaucagaguguacacauaugcauauguguguuuuuugaaaguauaauuguguuuuacucaaagauuacaaccuagauuuaacacugcccuaggucaggagggucaccaacagucuagaggacugauuauaguuguacggcagugagacaggaacggucacauuauguuaccugaaauaguguuguauacaaaaagauggcuuuauuacaauguagacuugaagaguaauacuguuuuugcuuauuuuuaaagcuuucugauccuucugauuuaccaaggaaugccuuuagaauuuuuaccauucuuguggaauuuuuauguauugagcauauugauuaugcuuuagaaacgggucuugcugguaaguauaugucuauuacacuuuuuguuaaacucuuuuaguucugcuugguugaacaauauucauaaugcuguuuuauuugugacuuuugugugaugaauucacuucaacacaauguauuuugcgcuucucuaauaacagggugugcagagugcuagaaauuaauuaggcuuaauuuuuacauauuguuuacauccaguaaagaaaggcuauagauuacuuaacucagcacaauauauuggcagaauguauaaaaguggucuaugcuauaaaaugucaaggagcauaaauggagguaagaauaauucugcuuaggaauugaguaaugaaguuuugagagaaaaauauucaaaaauaaagcuggaaaggaauacauuuauguuaaaguuuucagcuucauucuuuuggguuuacugcuuuguaacuauaguauaauaacaacauauucccugacuuccaaucuccuuaacauaguugauaaccugacccuguaaccuguuaaguggggaucucagauuuaacauuuuaaaaaugaaagucuuuagccaggcauggugguucacgccuguaaucccagcaugcaagaugccaaggcaggggucacuaugaguuugaggccagccuagacuauauagugauuuuugaguaaccuaaaauaauaaaacaaagaaacuguauuccuccaacagugaucuucucuuagguuuuuaaggaaguuguuaguuaccaaacccagaaacugcuuuaaccuuccuguucucauugcuaauagcaaguucauuagcaaacacuguagguauacauccaaauauaauuuaucuacuuuguuucaucucuacggauacaaucccacuuugagcauugucaucuucuaacugguuccuguguucauucuugccuucccuaguuucuaugcaauagccagcuuaauuguuacuuccuuuuuuuuuuuaagguuuauuuauuuuauacauaugaguaugcuguugcugucuucagacacaccagaagagggcaucagaucccauuacagaugguugugagccaccaugugguugcugggaauugaacucaagaccucuggaagagcagucagugcucuuaaccgcugagccaucucgccagcccuaauuguuauuuucuuauugaugacuccucagugauuauuacucuuagagggaauaaaaacaaacuacuuaaaacaauaugauccauagugugccucuauagauuucucaccaugcugcauuuccuacugugcccaauaacccuggucuucauuguuuuccuguuaggcuuuuugcacuuggcauuuguccauugcagaaaacuuuccccucagcucuuuacauuugucuuuucaaucugaccucaacuaagauguccccuuuucagagacacuugugcugaucaccuuagaugcaguagugcuccuuaggcggcauaguucuccauugucccagaguugaauuugauuuguuaaugucugucucuucucagaacuuacucauuuagcacauacuuguuagaugguuaguuaugggauucguguucucauaaaaaugauagacaaaugauuaggaaguauauaauaaaggaaaacaaaacuagauaaaggauagaaaauacuaacggggaggcaggguaaaggauuuacagacagaauuuuuuucuuuuuccuuauuuaucauuuauuuuguguguguucacgcauguagaggucagaggacaacuugcaggaguugguucucuuuuuccaccauguuuguuccagggaucgaacucagguggucaggcuuggcagcaggcaccuuuacccacugagccaucucgccagccucccaaaagcuuuuuaugaaaggguagucagagaaggcuucugagaagacacaugaaccagagaacucaauaaaguggugaguaaacugaauauuuggaguaagaauaaucuaaguagagacaacagcauauuaggaauauauaggaaucucaguuguuuagucccuccuacccuccagcauuauacucuagccuguagaaagcauauacaguucagaaaguuucuauuggcuguguaaaauaccagccuagaaaccuuuaauaaugaaccagacuuagcuauagaccagucacuaacuuaacucuauuacccuucauaagcaaccaugucuuuuagugaauuuuaacuuaauuagaguagacuguugacauuaauuauuuaaauugugcugguagaaaaugacuuaguguagucauuuguauuagaauaauuuaaauauuuuaagaugugauuacagaauaagaugaugaguaagaauaagggccaguaaaaugguucagcaguaaaaggcacuugcugccaagccugacaacuugaguucaguauccagaucccaugguggaaggagauaacugacucuugaauguuguccucugacuaacacacauacauaacuaaaaucaauuuguucauuagaaauuacaagauaacaaggaguaagguaugaagaauuuauuguucauuuagaauggaaacuuuccuauugauuucaauagcaguauuugaaauguuuaggaaaauuucauuuggacagggaauauuucucauaucuaugagcauguucaaugcaguuaguguucauggucauuguccuaaugaccacauacaauucugccagguaauaagacauacuggaguagcauuguagaccuuucuuuuuacugaaauuauugucuuuagguaaagucccaagucaaagcacacuaugcauauauauuuuaaaauaauuuucauuaauguacuuuuuuccuaaggagcuuauuccguacaacuuacauugcuucuagccuguauguauauauagguuuuuauguauguuaguacauaguuuuccauuuuuuucacauauuauuaguuaaauacauccacuaauacugccuuaauuuccauguuuuauggugauuaguauuuucuacaugugcuucaguuuuuuuaauuguauguuuguguuggcaccuuuaauuuuccuaccaacaauuguauuuuuuguacaaaacaucuuuguuuuccauuuguaaagcuacucuagguaguaagaacucuaggcaguaaguuauauauuaucauuagcugugggugguuuucuuagacuucucuuaauuuuacauagaaacacuggcaucucgagcuaaaaagaggaaggauccuugaguccguguauuucucuuuaugaaaggaggaaguggaucuagagcggguuucagcuccaucuuuuggugucagaauguuguugacaagcacagagcauuaggagauguuguggaaacacgccucugggugaugagggucugaauaguucugaggacgggguggagaacaugaugagcacaguguguaguugugguaggagguuuggggacagaaggagaaggcagagcccaggcacguuguuaauugauucauuuuccauuuuaucuaaacaaaucaugaagaugauuaacuuugggguauaaaaauagcuuuggauaaaucucauuaagcuguuuaaucuauagaauuguugcugauuuguuacaugacaguuaauuuuauucaugugguauauauaaauauuuuuuuucuuuugcucaguuuuuuuaaagguuguucccacuuaccuaugccuuccgauuuuaggaaucccaucaucagauucuaggaaugcaaaucucuacuuuuuggauguuguacaacaggccaauacuauuuuucaucuuuuugacaaacaguuuaaugaucaccuaaugccacuaauaagguuaguugcauugucauauuuucauugguauuuaaugacuacuauauuuuuauuacuauuuuuaaauaauacaucuucauauaagcaucaaauaggacaggagguuugaaauaaaaaucuuuucuuucuuucuugaauucuuguuuucucuuuucacugugcuguuaauuuugauauauuugaaaaguuuuaacuaucaugaaccaaaaucugaaaucuaauguggaaagggccuuccagcuuagagcaguucagcuguuugcauccuuuggaaggcaaagcagauaacaggcagggugguauauguagucuuaucuacucaggaggcugaggcaggaggaucucauguuugaggcagucuagucaacauaaugauuucaaagucagcuuggauaacuaagaugcaaucucacacagcgguuuuauguuugcuuguuugucucuguccuucugcaccugcauaaggcauucuucugauuuguuuaauaaagagcugauggccuauaguugaggcaggagaggaaaggccaguuucaggcagaggaaggaccucuggggaaaggagauaggcaggagauuggccagccagacacagaugaagucagauguauuggaacugagugaaagguaauggaccacauuguaaacauggacuagacuaaaugguuaaguuaugcaagcaaaucaggagguagucagcuaaggccuaagcuuuaauaaauaauaaguacgucauuauucagaaacuggcaagucugagacagucacgucauaagcuaguuaguucuuuccucccucuucucuuauaagggcugaggcuaggagagguauguaggauuuucagggaagaaagggaauugacaaauauuguaauuauguuauaauacauauaugcacaugaacaccaguagacaugauacacuuguaaagauuacaggaaacaggaaugaacauauuuugauaaagcacuaggauuuggaucauauuucauaucaauuuauauggacuuuuaaggcauuugaaaauuagaauuauauacauaugaacauauuucacgaaguuguuuucuuagcacuguuaucuaugcaagaaauguugagauaaaugaguuugauagacuuuauaaacaguauuaugccaugucuagaccagaaacaaguucaaagaucauuugugauucccaaaucagacuuugaaaggaaguuuacuguuuuucuguguaacucagguggguauuacagacaugagccaccaagccuagcuaguucuuauuaauuuacuuuuuaaaagaacuauuaugccgcauaacauagagucauaggaguuuuaguguuguuuauucuuuaauauuuugaggcuuuuggacauuuuaauaguauuuggaagguuuuguguguuuuauuuuaaaaaguuaaauguaacugaauuuacuuucuacuguccauauuauuaguuggauuuauuauauuuguaagagucuggugauacccgugacuuuuauuacuauucuaucagauauuuagauacacaggaaacuaguuucaaauucaaagcugcaugauuaugucaagugcuauuuccuuagagaucagaauaauaugucugucuuuucuugguuuuuaauggguuaauuuuucuaguuugaaugaauagaauauauuaauauauauaauugcaagcaaugauuuauuuuguaauuauuggauuuaugagcaaaugaaaauaacagguguuaguauuauuuacaaauaugaauacacaauauauaaauuauaaacuugucaaaugggcuacuaaugggaggguuuguuuguuuuuucccccuuuguaauaaacaauagcucuucuccuaaguuaucugaaugccuccagaagaaaaaagagauaauugagcagauggagaugaaauuggauacuggcauugauagguaaguuaacuguuuuuuaucuccugcuuuuuuaaaacuuguagaaucacauuugcauagcagcaugaacagaguuuuuagaguugauucuuuaauguacuguucucaucuauaagagaauuuucccccccuggaaaucaguauguuuaaauauauuucaaaucaaauucauauuuuaagccccacucauuugcaucaaacauguacaggcuacaaauuccuuuaaaaacagagaugccaagcuggggauauagaccagggguagaguauugcuagcaugugggaagcccugcacuuaucagugcugcugaaccaacaaagacuuguaguauuuaggacuauauuuccacuuaguggcuucagccuuaucuaugaaguuuuguaguaauuguacugauuuuguaaauguaacuuauguuaaaugaauuuuaaaacuuugacugaagauaauuacuuuccagguuucuguuuugagaauaugauguucuuacacugauugaaaaguaguagagcucacagaugugaaggauucacuacaucccaccaucuuauguuggccuacugucauuuuguaacuugaccucauuauuguugugcuuaauuaugugauccgucucuuuaauuuaacaugaaacuuaucuuuugacuacucugucuugcagccccuuaacucuaaauuaguguagucuuuuuauuugcauaagcugagugauugcucacuauugaggaaucacauagguuagauauuauugguacuuuuuaaccagugccuuuauugucagcuagaaucucaguacugucuuccugauugccuguugacugugggauugaaugugccagcuuccacagccguucucuuugagccguuuauccuuccacuuuccuaaguauucccuaugcacggguuugccugagaagauccuuagaugugaaggaaaugauuagugcuagguuauaagaucuuuucuaaggagaaagaugauaaaaccagaauaucaaguugauaucaagucacagaaugaccuuuuccccccaaaaucuaguuugucaauuccaaagugguuuugugaugauaggcaauuaaauaauuuaacuuaauuccguauaauccguagguaaaauugagcgaguuaagugagucauauauguuguguucucaaucuuuaggacauuaaauuguaugauuggacagaugaagcauaucuuggcugcagaacaaaagaaaacagauuuuaagccagaagaugagaacaauguuuugauucaguauacuaaugugaguggaacuaauauauuaucuucuuucuucauucuuguacacgcauuagugcaccuguugugcuguuuuuaaaaacaaaauaccuaauguucaguuuuaccaaaugaagacccugcuagcucagagaagcacaggaagcacccagcugcccuccauccucagcugcaaaagcccucauucuccacugucuaaacaccguuccugcuuccuuguguucacucccuaucaagugguuggugcuccaccucucgaccuauuguugacuuuauuuauuuagcucuuauuuacaaagaauucuuagaguuaaggugauugcugggaaugagcuacaccacaacuacuuguuuaauaguaaacagaaagcccuuggguuaaaggugugugcuagggcugagccacaccacgauaugaaacagauuuuuccaguucacggucuuaggguucacagugugaucaaauauccuucaacauaguugugcuuuaaguguuguuuuucuuauacuuagaaguuggaaaacuguauuuacauaucuguguaauaacuguagaaaaacuuuuacaggcauguguaaaaguuuguguuuauguaagaaaacaaguugagaagauuaaaaauuccauggaugggaagaauguggacacaguucugauggaacuuggaguacguuuucaucggcuuauuuaugaacaucuucaacaauauuccuauaguuguauggguggcaugcuugcaauuugcgacguggcugaguauagaaaaugugccaaagacuucaagguacauauaaacaaauuaguuacgcuugcaaguaagcucagaaacagaagcuguaccauuaaaagccuguacuggaaaugugugauuucgcuggcagcauuaagagacagcuuuaauauagucuaccaguuacaucucaauaugaacauuuuuccaguugggacuucauuuuagauaaggucauauuucagcacauuccaucgagauaguccuuuuaacauccaugauggaugauguuuaugucacacauuaggaaaaugauacuccuuuuucauguauguuuaucgaaaaucaguuuucccuaaugauuaaauuauuauuauuuauuuauuuagguuuuucaagacaggguuucucuguguagcucuggcuguccuggaacucauucuguagaccaggcuggccuugaacucagaaaucugccugccucugccucccgagugcuagaauuaaaggugugcgccaccacgcccagcuuguuuaaauuauuuuuaaagguguuauacuaaagauaauuaguucuaguguaccaaguuacaaauuauugaaaaacugaguaauaugaaucuuuuguuuaaagauuuauuuauuuuauguauaugaguacacuguagcuguacagauguuucugagccaucaugugguugcugggaauugaacucgcuucagccccgcuuucuccggcccaaagauuuauuuacuuauuauguguaaguacacgguagcugucuucagacaccagaagagggugucagaucucauuacggaugguugugagccaccaugugguugcugggaauugaacucaggaccuucagaagagcagucauugcucuuaaucacugagccaucucucucuagcccaauaugaaucuuuuuaaugguuaaaacuuuuagcuauggaaaccuuugaguuuuagcucuucagaagcuuuaagaaauucuaacauaggaggcaacuuccccauguuauuaaguucugacuagcaagaugugagaagacuuugcagagcgcauaggaaaauaaacugcugugguucagugcuuccuucccucucuccauucagauuccaaugguauuacaucuuuuugauacucugcaugcacuuugcaaucuccuggucguggcuccagauaauuuaaaacaagucugcucgggagaacaacuugccaaucuggacaagaacauacuccacuccuuuguacaacuucgugcugacuauagaucugcccgccuggcgcgacacuucagcugagcugaauuuacaaaggcaauggauuguuuucucagaaggccucgguaaugggaagcacaggagauuccuuaugacaccgccaauauuuuaugggaaaaaaugacuggaagaaagcagcagccauacuuaccuggaauuuuguuugaaauuuggacaccucuagcuguauuuuuaucuuuucccuguuauguugaauucuauacuuuaauuuauaaauuucaaauucuauaaaccuacaugacuguuauaauccuggaaaauguuggugucagaaaaugaaugaaauucaccaguguucugguucuugguuuuuaacauauucuacuuggaaaucuuaucuuccuguuuuugcauuaaaaauaggcaaaagugcaguaaaacuauauuucuuauuuaucaguuuuucagugaaauuuucagugcuggugauuauuaaucaagcuauuagguuuuccuaaagaacuucucacaucucaagaggaucccgguugagcaucauuuguguagguggugaugugcuuuuccuguagggcagcagcagugcuggucuaaggaaaaucucacgagcugaacuaacuguugaugaaccauuuuaaguagacacuaggaacagaucagaauguuaucugcuuucuggguaaaacuuaaaguuuacuauuuuuuauuugauaaauagauuuuaagucaauuaauuagcaagaaauuaauaaaacuaccuuauuuuauauuuaacuuaagguggaagacuuuuaaggaccauauuuguuauuuuaauacucuuaaaggaguaaaaaauugauguauaguguaaacgguguaugugagaaauaacaccauguuuagcaacagugcagucagucccuuaagacuaaucuugaaugagaugggauggcuaaacaugcaggagucuucuauuuuaagaggaacugagaauuuuagauaaugaauaguauauauuccaaguuuggaggcaagcuugcacugaaagccugcuuuucagaccuguagagucugucauucuccauucucauucuccagucucaaagcauuucugaaguuaguacuucuugaagauuauuaauugaauuggcuuaauauggcaacauaauaauucacucacaaaauuuuaaauaucaaauaaaacuuuagaaaggccauugcucauagaccuaucaauuuacucuaagaauacaaacuagguuauauguuguccacuauucuaaguuguguguaguucacagccaucuaggaaccagguaaacugcaaucuucaguucauucauagcauuuuuuuucuuucaguguaggauuuuggucuaauuuggaggaacuguuuuucuuuugagaaccugacugaauaguuaucaacauuaucaaacugccuagguccagagcuaaccacugcacagcuuacuguugacugaauuuucacuuucuguuuagcccaguguuaacgaugguaagcggcgggcaaugagcaggccaacuuuugucauugucacuuuugcaggauauaguggcagguuuagaggcuuuccagauagcuguccucagaaaagagagagccagaacagguucucgauacuagcaaagcucugugcuuguacuguuaccacuuagaacguacugaugugaacucaaauuauaccucuguuacuuaaagccaacaguuuaaggcaguaguuuuacuggccauuugaacucuuuguacagugucaauuuguaaaaaaaaaaaaaaaaaaaaaaggaaaaaaaaaagaaagaaaaauaucaaaugaaacaucagaugacauuuuaagacuucuaaaucagagaagcacuucaaauuauuuuguuuggauuaauuuuuaaaauguaaaccaguuacuuguugcuuagauauuuuguuaauuauuauuuccaugcuugaguucugugcaauauuuuccauuauguccagugacaggacaaagaaaauucaaagugaauaccuuauuuagacauguuaacguucaugcucaauaaacaaauucccugcaguuguuuuuuuuauuuuuuauuucacccuguuuuuacacuuuaaggacaucuauaaugaauucuauaaacaauuuuuacuuuaaaauauuccuuguuuuucauagcuuaggucucccccuuuuuuaguagaaaagaacgugacuguaaucaagauuuagaaaucuuaacuagaauagaugaguuauuucuuuaaggaaauaaaaauguugcauuguguaaacuaguauuuauucuuugcauuuuacuuuuuaaguauuuauaugaauggacaucauaaaauuuaguuuagaauuuauaacucaaaaugguugucaguagauaagaugcuuuuauauauacaugggaauuuucaguuagacaugauggacauaauggagccuaguaccuuuugccaaagcuuaaagaagaaccuuguaauaguccacaguucuuggugaacuauguguaauauuuaguuuaaaaagugcuccuccaaaacacugaaaauuauuugucuaaacuuggguguagcccugacuguccuggaauucacuuugugaaccaggcuggcuucaaacucagaaauuccccugccucugccucccaagugcugggauuaaaggcgugugccaccaugcccggcuuaaacuugggugccuuaaugugacugcugaaugaacauagacucagaaggacaaucagcuuuuauguuaguuauaguaagagcacaugacaucuccuuauccauaggcuaagaaugaagacuggccccuccauuacugaagaugauagaguauauaaugaacccuuaucaagaauuauuagauaauaguugaguggauggauuuuuagaguaugaccauguaaucauuccaugacaguuacuggccucauuuaggagugccauugcugggaguccuuagggucuuccuugcuuuaaaaagugcugcuaacauagguuaaaggagguuaaauucaaauuuaguuuaaagcaggcaauuuguguuauauuuucuuugaucuuucccuuuuucuuuccuucuaaauacuucacuaucugaauacuaccuuacugauacacagccugaauaauaauuaccauuauugauucaaaguagaggauuuacugauugcuugagaugccugugucuacauuaguauacauccagaugaagagaucuugguuucuaaaaugccacugcaccucagaguagucacauaaggcaugcuugaacuguugguucaagaguaagggucacucaaguacaugccugguugguggcuagaaaaucuuauaucuccugauuaacauguuuuuuucauacuaaaauauccugucauugcccacuuauuuuuaaggaguguaaaauguuuuucacaagcucccugaacacucguugauugcuaguggggacuuugguauacaaaacacugauuuaaguucauuuaaugacauugaguuucuuuacuacucgacuugagagggcuuguccuauaauguacuauauauuuugggaaaaagaucagugcauaucaugccaaauaauuuugcaugaaguaaaaacagcaauuuaaauuuuuaauguauaaucaagguaauuaauuaguucuacauuuauuggacuugauuuucauguacugugcuaaguccuucgcauauauuucugaucccagaguaacucuuaucauuucagagcuacuauuucuguuuggcaggugaaaacccuaaggcacagagcagguaaggagaccuucaaggucuauagcugacacagucucagacuuaaaucuaguauaaugggagugaauaaugucuuuuuuuuauaauauaugcuguauuuuucuuauuuguggaacauuauauuuuuuauuuuga

SEQ ID NO: 7416 - RNA, 19393 nt, Mus musculus
ugucgcuucccccaguuguugccuuucguuguccggcaccuguuugucacauuuaugccuucaaucuuugggguggaggaauggggcaacaagacuacuagccauucuuuugucccaacgggguagguaaagguucuucuucuucuuuuuuuuaaauugcaaaaugcuaucuucacagcucaauguuuuaaauucccucuaauucgcgguccaggccgggauuugcugccuuuguagccggcgcucccugccccacgcgccaggucagagcaaaaguuguaacaguacagcugcauaaaggcacuagagguuggaugucaacagccagcagcucccagggcaccuagcccugcccacccggggaggcugcggggcgaguuccgcaggaaccucuggaaccccaggcuagagccccacccccggcacgcggccucccggaagcccuccggagacaccucgggccccgccccugcacaggucaccucccuccacgcccccuuuucuggcccggcagccggcaggcagggaagugucguaaagcuuggcccaggaaacuuuacccgggguaacaggcgaggcgcuuuacggcggcggcggcggccgggugagaggcucggcagcggcggcgacagcgguggcggugguggcggcggagcggccgcggcggugaaggcgacugcggcgcggcgguggcugagggagaggagcggcggaaacggcggcggggagcggcgcggggugagccgcgaggaggggcgggugggaggcggugacacggccggcggcggggcucgggcggccagggacgguggccggcgcggcggcgugggggcggcgcggcguuggggacacucggugagggacgguuucugccuuuguuccccccgccucggccgcccccggcccgccaguccgcgcugccuggcgccggucggccgccucucauggccuccucucucggcugugucgcuucuaggauggcggagguaccgccugggccuagcagccuccucccaccaccagcgccugcggccccagcggcggcggagcuccgcugcccguucccggcgggggccgcgcucgcuugcugcagcgaggacgaggaggacgacgaggagcacgaaggcggcugcgggagcccagcgggcggcgaggcggcgaccucggccaaggcgcguucuugccuucgcugcccgcagcugccuccggagcagcagcagcagcagcucaacggcuugaucggcccagaacugcgacaccuccgggccgcggcgacccucaagaguaagguucugagugcagcggaggcggccgcccccgacggggccuccaaagugacugccacaaaaggagccgagggacacccgggggagagaccuccccacucgguccccaacaaugcaagaacugcacuccccggccggucagaggcagcggcggcggcggcgggggcggcgagcgaccccgcugcggcccgaaauggacugguggagggcaccgagcagcaggaggaggaggagauggacgagcaggugcggcugcugucuucgucucugaccaccggcugcaguuuaaggagcucccagggcagggaggccgagcccggggaggaucggacgauacgauacguccgauaugaaucugagcuccaaaugccugauaucaugagacugaucaccaaagaucugucugaacccuacuccauuuauacguauagauauuuuauccacaacuggccacagcuguguuucuugguaaguggauggaaugaaaacagggugagcccagcagagauccaggccacucggggcagggagugugagggcccggaguguggccguggauguauccuucauuuucauaguaccuuacagaugggaggcgcgaaggugcgcacuuuucccagguauuccguggaacuguguggaagguaagagcucgugaucuggguuaucuugugacuuuuggaacagcagcaauccugugcagagcauguuucacaugggggcugucuuacauccuguuuacauuagcuucuaaucauguuuaaccuuccucauccuuagagcacuuugcugugauugaauuggaacaugguuuugauccgauacaggccuuaguaauaacucaguuacagccauggucggggaagaauauaugcgcuaaaugugcuuuagucaacauggcugucagcaaacuugcuguggccacacaggagaaugaaaucgcaggcccuguucauugauuguggaccauuaacaguuguagucagccugcuuucaggugugcuauugcagaaggugucacuaacacuuccggugccugagagggcccugaaacuugaauagaaggcccuuuugugggaugcaggaaacuuaagugugaaacuacucaaaaacagucuaaaaacuaguaccauugguuaguguggguauagcugcgugaaggcuuuuuuuuuuuacuuauauguaagcugaguauauuugucugucggguaagaugaauaauuaaguuuacauugccagcaucaguaaucuaguaaucacucaacaguaauauugacucaguuucagucuguaugaaaccuuuaauuagacuugaggugucagccguguguggcgagcacaggcuuagauguuuacuaaaggcacauauuuaggagaguaaaguucccacgucuauuuauuguuuuaacccugacauaguugcacucagucuuccuugcaguauguuuugacaagacuuaaaaagucucgugguugcuugcacagcaagcagaaauacugcacagaaauacuaauggauauuguagauauugguaauuugcuagcucccauguaaauuaugcuuaaacuuuuuuucuuagaacauuuguuuaaacuuuagguacuauuuuguauuucaguaccccgccccggauucuuaacauuguauuaaaguaguucugcuggacaugguggcgcacaccuucaauccuagcacuugggaggcaagggcagccuggucuacacauacugaguucuaugacaacugggccauguagagagaacuuguuuuaaaaaacaaaacaagagguucuaagacagugucagugaauauggugcaguauuuacaacacuacugcauaugucaucaaaugccacuccucaaaauuguggauugacuuagucguaagguaagccacaaaaguguguaauggagucacauuuuaaacugaaauggagcuggggauguggcucaugggagugggcuugaguuauguuucagcuauagcucaguuuccuggcauuuagacuaugguaagugucaguuuuuauguagaccugucuuaauugucagauagauaacuuguacuucagccuuuacuagccaaaguugaacauuaagcaacacauaucuagaaguugaaauguguacaaaaagcuuuuucuaggguaucucacaugaaaguauagaauaugaauuuggagauagcaaacaaagugauaugcaacagagguaguuuacaacuagguauuuuauauugguaugcuuuucaaauugaauuucccauaagaacuaauuuuuauaaauaaaacuuuuuuuuccaaauuauaucugaaaggacagcccuaaagauaauauagacucacuuucuauuaauuuuuuaauggaaauaaaacccauggugauguacaaugcuuaaaucucuagcuauuuaguagcagauagguaaagguagaauccaggucuccuggcuucucaugacaguaaggugagggacuaugacauaccguugaccuaguuuaugaaacacauuguagcugggguuguguucagcaagggaaaguuguccuuacaugaauaagucucgggauuaaacuuugccgugugcccccagguuccagggauaacgugguagaccuaauggaauauuugaagaauauaugaaccauaaaaauugccuguacuugguugacucauaaaaauaaguuucuuaaaauucucccuaauauuccuaacacuuuagagaauagaagccaguacaaauaugagucccugucauuuaccacaagcuuguaucccuuuauauaguauuuucagugguaguguuuuuuagaaguucuuaaacagacaacaagccauauaaugcaguauuuccauuuauucuaaauguaauuuucuggcauccuccaggguuaguguucugaaguuugggaaacuguauuuugcacauacacauuuuucauaguucuauagacuuaacagacuuuuagccuugugaaguuaaaccagagacuucccacuuccuguacuucagaaaacacauuuaauaauaugcuucaaaaugugugcagcagcuuuucuuuggaaaaaaaaaaucaaguaauuuagugauuuuuguaaauguugauaaugcaauuaauuaggaagaaauugcaauauugauuuucauaaccagcaagccacaucagguuuuuauuuuuagauaauauguacaauuugauuuauacuuguuuacauuuuuaaauuagggaagcaauguagucucaagaaugaacuaacaacaguauuuuguuugcuuuuuacuuacaugaucagaggacaaauacuugaaacucuggugcauuugaaaguauugucaagcuguacuuaguggauuuaaguuuucuuuuugaguggguuuauuaacuguaggauacagcuguucuauggucuauaagguucacauauauuuccauuucacaugaaccuaacuuauuaggucagggcaaauauuuuuuggguguuacaaauauaugauuuggucugugauuauuuuguguauauguguacacauguccauacucucucucugucucuuagacauacacacuauuugacaauccaaaucagaaaaugcuuuuaguagggcuggaguguacaugcauauuauguuacugcuccuagguuuucucagcacuacaaguauguaaaaguugucuuuuaagauaacuuucucucuguuuuaggacuuaauccaaaaacaaaccaaauugauuguugugaauuaaacugauauuuuaugaaugagaaaacaaaauggaaauaauuguaagguuuuuugaucuagaauaauuauggaauaugugauauacaaugggaugaacuauuaaugguuauugaguuuaauacuccuucaaaaggguuuucuuucauccuacuucagguuugugugaaauggauuaaaguucucuugccuacagauuuucccauaguuuauuuaagaaggaauuacuggaaauuuauugaguaauagaccacaaaauauuacagcaaauucaaauuaaaauagauauuauauuaaguguaugcuagacauugcuuacuaauuuuuugacuaauuccuagugauguucaaauagguguuucuggaaagcuaauuuacaaauaaauauugcuugcuaagauaacguccuauuuauauuucccaggauacacuauuagaacuuuuuagcaguuuugaaauauuugaaaaacauuugcauugacaacacuggcauaucaaaaugaguuaucagcauuauuuaaaauuuaccuuuaauacuuggauaaccugauaguucuauuaaaauaugaauaagucauuauucuauuacacuaaugaaagauuggaauuugagauaaauguauuugagacagggccuugcuguauagcagcaagagcaggcugccuugaacuugggauccucugacucagauccuuccauccuuccaccuuagcuuuaugagaaggauucauacugucgaauauccugaaagugagaccgucguguauuuauaguguucacguacuuuuugagugugaucuaaguaauaccuucuaaacagugcuuuuugugggaaaaaaaaaucuuagguacuuuuuucuugaucaaaauuaauugccagguguaauuuucaguuauguuuuauauuuaucuuuuauuaaaaucuucauuauaaaaaguuguaauacucuacugauggauaacuuguacaauacuuuauuguauucuaauaaguagacuuuucuuuaaaauagguuuucacuuacucccucuucccaaaauguaaacagaccuuuauugcaaaugauuuuaauuguaagcacuugacauguagucaguaaauguauuugaguauuuuaccuuguagaaaucuugucuccccuggccugaagguuuuaauaagcauuacaaacaaagucauguuuugaagaaaguuugaguuuuagaaacaauaauauuugaaaaguuuugggcuucagacucugaagcuuugagauugcggucuugcucgaaguucuccugaucucucagagaugcugccccagagucuguugcuguuucccuugguaauugugcaguaucugauggcaaugugucuucauaacuguuuguuuauuuucaaggccaugguaggggaggaguguguaggugccaucguuugcaaguuggauaugcacaaaaagauguuccgcagagguuauauagccauguuagccguggacuccaaauacaggagaaauggcauugguaaggaaaauguuauuucacaaaggguaaauacauuauuuucauuuuuguguuuugaaacaaaagauuuaaaugugacuggaggaauaaacuuuucaagguaagggaagaaaaguuuuauuuauuuuuuauaaauuuauuauugugugucuguaacacacauaauuacauagucgucugaggacagcuuugggaguccuuucucaugguucuggggcucgaacucagauuaucagacauuagaggcagaugcucggacugcuuggccaucucacuguccuuaagauugcuuuucuuucaacauaguuccuaaacauuuuaaaaauagauuuuauaaauuaaugucuuuuuaaaaauagcaugugguaaguuuuuaucuucagaguuuuuaaaaaacacauucagaauucuuugaauucagaauacuuagaacuggaugaaauauuucugucuuuuauaguuaugaagguauuuuauaccagcuacuagucuugaagacuuuaaccaagcuaaaauuauggaauaauuaucauuaccuaaugcuaaucauuagacuuacaauuugagagcccaagagaagguaauuauuucuuucuauucugagauucauuuucuuagcuuuuuuaaaaguuggauuccuuaguuuuuaaguuacuauguguguguaaguuuguaucucuaucucugaaagugucugauaaagugcaugaguggaggucagagaacagcuuuugggggucucuucuaucaugugggucccagggaacugggugugagccucuggugagccaucucugggucaacagagauuuuuuuccuaacuaucauuagaaucaucuggaugguuuaaaagcagaugguuagacccuuucuugagaaucuuguucaccugguagggcugaagccuucucuguugccuaguuacaacuucuguccuagagucucguaccugcuggcucuuucuuucacaauggaagaucagauggagaagugcuuguugggauguguaaacucugggaugcauuuuaagcuaagucacuauugaugcugucacuagugcuuugagcaguuuugcugcauauaacuuuaaaagaguauguauguuacuguuauaaggaaucccuauaaauauguuauaguuuuauuuauuuauuugauguagugcccagucuuuuuccuuccaagugccacuugcugaguuuauuuaagagguaaaugagcuuuauuuuuggacugcuuuuuacaaaaauuugugauaaauuugguuuguuuuagagacauguuugaaacuuuggugcuuuuggaaagagcuaagcacuuaggagaaacagugagagaaccguuauuuuaagguuacauccuugucuugccuuguuuugagauguguacacauucaugugccuguuuugaaaaugaagagauuuuuaaaaauguauuuuagacagagucucaguauguauguagccuuggcuggcuaagaacucuauauagacuaaguuggccuugaacucacagaggucuauaucuuccuagcuucccaaaugcugggauuaaagguguguuccagcacacguggcauacuuuguuuuucuuaaagucagaauuggcaguuacuauuuguuuuaauguaucagauuaugcgacugaauuaugacaaacuuuuccagacauuuacaaacauagaaccugcaucagugagagggccuggcucuguuuugccaggcucacuaaauuuuaccacaacugauuuuaucuuggcccacuguggacuaagcaguucacguuagguuguccugugccuugugucuggagacuuggauaacauuuggcaauuucagcucagaucauucaguaacuucuugcuagcucaugaaauucuggguuacuuuauguaauuauaccucuuucuuuuuucuucuuaccuuuuucuuccuuuuuuaaaauuuccauucaguguuaaauagauuuuuaucucagucauuaaaaauugauaaaaaguauauauagaaauguuauaucuauuuaucacaauauuuauaugcuucaauaaucauauucuaaguccaacaauauaaauauaugauuaugggugagauauauuuauauauuuguaauuugagauaaaacauuaaugauaguuucuauaauucacaaauugucauuuaguuugcaguuauuguauuuaaaaacaauuuacuuuuuuuuuuuuuaaccuuuuucuucuuaccuuucuuaauaucuuguaacaauaagacaaaaaacucuagcuugggacuaauaauuauaccugagaaaaaggaaucaggagguaggucuucccaggacagccuuauugcuauguggagguuuccugggcuucucccaaccgauauaugguuuauuuuucacuuagaaaugaucaauguauguaucuacagucaagauaaaaccuaauauuugaccuuuuuaugcaauuaugauaaucauaauuuagauucuuuaagaaauuaauuauauuuuuccuuuauuaauacucagauuuauauucuagguacuaacuugguaaagaaagcuauauaugccaugguugaaggagacugugacgaggugagucuuucagcuauuuaauccugcugcccugggcaggauucuacuggguagacuuuuucagcauucuacaguaaucaugcugcaagucucaugcagaucuacuacacagaugcagggaaaauguuauuuuguucagaaauaauaauugugaucuggaauaacuuuuaauagacuugaauuucuucauaauacagaggugaaaucuaaucguuuaacuuuugucuuuaagaagccgugggaaacccugaaccugcacaggagacgacaucucuaggaagcgucuccaguguuagaugugaugugcagugaugugcacaucagcacaggagccuucccucuguaauucccuuauuccuagagcacugugcuuaauagcuauuggggauaacugggagguuaacaucgugcaguguagguaggaacagucuuaaacuagagaauggaagcuuuucuuagagcagugacaacuaaggaaguuauuacuguacuauuagcaacacagaugacgguuaucuuuugaaaaaaguaacuuuuuuggucuuugcgacagugucucacuauguagcccuggcuggccugggacuguguugacuaggcuaguccuuguuucagcuucucaaauguugggauuagaggcacauaccacugcuugcaucuuuacuauuauagggcagaugugccuuaggaaaguugucaaauacaugaaauuaggugauauauuuucuuugacauuaauaaguguuuuaaauaauuguuuuguuucaugagacucuuguuucaggcuagccuauaguuuacuauguaguucagguuggcccuacacuugcuauuuuccugccuuacucuccagaguuucaggguuauagaagugugcccuacuaaaaggauuuuuuuuugguauaaaguuuacaguaauuuaaaauaagagugccucccccgccaacuguguguguguguguguguguguguguguguguguguguguguguguguguguuuacaaaauuccuccuaccauccugcuccucaacuguguccuuuuuacuaaaagcugguuaucuacuuucacauuuucuaauccuauuuucauguaugcauuuaggcuucacaaaaguugcuuagcaguugugaguuuuauagacuauguuuugaucuucugcuacuggaauguauucuuguaaacagagaugcuuagggccaggaccuauuguguucagcugggguucaccuuuucaugaauuauauuagucauugccuaugaggcaagaugugugcuuacugauuaaguguugaaauaauacuagcuguucuucacagcuucuaagguaggauauggagauuuuggaaaugcuguguuaguguauaguuaaaucuuaauuuuaugauguauuuuagaauugaaugcuguuauuucauuuuuuuuaauuauuauuuucuucauuuacauuuccagugcuaucccaaaagucccccauacccucccccacucacuccccuacccacccacucccacuucuuggcccuggcguucccuuauacugaggcacauaaaguuugcacguccaaugggccucucuuugcagugauggccgacuaggccaucuuuugauacauaugcagcuagagucaagaacuccgggguacugguuaguucauacuguuguuccaccuauaggguugcagaucccuuuagcuccuuggguacuuucucuagcuccucuauugggggcccugugauccauccauuagcugacugugagcauccacuucuguguuugcuaggccccagcauagucucauaagagacagcuauaucuggguccuuucagcaaaaucuugcuaguguaugcaaugguggcuguuauuuacuuaaucuacugugugugugugugugugagggagagagagauggggaggagggggagagggaguccguguguaucuguuugccagugugggaauguguacguguagagguuuguuuuccuuaaucauuuucuaccuuaaauuuugagauaaaguuucagugaaucuagaucucaucagcucagcugggcuugguggcaagcaccuuuacucacuaagccaucucacuggcuccauaccagagguaucuugagaauuuaaauaacugugugacuccuuaauuucuuauguaucguuuaugacuuagcaguuauaugauuguugucaaaucauuuaacuucuccugcucugucacuuugugugaaguuauguuaauucuaccuuuaacuguugucaggaacaauggcuacuugucauucauuagcuaccuaguccaggucugcagggagucagauaacaguggcgcagcaugagcuuagcaugagcuuccagccuacaguguuaaagagugcugucuaaacugugccaggugggcuuagccucauagugauuuacuccuguuguauuaaauguauuauauuuaguauauauagaauuggaagaacaucauucuaauugcauuucucugccaaagagaaucaaacucauuaagcuuuuuuaaaaaauuauguguguguaugacugcugucugucuguccaccugccagccuacugugugcaggugcuccagaaggccagcagagcuugccgcuagaacuggagcacugacaguuagagcugucugauauaggugcugggaacugauugggguccucugagagcaguacuugcucuuaaccgcugagucaucucuccagccucucauugaaaaucuuuacauuuuaauuagaguagccauuuguauaauuuuucuuuauaauugggccuaauuuauuauguuaaacuagaauucaaauauguuuuuugaagauuuuaauuuuaugugcaugcauguggguaugcgauguaugucugaggaagccaaaagagugacuuggguccuuuaaagagcagaaaaggcacuuagcugcuguggcaucuucagccauucaacacuuaaccacauuuaacuuguaucuguauagcuguuuacaacccuuuuauaccuuuagagcagcgguucucaaccgauggguugugacgcuuuugaggguugcaggaccuuuuuacaggaaucgcauaucagauucuugcauaucagaauuuacauaguaacuaauaacaacaaaauuacaguuauguagcaaugaaaauaauuuuaugguugugggucaccacaacauaagaaacuguauuuaagggucauaguguuaggaauggugagaagcccugguuuacaauauuuuaaaugccuaauuauuagugaaaguagacuuagauccccuugccaagucgauuagaacuucauugcacugguuuaucuucccuggaaaauaguggggaggacugaagcuugguacuaugaaguucuagcuuauacucggauuccaauuuguccuuguuuacuugauuucucuuuuaaagauuuacuuauauuuauguauacacacacacacacacacacacacacacacgcguacacacauacacuuauauacauacacacacacauacauacauacauacugcuuacuggguucuuuugggucuuuuuuuuuuuuugaguuuuauucaucuguaaaguauagaccagugguucauaaugcugcgacccuuuaauacaguucuucaccgagugaugauccccaaucauaaaauuauuuucauugcuacuucauaacuguaaguuugcuacuauuaugaaucauuauuaaauacuuuuggagauagaaguuugucaaagggguugugacccauagguuauagauacccauuucuuuucuugagguugcugucuaaaugaguauagcuauccuuuuaaauuuuuucccuuuuuauuacugugaacuaaguaauuuuacauuguggcaguucucauuaaauugcuuuuauuuaacaauuguaauuguaauuagauguuggacugaugaaaaguaugugcagccauacuuagccuauagguuguuuuguuuuguuuguuuuaaaaacagaaacugacuuaauuuuuaaguaaaucaauuguuuuuuugcuacaacuuguauuuaagucuucuuaaagacauauccauuugauacuuaguacuugauuuuggauucuuuuuuauuuuauuuuuuauuuuuuugguuuucgagacaggauuucucuguauagcccuggcuguccuggaacucacucuguagaccaggcuggccucgaacucagaaauccgccugccucugccucccaagugcugggauuaagcccggcuugauuuuggaauuuuaaagguuuggguuuagcauaucauuuacuuuuauuacuuaauugcauaggcuauugccuuugcaugauggucucuuuucaaauacucugaucaucuaaaaagcauguuaauacuuucagugcauaugcaauauaucuuauauaaugaaagauaguaaggucucauuuaacagauaugagagcuuucugucuguuaggcaguguuaggugcagaggaagcagcuggaagguauauaacaauccuaccuuccuucagcucacuggcuagaagugacauagucaacgagcauaggggugugccauaggagcaguguacagugcuguggagcaguguaaaagggaauggcaugccagugaaucuauuagcaaccaggcagaaucccggcggaaagaaauacaauucuuucuuuaggagacaaaacacuuuacaugaaaaaccuaauccagaagauaaauccagaacuugugugugggccacauauuuuaggauagcuaugaguuugcuccaacauguuuauagaugaugucaguuugcauuguuaaaagcuugggcaccuaaggugaaguagaucauggcugguuccagagacugacaguuuaauguugaccaugaagaggaggaagagggaaacuggugguguacauggaagacauaucuugauaggcauuuuaaaucucuucagguaauuuuuaguucaguaagcauauuuuaaggcuagagucaauguuauuuuaguuaggaaauuaaugggaggauccuuuguagaaagugggagacuucuugagcugguggcaguuuagggcucugucaguguggaauaaaaauaagagaaaauguaggagggagaauugauaguacucaaugcuuggaugcauauaagagaguagacagaagagaguucaagacuccuaggguucagguugaggaacuggaugguaggguggagagccucuucgcugagaugcagaguugugcagguccugagugauuuuggauauagcaaaucaagguaucuuuucucucugucacuugaauucauauucaaaauagaauaggaagaccuucaugugcuuuaugggugcucugcuuugucuguguuuaguuguacuuugccauuuuucccucacucuaaaugcucaaagguuaugacacccugacaggaacuauggcacaaugugcugauacgucucagugacacaggugacagucaauagaaaaggcaaauagagcagcauauauaaaaguuaggaaggaagaguguuuaggcagagggaaguagaaauaagaagggcacauaguuuucaaaacuaucagcucucugcugucagggccaugaguuaguucagugauacuccaaaacguucacauggaacuucauauucugugauccuauguuaaguuuugauuugagcaaaaucuagaccacagguucucagugacaucaaucucaccugguaauuuguuuaaaaugcaaauucuugggcacuaagccucuuugugugugagcauauuugugugugugcuuguguggcauaucuaugugaaugugguaugcaugcaaguuggaagucugagaucuacggagcauaucuucuucaguuguguuucuugccuuauuuuuccccaacuccuuauuuuucuuaauuauuauuguauguguauauauuuaugcuguaugagugcauaugucacagucacacaugugaagaucagauaaccuuguagagucaauucuauucuuauaccgugauguggguuccccauagucaagugcagguugccaggcuugcucuggaaacaccuucaccugauuaaccaucaccagcccuuauguuuuugacacagggucucuuuaucuaaccuauagcuugccgguuuggcuagauugaucagugaccuuugugaaucugcucgucucuucucaaccugacaccugacuuuuaugaggauaauagagaucugaauuaggguucucaaguuugugcagcaaguaauuuauccuuccuagcccucagcagucuuauucuaaccauacuccaggagaccauguacccuaauauuuaaauucccuuggucuagguucaguaaacuuucucugcauaaggcucgcaacauuaggaagguugagaaccacugcuguagaccaauaugguaguuguuaucagaauaaacaaugacauguuaauaguaacaggaguuagaggucaggcuaaauaguuucaaauauuggcugcuuuuagaaacuuuugauaauugauuuuucuucucuuucucuuuaaaugacaccuguuuuucuccacaaaaauuaguucauuuuuguuuuauuauaaacauguaguucaauuacuaaaaauggaagcauuacaaaaauaauugcuuuucucauuuugaugacauuuucuguaugccaguuuuauuuuaucauaauauuuaaacuuucaaaaugcuugaucugguuauauacuuccucagcuuuuaaguguaaaauuauaacuuaaguuuuuuucuuuuuugaagguuguuuuggaaacagaaauuacaaauaagucugcuuugaaacuuuaugaaaaucuugguuuuguucgagauaagaggcuguucagauacuauuuaaauggaguugacgcacugcgacuuaaacuguggcugcgcugaggaacugacagcaaggaacgacuccacccacacggaagcgacuuuugcaugcaaugcaauuugugcagaauugcuuugcagguggauuuagugauucccaugcagcuguuaucugucaguguccauugaguguugcacaauauuuguugcacuuuggcauggcgcauuuguucugaauuaaaugagauuguuuuaaacuucaagaguucuguugguaccagcaggaugugccaguuaauagccaagacuuguucauuugcaaagucugcugacagugcuauuuauauagugaucauuuuaucacagaaccaguaagugggacaugauuuuuguuccuucaagaagccaauguagauuguaaaagucuccuaaguauacuaacauuucacacaaaaccugccauaguuuuuugaagggggugagggaaaagcuucaauuuagguuuuauuuuuucaauauuaaauuuuccaucuugaauauugguaccucagugauuaguggaugaaaaguguaggguggaauuugucuuaugaugaguaaagaugacaauuaaauugcgucugccagugccuguguagauaaguauucuugucuucaucucuaguuuuugaaugcaugcucuuuuucuuuuucuuuaauaccuuugcaagcaaacuuguuuuuauuuaaauucuaaauuugauaauaaauuauuucagauuuuuaucauuuggacaguuuuucuaggugaguggcaguacuuugcuuuagaaggaagucccuucuucccuuacaguaagaagcugacccuacuugggaaacugagaaauggcuuaaagggauggagcugggaauugugggguuuggaugcacuuuuuuguuuuuguuuuuuugagaaugggggaauuuuugaaaacaauagaaaauuaauguaaauugguaugaucuuauuuaaucaaaaugauugauaagcugugaagaacagcuucuauaaacuagcuggguuuuuucuuuuuucuuuuuaacuuuauuugaauucacauugcuuccauuucugaaaauacuucacuuuugguuuaguguuagaaaugaauuucaaggagcauuguauccauuucaagcugcauuuauuuucuuuuuacucaugagcagauuguugggggaccuuugcuuuguuccuccagaaaaaaaggagagggaugaaacauuuuuuuaaugaguucuuuggguuuucugagcagccaagguguuuauuaguuacaguggauuuuggcuaaucaguguaauguuagcaaauuguagcucccugcuuuggguugaguugguaaagcugugaugaguaauuuauuuaacuaggauaccuaagcacucauaaggaacaagagucaguuucucaaaaaugcuuauaggaaucuggcauucauguuguuuuuuucuuuugaauauacuuuucuucuacucuaauacuugguuugaauuuuauuuuauggcuguaauuacuguauuuuuaaaaacccuaccuccauuaacaguugguaaaggccccuuuucaggaaaguuuguugcgcuuuuuuuguuuguuuguuuuaaaggaaagcugcucuuugcucaguauaguauuuuggaagugaacaugguaacaaguacuuuuaaaauaaagaugcacaguuuauauuugaaaauaaaaacuuccugcuggugggaucauuuauaguuccuuauuuuuaagaaaaugugucuuuccauuuuauauugcuccuuaaaguuuaauauuaaaaaugugauaaccacauaguacucagcuuuucugcugaccauuuugaaucuguuuuggucaaacuucauuugggucccagcauuuagaagaaugccagucaucauaaugccucuguucucauuuucagugugaaggaaaguagcuaaacaguguacuugacaucgucaaaaguuguuuugauuugcugguacauagggaugacuuguugaggaacauacauuuucuugacucacucuaauggauauaguuguaaaauagauaugugcuagacuuaccaauucaaaaguuuuguucuuccuagguugucagggaaguaucacuacuacccuucaguucagaauugcugaaguaacugauugucugaugauuugugaacaugaucuuaacuaugugacuaaaauaucagaucauuacaauacugcucaauugauggauacauguugaauaucaguguauacuuugauguuuuuaauuacuugacccuuuuuuuaaaccuaaaauuuuaaccuaauuugauaaccuaguaacaaaacuuugcaaguugaauugcuucaacuuuaauuugacauuaggcuuucaauucucuuuuaucagcuuaaagugguuccauuuauaauugacaguggguucacuuggcuaaaacugagcaaaauuggugcaacuuucuuuuaguggggugcugccucuuuaagacugacuguacuaucuauccacugacacugguuuagcaguugauacugcugaacauuuaauacaugcuaccaugaagcuguauauguuaguauugaagaaagcuaacggguaugcuaccagucuuguaauuucccauacauugggaugaaacuacuuaacucgggaauaauccaagucuacagaucauaaaacauauuacugcuugauguugaagucagcaaaauaagauaaaaauugauuuuaccauuuucugccuccucuaauacacacguaagacaaaucuauguaaaggaguuugucauguuuuaacucuuaccaugcccuguguuaaggucuuggcugguauauaugacuagauguguauguuuauuauggugucuaaaaauuaugagguucauuacuuucuaggaccauacaggaaaucagguuggcaguacaccaguuacuuuucaguauacgucuacauuacuaggaugagugcuauaauguccaagggcuuucagguuuguaaaaacauaaccauaaguuacauugucaucacauaugaguugaguaucuaugaacuaucacguguaucucaaaaauauuggacugcuguuuaaugacuggggauauugcugcauaauuuucuccuauugaccccuauccuuuuggagagagagauuugaugggauuugaaaugugcaagcugucugaauaagauacagucaaauaaaguaugguuaaguuguguuugcauuuuucuuuaagauacagcugugugcauucuauaauuugguuucagauaaucaaaaagcaaccuguucuauuucucacugcccucuaucaggaguuauuuggaaggaacgauauaggugcuaucucucuacuuuauauucugacaaaguaaauuugga

SEQ ID NO: 7417 - RNA, 983 nt, Mus musculus
cuuacucucuggaucgcuccaguccuuucacuguauaauguggauuuaucuuaccaaaagagaaauauugguuacuuauuuucuucuucacugcuguucucacuucuugauuucucaaaguauagauaaguggauucagaaagggggugaagaugguguagaagacagaaagaauuuuauccaucagaaaguuugugaaaggccacacauaaaugagaaugcaugguccaaagaacaugagcaccacugugaaaugagaugugcagguggaaagagccuuagaugauccaauugaggaguggccccugauggugacaagcaccacaauguaggagaugagcaaaagcagaaaacuuauaagagcaauaacaccacugguugcuaccaugaagacaccaagaacauagguaucuauacaagccaauuggaucaccaaaggaaggucacagaagaaacugucuaccacauuuggaccacagaaggguaaauagaggauaaaaacuaguugacucauuguguguaggaagccuaccguccaagaugcuauuacaaguccaacacacacuuuuuggcucauaauuguugaauaguagagagguuuacauauggcaauauaccugucaaaagacauggaaaucagcaguacaauuucaguuccagugaaaagaugcaaaagaaagauuugagaaaugcaucccucaaaagaaauggucuugugaugagcaaagaaguccaugaucaucuuugguguugcaaaggaggagaggcauaugucaaucagagaaagguugcugagaaggaagaacaugggggaguggagaugugaaguggacaggacagugaacagaauuaagcaauucccaagcauugucauuaaguagaaaauggaaaaugccacaaagaagaauaucugaagcucaggagaaucagugaguccaaguaacacgaauuccggcacucuggaaugguuaagccucuccauc

SEQ ID NO: 7418 - RNA, 947 nt, Mus musculus
uuuauaaguuuugcauaaugcuauucccaaagaagacaugauggagagcauauuucauauccuuguuacgcagacuauagaugaaaggauuuaaagcuggugucaccacagaauauaucagugugauaauuuuauucaugucaacugaguugccagauguggggcugacauacaucaccauuaugguuccauagaacagagacacuaccagcaggugggauccacagguugagaaggccuuuugacguccaucugaagaaggaaccugaagaacagcucugagcuccaaggcauaagauccaaggauguacaaaccagugagaauaaugauaagaguacuuauagaauagaauacaugccuuaugauguguguagggguacaggacagugcuauuaguggguccacaucacagagaaagugaucaaugauauuggggccacagaaagacaauugagaaauaaagaaaaugggaaucaaaugugcagagaaaccaaugauccaacagagggacaucagaauacugcagaauugccuagucaugauggaaggauagugcaguggguagcagauggcuagguaccgaucauaagccauggcacagaggaagaagcauucaguugugcccagggagaagaagaaguagaacugaguaaagcauccagugaaggauauagucuuaguuuuggaaagagaguugaccagcauguugggaacugugcaggucacguaccagauuucuaggaaggagaaguuggccaggaacauauacauagggguguggaguuguugguuccaucucacugcacaaaugauggccauauucccagucaaaguuaucauguagagcagcagaaucagugagaaaaguaugauuugaaucuuccagggaccagggaaucccaauaagacaaaauaugucaccguggaucccucugacacguucaug

SEQ ID NO: 7419 - RNA, 926 nt, Mus musculus
ucuaaccaaagaaaacauuauggagggcauauuucauauccuuguuacgcagacuauagaugaaaggauuuaaagcuggugucaccacagaguauaucagugugauaauuuuaugcauagcaacagaguugcuagacuugggagucacauacaucaccauuaugguuccauaaaacagagacacuaccagcaggugggauccacagguugagaaggccuuuugucguccaucugaagaagaaaccugaagaacagcucugagcacuaggguauaggauccaaggauguacaaacaggugaggacaaugaauauaguacuuauagaauagaauacaugccuuaugauggguguagggguacaggacaggaccauuaguggguccacaucacagagaaaaugaucaaugauauugggaccacagaaagacaauugagaaauaaagaaaaugggaaucaaaugugcagagaaaccaaugauccaacagagggacaucagaauacugcagaauugccuagucaugauggaaggauagugcaguggguagcagauggcuagguaccgaucauaagccauggcacagaggaagaagcauucaguugugcccagggagaagaagaaguagaacugaguaaagcauccagugaaggauauagucuuaguuuuggaaagagaguugaccagcauguugggaacugugcaggucacguaccagauuucuaggaaggagaaguuggccaggaacauauacauagggguguggaguuguugguuccaccucacugcacaaaugauggccauauucccagucaaaguuaucauguagagcagcagaaucagugagaaaagugugauuugaaucuuccagggaccagggaaucccaauaagacaaaauaugucaccguggaucccucugacacguucaug

SEQ ID NO: 7420 - RNA, 18486 nt, Mus musculus
gaaaaaguaaagaagcaguuuuauuuugaaacaaauaacaaugaaaucaacaaauaacuuuaucaguauaaauuauuuuuacauauaaacaauucauaugcaucaaauugcacauucauucacuggcauaagugcaccuccaaaacaaaguaacacaaaugaaaauacaugacuguuaaaauacauguuaauggaaagccaccauuuuccaagacuaucauuuuuggccaucauuuuccaagaccauuauuuuuacagaaauauacuagcagagaaaaaucaaugcacacauuuaacauaaacacgguagaaucaauccaaagcuccagggaaacauaacacugaggcuucuaugagcauaaacacagcuuggucugaaucaggaucugugcaacaaugugauugugugagcaaugacaaacguagagacugagauucaugaaaugcccaugcccuaagcuaacaaucaagaaaccaaacaggaagccacacgcccuacugcaagccaacuucuucuaaggucgaaaugugaagagaacucagggaugcaggaaugaaaaaugagcuaaauucuuuuugcuuuaaaggcccugcugcagacuugcugcucugcuucauggcuuggagaugcaaaacuaaagaaguuguuaauggguucaggcgcugugggagaacacacaaaaaauggucugaacugaacaucuucaucuccaccaccuugauuuccaacugguauaugguccaaagaaaacuuugaguuauucccuaggggaggaaaugaggggagaauauaagaauauuucuuaaaagaucuuuaggaacaaaacucauaaccacuaaauauauauuaacaaaauucaacuccuacaagauggauaguauaauuaccuuaaacucaucuccuagaccaaagggcaugucacuccgcuuuccccuaccauggaauauacuauccccucuguaaaaaucaagcagacagaauaaacaucugaccauuucuaccacaccuuccuuggcuuuaacauacuucaaggagaggacuagcugacuucaucugccaaaagacagcaaggaucaaaagcuaagaagaggucuggaggaaaggcucggggguuaagagcacuuugugcuccuguagcagacugagcuuuuguuccuagcccucacauagugguucacaaucauccaguuucaggauccuacccucuucuggacuccaugggcaguguacauguggugcacacacacacacaaagcugggcagugguggcacaugccuuuaaucccagcacuugggaggcagagacagacagauuucuaaguuugaggccagccuggucuacagagugaguuccaggacagccaaggcuauacagagaaacccugucuugaaaaaaauuuuaaaaacaaaaaaauaaaaaaaauuuuaaaagcacaaaggaauuaaaaacauguauaaggauguuuuuaaaagggguucaauggccauuuauuuaaaaaaaaaaaaggaagaagaagaagaagaagaagaagaagaagaagaagaagaagaagaagaagaagaagaagaagaagaagaagaagcagcagcagcagcagcagcuaggcaaacuugcuuuuagacuggguuaaacucuaguccugaagcagguuuguagagcaguuggcagagaugcgccugccucugccuuccacaugcugaacuaaaggcucacgccacuacaccuagccauggggcucugucugcauacucuucucaucucaguuccacccuggaacacugucccucugaaccuuucuccucaaccuuuaacuccaaaauuacaggaguacuugggaaaguccaucacaagaggcuuguguaugccaauuuauacauuauauuaauacugagggaaaaaacaccugugccacugggaaugagccaacauucacccaccaaucagaaaagauccugagucauccuacacguugaauugcauucuuggacaauaauuauuacauccuuauuacuuagaaucauguccaagagccuggaacauaaaauauauuuggggcuggagagguggcucagcggguaagagcacugacugcucuuccgaagguccugaguucaacucccagcaaccacaugguggcucacaaccacccaugaugagaucugaugcccucuucuggugcaucugaagacagcuacaguguacuuacauauaauaauaaauaaauaaaucuuaaaauaaaauaaaauauauuugauaauuaugugaugacggaauaagcaaacaaaugauuaaagagcagaaauaagaacugcucagucugagccagcaagguggcucaguggguuauuguacagagauuaauucuguucaaauugaaaauaauuuaagcuaggcauggugguguacuccguaagucccaggauccaagaagcaggcagaucugugaguuugaggccagccagccuggucuacaaagugaauucuaggacaaguagacuuauguagagacccugucucaaaaaaauaaauaaccaaauaauaauaauaacaacaacaacaacuuaaauguaugcaaauccaccugagagcaacaguguacugaguaagacaaggaacccacagcucaguuuacugugguucuucgcccucaaagacuucugaaugugugaacuacacagcacaauguaaaaaaccuaggaguuggguuugagauuuccucuuaccuggugggaagccaaagacuccagacugcgggaucauaccugguuccagggagccuucuuggcuggcgauagugauauuucuuagccuaaggcuaucauaaaggccuuggagcuuuugguacuggcgauuacgcuccauaaguuuuucagagaugucacuaaacuuuuucuuguauucuucuagaacuuucuucauggaaauaaccuccccuuucauagaggucaauucuauauucuugcucuguauuugcugcauauacaucuucuccaucuguuuuaagugguucucggccuugcugaaauuauacucuugauagagacgcuccugguguaccugcccaaauaaaugagaagcagcacaauauuauagacucuaaacccucauccaagcacaaguggaaagaauguuuauacagggauaucaguauuacaauauuuaaaaccuggcuaaaaacauaaucacagcauacaaugagcguacuacagaaaaccggcugcucagaaaacuauaccaccaaaacaaauaugucuuaucuacaagugagaagcagcagaaguuaggugugaagguuuauuuaugcauguagucucagcagacaggaaagguacgcaggaucaaacuuaaggccaccugggccacaugggacaaaaccacgaaaaaaauuguauuuacaggacacauagaugaagucuaauuuuuccaaggauccagaacaaaacaauacgaucucaaaauauccuugcuaucuagaauuuacacauguguaaccccauguuagacagaacauguaacuugaacauagcaaaccaaguaauacaaccacuuuggaaaagaguucggcacgguuagcuugugcacaacccugggccugauccuuagcaccacaaaaacacccuagauaaacaaaugcagguaacugguuaaggaauaacugcuuacauauuaacuuccagcauuaauuaauaagaauauuaauagucggggcuggagagauggcucagcgguuaaaagcacugacagcucuuccagagguccugaguucaauucccaccaaccacaugguggcucacaaccaucuguaacggaaucugauacccucuucuggugugucugaagacagcuaccguguacucauauacauaaaauaaaucuuuuaaaaaauauuaauacacuuuucacaguuuauucacaaaauauauaaaauaucuacuuagcacgugacaaauacuuaaaugauaaaaauauuuagauaaaguucucugcacauucacauauuuaugugaaauauaaaauaaugaaggggcuuuuuuucuaggaaaucccucagaaggauuggguucagugguaaagcacucccuugugagcacaagcgccugagucuggcaccucacaccaagauaaauaaagaucacaggcuucaaaucacacuucaguguacacgugugcgugugcuuguggaggguacuguggccuaucagguaucuucgcaugagagccuagcucuccuaugguacuaaaugcaggcccucaugcuuacaggagcacuuuacccaccgagacaucucccagccccuaggcacuaaccugguauguccagaaggccaaugcccgggagcuaauguccaaaacaaccucugggcgaagcccugccaauaccauagcuuuguacuccucugauggacugaguucuguucgaacaauaucuagcuuuccagaaaggguacuguugcaagcaggacagaucgcuggugaacgacugaacuccccgcugccgugcugaucgcagaagaugugagaacaggcagugacccaagcauaaccagagagcuugauccgacacuuccgauaauugcaaagcagcaugucuucacacaaagacauggcgaaucuccaaaagaacccuaacagggaaugagaagacaugucagucaaauuguaauggcacaaauaaauaaaacaugugcuguuauuugauuuuaaaaaauggacauuguuuuaauaaaauuauauugacuucagccucaauaccuuggucuuuccaaggccaugaagaaagucauauauacagauaguuccaucucuuaccaaugucaaaaagauugugcacaugcaaauguuuagaaacaucacauaguacaaagaaacagaaauuaaaucugcccuuuggggccauguuccaacaccaaaacacacagcauucuacuaagaccaggaaugcugaugcaagucuugcacaguacuugggaggcagaaacacacagaccuucuuaaagcucauggucaggccauucuacagugaauuucaggacaguugggacuagugcaccucauacuuggcaaacaugagacugcacauaccugcagcaucuuuucaguaaaaaucuuaagugauaaucuuuggguuauuuuauacaucuugacgucucauaucccuuacccaaacugccuuaauuuuaaaagaauagcugccuaauaaaauuagaugaggcuaauuuaucuauuaugaagcuugaaaauucuacauuaaaaaugccuguuuauauauucaguuaaacaauacaucuaucaauguugcuacaguuugauuguaaacauuuccaacaaauucucuagacugaguuauuuuucaaguguucacuauaaaaagcaacagcucugucuuagucaggguuucuauuccugcacaaacauaaccaagaagcaaguuggggagaaaaggguuuauucggcuuacacuuuucacauugcugucagucaccaaaggaugucaggacuggaacucaggcaggucaggaagcaggagcugaugcagaggccauggagggauguucuuuacugguuuuauugcucagccuccucucuuauagaacccaagacuaccagcccaaagaugguccagcccacaaggguccuuucccccuugaucaguaauugagaaaauaccccacagcuggaugucaugguggcacuuccccaacugaagcuccuuucucugugauaaccccagccugugucaaguugacacacaaaaccagccaguacaagcuccaacaggucauacaguauuugauagugggaguaucaaucauauaccaaggaaaaggagacucggcauacacaugugcuuaguacuaaggguuuccuuggcacugugacugauaucccgcaccucuaaucccaacacucagaaggcugacuuugucccaggccacccuaggcuuugaggccagccucaacuacacaccaagauccugucucaaaaaacaaaccaauguuacuuuaguagccagggguuuggggugggggguggauauaugcugacaccuucaccucaaaugucacagccguaaugccgaccgccugagguuucugugaacuacgggcuccaaugagacccuguguuaagauauucccacacccuugcugcguuucuagauacgacucacaugacaacagaggccaaacuuacuuuaccuccaguaagguaaugcgcccuuccuagcucaagugaaggugcagacuccacaucgccacaagguagccgggcaagucacacaagaugacggacagccaaguuuuucagaacaugacccacacaaguuuuccccuaauuuuccgccuuuccccaccucccacagaaaagcaaaaacagaaaaaaauaccugcaacaagguaaaguaaaggugucgauccuccacucaagacagauuucgcguggccaagccgccagggcgcaugcguggugcgcaaggccugauggguagcaggaggcgggaugauggguagcgcugggcacucagugcugagguaaucagaugccuagucuccuguuuuacaggucaaucuacacuuaauaacuuccuuuagucugucuacaccaguuauucacaaggugcuuaaaggcggcucacgcuuuuaaucccuguauuugagaggcagaagcaggcgaaccucguugagucgaggucacccugaucuacuagacugaguucuaggacaccuaaggcugagaccccaaaaaguaauaggaucaagugccauauuuuucuuuagccaggcaccuauuggugcauuucuuuaaucccagcacuggagaaagacugauccgaguuccagacuagcccaggccauauagugagagccuuucucagaagcuaccauguuuguguuucugcguggaugucccaggauugggagcagcccucucagaugcugagagcuggucuucuaggucaguaagaacuacuggggcaucccuccagucucaggcgucuaaacuuuugaggcaucuuuacggguaguuaaguggcuguuuuggggggaaaaaaaaguauauguugucuguaugcacaccaucugcacauaagaggguauagggccccauaaagcuauagaaccaccaacuagguacugggaguugaacucaggaccucuggaagagcagcagucagugcucuuaacugcuugcugagcuacugcugagcaaacuucccagcuccuaaauccugcuguaacucugcccuuccuagcuuaccuauugcaacugugguuuuucugacugcuaaaauuagggugagaagauggcuaaaaggaagcuaagaagcaaacuaauaugaaccuguugugaacuaauuaacagccacaaagaacaaacaugguuccuaauauuaaauccuucccuuuucucccaggcuuuguuucccauacuggccuugaacucacuuuguaacagagaaugaccuugaacuucuaaacuuacuaaauguugggaucaagggaauguaugcuggagauaaaauaaccuguuuuuccaugcauguuagauaaacuaaacuacagccauuagaaaccauauucaauuaauggaauaguucgauuugcuuuccccuagcaacuuaaguccuacugguaccagcuaagucaguggagauuugaaauguaaggauaaguacaaauuaaguuuguaaaagaauuuaaagcacuucaaacagcuauagcuugcuucauucgaagagauguagcaucucuggcucugggcaggucauaaucgggaccaggacccagccacucagcauccggaccucaagaaaagcagauuauaugcuucacgacgggcuuucuguagcuuaaggauggggaaugguggcuguuucccuuaggcaggcugguuuugaaacugcagggccuaaucacuguauuuaaucagugugugucuggacuuggggucagcugcuuuacuucagucuugggggagcaguauuuaaguagguccauggauaaacaacugagccuugaguuuuucuagcugucacagacaaagaauacaaauacaguauaaccucaaaugucaaagaguauaauauaagcacaagagauuuuaaaacuuauuuugugaacuuccaaguuacucuuguaaaaccaaccuugcagauacauccaaguaauagaugggauauacuaaagcauacucauuuauuguccuaacacacucguucuaggcuuuuacaguuuaaaaccaagaccaaagcuaugcgaaucucccuuacaugcuaaaaguucccaaauaugcuggagcuaugugaaugcaaagcucuagcaaacuauguugccucauaaacuucagacauaaaaugcacacugcuagacaucaacauguggagccaccaggguuuacuuugugguccuguucauccgacuugcaaguugauucugugacacuauucuguugcaucagcuuucaucuuugaguacacucuacccucacauugaauauuuuaaguugcuuuauuuauuaauuauuacuuguugugcccaaugaugguggcacaugccuuuaaucccaggacucaggaggcaaaggagggcagaaugaggucagggagauaggacuguuacaaagagaaacuaugccucuggggggaaaaaaagaaauucauuacuugggaugacucaaugguuggcuguucuugcaaaagaccuggguuugauuuccagcaccuacacaccaucucaaaacuuccuauagcuccacuucuagggucugaugcccucucuucuggccucaagcaccagauguguaaauguaaaaaaaaaaaaaaagaagaaagaaagaaagaaagaaagaacaacucauacacaaauuaaauuucaaaauuuuuauuaauuaagacaaaucauuuaaaauuuaaacaugaauguucuaauuaacuuccaagaucaaucaaaagguucucuauagcuaugggccaugcuuugaacaucauccuauaacaucugcugcuuuguaacugacagaaaguacuacccugaacagaccgccuguuuauccucacaaagcccugagaagacaagccaguuuuguauaugaauaaaaucuuaccuaggcucaacagugagaggaaguuuacuucuuaccacauaaagaggcauuuagaagauaagacucugauaaugauagggaucaggcacaugaaacagaaaagaccauuggcuuaugaaaucuugguuagugccaugauuagucugcugaauaaguauuauacccaguuacauggggauacaaauaccuucucauuccaugccaugccuaauuuuagaacuagagugagcuuuaggaggcagugcagugguaguggcacuaaaaugaguaggccacuuggcagacagaacuuuaacuuuauagguguugugccuacaugucugcauaccaugucugcaguacaaaugugagccagaagagggcaucaaauacccuggagcuagagacaggagauuguuugccagccucuauguggguccuucuagucuggaaaauuaaccaacacccaacuacacugaggucagaagguucuagguagaaaacucgccgagguuauaacuuguuaaaugauaagaacacaagagaacacaagaauauaaagcagucugucuagaagccuacuauguauccuuacauguaaccacuauacuauaccaccucccaagauccuuggcuuuuuaaauagaauucaagcagcuggccaaauuacaaagcagaacuuucagauucuuaugucaaaaaaaaucucccaaucucaagacuuaccauuaaacaaugcaacuaucauuuuucauacaaccaugguuuuacagcaugaugguccagacaggaaaugggauugcuaucaaccugauguucucuccugaauguucaauauucguacuucuuguauuucauccuucauuucugggggggaagaggaguauacaaugcucuucauaaguugugugugcuuccaaauuucuuauacaaacaugcauauaaaaagugucaaguaaggaauuauguauggucuauaaccugcuugguaugcaaacccauuuaauaaaacucaugaaacuguauuaaguagucauauaaagacugaaaaguagccaggcauuguaguggcgcacaccuuuaaucucagcacguguuaggcagaggcaggccagccuggucuacagagugaguugcaggacagcuagggcuacagagaaaccaaaaagacugaaaaguguuauguuuaaaacucucaaauguggggacuagagaaaggacuagcugcucuuccaaaauaccccuccaaaauaccccaguucaauucucagcacuaacaugguggcucagggcugacuguuaacuucugucacagggaauccauguccuccugcucuagccucagugggcacuguauguacuuaguacauaggcauacaaugcucuuccagaggaccucagcucugcucccaaugcccauuaucaggcagcucacagcaggccaggaguccaacacccuguucuggcaaagcaaaacaguacgaaaaaaaaaaacaauucuuaagguuuuuuaguaaguagaacaguaauccaaaauaguuuccaagucauuuucuugagccaauacuaauuaaauuuaucuucuauaagaaauacaacuucccccaaacauagggggaaaaaucacuuggagccccuguuggccacaagauggcaguguaaggauauuuuuacuucuaagagcuuucuugugacaagaaaacccacagaaaccaauuuaggcucauaggggcucagagacuaaagugacagcagggagccuacgcggggcugacccuuugggaugccuaauagugggcaggggcugucucugaccuucccugcuguugggacccuguuccuccuacugguuugcuuguuuagccuuagugaagagcacccagucuuacuuguaccuuuauaugucauguugauaucccugcauggccugccuuuuucagaaggggcuggggaaugggaggagagagaggagaggagauagggaaaauugcaauugggaggcaaugagauuuuuuuuuaaagugcuuacuuguaaccaaaaguucauuacgacaaauaaccuucugaacuagaaauucuuauuuaacauuauuuaacauuaaauuguuagauuagugacaggcagaacaaagaaaucauuaucuagaugugguggcggagugcaacucagcaugcagagggaggauuucuggauuuccauuuugacccagucaguccaaacagaaagauccccuugucaagguaggcuucuguaugagguaaaauauaaaaguuacauguguauuaaguaagcacucaagagacugcucuucuucugaagguccugaguucaaaucccagcaaccacauaguggcucacaaccaucuguaaugagauuugaugcccucuucuggaauaucugaaaacagcuacaguauacuuacauauaauaaacaaaucuuuuuuuuaaaaaagcauuuggaagacacugguaaugguagggaucaggcacaugaaacagaaaagaccauuggcuuaugaaaucuugguuagugccaugauuagucugcugaauaaguauuauauacccaguuacauggggauacaaauaccuucucauuccauaccgugcccuguuuuaaaacuaaacugaacuuugggaggcagugguaauggcacuaaugaguaggccacuuggcagacacagaacuuuaacuuuauagguguuuugccuacaugucugcauaccaugucuacauuacaaaugugagccagaguagggcaaauacccuggaaagguuguuuguaagccuccauguggguccuuagggaauuaaaacuaguuauuuagauuaaaacuauuuaauuagaauuaaguuuccuaucaauccuguaaugccaauuuacuuggaaggcagaggcaggaaaaucaaguugaagccggccugggcuacugagcaagagccuaucucaaaacuauucaaacuaccaacauucuucauuguucagcaaacuguauugcaaucccauacaauacaauacaauacaauacaauacaauacaauacaauacaauacaauacaauacaauacagaacacuuaaaccauugcagaaaaccucacuggaaaucagggguaggaugguuagcaugacuaauaaguugauaggaaaaggaaugcuaccuuuaaaauuacugcuacacaugugccaagugugguagcaaauaccuuugaucccaacacaugggaggcaaaaccagaaggaucaggaaugucaaccugggcuacauaacccagaaaaaggcaggaaaaaaaaaaucacaauuucauauuuacauagaaaucugccucuuuuaagcuacaucaguucccuaagguaaaacaauucugccuaaaccccacucugcucacuuuagugugaaauagcuauggaagaugguuugcuuuaagcuaaaugagaacacugguucuguaggucagagacaugcaugagcaaaggacuguuccauguggcauaaauagaagacaugugaaggaagacacagcacaaauauccacaguuugaacaaugucugccaagucuuugauucaagugcuuuuuaccuuguuugaugaaauggaaggccacuuucucauaaaacccaaauacugcauuucagggguauggugucucuuucacucucucccuuucucccucucucccucucacucucucucacauacacacacacauaugcacacaccucaacaccuauccccuaaaaauuuuguaauaugccauaaucaaagacuguuaggugugguggcccacgccuuuaaucccagcagucaggaggcagaggcagacagaucaagcuguaggccagccuggucuaccuaacaaauuugaagccagccaggggauacacggcaaggcccugucucaagacaaacaaacaaaccaaaaaaaaaaacacaagacuuugugggguaugaaccuguaauuuaagccugaggcagaaggucggcagauuaaaagcuuaaauaauuuaacaagauucuguuucaaaauaucuuacaaagcuagaccagagaaucgcagcucagccagugucccaccucucaguaccauggggaaguugcugggaccagcauguguaaugcggaaaaccugggugaacaugaguaccugcauuuauauauagucccaucagccuuuaaaccuuccuugagagagaauguccaagcccacuuuagauauccugggguuuucacagggccucuaugccgggcggggcugagugcuacagucccagcucuuuccuggacacaauucaucuucaaccuggaacuaaacaacaaaagcaacaaaagcaacccugaggugaggcacagcuauggauacaguuucauuucgaacuaccagcuguuuaccauaccagggacagaauacagugggaauguauaugaccaaccacguggcucacaccgcuucacccauccaggcucaugacugguaaguugaaggaggagugcuugaaagccauggcucaagacagcaggaaaaaaauaacuuacaauugggauacagggcaguaacucugccuaauuuuaacuugcuauuuccccuguuuuauuaucaucccccuccuuagaguucaucaucugcuuccuacaaauuucaucgauaucucagugcauggucuuuguuuuaaaaauauucaagcaaggcuuagagacugucaagguaacuaaguuuaaugguuaagaaacuaaauguaggggcuggagagauggcucaguggugaagagcacugucugcucuuccugagguccuaaguucaaaucccagcaaccgugugguggcucacaaccaucuguaaugggauccaauucccucuuuugguguccuuuaaaaaaaaaaaguauuauccuuuccccagccuaauuaagacuuaauugccagggcuugagagauaggugccucagagguuaagagcacugucugcucuuccagaaauucugaguucaauucccagaaaaccacaugguggcucacaaccaucaauaaugagaucugguucccucugcuggcaggcagacauacacacaggcugaaugcuguaugaauaaacagcauuucuuuuaaaaaagacuuaauuuacaaauacaaacggcauaaucuaauagguaguaauuuguuaagagguagcuaucuaucucuuaaacgucugugaagaggaagauguggggagcacacuuaucuguuaacaauuugagugcagaucugcagaacuuaacuccacuaugcuuuuuaucuauguaugaauguuuugccugcauguauguaugcgcaccagugucuuccuggucuccagagcccuuggaucuccuggaacuagagcuacugaugguuuuaagauacaaugugccgggcggugguggugcacgccuuuaaucccagcacuuggaagaggcagguggauuucugaguucaaggccagccugguggucuacaaaguugaguuccaggaaagccagggcuauacagagaaacccugucucggaaaaaaaaaaaagauagcugaguguugagaacagaaugcagguccccuugcagcaccucuaacugcugagaccucucuccaugcucagauuuguaauuauggacuuaagacaaauaagcuauaaaggauauagaagccacauaugccuauuagcacauucagcuugcuagguuaggauuuucuucucacauucucugccuauaacaauaacccaugcaucaggugugauagcacacaccuuugauccuagcacucaggagacagguauagugaucugugaguugaggccacuccgugucuacauagcaaguuccaggacagcaaaacccagucucaaaaaaauaaaaauaaccaacuaaguaggacugcagagauggaccuugcagagaucugagcucaauucccagcacccauguugggcagcucacugcuauuguuaacuccaggggaucaaaaagucaaaaagccucuucugguucagaaggcaccugcauacuuuaugccuccacacuuaacagacuuaauuacaaauaaaucuuuaaagaauaucuagcccagggguggcaauccaugccucuaaucccagcacgcaggaggcugaggcgggcagaucugaguuugacaccaaccuggucuacuaagaguuccaggacagcuagaaccauacuuuuuugucaaaaaaagaacaaaaagccaccaacaccaaaaaccgguuacgcuuagacuaguaucaaggagaaaaacaggagucuugugaguuccacacaccgaggucauuagaaaacuuuucaugagucaaaaauacccgcaauggagauuauaaacucacagcuugcuuuugcaaaguagcuaguauuuacuguauaccaacuaggguguauuuuguucacucuucacaaaggaagcucagaauggcucacacuauccuccgagcagagcagaguaucuccagauacuccagacgcaggcgcuacaauuugaacauuggcuugcgcaaagcuaaaaaacccugguccuucucagagcgucuuauaaguauuuuaggacacaggcgccaccguuagcccuccuagggcuuguuaaaccaccuauccucagcguuaucuaucuaguuucacacauggucugagcaaauacgacacuguucacuaaagguucgcaaaugugucaaggucguggccccacaacauucaacagagacauacacgugggccucggcaguccuuguuugccagcuuuccccagaccaggugacccagaaacaauacauucugccucgggcacaguguuccugaaucuggggaaauccgucuguauucuuuuuuuuuuuuugggaaaggcaccguuacuaccccggcgcuaaccugggcggucucggagggugagugcagccucugucuuugguucucugaguucaaggccugauuuacagagugagccccaggucugugaagaagugaagaaggagguggaggaggagauggaagaggaggaaaaggaagaagaagaggaagggcaggagaaagaggaaagaaagaaaaggaagaugguagggcgugguggcgcacgccuuuaaucccagcacuugggaggcagaggcagaggcaggcggauuucugacuucaaggccagacuggucuucaaagugaguucccggacagccaaggcuacacagagaaacuaaagaggacgaagaaauucugaauaucacagauauaccgauggagcuggggggaaaagucauccuaagugagguaacccugacccaaaaaggcaaauacauaugugaauguuagcuucuaauccuuccauaggcaugcugcaauccauuauaaccacaacgguuagguauagagucagggaugaggaaggggagggaggacaggaucucccaagggaagggaaauagaauauauagcuauggagaaacaaggggagaauggagcuggaggauuaaauggggagggggauggagaagaaagguaaugggaauagagacucagaaagugacaaauaagcaugcgucauccauaagggagccugcuacuguagaagcuucuuaaaacauguacauguaugaaaagaaagccucagcuagacaccagucaccaccaagagaaaccaccagggaugggugacaucuaagugaguuguuugccaaaagggauccauggaaacccccaaagaacccaguauccuuugcucucugcaaacugauggcaaggcccuguuguuaaacauugauacugucauaccucauugaauauggaccaguugagcuagugccugucuagagccuucaucccuacugacuaauuuucauaguacuggaagguacccuguacaccuacugauaugggaugugugugugugguaugugagugugugcgugugcccgugccccccacaccguuagagugagcauauauguaugucucuugugcuuuuucuuucuuucuuuuuauucuuucgguuuuuuucaagagaguuuuucuauauagccugggcuguccuggaauuuacccucuagaccagguuagccuugaacucagagaucugcuucccugugccucccaaguauugggauuaaaagugugugccaccacacccagguuuuguuuuguuuuuuuuuuuuuuuguuuuuuuuuuuuuuguacaggguuucucuguauagcccuggcugaccuggaacucacuuuguagaccaggcuggucucgaacucagaaauccaccugucucugccucccaagugcugggauuaaaggugugcgccaccacugccuggcucacccagcuuuuuuuuuuuuuuuuuuuuuuaaugaguuuguauguguuuguguacguaucacuugugcuuuuuauuuauuuauuuauuuauuuuuuaauuuaauugccuguuuucuaaagaaagcucaagaggacauggaguuaguuggauggagaccuggaggagaugagggacgggaaaugguaaucaaaguuuuauuuuucaguuuuggucauuaaucgaucugaggcauccacacacuagucaagucacagcuucgcgccuuuguaaggaaagcugggcuugguaugagcccuauuccacuccuaucucaauugcuucuccuuucucaguguucuucgcuguagcucaacucugcucauuuacuucaugaggaauucccagccuguuucucuauuaugauacuaugugcuuuuccuaaguacuuauuacaguuacagguucauuuuuuugguuuuguaauaagucuacauauauauucucccaauaacaaguuacaugaagguaugaacuacguuuauuuuugcuagacaaauagcuaaaguauagccccaaaaauccaacagugggaggggguucauaucauguuucacuaaauguugucaaacucccuucuauauuuuuaugguuuaauccauauuugaacaacucucaagcuuggucuuuuuauaguagaggguuguggucaauacagucacaacuguucaaaaugaaugaaugacugacugaaugcugagacacagaguaaauauauaaaacccuuucgagucaauacuccaaaaggaucucgaucaaaaaagagggcgggggagaguagucugaauuggguuaugaggcccgggaggugccucaccucagccauugaacucgcacugcuggccgugagucuguuccaagcuccggcgagggaggcauccgcuccggcgagggaggcauccgccccgacucggggcuucuccugcccagucugcccaagcguagagcccugcucucugggaacucaccuccccgcucggggagagcccgguuagggccgcgggaggcccaagucucagaccuucccaggggccgaagagugacacgcacu

SEQ ID NO: 7421 - RNA, 327 nt, Mus musculus
gagggcgggggagaguagucugaauuggguuaugaggcccgggaggugccucaccucagccauugaacucgcacugcuggccgugagucuguuccaagcuccggcgagggaggcauccgcuccggcgagggaggcauccgccccgacucggggcuucuccugcccagucugcccaagcguagagcccugcucucugggaacucaccuccccgcucggggagagcccgguuagggccgcgggaggcccaagucucagaccuucccaggggccgaagagugacacgcacucagcacguggccccgcugaugagcuuccuccgcccacuu

SEQ ID NO: 7422 - RNA, 13464 nt, Mus musculus
cccacaaagcacagcgcguaauuugcaugcgcucuaccccaggcuccugugcuagacaagaagcccgcgcauccgggcaagggaugaugacgucguccuucaagagcgauggcgccgcggcggcagagaucaggcucuggaaggcgaggugggaacucaguccgcaggcugaaugcucggcccagugucacagggagccucucgcuuuuucauauuacacuucaguccaaagaggcgggucacggauaagcgcuuacaguaaagugauuagcuguagucaaccuuuuaagauacauccgauuucagaaaguaaaauucgaaucuuagaauuggugucuguagaccguauacugugucuguggucucgguuuuauauuucgggcaacuaaaguucaaugaauuuacagguucuaaagcuccaaauagcaacgcuggcagcaaguuggucaguccagaccguugaacacuuuacugaugaccaugaugaaguggucuaguuugaaggaagguauuagagaccaaaggcuaugagacccauguaaugaacuguaaagaucuauguaaacuuauuuuauccuauuauuaauaucccaucaggauagcaauuuaggcaguauugcucagugaguggugugcaaguuauuaagagcauguugaauuauuucuuuagaaauuauuuaaucuuuauguauuuuaucugcauauauauauauauaugcaccauguaugugccuggaaguguuggaccccccguacuagaguuacugacaguuguggucugccauaugagagauggaacuuaaacccagagccucgggaagaaucaggcagcuccuucaucacugacccaccucuccagcuacuuuaaguucuuucuuuaaaggauauuaugagagccuggugggcauguuggcucacaccuuuaaugcucgcacuugggaggcagaggcaggaggaucucugugagguccaggacagccagggcuauauagagacccugucauuuaaaaagggggguggggggaggaggguugucaagaagcuggagaguuagcucaauguuaaaaaccacuuguuagccaggcgugguggcacacgccuuuaaucccagcacucgggaggcagaggcaggcggacuucugaguuugaggccagccuggucuacaaagugagcuccaggacagccagggcuauacagagaaacccugucucgaaaaaccaaaaaaaaaaaaaaaagaaaacaaaaccaaaaaaaaaaaaaaacacuuguugcccuuauagagggucugaguuugauuccaaaaucccacauggcaagucauaaccacccucccagaccuccagguacaccagacauccagacaugcacguggcacacauacauauacagacagaacacccauacacguaaaaggaaacaauaaccuuuggggguuuguuucuuuguuuguuuuggguuuuauguuuguuaacagucaagggcagagacaacucuacugucucugacagcaaccuuaguuuuucagagaccuccacucaggcaaaccuaguauucuugccuuuaaaguagaaaugacuuucaagaguaugcaaaaugaaccaaaguuggaaguuuauuacaggagaugccaauauauguuuuaagcacaaggguuaaaagaaacggaaugacugggaagagagacgccacagaacaugagugugggcuucucaaagaagaaucacccuucacugucuuuagaauagacauguauguaagauuugugauuuuuggcucuucaaggaguuguuaaagaauuuaaaugagaucacaguuccugaggagaucugacagaauuccagaguccaagucuggaugauaagggaugcagggaguuagguuaucagcauugucaacaaugcucguggucuguuuaagacucccauaaaaugggaaagaaaugaaccaggcccauugucauauucauuuaggccgacagcccaauucagugucauuuuaacaugaaaauaucugaagaucugcaucagcagccuucauagaauguuaauugggcugaauuucuugcuucucaacuucagagaggcuucauccugacucggggauaggaggggcugcuuuuccuuuucauagccaucuaauuuuccuguguuuuuauuuugcuucaguguuguuucaguaaaguuagaucaucuucauagugcaguaauucuugguauauuguucuugccauaagugcuaaaugaagccaagaaaguugauaauggcaacaaagcaacagaagacgacucuccuccuggcaagaagaugcgcacgugccagagaaaagggccuauggcuggagggaaggacgcagacaggacaaaagacaaucgagguaaugggccagggaggacaugggacaacucuuggguuuccagaagaauggggauaacauuuguuccuucccucuucaggaucuaauuaauuucucuaucaccugggcauucugcaguaccagucuacuuuguugaauauuuucauagauuugagauggauuagaacccaggcagaagaccuggacugcucgggaagggcaaaguuaauuaugacagcuuuguagccaagacggcccuuuugauucccacaucaguaacggcagugcguguuuguguucccucagacucugugaagaccuugcuguuaaagggcaaagccccuguggacccagagugugcagccaagcugggaaagguaaaagcaccugcaauggaaggcagaguuuucuugucuuaugaugaucccugucuagaaugucgguggugcucaguuuaaaaauacuuccgaaaauauugcuagugaugacuucucuccagaguugagaaguaggggugaugagguuucagcuuagcagaauauugagccuggagaaaugauccagugguuaagagcauuuauuguucuucaagagccaucuguaacuccauuucuaggagguaggaugcacucuucugaccuccacaggaccaggcgugcaaguggcacacacacacacacacacacacacacacacacacacacacacacacacacagagagagagagagagagagagguaaaacacauguaaaauuuaaaaaugaauagauuuacuuuuuaaaaauguaaagaaauucacagaauaugacauaauuacuacagggccugccauuagcuuuccuucuucacccaggaaauguuaggauuguuaagggagaacuguguggggguuugguuugguuugguuugguuugguuugguuugguuugguuuggagacaggguuucucugugugacuccuggaacucacuccauagaccagacucaucucaaacucagagaucugccugccucugcagaucccugcaugcuaggacuacaggcaugugucaccauugcccacuugacaguguaauuuugauuauagacuaccauggaauggcaggaguuacugaugaaggggaaagagguuggaaggaucuggaagcaagccuacuuauaagcagguuucuuuugagguagacucuuaggucucuguaauuagaaguaguuauuauguuuuuuuuuuuuaagauuuauuuauuuauuauauguacacuguagcugucuucagaugcaccagaagagggcauuagaucucauuaccggugguugugagccaccaugugguugcugggauuugaacuucagaccuucggaagagcagucggugcucuuacccacugagccaucucaccaacccguuauuauguuuuaguuauaauaaugguagucuguauguagagcaugcauuuccuuuucucugccuggaaaacaaauguuguaggugcuggagaacaaaccuuaaagcauuaggggugaaaagucucacuuuaagccgaagacugagugcgcugaugcuauguguucucucuucccaggcucauguguauugugaaggagaugaugucuaugaugucaugcuaaaucaaguaagaagauaagucauucuaauugggggaauuucuuucuuuucuuuuucuuuuuccuuuuaaaaauuauaucuguuuagugaauuuguauguaucuauguguggaagacaaaggacaacuugagucaguucucaguucugguguaguggcacacaccuuuaauccaaucacuugggaggcagaggcaagcaguucucugugaguucaaggccaaccuggucuacauaaugaguuccaggacagccagggcuacaaagugagacccugucucaaaaaaacaaaaaagggacaaggggggaaaaaaagaaaagagucuguucucuccuucugccaagagugucucugugaugaacucaggauuagcuggguuuggcagggagugccuuuacccauugagcccccagcuaguccagguuauuagaauuuccuuauaauauaaucagcucaugucuuuccaaaauugacauuggcuuuugauuauauuaugaucuacuuuuugcccaugguaaagacuguuuguuuguuuguuuguuuuguggggaucucuguuuauuugugacagguacugucuuuguagcccaggcaggccuucaacuugcagucuuccuguuuccauaucuauaggacugagauuauuggggcacagcugucuaacccaguucaagcuggcauuuuaaacauguguagauaguuuuauuuauguuuuaaaaaguaguauuguugugugugccuggugggagaagacaaauauguggagucccccaacccccaccccuuaucuuugcaugugcauguguguguugcuauguugcccuuacuagccuggcagucacuguguagaccaggcuggccucagacugacaguaauucugcugccucagccuccugagaguuagaauuagaagugugugcaccacaauuuucuguuucuuucuuuuuuucucccaguuugagagaccaaacccagcaccuugugcuugccaagcaaagcucuacccagagcuggaucccuaaccaaucuuuuuuuaaugauugauuuuuaucuuauguacauugguguuuugccuacaagugugucugugugagggugucagauccccuaggacuagagcuacagacaguugugagcugccacgucggugcugggaauugaaucccaguucucuggaagagcaaccagugcucuaaaccacugagccaucucuaaggccccucgugucuucuugucuuucuuucucucucucucucucucucucucucucucucucucucucucucucucucucucugucugucuuucucuccgucucucucugugucuuuguuuucucucucucauauacacacauaguuuugaauagauauuuucuguuaauguauuuccuggauaugacucauuugaauuuaucuacuuuugugcuugugagugcagauauaggcuuauauagagaggccaaaggucaacuucagguauuguucaucagguuccacugacuaguuuugauuuuguuguugugguuguuauggaaagugcuuuugcuaaccugcucucuuaauagguuaggccagugggcaggcuccagaaauccauguuucugccgcucagugcugggauuccaaaugugcauugccauguucaguuucucacguggguuuuggggauugggaacucagaccuuaugguuguuuagcaaguacuuuacugacugagcuuucucaccaaccacacacuuccauuuauugaucuaaauaucuaaauaugucauuuuacagcucacuaguauucuauuguugguuuuuugguuuuuuguuuuuguuuuuuuuuugguuuuuugguuuuguuuuuuuuucaagacaggguuucucuguauagcccuggcuguccuggaacucacuuuguaggccaggcaggcugaccucgaacucagaaauccaucugccucugccucccgagugcugggauuaaaggcgugcuccaccaccgcccggcuucuguuguauuauuuauaccuaaacuaucauaagcugugccagggagcuggcugagacacuaacucuugcaguauaugccugaggaccucaguuuggaucccuaacaccuaaauaaaaagcugaguacaguggcucauacauguauuccuagcugcaaggagacagagacaggagaacacaugggcuugccugugagcuccaggcucagugagagacccugucuuaauaauguagcgugaaaaauugucccggccugugggacagucgaagagggucuggggaaccaccuguggagagaaugagaggugagaaacaaggacgggcagcaagucugauugaucaagcugucaaauuuuuauuauucccaggcagguuuuaugcccacagaagcaggguauggggaggggggugacgcagaaucgcuuuguuucugggggaacacaccuguucccaaaagcaggcuauuggcuagguaaaaaguucagcaggaggaacagaacagaauggguuucuagguaccuguccacaagaucuauagcuauuuguucuuaacuggggguaguguuuucucauagaggccucaacuuuuucccacagaaaucucaacuaaguuaauacuuuuccacuaaggccaaaacuuuguaaguaagcacuuauggcugacaaggcaguuaacauucaaacagggucgcucccaacaaaaaaugucuauggagggagccauugagaggaucccauuaauguaggaugucaggguuggguaguggguuucacuggauggcuuuagcucccuugucaaagaucaagugaccauagguaugugggggguaguggguuucagagagcuuccaagaucccacuuuaauucccagaaugaaauguuagguuucugcuuauauccuuacucucucaagaucgauuuguuucaucaugcuaugcuuucacuguggcaauuccuguacagcuguagcaaaggaaacacgguggucugugugaccuccaguuguaaaacuaacuccucuuauguuauugucaucccacuugucacagaccaaucuccaguucaacaacaacaaguacuaccuuauucagcuguuagaagaugaugcccagaggaacuucaguguuuggaugagguggggccgagguaaaggcuuucugauggguugaugaguuguuguucagaaucacagaggcuacgcagugagugggcuuacgucuccgcgugacucaggaaugcacaugggcuuuugagguugaggggugucaggcauccacauuggggugcuuggcgaagcugagacgaccccuguacuggacugacaguacugcuuauauauaggcugugacacuuagcagucauuaguaucagcaugaucgcuugccuaagcccuuucaccuuucucuccucuuuccugccuauuagucagauaguaagcagagagaccauagagagauggcucguuacuacuggagagcuacacucagggucuagggcaaggaacccuccuaugugugcauuuacuuugcaguuggaaagacggggcagcacagcuuggugacuuguucuggugaccucaacaaagcaaaagaaauauuucagaaaaaguaagugcuaaaaaugaguuuaaaaacauacccuuuuuggaucgcucuuguugaaauguuucacguaaagaugauuuggcauaaaaguuaauucauuucuacucucacucucugugauuagaacauuaaauuguaucuucagccaguguuuaaaucauccuagaaguugaccagaagaauauuuuuuuucuuuuuucuuuuuuuuuuuuuucugguuuuuugagacaggguuucucuguguagcccuagcuguccugaaacucacucuuguagaccaggcuggccucaaacucagaaauccgccugccucugccucccaagugcugagauuaaaggcgugcaccaccacugccaggcucagaagaauauuuuuuaaacacagcaagcaaaucuaagaaauuagacacaccagacuacacccacagcauuaaacuucuggaggugauuuugaggacagaccuucuagagucuagaaacaugucucuuucuggacaagcauugcuuaucuaccuguucuucuauacauccauggcuucugucucggggggccucugggacgccuuuacuccccauuuuacaugauuuccuuguuccuguguugcuguuccuucagugcccugaguuacaguucacacuagggaacccugagguaggccugagcggugagggacauaaauuguugagaaacuguguuagagaauugcugcacgccucccucuggcaaugaaccuugacucgucugauuuucccacuaccuugggcuccacagauuccuugacaaaacuaaaaacaauugggaggaccgugagaacuuugaaaaaguaccuggaaaauacgacauguuacagauggacuaugcugccagcacgcagguaugcugacugagucagggggggcuaaccaggcgcuggagaucagccucagaccagaagaggcugcgauauuaggagucacugcuacuucccaccucagagagaacucucccucgucuuugaucgcagagucuggucuucucuguuauguacuagaauucuuucgaaauucaaggucugcuucuagaaguucaguguuccugaccaagagaagauggagaaaugaccaaacugaggagcuguuuaaagcuagcuucaucacugugaaggaagugcaggggcugaugugggauguuugcccagcaugcacgaggaggcccuggguucaaaagcaagaaucacaaaaagaaagaaagaaaaauaauuuugacaaauggguuuccaggaugcugagaagcuaccuaaaaacucuuagaucuggaaauuaagaaacuugcauuaauaugaucaggucaggggugugagagcuguguuuacauacuuaaagacauugcugaaaggccuuuuguucuuccucgaguguuucacugugagggagcacuagcaagucaggguagaaaucacauuggcuacgcuuaacuagauuccuaauagaauguaccagcauucaaacacaggaccacaguagagcuguucccuacagauguuagaagugguguuuauuuuacuacaggaugaaaguaaaacaaaagaagaggaaacuuugaagccugagucucagcuggaucuucgaguccaggagcugcuaaaguugaucuguaacgugcagaccauggaagaaaugaugauugagaugaaguaugacaccaagagagccccgcuugguaggacucagacucugugcagccccucaggguccugucucugcaugagcagucucaucgauagcuaagguuuacucaaaauccuacaugagggaaacgggaucgagggggaugggguugaaaggaauugugucauuacugggcagugauaugcaguuuauagggaugggacucugguuuggggccugaucucugccugggccuccaggaaagcugacaguggcgcaaaucaaggccgguuaccagucucucaagaagauugaggacugcauccgcgcuggccagcaugggcgagcgcuuguugaagcgugcaaugaauucuacaccaggaucccucaugacuuuggguaagguugugcugucucuuuauccugcucuucuacucaccuuuuaugcccuaagcagcugcagaggcuaugguccucuuaaacuuguauuugucaccuuaaauaaaauuggauccaaugugauuuguagcuagcuuagaauaagggacggcagcacucaggaggcaggagaggcugccucaugaguuugaggccagcuuuaacucuaucucaaggaaaguuuuaaaauaaaagaaauaugggacauaauuucccaacuuuuuuuuuuuuuuuuuuuuugguuuuucgagacaggguuucucuguauaguccuggcugaccuggaacucacuuuguagaccaggcuggccuugaacucagaaauccaccugccucugccucccgagugcugggauuaaaggcauacaccaccacgcccagccaaacuuauuuuuuuuuuaagauuuauuuauuuauuauauguaaguacccuguagcuaucuucagacacuccagaugagggcgucaaaucucauugcagaugguugugaaccaccauguggucauuggaauuugaacucaggaccuucggaagagcagucagugcucuuacccacugauccaucucuccagccccaacuuauuauaaccauauucuugaccaagugaaaguuaccaacucaagagagaauggaccccuggccccacaaaauaaaauaaaauaaaaccuuaaaaugcaaaaacaugaaaagucuauaucuagccacugugugaaacaccuugcaaaccccgucccuucuguucuuuaaggggacuauaguuacacaaauaccacuuuucugaaucuaaaugauugguauuaaaugaagaaaacacauuucugcccuuuauuuguguguguauaugugugugguccuggggauugaaccuaggccuugugcauguuaccugagcacuuucccacagagcuguagccucacucaauccauuugucauacugguuuucauuguuuccauuuaaaauagcucugaaugcucaaaggacuuaccucuucuagauuguauucagacuuccuuauugaugucaauguagcuuuuuaaaaaaagauuuauuuaucuuuuuuauguauaugagcacacgauagcugucuucagacacaucagaagagagcaucagaucccauuacagaugguugugagacaccaugugguugcuaggauuugaacucaggaccucaggaagagcagucagugcucuuaaccgcugagcuaucucuccagcccaauguagcuuauuuuuaauaaggaucccauaaagaaauuucuacucuagucucuuaacaugaaaaucuaaauaguuuguuuuuucucuuuauaugcuugggcuuugaagucuucacaggucucucucuuucaaauagguaaucuuauuuuuguuucuuuguuuucuuuccuuuuaaaguuuuuuuauuuguugacuuguuuguuuguuuguuuauugugagacaaaguuucucuguguauuccuggcugucuuggaacucacucuguagaccagacuggacuugaacucagcucacauagauccuccuacccuuccuccugagucugggauuaaagguguccaccaccaggaccagcucuuuccuuuucuuuuuaguaagaagaaaacucucaguuucccagaggaccuauucuuuagccaugcaucucguaucuacagaucugacugcucacugugcuuguaucucuguccuuagacucuccaucccuccaguaauccggacagagaaggaacugucagacaaaguaaaacugcuagaggugagcucugaaugcauuuggaagguuucagccucuucuuccgaguuccuucacauugauucuugauuucauuuuccuaggcauugggagacauugaaauugcccuuaaacuggugaagucagagcgccaaggccuagaacacccacuggaccaacacuauagaaaccuacacugugcuuugcguccucuggaccaugaaaguaaugaguuuaagguaauaaaaacagucauuuaucuucacauucuuacuccaguagaacucuucuaacucauugugaggcugucuggggacggaaaguucugccagcuucaggagcccugcauccugcaguucauuccagucucuuauaagguccacauuugcuguucuuaauuauuuucugcaggugauuucucaguaccuacagucuacgcaugcuccuacacacaaggacuauacuaugaccuugcuggauguuuucgaaguagagaaggaaggggagaaagaggccuucagggaggaccuuccuaacagguguggguccacucuggguugaguagacauuuccuugacugaaauacagggaaggagcuuggaggcuggcagaggcagcuguuguguuggguuguuuuuuguauuugcgauugauguuugcagaaaaagaggaaacuaauggcucuuucuuaggaugcugcucuggcauggauccaggcugaguaacuggguggggauccugagccacgggcuuagaguugccccaccugaggcucccaucacagguuauaugguaaguagacugaaggcuaggagcccaaagagaaaaaaacauacaaugaugacuuuuuuuuuuuuuuuaccgugucccucuuuaaauucuaaaaaggcaaacaucgguggcuguuuuuguugucucgugagcugacuuggaaaagacagugggggaggaacuaugcuguguuaugagagcagagucucaugaccagugcugucuuccucaucauagauuuuuuuuccuuuuuugucuguuuguuugguuuuguuuugagacagggucucacuauguagcaagucugcaacuugcuauguagaccaggcuggacucaaauucagagaucugccugcuucugccuucugagugcaggggauaaagguaugcaccauaccaggaccuucucaaaaagugcauuagacagcugaacuccauuguuguugauuuauuucaguuuggaaaaggaaucuacuuugcugacauguccuccaagagugccaauuacugcuuugccucucgccuaaagaauacaggauugcuucuucugucagagguaaggccggggacacagcuaugaucucuaauuuacuguuaacucagauuuugcacugguaaaauuugacuuuggauucaagaaauucaccuggaauuggauucccauugcauuagacucuucugcugaagcaagggaauaaaauacagaucagggugacuuuagaaucaccuaguucuugacuggguauaggcauucagggaccuuuuguuuugcagguagcucuaggucaguguaaugaacuacuggaggccaauccuaaagcacaaggauugcuucggggcaagcauagcaccaaggggaugggaaagauggcucccagcccugcccacuucaucacccuguaaguaccccgagcuaaggcugcuggaagacuucuuucuaguuguuaagaaucuacugucuauuucaacucuggacaaaaugcugacuuugacauauuuucuuccguuuggcaggaaugggaguacagugcccuuaggaccagcaagugacacaggaauucucaauccagagggguacacccucaacuacaaugaguuuauuguuuauagccccaaccagguccguaugcgauaccuucuaaagauucaauuuaacuuccugcagcuauggugaauguugaucagacaagccagagagaauauaaucuucaaacaaaaaccaagcaauauuauguucuugaacuuuuugauauuuuguuuaauaaaauaguauaaaucugucu

SEQ ID NO: 7423 - RNA, 2149 nt, Mus musculus
uuauuuuguccaugcgaaauuuuuuauuuaagcucaucuuuaugaacaaaucacaaaaaaaugugcaccccccaauucccuucuuccuuuucuuuuucaaucuucuuuuuucuuuuauguagucuaacuaaacuuucucauuuucaacuauauuccuugccuaucuuaaacauagacauuuaccccaucauggugguccacaccuguaaucccaagacucugguguuggaaacaaggaggaucagaaguucaaggacauccccaacuacacaaugagauugaggcuagccucggcuacacaaugagauugaggcuagccucggcuacaugagaccuugucuagagcaacaacaaaauaaacaaaaaccuaaacaaaaaaauagaggaaacaagucgaaaauaaugugaaggggaaggggcugacaagaagaaacuuccuucccaacugccuuucuuuaucugucaccuucucagccauguucucucaucgucuugaucccauccugguucuugaguucauccaaagggaaggaaagacauuugaguggauucucccaccaucucaucaaaccucauucuuuccuuuuuucuaccaaggaugcucucugcuuggccuuucuccuccccaaccccuagagugcucccaccucacccugcuaguccugccuggcuucagguuccugugcugugcaauucuugaugggagcuucucccuuuugguguuuguuuguuuuguuggaugugguuugguuuucuugaaacaguucaaauccugauccuccugcuuccuccuuucaagugccagaauucccuggguauaccaccuaaugguacagcccguguagucagaccugggcauuucugucucaagugggaacuaaaagacuccacaggcaaccuguggagucaaggcugggccuacaaaacuacccaagaaagaauauggcuaaaauucaggcauccuggagacuagagaguaaaaugccaaagaaagggaggacuguuuaguucccuccaaacuccuccacugauuuuugaaaugucccaguguuuuccuggucccuauacuuugauuacugaagucuggguuuuuguuuguuuguuugcuuguuuuacuuuuaaaaaaaacuuuucagagauuauagaaccagaacuuuaugcauaccaaauauguacucuaccaaaaaguuccacuuuuaacucccaacuaacuguauuucuuucaucaaaaacuccucuuugguaacugggcaugguggcacacgccuuuaaucccagcacuugggaggcagaggcagacagauuucugaguucgaggccagccuggucuacagagugaguuccaggagagccagggcuacacagagaaaccuugucucgaaaaaaacaaaaacaaaaaacuccucuuugcugggcaguggugacacaagccuuuuaaucucagcacuugagaggcagaggcagguagaucucugucuucgaggccagccuggucuacugagugaguuccaggacagcaagggcuacacagagaaacccugucucgaaaauaacaacaacaaaacaaaacuccucuuuaauccuuguggaguucuuccugguugccuccuauacccaaauauuuaucugccaaucuuuucuccaaggccugcuucccaugaguucuagaaguacccuuuucuuaguagagaucauauacaaaagcaguguaugaguuucaagguguaaugugcaguaaaauaccaucaagaacaaagccuucucaucugcacuacauaaugagacugccucaaaucacaaaagcaggggguggaaagauagcucagugguuugcucuucccaaggaccagggaucaguucccagcauccacacuguugcucacaaccaucuguaaguccagcuccaaaggaucugcuguucucuucuggccucugcaggcaccagauacaaaugugugcacagauaugcaagcaaaacacccaucuccauaaaauaaauauuaaacaauuaaaaacaaaacaagcaaacaaaaagaauaaagccuucuuugaggguuaagaauagagguaaguaggcagaauaccuacuuaggaugcaggaaguccuaagguugaucaggggugguaguauaugccuaugaucccaacu

SEQ ID NO: 7424 - RNA, 24398 nt, Mus musculus
aacgcggcgcgcaggcgccuuagggacccgguagcgacggcggcggcggcgguggcagcggcggcgggagcuggucgcugaccgagcgggagucgccauggcggcagacggagagcgcuccccgcugcucuccgaggccggcgauggcggcgcugguggcaacggcuuagcgggcccgggcgggagcgcgaccgggcccgguggaggccugacgcccuccgcaccuccguacggagccgguaaacaugccccgccccaggguaagccggaggucugaggugcacgcaggccuaggggcggaucgggucagggggcggagccugcuuccgcgccagguguggccccguggcaccugucacggggcgaggcauccucgguccgcaaucacugccuaagccuggccugaaagcggguuuugaggaaacugaucugagcgcuuuuuuugugagcagcggaucgagcuuacucagaggguuccccacguccguggagcauccgugggaaguguucgaaugaugauuuuggguuuaucugcuuccucuucguagcauuucccccguucccugagggacauccagccguguugccuggagaggacccaccccccuacucacccuugacuagcccggauagugggagugcccccaugauuaccugucgcgucugucagucuccgaucaacguggaaggcaagaugcaucagcauguagucaaauguggugucugcaacgaagccacugugaguuauaacuaucugcagaaugggccuuguuuccuggauccucuuucugguucaacacccuguucaugaaacuuucaguuccugcaucuugcagcagccauuucuuuagaagccacucacuaaaaauaacguucaccaagcucucacuuuuugaucuuuccuggaccugaaguguaguucucacuggcaguuguugcaguugcuuuugauuuuuguauuuugggguucucugcuuuucugagacgaucucacaaugacccggguucccaucagacucugcaaucuuccugccccagucucacaggcacacucuacucugcuggcaacauuuguauaucucaaaugucugauucucuuucucaguaauguccuugcagaggacugggauaaugggcuucucugcugaaaugcccauuguuccuuuauucauuguucucuagcccaucaagaaugcaccuccaggaaagaaguauguccgaugccccuguaauugucuccuuaucugcaaagugacuucucagcggauugccugcccucggcccuacugguaagagaccuaagaagagaaggccauauguaaggaaaguuguaaagcaauagggaaacaaacaaacaaaaaaacaaacaaaaaucuagagcugggcaagguggugcaugccuguguucaaucccagcaccugagaaguggaggcaggaaggccuguguaguagcaccuugaaugucuagucauccugccuacaccuccuaagugcugggaugcagugugucaucagauccaaauagaacuaagaauuuuaaaaacauacuuuucccccuguauagcaaaagaaucaucaaccuagggccugugcauccaggaccucugaguccagagccacagccaaugggugucagggucaucuguggacauugcaagaacacguuucuggugaggagggauauugggaaacccuggaggaggcaaguacuaggaauaguaguaaauccugaaaagaauuuccuccuccccccugcuuucggguucucauggaggagagccuucuuucuauggcuguucuucuuuuuccauaguggacagaauucacagaccgaaccuuggcacgaugcccucacugcagaaaaguguaagugguuagggauuguacuggugacugggugguggguggcauaaaaucaacagggcuauuccaaauaucaguuucuauuggcuccccacaggucaucuauugggagacgauauccuaggaagagauguauuugcugcuucuugcuugguuuacucuuggcagucacugccacuggccuugcugugaguagccucaaugcaaaccucuuaccagccucaucacaggcuaagauuugagaaggugauaccuuaaagaauggugagagagcugguguuggguucugucccuguaaucaaagaauacaggcaguucuaagguagcccaggcuacauagcaagaccccaucuauaauacaaaaugagggaguagguuguugccagcugcaaauguggcuuagcugguaaaaguauuggccuagcuugcaugaacacgaucauccagcaccacacaaacugagcagaacugagcauggcggugcaagccuguggucccaguaccuaggagguagaggcaggagcauagaauuucaaggccauugacuauaggauuugaggcugugcaggguaccaacaugagacccuugccuuauaaaauaaaaaccuaaaaugagucuggugauaggauguagggggaguauacuuuuagguagaggugaacuaaaguuaaaauucacuaauaaacuaagaagcuaaacaguguccccacucuggagaaagaaaugaguuaucagcaauccugguucacucaguagaugugagaaaugcuggcagaugccugggauggcagaguacuuuacugcuuaagggaaggaagcacuaaaccaccugaucuuggaaagaccccugaagguguuacaagugauugggguacagagacagaaguuugcauugcauuacuguuucuaggacuuugaaauaguagauaccaaaaguaaccucaucuuuuucuucuuccucaucugucaguuugguacauggaagcaugcacagcaauauggagggaucuacgcagccugggcauuugucauuuuguuggcuguucuauguuugggucgggcccuuuauugggcuuguaugaaggucagccauccuguccagaacuucuccugagccccuugaugcagucugugccugaccgcugccugguaccaacaguaacacuacaaaaggcucucuggacuucuacaaggaagccaaacagcugccucccuuuucccuggggagagguaggaaggaagcagucccuuccuuccuuauguuuggaaggguagguaagaccauugcuggcuggcugcucucuuccagggguugcuguuuaggguaaauaggcaacauugccccuaagccuggauccuaaagaugguucuagccaugcccuuccuguacgugcucccgagaaccauuccugucccuuaauacauuccagggcaggguuggggugggagaugggaggggguguuccccucccucugugcaccauuaggaccuugcugcugcuauugcacuucaccaggggcuggcucuggccucaauacccagucucuucuccccacauuucucguccuguggggugggguaagccacugcucuguacagaacuauaggaacugauguguauauauauaacuauuuaauaugggauauguuccccuaauccuguacuucccugaauuccuccuuccgauuuuacuuccaguugcaguauugaacugggcugagguagggucacugucuugggagagguuagggacucaucugugcuuguaaauaaauaaugucaugacucuaaccuuucccacuuaacaacuuuuguguaugaaaaagggaauauguaguuuucacaaagggacaaagaaagccaagcugaaaguagggccuuuuauuucucuuggauugucuaaaggaaaccagaaguuugguuuaauguuuaaaaugagggagcacauacaaaaccaaacaccugaaggcuaaaacaccagacuucugcagagagagccaucucccaggcaggaagcuacugcaggaggguaucacagugcuagguaaagggugaugggacaguggucacugccaagagccuuggaccggaucuugcugucacacaaugcagguaaaagagagugggaaagcaaaaaguaaucaaggcgccaaccaacauucuuagagcgggcauucaucauguaaguccagaaaguguaagcguaagcaguguugggguagagaugccggaagcugucagccaaugguacagcuuguagcaguuccccaaaaccuuggcgcuccuggggaguaaagccagcauucuuuuuguuuccuuugggguuacggaggucaauuucuucaugagccacauugagauccccacauagcacaagaggcuuucuggaagccaaguccuuuagaaacuuucggaaggcuucaucccaacgcugucgguauuccagucuuaccagaccccugccugcauugggaacauaggcuguuaccaggacaaaggacucaaauucagccacaaucacccggccuucuugaucauguucuuccucgccuauaaaaauaaaaaccaguguaaaaauuuuaagaaaggucuaagaaaaaguaguagaguuaacugaagaacauucagacaugaaugucauuaaggucucaccaaugccauaagagacuuuuagcgggcacuggcgggaaaguaggcccacaccacuguauccuucuuugucugacggagcugaccaguacugaugggugaguccaggcagcucuugcaguucagccgggaguuuguucuccgagcacuuggucucuuggaggcacaagauaucuggugcuucuuccuuuacccacugaauggaaauguggaaaauuaaaauuuuaugugcuacaugcuauacacagaaggcauucgagcagcagaauauaaacaaaucuuguaugugagugaguguccguuagucaccugacuggggugcuggaaaccuaacuggaaccuucggaagcacaaugugcugucaacugcagaacgcucgcucccauuuggaucuuaaguaguuacugggauugaggauaugcuaaguaacccaaaagcggggggggggggggcaaacagucuagacuaguuuuuuuaaaaaaugaaaugagggaguuguugggguuuauauaggcuuuuaggagcccuccaccaaccccccgggggggcaucuacagacgcgaaaaauaacguuucaaaggaaacaagaugauugguccuuaagacgagucaaccaagaaaggucuacuucccgauucugaacuguacucacauccaaaccuuucuuuuuaauccaggcucgaagcccauccacauuccaggagcauaucuugaguguggcagauuugccacugggugagguuuucugaucuggaggguccucguacaggacagggcccucucccgcggccuccuucucgguuuucuuugcugcccccuuacucuucuuggucucuggcucuauaaaauggguaaaguaguaagagcuggcaguuccaaccucaggccagaguuaacucuaaccucauuaggcguucuaauuacacaaacuucucggaacccagcaacguaacuugguccauauuuaccguaauucauggcggucuaguaaagcccugaacuugccuggggggugggguugggcacgcuuacccgacuuggguucuuccccgucgucggccgccgcuuucuuuccccgcuuuggcaucgcugugacgaaagcccuuaggcuccuggagcaccgaagcaguguuuacugcgcugccugcagauaagaaacgaugaaaucaaaacacaaggagaggcagcgaggcgccucccguaggcguuugcacacccggggcugcgguucuuccggccuggcccgccacgagcaaugcagccccucgcccgcguuaggcccuucagcgagcagggucgcgaaacgcgcuagaacaagguaccugaccucccaacgaagccagagacccucacggcacaaagaauggagucugccuguucccacgugggcgauugguguggucacgugauucgagggcuccgcccccacgugguucuggagcgcgaugauugguccuccuggcaccucgugacauaacuucuggcgcccgaaagucccuucgcuugguucuggguuguucgugguagugccgguuacagcucgucacucggccucacgaccgggagccgugaggcaccaugcccgcggugcugggguucgaaggcagcgccaacaagaucggcgugggcgugguccgcgacggcacggugcuggcgaacccgcggcgcacuuacgucacggccccgggcaccggugaguggcugcggccgcgcuucccggcuccuuguccaguuuuguucuguccgauauuccacacuguugccuaugucagauuuuacaggcuuccccacuccagacuccccugauugugcguuugguugguaacuuuugacuagaagagucagacaccuggggcuaggucacguggguucguucagguuuuguuuuuggguuuuuucaugcauuuuuuugagacagggucucuccuuguaaccuuuacugaccuggaacuugcuguguagacucuugacugcuggaauuaaaggcaugagccacuacccccgguuguauucugauuuuaucgagcaacuuuaaugagcuaagcauccgaaaauauguguuccgaggcagcgcuguagaugcacauagagauugguuuacacugcaccgugauaaauauaaaaguaaucuacaacgaggagggaaagcuggaggaguuccuguauuuucgaucuguuuuaggugucuguuuuucgguacuuuuagaauggaaauggguaucaguggguuuggacaguuaugugaaaagcaccaggcacugcacgacucucaauauaguuacaaguuguauuuugccuacccucucccaaaacuugcacacacauauaaccugcauguaccucugaaggcucccuaagcaggugaaauguuucagguuacauaguagaaauauauguguguuuaggacucacucuuguaggcucuaaagcacagaggcugagauacgugugguuaaagggaagcuacugacaguuguagugcuguaguuaucauauguuaaguccaacgauaugaccuuucauaggguucuauggaauuacaggaaaaguuaacaaagaguaggaaguuuguaaaacucagauugcuccugaacauuguguguggaccagcaccaucucugaaaccccaguagccuauguagagguuggaaagcuaacagaguguguggugcagucuguaauggugacaccugggagacugcgacaggaucugaguuuaaggcuguccuauguugugaccuugucucaaaaguagagauuugaaaagagaauaucuugggcuggagaaauggcucagugguuaagagcacugauugcucuuccagagguccugaguucaauucccagcauucacaugguggcucacaaccaucuauaauaggauccaaugcccucuucuggugugucugaagacagcuacaguguacauacauaaaauaaauaaaucuuuagaaaaaaaagaaaagaggaugucuuaaaaccuaggcaaguagaguauguuuuucuacaucguuaaaacgugucuuuguugguuuuuuacuucuuuuuuuuuaauauuauuuuuauuacguauuuuccucaauuacauuuccaaugcuaucccaaaagucccccauacccccgccccccacucuccuacccaccauucccacuuuuuggcccuggcguuccccuguacuggggcauauaaagauugcauguccaaugggccucucuuucuagugauggccgacuaggccaucauuugauacauaugcagcuagagucaagagcuccgggauacugguuaguucauaauguuguugcaccuacaggguugcagaucucuuuggcuccuuggauacuuuuucuagcuccuccauuaggggcccugugauccaucccagagcugacugugagcauccacuuauguguuugcuaggccccggccuagucucacaagagacagcuauaucaggguccuuucagcaaacgcuugcuaguguaugaaauggugucaucguuugggaugacugucuaugggauagaucccuggauauggcagucucuagaugguccauccuuuugucucagcuccaaacuuugucucuguaacuccuuccaugggugauugcuuccaauucuaaaaaggggcaaaguguccacacuuuggucuucauucuucuucaguuucauguguuuugcaaauuguaucuuauauaucggguauacuaaguuucuaagcuaauauccacuuaucagugaguacauaucauuugaguucuuuugugauuguguuaccucacucaggaugaugcccuccagguccaaccauuugccuaggaauuucauaaauucauucuuuuuaauagcugaguaguacucccuguguaaauguaccacauuuuuuguauccauuccucuguugaggggcaucuggguucuuuccaucuucuggccauuacaaauaaggcugcuaugaacauaguggagcauguguccuucuuaccgguugggacaucuucuggauauaugcccaggagagguauugcgggauccuccaguaguacuauacuauacuauguccaauuuucugaggaaccgccagacugauuuccagagugguuguacaagcuugcaaucccaccaacaauggaggaguguuccucuuucuccacauccucgccagcaucugcugucaccugaauuuuugaucuuagccauucugacuggugugagauggaaucucaggguuguuuugauuuguauuucccugaugacuaagaacuuugaucuuuucuuuuaagugcuucucagccauucgagauucuucuguugugaauucucuguuuagcucuguaccccauuuuuuaauuggguuauuugguuucuuagugguuagcuugaguucuuuauauauuucggauaucagugggauuagugacaauuuuuuccccauuguguagguugccaguuuguccuauugacugugucuuuugccugaacagaaucuuuccaguuucaugaggucccauuuaucaauuguugaucuuagagccugagccauugguguucuguucaggaaguuguccccugugccaaugagauuggggcucuuucccuucagugucauuauaucucaucuuaaugugcauuuaccacauuuagguuuugaagagcuuuuauuuuuuuauuuauuuuuggcuaaugacauuucuugcuguuuauuugucuuauacuauggaaaagauguuagacaaaaaguaagacuaaagccaggugugggagcauaaaccuggaauuccaguacuccaggaggcagaagcaggcagaucucugaguguggggcgacccuagucuguauagcaaauuccaggccagccagggcuacaucauaagaccuugucucaagauaaacaauaaaaaauggaaucaagucauuuacucugaguuuagagagggagggaaagcaguggggguagcuuggaacaccagcaauaccuaauauuuggucccuggaacugcuaacaaacagagccuugguuguucaagaacuugcagaggagacagaccgagcacugaaauggcuaucagaaguuggcuacgaccuguauacugagaacaguuguggaagcggaccuuacagcuaaagaaauacauaccaaagaagucagaauggaccaaucagugauuaucgaauauuugaaaacagcugaaaaguuaaaaugaaacaaaacaaaaaaacccucaguaaguugaugccucauaaacagacugaaaaucgaacagccauuguuuucaguucucaugcaugaaccauuucucagauugugaugacaacaaguagacuguacaggaaaacuagucacagccagcuuaguggcuggacugagaagccccaaagccagacuuucaccaaaaacaguccagucacugguggucugcugcugcucugacccacuacagcuuucugaaucccagagaaaccauggcaucugagaaggguacccagcagaucauugagaugcaccaaaacuguaacuccugaagucagcagaaagagcccuauucagagcaaugccugacugcauguggcauaaccagugcuucaaaucugaaugaccaaaguggagcuuugcuuuauccaccacauuuacccgaccucucaucagcugaccaccgugucuucagaaccuugacaacuucucucagggaaaacauuuccacuacaagcaguaugcagagagagcaugcuuucccaccgcaagcaguaugcagggagagcaugcuuucccacagugagcgguaugcagagcaugcuuuccaagaguuuguuaaaacuuugguuuguugcaggaauaaacucaucuuuuuggcuuauuuguguguuuguuaguuuguuugaaacaaggucaacaaaucccuggcuguccuacucuguagaccaggcuaaccucagacucauggagauccaccugcuucugccuugcugggauuaaagcuuugcaccaccaccacccaacuaacugguuuguuggcaaaguguguuaaagugguuuguauuuugaugaauaaaaauguauuggcacacgccuuuaaucccagcacucaggaggcagagacaggcggauuucugaguuugaggccagccuggucugcaaagugaguucccgaaagccaggguuauucagagaaaccgugucucgaaaaaacaaaacaaaacaaaaaaaauuagugauuuaagguucauagccccauaucacagaucccuuugcaccagccuagcaccugccuucuuguaguucauguucuauaugccuuuccuuaggauuccuuccaggugacacggccaggcaccaucgagcuguuauccuagaccuacugcaggaggcgcuaacagaggcaggauugaccuccaaggacauugauuguauugcuuucaccaaagguaagucugggagaguugucagcaagggcaguaugugggugguggguacagaccaccaccauuacacauuuucaaaucuacuuucucuacauacuuuuccuaauuucuaggauucuaaccacauuuguacgcugucagguccuggcaugggauccccauuggcuucuguagcuguuguugcccguacaguggcccaguuguggaauaagccuuugcuuggcgugaaccacugcauaggccacauugaaaugggccgucucaucacuggagccguuaacccaacuguccuguaugugagcggaggaaauacccagguacuuaagaggacucuuuguauuccaucuuaaugcuaagguauucuaccugaguuauaggagcugcaagagcaaaaccaggcucauucagaccuaagauauuauagagaauacaacagagauaugaaguugcaagcucuggagacaaauuagaauauuugaacuuuauacauacagcuagaauuucucauuuaaaaagaaaagaauguggguuucuuaacuucaagauaaugucucucucuuuuuacuuguguggguguuuugccugaaugcacauaggagcuucaggaagacagaagagguuaugagaucccugggaacuggaguuauagacaguugugagccacugugugggugcagggaaucaaacccagguccuuuggaacagcgguuagugcauuuaacuauuggaccaucucuccagcccuauaaauauauuuuuuuucccuucauuuauccacccugcucucccucuuuucuaaaagucagggucuccagauaacccagccccaaaguugugguucuccuuccucagccuaagcaacugggaucacaagcuacugugugaugugacuguggcagggacucaaugcaguagacagcuucccuuguacuauuuugaucuucugaacuccucccacgugcugggauuacagacuugcaccaccaugccuggcucaccuuuuucuauuucugacggaaugucuguguaggucaccacaacaaacucaguuuugccuguuuuaaauucuuuuuuuguuaguuuggguuugguuuuuuuguuuguuuugguuugguuuuuguugguuuuuuuguuguuguuguuuuuuguuuuuguuuuuuagacaggguuucucuguauagcccuggcuguccugaaacucacucuuuagaccaggcugaccucgaacucagaaauccgccugccucugccucccaacugcugggauuaaaggcaggcagcaccacugcccggcuuuguuuuaaauccuuauuuuuagguguguguguguguguguguguguguguguguguguguguguguguguguguguguguguguguguguguuuuguuucuuaagcuguauaaugugagaugcuucaagaauuugugugcagucccugcccaggggccguacucauccucugcaucauuacaguuuuggugugugggcuacaaauuaagcaccaguugguugguucuuggaagaaaaaaauuuuuuuaauuauuuggcaacuuuauacauguauguaauauaucuugaaaauaucuggguuuauuuuguguaugugagauguggguauguggguacacacauguuauuguauauaugcacaucaggggacacacuuucagaguccacuuuaugguaagggaucaaacucuggucucuaggcucaugugcaaguguuuuugccuuuuaguagcuccuggugugguuuucuugagacagcaucuugcuaugugucuaggcugcccuuagcaaucacuguguagaccagcauggcugccugucucagccauaccuguacuggaauugcagguaugagccacuauagacagcuucccuuucuuucuuacuggaaugucuaguggccauguuagcacuaugcuauuuucuuccacauagcugaacaccccauuuuacagacugaaagcuucauggucucacucuucucaggugauuuccuacucagaacaucguuaucgcaucuuuggagaaacuauugauaucgccgugggaaacugccuggaucguuuugcucgggugcugaagguaggcgacugagacuguagaguguauaagaugugggucugggaaacaaaaagaaggaaaaggcaagaagaaguaacuagaucuuaggcuucuuguauaucuaaaguuagucuuugucauuauauuuaacauagguagaaaauugagcccuuauguauauguguaucuguuaguuguuacuaaugugucuguccauguguaugguuuauaaaaauauauaccaguugcuuguugguuuggggaggagccccagagugcugaguagauaugagaaaaauguguuuuacauuguucauucaugguucucuacuucucucuccuccugcugauagauuuccaaugaccccaguccaggcuacaacauugagcagauggcaaagcgguaagaggaugugaaggcgaagagcccuggcugugcagcuuuagagacgucuuuucguuuauguuaaugagguaugggagggguucuggagggugagcagccagcugacucuggcuuuagugcuuuuauucauuucuacauagaggcaagaagcuagucgagcugccauacacuguaaaggggauggaugucucguuuucagggauucugucuuucauugaggugagugugaguguuaggagagagagagagcaaucccugcuuuuaaaaugacaugucugcuuugcucaccauuauuuccugcauaagcgcucgcucauaguaggugcugaauagauucauuuagcagguacuggauauugucuaugugccaggcacuacugcaaugauugggauacaguacaggacaaaacaaucccuuccuaaagaggaaaaagauuuuaaaaggagaagccaaugugggggugcaucccucccguaaucucauugugaugaagucagugauccuuccaaagccaggagguuuuguuuuuaugaaagccucauacugguauucauguuuuuggaucgcugccccuuuaauugcaggaugcagcgcagcgaaugcuggccacuggagaguguacuccugaagaccuguguuucuccuuacagguaagugaaaagcugggguguaaaacaugcucuagacuagagcugaaguaaaaugggauaugccucugagguucccccgugucuguccuccacaggaaaccguguuugcaaugcuaguggaaaucacggagcgagccauggcacacuguggcuccaaggaagcccucaucgucggaggaguuggauguguguauccgugggcagugagcugccuucucccuccugauacucuaaauugccagaguuuggaggauuauuuguuccaucuccuuuccuuguuucccaauccuuuucccuggucuccugguaaacucaugggagcacagcuggugugauagcaagauggccaaaucuaaguucacugugucuucucuccuuguagguaaccugaggcugcaggagaugauggggacaaugugccaggagcggggagcccagcucuuugcaacagaugagaggugaaguccccuucuuugucucaaguucuuuucuucccauuauuauggcuucucugugucuuaaucacaaguucuguucucuucuuuccagauucugcguugacaauggagccaugauagcccaagcugguugggagauguuucaggcugggcacaggacuccucucaaagauucugcaauuacucagaggugaguggcagacaccuuagagagaguagauauaggagauaggcagaaaccaacauguaagaaaguugaaaaacaagaacaaaaaauacuaugggugauggguauggugcugugcaccuauaaucccagcaugugaggagagaucaaggcaggaagauugugguuuugcuauaagccugggcuacagacacugucucaaacaaauugcuaaggggucgucaguccuuuacagaguuuuucccauuuuccgcagguauaggacagaugaaguggaagugacauggagggacuaacaccaucaucagaaagagaagagcuuuccaggaggaaugcucaacugagagucagucuugguaauguucuagacugcccucuucgcugacaaggguauggacccuauauaaggcuuagggucccuauggaaacccaacaugacgccacaauaaaaauuugguuuuguauguugauaauuagguuguguuuuucaguuagcacuggguaaagucuuacugaucucagggacaacuggugggggucagaguagcaccuugguugguggcgcagcuacuuuugauggcugcuacuuggagaaaacccugggugccauacuaacaucccauuagcagaaauacccuagcuaauaguauuuuagugccaugcccugugcugaccacugugcaguuaacuguguuuacauucacugaaguggacauccaggacaacccuuaaaaaggccuggaaauguauaauuuguaauuuaaguaaaacugcugccuucauaacuuuauugauguacuacuacuauaaauacuucacgggccaauuugagggacaccucaaauuuacaaugccccaucaccacuacaagcgucagaacuacagauauugugcccuuuaucuuguauauauugacacaagguguccuaaacuaccaagcuccucuuuugcccucuuuuagccaugugucuuuucauucauucauauucucucucucccucccucccucucucucuccgucauucauuuauaaaauccauauccccucaccgucucacccucaucucccaauggucccuucucauuguucugagaccugguuucuuagucccugcuucucuuacuaccuguuggugaaucuuucacaucccuguaccccugggccuagacguggagcacauguccuccuucccuccucaguuugcuuuucuuccuuuucuccccaucuuuuuuuuuugagacagagacucucuguaguccuagcuggccuggaguuugcuaugggaaacuaggcuugcuucaaacucagaaagauccaccucugcuucugccuccugagggcuaggguuuagaagccugcaccaccaugccccaccucuucuguuucuuguuaucgccuuuguccuuugcagcccauuguucuguauuucagucacuucuugucccucagccucagccuugcuacucagauucaucccugcacccggacccccaacccccacccuuacuuccuuucuacaggcuucccuugcaaauaagcgcuuuguuguagaagcuuccucucccuuuaccauuaauaauaauuaaaaaaacaaauccaagguaucaucaaguuucgccuggucuugacccgccuccaccucccacacccacacaguguaagagacugaacccacagaaccaccugagcugcauccuuagccccaauuauacuucugucacacuuuauaccuagaucagcaaguuagaggcaggcagauagacagacagagagacacacacucagagauagauauauguaggggaaggcagagagauagaagagagcacgcacuaagugggaagaguggguuuuuguaacaucagagcccauacccauugacacaauucuuccaauacagccauaccucccaaucuuucucaaacaguccuaccaacugggugucgcgcccgcucucgaccagcaagaacgacgcgaccaccaguccuucuaacagcaguuuauucaguccugauucuucuuguuuauaucucccccgaacccugggccucucacuccuuuuauacucucauccacgcaccgcaggccacgcccccucgccagucacgaggcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacaacuggggagcaagcacuuaaauauauaagccuguggagccauucucauagaaaucauaccuugguucuuuaaauuagaagcaaggagcacacauuuaucaaguucucagcuccauacugaauacuuuauaucauuuauacuuagauacucugauuucuguuccauucccacagacaagagguucucaaccaagucugguuuggucuuaggaggacaaagagaagaugcuacuaaagagaagccaaggcgggcuggagagagcucauugauuaagagcacuuacagaggacuccaguuggauuccuagcacccagguggcagcucacuguugucaguaucuucaguuccaggggaucugaugcuuucuggcccugggcgccgggcacauaugucaugcacacaugaggcaaaacacccauacacaugaaauaaagcuacaucuuaaaaagagaagccaagccgggcggugguggcgcacgccuuuaaucccaguacuugggaggcagaggcaggcggauuucugaguucgaggccagccuggucuacagagugaguucaaggacagccagggcuacacagaggaaauaaauaaagccaaggaugcuagaaaauacccuacaguuuuuaauaaagccccacaaauaaaguccuaugcaaaaauguuguuaguaucacaguugaaaacugccccagacaggaauguguaaugguuugguuugguuuggguuuugagaacucuauagaguagcuauacgcugauugaccuggacaguucugagcuauguccuaauugcuaagcagauccagcugcucucacugagugugaguugacagguuagcugcaacuucacagcguggcuuaaaagaguugccuccgguuuuccucugaauucgcuaugaaaaucuauucuguugcugaggguggagcuuaggugguagaacauuugcuugauacaaagcuauauaagcggugauuaggcaucuggaaucuccaugcuuugcagguagagacaggaagaugagaauuuaaagguuuuccuuagguauauagugaguucagggcuagccugggcuacaugagacccuaucucagaaaaugaaaauuaaacuaucucagcagauuuguuguuaccauaucauuaguuacuuagucacaaauauaaugguggauucuacuucuuuuauaagucugucugaaacauuuaacacuuacucuuuuagaauguauugucugcuuucuugcugacucucuguugccuuugcugguucucauuucucagucuuagcuuggacugaguugucuccugccuucagucucuugagugcuggcaccugugccacugugccugucuaugucuacaguccuaacauccgagaguccucagacaguuggcacaggcauguggggugauuguguccagucuuaagccaugaaauucauuaggauauagguaacuccaguuuuauaucucuagccaggacugcccucccaaauaccaagcugcccuuuggcaucuuugccuggguacaaauguagcacccugucuugggguuuuuauugcuguaguaaaauaccacaaccaaaaucagcuugggaaagaaaagguuuauuucacuuuacagucuggagcauucuguaaggcagucuguacaggcaggcacuagagcugaggcccugaggugugcugcuuacuggcuugcucuguucaccuugcuuagccuguuuucuuauagcacccaggaccacccacagcgagcugggcccucccacaucaaucaucauugaagaaaaugcaccauagacuucucaucucacaggccaaucugguguggacaguuuucccaguugaaguucccccuucccacacucaaacuuguguuacguugauauaaaauugauuggcacacacuuuaaguuuaagguauccaaaacugaacuuaaguuccccagccuucuccuuuaguuauuucuuauuuaagugaucaguacccccucugguucaugucaaaacacagaccuuggcauucuuuugaguucuaugaauagguguguguguuucaccuucaguuaaucaaauccacuuggauuuacuuuucaacauuuaaccacauuuaaccacaauccucuuuccuuuuaagcugaaccaaauuaguggcuuaucuucagaaugcccuaauuccuuccucucccccuacaguagucuuuuguacugaaggccuguggccauaaccuuaggguuuguaugucuagcucacuuuaugcagcuccuccagcuagcgacucagggcagggcugcucacaaaaggucauaaaggucauuggguucauuuuuucuugcaugucaguagauaggggauuaacauaguccuguaaugauaaaggggggugacaagcagucuucccagcgaccuuuggggggcaggggaggagggugugugugcugagaaagaguacugccugaagguuucuuaagugggagaagggcaacgaaugcuuuguaauguaagugucaacccaccccaaccagcaaggcuaagucuguagauagggcugggaaauccugaggagcugugggguggggguggggucugacugggcaaggccuuugagcacaagagcagugccaacagauugcucgucauuuuuauuacuaagguaaggcauacauaggugagaugguuuuacaguuuaagcaaguacagauacugugagggaauauaccugguuuauguuuuaugaauacucucucuggucaugcuaaagacucaaggauacuccagaucuucaccuuucccauagggacaauucagacauuccagguccuucccuucacgugcuugcuuuugaaugcauucacguacccuaguguaugcaauucuuucuagaaguacacccgugggaagaccauuccgcagucugcccuauccaugguucacaguaagucgcacaggcgcccacaaaguaccugucuguguucuaggcuugcuuuuuuucugugcaugauguugagguugagcccagggucuugcguguaccgugcaagcacucugccuuucagcucucccuugcccuugagccucucaagugcuaguaagccugcaccgccaugucccacccugaugguaccucaggccacuacugcugccuccucuuagaucauuaacuucuccuucuuuuccucugagacuuggaaaggaaugggggcuucugagggucuuuuaggcuuccuaccacuaucaucacugagccaguucacugacugcaggcccugcuuugacugaaugucauuugagucugcuggugucguaacugccccaaagagaaaaauuauacaaaguggcugugguggugcaaaccuguuaagcucagcccuugggagggagaggcaaaagaaucacauuccaagccaguuugggauacugucuuaggguuuccauuggugcagugaaacaugaccaaaagcaaggugaaggcaagggcucuauuuggcuuucacuuccauagugucguccacccuugaaggaagccagacaaggcagggaccugagaauaggaccugaugcagaagucaugaagggcacugcuuacuggcuugcuccacauggcuuacucagccuccuuucuuaaagaacccaggaugaccagcccaaagauggccccacccacaaugggcugagcccuaccccaucagucacuaagaaaauguucuacaggcuugccuacagccugguguuauggaggcauuuucucaacuuaggguucuucuucuugggugacucuagcuuguaucagguuaacauaaaacuagccagcgcagauacacagugagacccagucucauaccaaacaaaagagaagacaaauuccuuuccuaucgagcaguuacucuaacuccauccucaggccaugccucccuauuagguacuuugcuuuucucaaauuaucccacugucaugcucagcugccuuugauacucaguuucugcuuuccucuccuuauucuuugacucaccauggccuuguauuguguagucacaauuagcccugcugccauccuucagaggcagacacaacugcagggaaaggcauccccugacgagaggaguaaaaaggcacggaaggaggagcugagggaggaagggcuuucccucccuuaagagcuggaaacgccaggcucaguucccagcauccacauggcagcucacaccugucugucugucuguaccuccaguuccagggaauccauggcaccagacaugcacauggugauaaauacacaugcaggcaaaacacccauacauaaaauaaauacccauacaugaagcaaaauaaaucucuuuuuacugagagagagagcuagaagcaauggaauuuauccuaauguucuuuccuuuuaguucuaguuccugacaacuucucuuuccaucucccugcccucccccacccccacccccacccccaccccaaauaaaagcauuacaauaguccuccacagcagauaugggcaacugccaauuuugcuuauaucagaacauugugcuugagaaggccugcaccucagcccugaacggagaggccguggagaaggaguagggcuguauuauguuugagaggcaggugacaagaaggguuucaguuuagcagaugccugcauggacucagagcccagaaugaagcuuaugagcagacaggucuuguauggcauguguuaguguuaucuagaggaaaagaaaugguagacuguauauauaauaaagggggguuuauuaaucugacuuaacgguauauaguccagguauuccagcaagggcugucucacucuggagagguuaagcaucagggaguuacuuggucacuaaggcugaaagucucagcauuuccaaacuggugcuggaggccuggaagauucccagagagcaguugcucuuuacuguacauuagaauccuaaagaaguugguucuaacaccaguaaaggaaugcagguaugggauagauaaacuugccagucagacugaggaaagcagggaggaaacagaguuguagaguugaaaagaaacaggcacaugggaaaacagaaaggggacacugaguacucaacagggagagaagccgugugagugucuuaguuaggguuuuacugcugugaacagacgccauaaccaaggaaauuauaagaacagcauuuaauuagggcuggcuuacagguucagagaguuaguccauuauuaucaagacaggaguguggcaagauucaggcaggcauagugcagacagagcagaggguucaacaucugaaggcugccaguggaagacugacuuccaagcaacuaggaggagggucucaaagcccauacccacaggacacaacuacuccaacaaggccaccucuccaaauagugccacucccuaagcauauacaaacugucacaaugagucuucuaaacauucagucagcugaugugagucucagcaucuugaauggcuuggagcuccuaagagggaagcacaaacgcaggcugggacugcuacuuccuuaaacuuccuuaagcguccuucuccugagugcucccugcuuugccaauuuucuguucuuaagagcgucuuucauuguguaacuuaggcuggcuucaaauucauaaucuuccugucucagucuccugaguguuggggcugcaggcaucuacuagcauaguggacuuucuuuuuucuuuuucuuuuuuuuuuuuugguuuuucgagacaggguuucucuguguagcccuggcuguccuggaacucacucuguagaccaggcuggccucaaacucagaaauccggcucccucugccuccugagugcgccaccacgcccagccauaguggacuuucuaaccguguuaaguuucucuagcccacuugccagccuuaguuguacauugcuucucuuccugauuuggugcccacagaucacaaguucuuggagaagguuccuaugaaaucagccucauguugguagagguuccuacgaaauccaccagggcugggugcuacuggggccuggaggaggcagucagcaccacuguggccuauggacagaauguguggugugaaggccucaucagugagaacuguacucaccaguggguuuuagacacgagguuagagagguagaauugagagaaagccuaaaaggcuccuagcccuggagcuguaacucuaaaaacggcugucaaauaucaucuagaauauaaucuuugugaaucugaggugaauuguuucuuucccauccuauuuuaguuucuuuaagauuauuuucauauccaguccaguuuuccagccaaacuaguguuaaaucccagcagagacuaauucucccauuggcuuugauucgcagaggugcaccaggaucauaaugaggguucaagagccuaggacaacagcccucacauuuagcucugggaaagugaucugcacaggagcuaaaagauaugaggacaaaauccacacuguguuucugcuucccucuuaggagcuccaagccauucaagaugcugagacucaacaucaccugacugaauguuuagaagacucauugugacaguuuguauaugcuuagggaguggcacuauuuggagagguggccuuguuggaguaguuguguccuguggucacuguggccaucaagaauuagaaauauuuaaauuggauaagauagcucuagcauuuuauuucaguuuaagguaagguuuuuuucagacuuacccagucaguauccaaaagacucuguucuggcccacgcucuugauuuuucacacugacuucuuuguauguaucuaaaugaaacuuggagccuucuagucuaugguuuauggaucgcuggucucagaagccuucauuuagauaagauugggcaacugugcaagauauauccagcaauguauuucagcauuguuuaaaauuagugaaaucguauuaaauaucuaaugagaggguauugauuuaagccacuguguggcgcacacacacacacacacacacacacacacacacacacacacacggugaacuggaagucaugucaugacgugauugguuggggagcagacaacuaaauugauucuuaccgaccucuguagacugugucauaucacaugcauucaugaguauuauuuuccaugcuugggcuucuccuggcuuagggaugugcauagcccagcagugaaagcggguuucuucucacgugacuacaagccugcauucuccagcagccuccacucuguuaucuucuguuacugugcuacuuggguugucacuuuguuuuuugcccuguuuuugaaacaggaucuacuauauagcccaaagugauucugugugaauaaccacauuugugaaguaaaaauaucuugcucaaa

SEQ ID NO: 7425 - RNA, 2174 nt, Mus musculus
cugaaaguagggccuuuuauuucucuuggauugucuaaaggaaaccagaaguuugguuuaauguuuaaaaugagggagcacauacaaaaccaaacaccugaaggcuaaaacaccagacuucugcagagagagccaucucccaggcaggaagcuacugcaggaggguaucacagugcuagguaaagggugaugggacaguggucacugccaagagccuuggaccggaucuugcugucacacaaugcagguaaaagagagugggaaagcaaaaaguaaucaaggcgccaaccaacauucuuagagcgggcauucaucauguaaguccagaaaguguaagcguaagcaguguugggguagagaugccggaagcugucagccaaugguacagcuuguagcaguuccccaaaaccuuggcgcuccuggggaguaaagccagcauucuuuuuguuuccuuugggguuacggaggucaauuucuucaugagccacauugagauccccacauagcacaagaggcuuucuggaagccaaguccuuuagaaacuuucggaaggcuucaucccaacgcugucgguauuccagucuuaccagaccccugccugcauugggaacauaggcuguuaccaggacaaaggacucaaauucagccacaaucacccggccuucuugaucauguucuuccucgccuauaaaaauaaaaaccaguguaaaaauuuuaagaaaggucuaagaaaaaguaguagaguuaacugaagaacauucagacaugaaugucauuaaggucucaccaaugccauaagagacuuuuagcgggcacuggcgggaaaguaggcccacaccacuguauccuucuuugucugacggagcugaccaguacugaugggugaguccaggcagcucuugcaguucagccgggaguuuguucuccgagcacuuggucucuuggaggcacaagauaucuggugcuucuuccuuuacccacugaauggaaauguggaaaauuaaaauuuuaugugcuacaugcuauacacagaaggcauucgagcagcagaauauaaacaaaucuuguaugugagugaguguccguuagucaccugacuggggugcuggaaaccuaacuggaaccuucggaagcacaaugugcugucaacugcagaacgcucgcucccauuuggaucuuaaguaguuacugggauugaggauaugcuaaguaacccaaaagcggggggggggggggcaaacagucuagacuaguuuuuuuaaaaaaugaaaugagggaguuguugggguuuauauaggcuuuuaggagcccuccaccaaccccccgggggggcaucuacagacgcgaaaaauaacguuucaaaggaaacaagaugauugguccuuaagacgagucaaccaagaaaggucuacuucccgauucugaacuguacucacauccaaaccuuucuuuuuaauccaggcucgaagcccauccacauuccaggagcauaucuugaguguggcagauuugccacugggugagguuuucugaucuggaggguccucguacaggacagggcccucucccgcggccuccuucucgguuuucuuugcugcccccuuacucuucuuggucucuggcucuauaaaauggguaaaguaguaagagcuggcaguuccaaccucaggccagaguuaacucuaaccucauuaggcguucuaauuacacaaacuucucggaacccagcaacguaacuugguccauauuuaccguaauucauggcggucuaguaaagcccugaacuugccuggggggugggguugggcacgcuuacccgacuuggguucuuccccgucgucggccgccgcuuucuuuccccgcuuuggcaucgcugugacgaaagcccuuaggcuccuggagcaccgaagcaguguuuacugcgcugccugcagauaagaaacgaugaaaucaaaacacaaggagaggcagcgaggcgccucccguaggcguuugcacacccggggcugcgguucuuccggccuggcccgccacgagcaaugcagccccucgcccgcguuaggcccuucagcgagcagggucgcgaaacgcgcuagaacaagguaccugaccucccaacgaagccagagacccucacggcacaaagaauggagucugccuguucccacgugggc

SEQ ID NO: 7426 - RNA, 9113 nt, Mus musculus
ccuuuucuggcugggaaaucaugacugugugcggguuucaucugcugguugccuuagacuaggagugggucucuuugaaaagaacucuggagagguuuccugccacaccucuggaugagggugugucaccauggagacaaggccgcugccauuggcuggagccuggggcugaggauauaaaggccggcccagcgaauagugcacuaacagucuugaccugacucagacagugucgccguggagcggaaagggcaggauuucggcguggccgucggugacuccauggagaacgaguaagugccgggcccggggacucgggcguucugccgagagagacgggcuguagcugagaacugggaacuuaucagccugggcccagagaaggagcgagucuguuggggaugcagagaggccuggcacagagcccaguggcagacauagggcuccagaaugguggggcggcuggcgcgacaggcaggcgcgggaaccagcgguaggggcgccccggagcaggaagaaacagguuagcgcaguguaggcaccaucacaaggaacauugugccuccaugguguauguggauguauguggggaaggaggcgaaagcccugacuacuuaauaacacaaguuuccuuuccagcgguccaaguaacccaguagauaauucuguugugcaauuccgcaguuccuuuagagggaaaauugcucauuuuccgcgacucucucuccuccaagcuggaagucgcauuaacaaaugaggaauggagucuuuuuaaggcugggaaaucuguauucacugaccugcuuagauacuuauacacaccuuccugcccacuuuaaaaacaaaaacaaaaagcaaaaaagucaacucccuuccuuuugggucgggaauuccuagauugacucaccgcagagcuguagggaucacaguggcuuuaggaugaucucagguccgacguguccucggggacugugagcuauagcuggacauggccagguggccaagccucauacuuccggcccuuuaggacugcauccuaaauucuugccuacuuaauugcuucuaucugucccugcccuaccuagcuguuucauuguggauaaccuguuguguuauaguccuguuuugcuuccuauaguauacucuguggcaguuugugacaaggucuugcuauaccuccaggcuaggcucaaguuauacuaaugucugggucugccaugucuuuaagucucuaauacuuaaagcucccuggcuggaaggaaaaaaaaaggcuuuuuuaguuguguucaauuuguguacaccuccguucuuccacuccuaggagcaaucuuugaucuuugcaguaugaugugauaaaauuggacuugggacugugagaagguccaggcugacuagacaggguuugucuuccuucuguuuuggaacccucaaacucgcagagauccuccugccuugcuccuccuccuccuaaugcugggauuuuaaagaucugccucaccacgaccagcucccaguuaauacuaguacuugguuaugaguuauguaccuuguucuuugcuuucugaagaacaaaauaccuuaguguggggggaagccaagaugaaaggagggagagggagagggagagggagcagcaggagguggaaagauuaacuguuacacaacagagcuuccuagcaagucugguuguuuguucuguuguuuugaaacagucucuguacauagccccguuucuuccugaaacucacaccuuagaccaggcuguccuugaacucacagagaucugacugccuuugccuccugagugcugggauuaaaguuguuugccacccuucauaacuucuuuaacaaguuuuucaucugaagggaugggccuacaaacuucuauuuugaacuagugccugaagcuaguacuagcuuggcauuuuauaaccaguguugugaaauaagccuggguuuuguguuguuuuacaaucauuuaguuucuuucuuucuuuuucuuuuuuuuuuuuuccucacagagacaggguuucuuuguguaguccuggccauccuggaacucauucuguagaccaggcuggccucugccucccaauugcugggauuaaaguugugggccacagucauuuaguuucuuaacuguaaaucauagcucacacuguagagacaggaggaucaggaacucacagucaguuugagucuggccuaaguuacaugagacucugccugaaaacaaacuccaauacuacacauacacacacacauacacacacacacaaaaggagagaaagaaaaagaaaaaaguuuaguuaauuccauauggcagagaucuguaucugggaaucaaagaaacauguuuagagaaacuaaggcucuccuguagauuucuaggaguguuauuacuuacuaauaaaaauuuuaaaauuugagggcuaguaacaugauucuacaaguaagguacuugcugccaagccugaauuggguuccagucuugugguagaaggagauaacugacucaccguuauccuuuugaccaccaaacaugauguggcaugcuuugaacacaucacacacacacagacaccaacuaaauuaaguguaauuaaauuuucaaauuaaaaauuaauuaauuaaauaugggcccagugagcagagcaagcccaaaacaacugccacgggcacuaauagaugagaaagugagagauggagagacagaagaaaaagggaagcagaguguugugugcacaaugaagggaguggaacuggagacacgaguguagugaggaggagcuuggugugcuaucuguagccaagguaagguccuggccuuugcuacuacugagaaccaugucugggucuuuuaccaccaaaagccaaguggaucuucugggcugccaccuggggacaugacugagggcugugcagagcugacucugcccucauuggcugcaacacucaggagaucuggccccaacccucaccugggagggagagcugacccaggugaugugaguggaggagcuguagacucagccaccacccaggcucacauccagagcuuugaauuggccuacccuuacaucuaccccauggaugagcuguuggagcagggaauaggggcaugguggugggcuguugaguaguaggcaacauagggagacccugucucaaacaaacaauaaaggcaugaggcuugccuuuaggagggccucaguucauuuagagcccucacauugauuugaucacugcgucauaaaccugguuccuuuucuguccaaaggagagaagggguaugagcuuccuagugcuggaggugcaacuuagcgacagagcacuugagguggggccaucauugcaaacaggcuuucauucauuuuugucaugcucuggaaugaaggguguuucuugucaggccuuuagugggccugauucagcaguaggcaggugagugguuguauaagcaggcugggcuuucagcucuguuuccuuagaauaccuguuagguuuucugugcugacagccuauguauguacuuguccuuuaauuccuagguucacauacgaagauuaugagaccacugccaaguggcuucugcaacacacugaauaucgaccucaaguggcagugaucugugguuccggcuuaggagggcugacugcucacuuaaaggaggcucagaucuuugacuacaaugagauacccaacuuuccccaaagcacagguacuggcuggacuguggggcguuagucacuguucuauugcuguggagagacaccaugacuaaggcaacucuuaagaaagagcauuuaauuagaggcuuucuuuguuauggguuuaguccauuaucauuguggggaguauggcagcaugcaggacacuggagcaguagcugagagcuauaucuugaucugauggcugaaacagcuacacggggccuggcaugggcuucugaaaccucaaaguccaccccuagugacacacaucuacaacaaaggccacaccuaauucuucuaauacuuucagauauagugccacuuccuggugacuuaggggaccauucauauucaaaccaucacacugcucuuauguggaaucuaaucaaggagauguuuuuauucuuguccuaacuuauuuauuuauuuuuaaagauuuaguuauuauuauauuaguucacuguagcugucuucagacacaccagaagagggcaucagaucucauuacagaugguugugaaccaucaugugguugcugggauuugaacucaggaccuuuggaagagcagucagugcucuuaaccgcugagccaucucuccagccccauuguccuaauuuuugaccaaagauaaauguaagagggaaagagacaccacagaaucagaaaggcuucagaaagaaauccuuauuaguguguguguuaggguggggaggcuugggaaaggugcugaacaaacauguucacucucugauacccaugaacugaaagggaagaacugauucacacuaguugucuucacgcuauagcacgcacacgcacacgcacucacacaugcacgcacucacacucaccuucaguagaagaagcagaaccuguagcccuaggagaaagacaaccuguuccaggucauccucccugucuuccuucaucuccaccucuaugugcagccuagacauacauagcaacaauaagcacuguggccacugugguuaugggcgcacacagggauuaauacaggaaaacacuugguucauaguggccuuuggaaauguaacguugagcucugucaucauuguagcgcugugaccgcaagcaugaaaacucagacucagauuuagaaaggacaagagcaagcuuuuucauuucucuuuauuuuaaauaacuuacuuacuuugguauuauuauuaugauuauuucuucuuacauaucuuccuuucuaucuaccuuuccuaagggaguugaaacuuuuaguaaauauuuaaaagcccuuugggguaagaauggaagagcagagcagggaggagugggagugagggaaggaaggguaacccuguucagagagaagggagaaggcagacaguagcgaugugggccaucugccacuccgucccgcagggagcagagcccugcacuaagugagaagcaaguuaacuugaaguuuagcuaugucuacuuuguucuauugcuuuuuuuuuuuuuuugguuuuuuccgagacaggguuucucuguguagcccuggcuguccuggaauucacuuuguagaccaggcuggccuugaacucagaaauccgccugccucugccucccgagugcugggaaagacacugccagauaauggggaugguaguaacaguuaaucuguaugcucccaugacccacauaccccacaggauugcuaugugggccaaaaagaaagagucguauugggcucgucuuccuuguucaucuuuaggaugccaacauaugccaggagcucccucgcuggaauaaggagacacacaguuuaguuagcagaguuaauuaucauacacauuuuaagcuuugguuuguacucucuuuugcucccuugcaguaugaguuucuccauuuggaaaaguuuuuugaaauuccuucuguuauauguucacaucaauguucuuaucccaugucucuaagguacaguuguaugauuauaaagaucagcauacugcuguuguuguuaauuauaucaucauacguuagacacagugaguggcuucuaguaagugcuugugugugugauacagggaaguaugcuugcuuuucuuuuuguagcagucucgccacauaucccuggcuggccuggaacuugcugugcagucuaggcuggccuugaacugacagagaccucccugcuucugccuccugaguacugaaagaaaaagcauguaccauucacuacacugagcauaaucacuuugcuuuuuucucuugcugucuguagugcaaggucacgcaggccgacugguguuuggauugcugaauggcagaugcugugugaugaugcaaggccgguuccauauguaugaaggauacucacugucaaagguaaacacccaggggcacaagcuugguuggaucaagaggaagaugggagaacuguccuacuuugucuaaccauuugggcugcuucaaauuuuugaucuuuuguuucaugguucauauuauccuuaccuuugaguugguuggugagguuuugaaaagucuuuucugaccuuuugcaucuaaggugacauucccagugagaguuuuccaucuucuggguguggaaacuuugguggucaccaaugcugcuggaggacucaaccccaauuuugaaguuggagauauuaugcugauccgugaucacaucaaccuaccugguuucuguggccagaacccucuccggggccccaacgaugaaagguacacaucuuugaucccuugcucuacaugcagagagucuggccuuguccaggaguugggaaagaaaguucacuuggugccauuuaucugagauaaucccaccuguguuccagguuuggaguucguuuuccugccaugucugaugcuuaugaccgggauaugaggcagaaggcuuucagugccuggaaacaaaugggggagcaacgaaagcuacaagaaggcaccuacgugauguuggcaggccccaacuuugagacuguggcagagagucgucugcuaaagaugcugggggcagaugcuguuggugagaagggggauuuggcuggugguuugaggaaaggaucugguaaaauagcaaaggggagagagaacuuauggauuugggggaggaugacauagaauacuaggaaagcagagaccacaggcuugagcucagcacuguuacugaauguaaguacagccaccuucucuaccuguggcugcaagauggacucauuaauuggaacaaagcagaggaaaagauuguguuggcaaaguguauaaguagcuaguaaggcuaccugagagagguagggcagcgaguguucugcacuaauuuaguugcuguggaugcuuucugaaauucagugaacuucagagagugagagugagaagagccacaugagucauugucucuccccuucaggcaugagcacagucccagaaguuaucgucgcaaggcacugugggcuccgugucuuugguuucucacucauuacgaacaagguugucauggauuaugagaacuuggagaaggccaaucacauggaaguucuggaugccgggaaagcagcugcacagacauuggaaagguuugucuccauucuuauggagagcauuccacucccggaucguggcagcugaccugcaauggagugcuccgcugcuccccuggugggguccaaguagcucucuacucuguuuccuugaugaagucacuagucucuguucuuagauccuagcagaaaggaaagaggagcuuacccuucacuuuccagauguuguucuacuguucuaaugcccagucuucuugcuuaguugccuucucaaauuaacuuucauuccucuggaagagcuggagcccauuccucccacacuugagauauaugccuucaaacaguaccuucuacaucuuggagaugacagacauguucugggcucagucuaaagcccuaaggaccaaagaucaacccaauaccucuuggauuuuauuuaguaucacaauguuuugagaauaaagagaucgaguacuuuucuuuugugugugguucgguaugaagcuggggcaucggccaaaaacgacuugaaaagcuuuggggaccacauguuccaaaagcagcuaagaauggagaugaguuggugcgugaguagcaagggaugaaggggaaaaaaugguguguguguggaggggaugcgacuacuucuuucagacuuguuccuagccuucauuucccacguucuccauuuacuccauugcuugaguaucugcaucucacagaucucacuucuccagcacugccuuuuuuuuuuuuuuuuuuuucgcauuguuuuuuuuucucugcucuaauuucugagucaugcucuuuccagaucuauauugacagugcagcagcagauacacuuuugucugccgccauuugucauggugauggcuacauucauuccaacuccaaccaagccuguaaaguugguucacacuccuucucugcuuaaacaccauggaauggcuauucuugguuaucaacuugacuaugauuggaauuaaaaaaaaaaacaaacaacucaaauagagggcauaacugagggacuuuugcuucauuugaaauggaaagaucuacuuuuaaucugaaucuuugagguaggaagacacaucuuuaaucucaaucuugaguugggaauauucaccuucgauccagcucuaaucuggccugugccugcugaugggaggcuauauaaggaagaacauggaggaaggaaacugcucuucaugugcuuacucuugugcuugugcugcuagcaaguccaucccuucacuggcaucacagccugcuucaggauucuagcauauacugcacaacguccaauggagacagccaaccucaggaacccaaaguucaaaucauuuagaagugaaaauacacccuagagacgacaugaaaauuaugaggguagugacuucuguacaauaucugccuuccagccucauccaguaauaagccaugccaacauccugugcuaaggugagagauaaacacuugaacaagacugcagcuagucaagcaacguacucaagugugcgucacccacuuacagcauagguacaucagcaagauuugccccagcuagucuguuauggaagauaagcuuugccaucuugucugucuccagaaugauuccauggcuacgauauuuccaaacucuugcugggacccaacauuuaagggggaaaugugggugagaggaaaguggaguacucucagcuaacacacagucuuuuuuuuuuuuauauaccaaucccacauugugauguucaguuuucacuccaacugaacuuuugcauaaauucauaacauuuucuuguuucuguuuuccagcacuuuacauauuugaguguuuaaggagcugggaauagaucagucaguaaagugccuaccuu

SEQ ID NO: 7427 - RNA, 9113 nt, Mus musculus
aagguaggcacuuuacugacugaucuauucccagcuccuuaaacacucaaauauguaaagugcuggaaaacagaaacaagaaaauguuaugaauuuaugcaaaaguucaguuggagugaaaacugaacaucacaaugugggauugguauauaaaaaaaaaaaagacuguguguuagcugagaguacuccacuuuccucucacccacauuucccccuuaaauguugggucccagcaagaguuuggaaauaucguagccauggaaucauucuggagacagacaagauggcaaagcuuaucuuccauaacagacuagcuggggcaaaucuugcugauguaccuaugcuguaagugggugacgcacacuugaguacguugcuugacuagcugcagucuuguucaaguguuuaucucucaccuuagcacaggauguuggcauggcuuauuacuggaugaggcuggaaggcagauauuguacagaagucacuacccucauaauuuucaugucgucucuaggguguauuuucacuucuaaaugauuugaacuuuggguuccugagguuggcugucuccauuggacguugugcaguauaugcuagaauccugaagcaggcugugaugccagugaagggauggacuugcuagcagcacaagcacaagaguaagcacaugaagagcaguuuccuuccuccauguucuuccuuauauagccucccaucagcaggcacaggccagauuagagcuggaucgaaggugaauauucccaacucaagauugagauuaaagaugugucuuccuaccucaaagauucagauuaaaaguagaucuuuccauuucaaaugaagcaaaagucccucaguuaugcccucuauuugaguuguuuguuuuuuuuuuuaauuccaaucauagucaaguugauaaccaagaauagccauuccaugguguuuaagcagagaaggagugugaaccaacuuuacaggcuugguuggaguuggaaugaauguagccaucaccaugacaaauggcggcagacaaaaguguaucugcugcugcacugucaauauagaucuggaaagagcaugacucagaaauuagagcagagaaaaaaaaacaaugcgaaaaaaaaaaaaaaaaaaaaggcagugcuggagaagugagaucugugagaugcagauacucaagcaauggaguaaauggagaacgugggaaaugaaggcuaggaacaagucugaaagaaguagucgcauccccuccacacacacaccauuuuuuccccuucaucccuugcuacucacgcaccaacucaucuccauucuuagcugcuuuuggaacaugugguccccaaagcuuuucaagucguuuuuggccgaugccccagcuucauaccgaaccacacacaaaagaaaaguacucgaucucuuuauucucaaaacauugugauacuaaauaaaauccaagagguauuggguugaucuuugguccuuagggcuuuagacugagcccagaacaugucugucaucuccaagauguagaagguacuguuugaaggcauauaucucaagugugggaggaaugggcuccagcucuuccagaggaaugaaaguuaauuugagaaggcaacuaagcaagaagacugggcauuagaacaguagaacaacaucuggaaagugaaggguaagcuccucuuuccuuucugcuaggaucuaagaacagagacuagugacuucaucaaggaaacagaguagagagcuacuuggaccccaccaggggagcagcggagcacuccauugcaggucagcugccacgauccgggaguggaaugcucuccauaagaauggagacaaaccuuuccaaugucugugcagcugcuuucccggcauccagaacuuccaugugauuggccuucuccaaguucucauaauccaugacaaccuuguucguaaugagugagaaaccaaagacacggagcccacagugccuugcgacgauaacuucugggacugugcucaugccugaaggggagagacaaugacucauguggcucuucucacucucacucucugaaguucacugaauuucagaaagcauccacagcaacuaaauuagugcagaacacucgcugcccuaccucucucagguagccuuacuagcuacuuauacacuuugccaacacaaucuuuuccucugcuuuguuccaauuaaugaguccaucuugcagccacagguagagaagguggcuguacuuacauucaguaacagugcugagcucaagccuguggucucugcuuuccuaguauucuaugucauccucccccaaauccauaaguucucucuccccuuugcuauuuuaccagauccuuuccucaaaccaccagccaaaucccccuucucaccaacagcaucugcccccagcaucuuuagcagacgacucucugccacagucucaaaguuggggccugccaacaucacguaggugccuucuuguagcuuucguugcucccccauuuguuuccaggcacugaaagccuucugccucauaucccggucauaagcaucagacauggcaggaaaacgaacuccaaaccuggaacacaggugggauuaucucagauaaauggcaccaagugaacuuucuuucccaacuccuggacaaggccagacucucugcauguagagcaagggaucaaagauguguaccuuucaucguuggggccccggagaggguucuggccacagaaaccagguagguugaugugaucacggaucagcauaauaucuccaacuucaaaauugggguugaguccuccagcagcauuggugaccaccaaaguuuccacacccagaagauggaaaacucucacugggaaugucaccuuagaugcaaaaggucagaaaagacuuuucaaaaccucaccaaccaacucaaagguaaggauaauaugaaccaugaaacaaaagaucaaaaauuugaagcagcccaaaugguuagacaaaguaggacaguucucccaucuuccucuugauccaaccaagcuugugccccuggguguuuaccuuugacagugaguauccuucauacauauggaaccggccuugcaucaucacacagcaucugccauucagcaauccaaacaccagucggccugcgugaccuugcacuacagacagcaagagaaaaaagcaaagugauuaugcucaguguagugaaugguacaugcuuuuucuuucaguacucaggaggcagaagcagggaggucucugucaguucaaggccagccuagacugcacagcaaguuccaggccagccagggauauguggcgagacugcuacaaaaagaaaagcaagcauacuucccuguaucacacacacaagcacuuacuagaagccacucacugugucuaacguaugaugauauaauuaacaacaacagcaguaugcugaucuuuauaaucauacaacuguaccuuagagacaugggauaagaacauugaugugaacauauaacagaaggaauuucaaaaaacuuuuccaaauggagaaacucauacugcaagggagcaaaagagaguacaaaccaaagcuuaaaauguguaugauaauuaacucugcuaacuaaacugugugucuccuuauuccagcgagggagcuccuggcauauguuggcauccuaaagaugaacaaggaagacgagcccaauacgacucuuucuuuuuggcccacauagcaauccugugggguaugugggucaugggagcauacagauuaacuguuacuaccauccccauuaucuggcagugucuuucccagcacucgggaggcagaggcaggcggauuucugaguucaaggccagccuggucuacaaagugaauuccaggacagccagggcuacacagagaaacccugucucggaaaaaaccaaaaaaaaaaaaaaagcaauagaacaaaguagacauagcuaaacuucaaguuaacuugcuucucacuuagugcagggcucugcucccugcgggacggaguggcagauggcccacaucgcuacugucugccuucucccuucucucugaacaggguuacccuuccuucccucacucccacuccucccugcucugcucuuccauucuuaccccaaagggcuuuuaaauauuuacuaaaaguuucaacucccuuaggaaagguagauagaaaggaagauauguaagaagaaauaaucauaauaauaauaccaaaguaaguaaguuauuuaaaauaaagagaaaugaaaaagcuugcucuuguccuuucuaaaucugagucugaguuuucaugcuugcggucacagcgcuacaaugaugacagagcucaacguuacauuuccaaaggccacuaugaaccaaguguuuuccuguauuaaucccugugugcgcccauaaccacaguggccacagugcuuauuguugcuauguaugucuaggcugcacauagagguggagaugaaggaagacagggaggaugaccuggaacagguugucuuucuccuagggcuacagguucugcuucuucuacugaaggugagugugagugcgugcaugugugagugcgugugcgugugcgugcuauagcgugaagacaacuagugugaaucaguucuucccuuucaguucauggguaucagagagugaacauguuuguucagcaccuuucccaagccuccccacccuaacacacacacuaauaaggauuucuuucugaagccuuucugauucuguggugucucuuucccucuuacauuuaucuuuggucaaaaauuaggacaauggggcuggagagauggcucagcgguuaagagcacugacugcucuuccaaagguccugaguucaaaucccagcaaccacaugaugguucacaaccaucuguaaugagaucugaugcccucuucuggugugucugaagacagcuacagugaacuaauauaauaauaacuaaaucuuuaaaaauaaauaaauaaguuaggacaagaauaaaaacaucuccuugauuagauuccacauaagagcagugugaugguuugaauaugaaugguccccuaagucaccaggaaguggcacuauaucugaaaguauuagaagaauuagguguggccuuuguuguagaugugugucacuagggguggacuuugagguuucagaagcccaugccaggccccguguagcuguuucagccaucagaucaagauauagcucucagcuacugcuccaguguccugcaugcugccauacuccccacaaugauaauggacuaaacccauaacaaagaaagccucuaauuaaaugcucuuucuuaagaguugccuuagucauggugucucuccacagcaauagaacagugacuaacgccccacaguccagccaguaccugugcuuuggggaaaguuggguaucucauuguagucaaagaucugagccuccuuuaagugagcagucagcccuccuaagccggaaccacagaucacugccacuugaggucgauauucaguguguugcagaagccacuuggcaguggucucauaaucuucguaugugaaccuaggaauuaaaggacaaguacauacauaggcugucagcacagaaaaccuaacagguauucuaaggaaacagagcugaaagcccagccugcuuauacaaccacucaccugccuacugcugaaucaggcccacuaaaggccugacaagaaacacccuucauuccagagcaugacaaaaaugaaugaaagccuguuugcaaugauggccccaccucaagugcucugucgcuaaguugcaccuccagcacuaggaagcucauaccccuucucuccuuuggacagaaaaggaaccagguuuaugacgcagugaucaaaucaaugugagggcucuaaaugaacugaggcccuccuaaaggcaagccucaugccuuuauuguuuguuugagacagggucucccuauguugccuacuacucaacagcccaccaccaugccccuauucccugcuccaacagcucauccaugggguagauguaaggguaggccaauucaaagcucuggaugugagccugggugguggcugagucuacagcuccuccacucacaucaccugggucagcucucccucccaggugaggguuggggccagaucuccugaguguugcagccaaugagggcagagucagcucugcacagcccucagucauguccccagguggcagcccagaagauccacuuggcuuuuggugguaaaagacccagacaugguucucaguaguagcaaaggccaggaccuuaccuuggcuacagauagcacaccaagcuccuccucacuacacucgugucuccaguuccacucccuucauugugcacacaacacucugcuucccuuuuucuucugucucuccaucucucacuuucucaucuauuagugcccguggcaguuguuuugggcuugcucugcucacugggcccauauuuaauuaauuaauuuuuaauuugaaaauuuaauuacacuuaauuuaguuggugucugugugugugugauguguucaaagcaugccacaucauguuugguggucaaaaggauaacggugagucaguuaucuccuucuaccacaagacuggaacccaauucaggcuuggcagcaaguaccuuacuuguagaaucauguuacuagcccucaaauuuuaaaauuuuuauuaguaaguaauaacacuccuagaaaucuacaggagagccuuaguuucucuaaacauguuucuuugauucccagauacagaucucugccauauggaauuaacuaaacuuuuuucuuuuucuuucucuccuuuuguguguguguguauguguguguguauguguaguauuggaguuuguuuucaggcagagucucauguaacuuaggccagacucaaacugacugugaguuccugauccuccugucucuacagugugagcuaugauuuacaguuaagaaacuaaaugacuguggcccacaacuuuaaucccagcaauugggaggcagaggccagccuggucuacagaaugaguuccaggauggccaggacuacacaaagaaacccugucucugugaggaaaaaaaaaaaaagaaaaagaaagaaagaaacuaaaugauuguaaaacaacacaaaacccaggcuuauuucacaacacugguuauaaaaugccaagcuaguacuagcuucaggcacuaguucaaaauagaaguuuguaggcccaucccuucagaugaaaaacuuguuaaagaaguuaugaaggguggcaaacaacuuuaaucccagcacucaggaggcaaaggcagucagaucucugugaguucaaggacagccuggucuaaggugugaguuucaggaagaaacggggcuauguacagagacuguuucaaaacaacagaacaaacaaccagacuugcuaggaagcucuguuguguaacaguuaaucuuuccaccuccugcugcucccucucccucucccucucccuccuuucaucuuggcuuccccccacacuaagguauuuuguucuucagaaagcaaagaacaagguacauaacucauaaccaaguacuaguauuaacugggagcuggucguggugaggcagaucuuuaaaaucccagcauuaggaggaggaggagcaaggcaggaggaucucugcgaguuugaggguuccaaaacagaaggaagacaaacccugucuagucagccuggaccuucucacagucccaaguccaauuuuaucacaucauacugcaaagaucaaagauugcuccuaggaguggaagaacggagguguacacaaauugaacacaacuaaaaaagccuuuuuuuuuccuuccagccagggagcuuuaaguauuagagacuuaaagacauggcagacccagacauuaguauaacuugagccuagccuggagguauagcaagaccuugucacaaacugccacagaguauacuauaggaagcaaaacaggacuauaacacaacagguuauccacaaugaaacagcuagguagggcagggacagauagaagcaauuaaguaggcaagaauuuaggaugcaguccuaaagggccggaaguaugaggcuuggccaccuggccauguccagcuauagcucacaguccccgaggacacgucggaccugagaucauccuaaagccacugugaucccuacagcucugcggugagucaaucuaggaauucccgacccaaaaggaagggaguugacuuuuuugcuuuuuguuuuuguuuuuaaagugggcaggaagguguguauaaguaucuaagcaggucagugaauacagauuucccagccuuaaaaagacuccauuccucauuuguuaaugcgacuuccagcuuggaggagagagagucgcggaaaaugagcaauuuucccucuaaaggaacugcggaauugcacaacagaauuaucuacuggguuacuuggaccgcuggaaaggaaacuuguguuauuaaguagucagggcuuucgccuccuuccccacauacauccacauacaccauggaggcacaauguuccuugugauggugccuacacugcgcuaaccuguuucuuccugcuccggggcgccccuaccgcugguucccgcgccugccugucgcgccagccgccccaccauucuggagcccuaugucugccacugggcucugugccaggccucucugcauccccaacagacucgcuccuucucugggcccaggcugauaaguucccaguucucagcuacagcccgucucucucggcagaacgcccgaguccccgggcccggcacuuacucguucuccauggagucaccgacggccacgccgaaauccugcccuuuccgcuccacggcgacacugucugagucaggucaagacuguuagugcacuauucgcugggccggccuuuauauccucagccccaggcuccagccaauggcagcggccuugucuccauggugacacacccucauccagagguguggcaggaaaccucuccagaguucuuuucaaagagacccacuccuagucuaaggcaaccagcagaugaaacccgcacacagucaugauuucccagccagaaaagg

SEQ ID NO: 7428 - RNA, 10704 nt, Mus musculus
aucaccugcugguggccuuagacuaggaguggaucucuuugaaaugaacucuggagagguuuccugccacaccucuggaugagggugugucaccauggagacaaggcugcugccauugguuggagccuggggcuaggauguaaaggccggccuagguaauagugcacuaacagucuugaccugacucagacagugucaccauggagcagaaagggcaagauuugggcgccucugucggugacaccauagagaaagaguaagugccgggcccggggacucgggcguucugccuagagagacgggcuguagcugagaacugggaacuuaucagccugggcccagagaaggagcgagucuguuggggaugcagagaggccuggcacagagcccaguggcagacauagggcuccagaaugguggggcggcuggcgcgacaggcagacgcgggaaccagcgguaggggcgccccggagcaggaagaaacagguuagcgcaguguaggcaccaucacaaggaacauugugccuccuugguguauguggauguauguggggaaggaggcacgagcccugacaacuuaauaacacaaauuuccuuuccagcgguccaaguaacccaggagauaauucuguugugcaauuccgcaguuccuuuagagggaaauuugcucauuuucugcgacugccccucucucuccuccaagcuggaaguagcauuaacaaaugaggaauggagucuuuuuaaggaugggaaaucuguauucacugaccugcuuagauacuuauacacaccuuccugcccacuuuaaaaacaaaaacaaaaaaccaaaaaccagaaaagucaacucccucccuuuuguguagggaauuucuagacugacucaccgcagagcuguagggaucacaguggcuuuaggaugaucucagguccgacguguccucggggacugugagcuauggcuggacauggccggguggccaagccucauacuuccggcccuuuaggacugcauccuaaauucuugccuacuuacuugcuucuguuugucacccuguggcucuaucugucccugcccuaccuaauuguuucauuguggauaaccuguuguguuauaauccuguuuuguuuccuauaguauacucuguugcaguuugugacaaggucuugcuauaccuccaggcuaggcucaaguuauacuaaugucugggucugccaugucuuuaagucucugauacauaaagcucucuggguggaagaaaaaaaaaaggcuuuuuuaguuguguucaauuuguguacaccuccguucuuccacuccuaggagcaaucuuugaucuuugcaguugggugugauaaaauuggacuugggacugugagaagguccaggcugacuagacaggguuugucuucguucuguuuuggaacccucaaacuggcagagaucuuccugccuugcuccuccuccuccuaaugcugggauuuuaaagaucugccucaccacgaccagcucccuguugauacuaguacuugguuaugaguuauguaccuuguucuuugcuuucugaagaacaaaauaccuuaguguggggggaagccaagaugaaaggagggagagggagagggagagggagcagcaggagguggaaagauuaacuguuacacaacagagcuuccuagcaagucugguuguuuguucuguuguuuugaaacagucucuguacauagccccguuucuuccugaaacucacaccuuagaccaggcuguccuugaacucacagagaucugacugccuuugccuccugagugcugggauuaaaguuguuugccacccuucauaacaucuuuaacaaguuuuucaucugaagggaugggccuacaaacuucuauuuugaaauagugucugaacuagcuuggcauuuuauaaccaauguugugaaauaagccuggguuuuguguuguuuuacaaucauuuaguuucuuucuuucuuuuucuuuuuuuuuuuuuccucacagagacaggguuucuuuguguaguccuggccauccuggaacucauucuguagaccaggcuggccucugccucccaauugcugggauuaaaguugugggccacagucauuuaguuucuuaacuguaaaucauagcucacacuguagagacaggaggaucaggaacucacagucaguuugagucuggccuaaguuacaugagacucugccugaaaacaaacuccaauacuacacauacacacacacauacacacacacacacaaaaggacagaaggaaaaagaaaaaaguuuaguuaauuccauauggcagagaucuguaucugggaaucaaagaaacauguuuagagaaacuaaggcucuccuguagauuucuaggaguguuauuacuuacuaauaaaaauuuuaaaauuugagggcuagugacaugauucuacaaguaagguacuugcugccaagccugaauuggguuccagucuugugguagaaggagauaacugacucaccguuaucauuuugaccaccaaacaugauguggcaugcuuugaacacaucacacacacacauagacaccaacuaaauuaaguguaauuaaaauuucaaauuaaaaauuaauuaauuaauuaugggcccagugagcagagcaagcccaaaacaacugccacgggcacuaauagaugagaaagugagagauggagagacggaagaaaaagggaagcagaguguugugugcacaaugaagggaguggaacuggagacacgaguguagugaggaggcgccuggugugcuaucuguagccaagguaagguccuggcccuugcuacuacugagaaccaugucugggucuuuuaccaccaaaagccaaguggaucuucugggcugccaccuggggacaugacugagggcugugcagagcugacucugccccucauuggcugcagcacucaggagaucuggccccaacccucaccugggagggagagcugacccaggugaugugaguggaggagcuguagacucagccaccacccaggcucacauccagagcuuugaauuggccuacccuuacaucuaccccauggaugagcuguuggagcagggaaugggggcaugguggugggcuguugaguaguaggcaacauagggagacccugucucaaacaaacaaaaaaggcaugaggcuugccuuuaggagggccucaguucauuuagagcccucacauugauuugaucacugcgucauaaaccugguuccauuuuuguccgaaggagagaagagauaugagcuuucuagugcuggaggugcaacuuagcggcagagcacuugagguggggccaucagugaaaacaggcuuucauucauuuuugucaugcucuggaaugaaggguguuucuugucaggccuuuagugggccugauucagcaguaggcaggugagugguuguauaagcaggcugggcuuucagcucuguuuccuuagaauaccuguuagguuuucugugcucacagccuauguacuuguccuuuaauacuuagguucacauacgaagauuaugagaccacugccaaguggcuucugcaacacacugaauaucgaccucaaguggcagugaucugugguuccggcuuaggagggcugacugcucacuuaaaggcggcucagaucuuugacuacaaugagauacccaacuuuccccaaagcacagguacuggcuggacuguggggcguuagccacuguucuauugcuguggagagacaccaugacuaaggcaacucuuaagaaagagcauuuaauuagaggcuuucuuuguuauggguuuaguccauuaucauuguggggaguauggcagcaugcaggacacuagagcaguagcugagagcuacaucuugaucugauggcugaaacagcuacacggggccuggcaugggcuucugaaaccucaaaguccaccccuagugacacacaucuacaacaaaggccacaccuaauucuucuaauacuuucagauauagugccacuuccuggugacuuaggggaccauucauauucaaaccaucacacugcucuuauguggaaucuaaucaaggagauguuucucuucuuuuccuuacuuauuuauuuauuuuuuaaaaagauuuauuuaucauuauauuauuuauuauuauauuaguacacuguagcugucuucagacaccucagaauagggcgucaguucucauuucagaugguugugagccaccaugugguugcugggauuugaacucaggaccuuuugaagaacagucacugcucuuaaccacugagccaucucaccagccccauuguccuaauuuuugaccaaagauaaauguaagagggaaagagacaccacagaaucagaaaggcuucagaaagaaauccuuauuaguguguguguuagggugggggggcuugggaaaggugcugaacaaacauguucacucucugauacccaugaacugaaagggaagaacugguucacacuaguugucuucacgcuauagcacgcacuagcacucgcacucaccuucaguagaagaagcagaaccuguagcccuaggacaaugacaaccuguuccaggucauccucccugucuuccuucaucuccaccucuaugugcagccuagacauacauagcaacaauaagcacuguggccacugugguuaugggcgcacacagggauuaauacaggaaaacacuugguucacaguggccuuuggaaauguaacguugagcucugucaucauuguagcgcugugacgcaagcaugaaaacucagacucagauuuagaaaggacaagagcaagcuuuuucauuucucuuuauuuuaaauaacuuacuuacuuugguauuauuauuaugauuauuucuucuuacauaucuuccuuucuaucuaccuuuccuaagggaauugaaacuuuuauuaaauauuuaaaagcccuuugggguaagaauggaagagcagagcagggaggugugggagugagggaaggaaggguaacccuguucagagagaagggagaaggcagacaguagugaugugggccaucugccacuccuccccgcguggagcagagcccuguacuaugugagaagcaaguuuuuuuuuuaaauauuuuuuuuauuccgaauauuccucaauuacauuuccaaugcuaucccaaaagucccccacauccucccccucccacuuuccuuccccuacccacccauucccauuuuuuggcccuggcguuccccuguacuggggcauauaaaguuugccuguccaaugggccucucuuucuuuugauacauaugcagcuagagacaagagcuccgggguacugguuaauucauaauguuguuccaccuauaggguugcagaucucuuuagcuccuuggauacuuucucuagcuccuccauugggggcccugugauccauccaauaguugacugugagcauccacuucuguguuugcuaggucccggccuagucucacaagagaaaucuagguccuuggaucaaacgcuugcuaguguaugcaauggugucaucauugggaggcuaauuauguuuuuuuguuuuuguuuuuguuuuuguuuuuuguuuuuuugagacaggguuucucuguauagcccuggcuguccuggaacucacuuuguagaccaggcuggccgaacucagaaauccgccugccucugccuccugaguguugggauuaaaggcgugcaccaccacgccuugcggcaggcuaauuaugggauggaucccuggauauggcagucucuagaugguccauccuuuugucucagauccaaacuuugucucuguaacuccuuccaugggugauuguuuccaauucuaagaaggggcaaaguguccacacuuuagucuucauucuucuucaguuucauguguuuugcaaauuguaccuuauaucucgcuauacuaaguuucugggcuaauauccacuuaucagugaguacauaucauuugaguucuuuugugauuguguuaccucacucaggaugaugcccuccagguccaaccauuugccuaggaauuucauaaauucauucuuuuuaauagcugaguaguacuccauuguguaaauguaccacaauuuuuguauucauuucucuguugagggccaucuggguuuuuuccagcucuuggcuguuauacauaaggcugcuaugaacauaguggagcauguguccuucuuaccuguugggacaucuccuggauauaugcccaggagagguauugcgggauccuccaguaguacaauacuauacuaaguccaauuuucugaggaacagccagacugauuuccagagugguuguacaagcuugcaaucccaccaacaauggaggaguguuccucuuccucuacauccucuacagcaucugcugucaccugaauuuuugaucuuagccauucugacuggugugaaauggaaucucaggguuguuuugauuugcauuucucugaugauuaaggauguugaacauuuuuucaggugcuucucagccauuugguauuccucgggugagaauucuuuguuuagcucugagccccaucuuuuaaggggguuauuugauuuucuggaguccacccucuugaguucuuuauacauauuggauauuagucccgaaagcaaguuaacuugaaguuuagcuaugucuacuuuguucuauugcuucuuuuuucuuuugcucccuugcaguaugacuuucuccguuuggaaaaguuuuuugaaauuccuucuguuauauguucacaucaauguucuuaucccaugucucuaagguacaguuguaugauuauaaagaucagcauacugcuguuguuguuaauuauaucaucauacguuagacacagugaguggcuucuaguaagugcuugugugugugauacagggaaguaugcuugcuuuucuuuuuguagcagucucgccacauaucccuggcuggccuggaacuugcugugcagucuaggcuggccuugaacugacagagaccucccugcuucugccuccugaguacugaaagaaaaagcauguaccauucacuacacugagcauaaucacuuugcuuuuuucucuugcugucuguagugcaaggucacgcaggccgacugguguuuggauugcugaauggcagauccugugugaugaugcaaggccgguuccauauguaugaaggauacucacugucagagguaaacaaaccaggggcacaagcuugguuggaucaaaggaagaugggagagcuguccuacuuugucuaaccauuugggcugcuucaaauuuuugaucuuuuguuucaugguucauauuauccuuaccuuugaguugguuggugagguuuugaaaagucuuuucugaucuuuugcaucuaaggugacauucccagugagaguuuuccaucuucuggguguggaaacuuugguggucaccaaugcugcuggaggacucaaccccaauuuugaaguuggagauauuaugcugauccgugaucacaucaaccuaccugguuucuguggccagaacccucuccggggccccaacgaugaaagguacacaucuuugaucccuugcucuacauguagagagucuggccuuguccaggaguugggaaagaaaguucacuuggugccauuuaucugagauaaucccaccuguguuccagguuuggaguucguuuuccugccaugucugaugcuuaugaccgggauaugaggcagaaggcuuucagugccuggaaacaaaugggggagcaacgaaagcuacaagaaggcaccuaugugauguuggcaggucccaacuuugagacuguggcagagagucgucugcuaaagaugcugggggcagaugcuguuggugagaagggggauuuggcuggugguuugaggaaaggaucugguaaaauagcaaaggggagagagagagaauuuauggauuugggggaggaugacauagaauacuaggaaagcagagacaacaggcuugagcucagcacuguuacagaaugucaguacagucaccuucucuaccuguggcugcaagauggacucauuaauuggaacaaagcagaggaaaagauuguguuggcaaaguguauaaguagcuaguaaggcuaccugaggagagguagggcagcgagugcucugcacuaauuuaguugcuguggaugcuuucugaaauucagugaacuucagagagugagggugagaagagccacaugagucauugucucuccccuucaggcaugagcacagucccagaaguuaucgucgcaaggcacugugggcuucgugucuuugguuucucacucauuacgaacaugguugucauggauuaugagaacuuggagaaggccaaucacaaggaaguucuggaugccgggaaagcagcugcacagaaauuggaaagguuugucuccauucuuauggagagcauuccacucccggaguguaaccuccuuuagccuaggcaggcugguucagacuguaugccacugagguggggccaccugaugugcugcuucucuaauucaacuaguuucuuuugauuugacacugccuucaccugcccugaggcugaagugcuucuccaagauuuucuggaguuaacaacaaccugugaaucugucgaauugcugcuaaaaggcugugcugaugacaucaagaaacuuggugugacucgggagggguuucccucuuuauaagcacagacuuuuauuaaacauuugaaccuugagcagacuugcuugucuugguuccauuauuucucgaccggcguagauucccucuucucuuucagcucugguugccucuuaggcuugaaccaggacaugagagcugcaggccugccccaacaccggagcauggcagcugacuggccauggagugcuccacugcuacccuggugggguccaaguagcucucuacucugguuccuugaugaagucaccagucucuuuucuuggauccuagcagaaaggaaagaggagcuuacccuucacuuuccagauauuguucuacuguucuaaggcccagucuucuugcuuaguugccuucucaaauuaacuuucauuccucuggaagagcuggagcucauuccuuccacacuugagauauaugccuucaaacaguaccuucuacaucuuggagaugacagacauguucugggcucagucuaaagcccuaaggaccaaagaucaacccaauaccucuuggauuuuauuuaguaucacaauguuuugagaauaaagagaucgaguccuuuucuuuugugugugguucgguaugaagcuggggcaucggccaaaaacgacuugaaaagcuuugggggccacauguuccaaaagcagcuaagaauggagaugaguuggugcgugaguagcaagggaugaaggggaaaaaugguguguguguggaggggaugcgacuacuucuuucagacuuguuccuagccuucauuucccacaugcuccauuuacuccauuucuugaguaucugcaucucacagaucucacuucuccacugccuuuuuuuuuuuuuuuuuuuuuuggcauuguuuuuucccucugcucuaauuucugagucaugcucuuuccagaucuauauugacagugcagcagcagauacacuuuugucugccgccauuugucauggugcuggccacauucauuccaacuccaaccaagccuguaaaguugguucacacucauucucugcuuaaacaccauggaauggcuauucuugguuaucaacuugacuaugauuggaauuaaaaaaaaaaaacaaacaacucaaauagagggcauaacugagggacuuuugcuucauuugaaauggaaagaucuacuuuuaaucugaaucuuugagguaggaagacacaucuuuaaucucaaucuugaguugggaauauucaccuucgauccagcucuaaucuggccugugccugcugaugggaggcuauauaaggaagaacauggaggaaggaaacugcucuucaugugcuuacucuugugcuugugcugcuagcaaguccaucccuucacuggcaucacagccugcuucaggauucuagcauauacugcacaacguccaauggagacagccaaccucaggaacccaaaguucaaaucauuuagaagugaaaacacacccuagagacaacaugaaaauuaugaagguagugacuucugcacaauaucugccuuacagccucauccaguaauaagccaugccaacauccugugcuaaggugagagauaaacacuugaacaagacugcagcuagucaagcaacguacucaagugugcgucacccacuuacagcauagguacaucagcaagauuugccccagcuagucuguuauggaagauaagcuuugccaucuugucugucuccagaaugauuccauggcuacgauauuuccaaacucuugcugggacccaacguuuaaggggggaaaugugggugagaggaaaguggaguacucucagcuaacauacagucuuuuuuuuuuuauauaccaaucccacauugugauguucaguuuucacuccuacugaacuuuugcacaaauucauaacauuuuccuguuucuguuuuccagcacuuuacauauuugaguguuuaaggagcugggaauagaucagucaguaaagugccuaccuu

SEQ ID NO: 7429 - RNA, 799 nt, Mus musculus
auguguuuuuuuuuuuccuacuaaauagagguuuauuugcagaaguugaaaaaagcucaguuugcauacauauguacagaucccagcuuugagccacucgggguggugggcacccuugggcgaugaacaggucacaccaacagaaacugagacucaguagguuggcucaguucucaagacccagaaguacuggccagccuaacccccucccugccugagaccaucuucccacaggaugugugugcugaacagaucagaugggacacggagaacuugucagucagaguuacaagccucuuguccggugguggcguccacugcagaggccaggcuguccucuuggccuuuuagccgcucacagaucagcucugcaaugguucucuggguccgcuuuucuagcuucucuagcuucuuggccacaucucucuugagaucccaaucagguuuccggggugccaaguuggccagguccacuuccucaaugacaggcucuggcuuggcugccuccagcugcuccuucaccuucuccuccacugccacugguuuggccugggggacccgccuccucuucaggucuucauccucugggacauaguuccugagccugaguccccugugcuucccaacuuccucucccucuucucugagcugcuuggucuguggcuccccaucuucccuguccuugcgcccgguuuucucccggagggccuucagccguucuuuccgccucuuccucuaggcggcccacaccggcaggagcagccgccaucuuuucggaggccccccaccucccccacca

SEQ ID NO: 7430 - RNA, 799 nt, Mus musculus
uggugggggagguggggggccuccgaaaagauggcggcugcuccugccggugugggccgccuagaggaagaggcggaaagaacggcugaaggcccuccgggagaaaaccgggcgcaaggacagggaagauggggagccacagaccaagcagcucagagaagagggagaggaaguugggaagcacaggggacucaggcucaggaacuaugucccagaggaugaagaccugaagaggaggcgggucccccaggccaaaccaguggcaguggaggagaaggugaaggagcagcuggaggcagccaagccagagccugucauugaggaaguggaccuggccaacuuggcaccccggaaaccugauugggaucucaagagagauguggccaagaagcuagagaagcuagaaaagcggacccagagaaccauugcagagcugaucugugagcggcuaaaaggccaagaggacagccuggccucugcaguggacgccaccaccggacaagaggcuuguaacucugacugacaaguucuccgugucccaucugaucuguucagcacacacauccugugggaagauggucucaggcagggaggggguuaggcuggccaguacuucugggucuugagaacugagccaaccuacugagucucaguuucuguuggugugaccuguucaucgcccaagggugcccaccaccccgaguggcucaaagcugggaucuguacauauguaugcaaacugagcuuuuuucaacuucugcaaauaaaccucuauuuaguaggaaaaaaaaaaacacau

SEQ ID NO: 7431 - RNA, 1134 nt, Mus musculus
ucaggaugggugauagaacgucguuucaucuuuacagcugggaaagauaauaauggcuccacgugcgaaccagagugucggcacuacggaguuuguccuggcaggcuucccgaaucucaacagcacaggagcggaaguguucuccguguuccuuuucguuuaccuguugacucuaacaggcaacacguugauuguugucuuggugggggcggaucaccgccugcagacacccauguauuucuuccuggcuaacuuguccugccucgagauucugaucacuucugucaucauuccgaagaugcugagcaauuuccucucgagacggcacaccauuuccuuugcugccuguaucacucaguuuuacuuuuacuucuuucugggggccucugaguuccuacuguuggccgucaugucuguggaucgcuaccuggccaucugccguccucugcauuaccccuugcuaaugaauggagccgugugcuuucggguggccuuggccugcuggauggggggacuccucccugugcuuggccccacaguggcuguggccuugcuuccuuucugcaaacagggugcugugguucagcacuucuucugugacaguggacccuugcuucaccuggcauguaccaacaccacgagacuggaggaggcugacuuuguccuggccuuucuugucaucauguccucgcucaccauuacuggugcguccuauggccacauaguccuggcgguccugcgcauccccucugcuuccggucggcagaaggcuuucuccaccuguacuucucacuugauggugguaacccucuucuauggaagugccauuuuccucuacguaaggccaucccagagcggcucuguggauacuaacuggucuguaaccgugauaacaacauuugugaccccucugcugaauccuuuuaucuaugccuugcgcaacgaucaagucaaggaagcuuugaaagagauguucaggaagguagucgccaagcuguuagaacagucuuuacuuggggauaguuugagaaagaagacagccaguugaaagcguggggacucagucucagguccacacaucuccauugccagcuuuuccuucaucaugagaggagccaggacgagcuucaagga

SEQ ID NO: 7432 - RNA, 15077 nt, Mus musculus
uggaacgcccacccuccacuccucugcaccccgccccaaucuguuugcguggccaggcaacgccgaccucacccauaucggggacgagauuccaaaggaaauuucauucuucuauucgccaucccaacaggaaggaaggagugagaaacaaagcugccgccuccaguuccggguccagguggguuucuacuucugucccuccagguuuggcuuuggaagucccuuccuacuaaggacaguuguggggcuccugggagaugacuucucgacuucucaggucugacugcggggcugaggugugguggggcucaacgcuguuuccacaguuagcuuuucgcaucuugccagaguccagcguggauguccauugucuagaaccagggcucauaggggaccgcagaauccgcgaagggaggaauuccaagaagcccgcguuugcucagauaaggaaaaauuuugagaguuccuagguugauaucagauuuguuaugcaagucugucaagguugugcaaggauaagugguguuuucguuuuuguauuuccugucucccucccuuaacucauguuuaaguguguugugaaaccauuggagaccggucaacagcauccucugugccuucuuacugaacaguugggauccgcuaugucugagacagcacaucaaaccaugccagcgcaacgauggagcaucuuuauuucggauggaggauaguagaaaccuuguccuuuuauugggacaucuucagugggccaguccuucggucugugauggcaggaaucucauagccaguccauacaugcagucguuagaaacuucaguuagcagacaagucugaacagccucuggcaaacuccaaaaaagcugccuuggcuauucauaaacgagcaccacccagcucugagccaguuaguguugcuaguugcagcgguuucauuucaagaaauaauauaaugauaaaacaaucagauguuuuagagaguuauggaaauaaucaguguuaaguaauuuucaauacugcuuuaaacaugaguuuugauuuuucuagaaaucauaaaaguugugucaugcauuggaaagcuuccauucacagggacaccaaaugcuccuucgucaguuaaugucccuuucuuuguucuucaguucccucuuccuuacagugaagguugagagaucaucucauuucgaucucauggggcagugggaccucagucacaugauucagagaagguggaguugaagcuuaguuaaacaggggugauuagaaaacgugaacuagcuacaguucgagaucaggccugggggagucaucaguuugacaacggcuuagcuugucgggguucgugguucccccucaccccuguuuuuucugcaccccacaaaacgccauagagcuguccacuggaggcauucuuagugugacuucaagcauggauuaaaaaguguacugaugcaggcugguaaaacaugucuugagaucuuccauuguguacacauuugaguauagagcacuauauguaagcaguuacuuucagaguggcugcaagcagagcccaguauguugggaaguaauguuuaauuuguaucguguuuggaaauguccgaugucaucaggucuuuguuuccauucucccugacccaggggagcccccacuccucagggggcccucuggugagcuuuccuuuucuaguuguuacuucguuacugacugaguaguauguuagcaguguaaaggaauuuuuaguguccccgugccuucuacucuauaaugagcccuaaggacagaaucaaacauacacacucuguauaaagagaggaaugugccaacacuagaaauaucagaagaagaaugugucauggauauuacuggcuuggagaagagacagacaaaauuccaggaaaggaggauggcuuucaggagguuaaauauuuuaauaaauacuuuuuaaaauuugguaguuguuuuauacgaauuaaaauuaccaacaaagauauaauauucaggccuggggauguggcucaaugguagucuauguaucauaugugagguccuaggucugagcucuggaaaacacacacacacacacacacacacacacacacacacacacacacacacacacacacacauacacacacacacacacacacacacacacacacacacagaguuuuuccuuccaucuuaauaaauuauaaauuuaaaaaaaaauacccauuucuguuucaauaugggccaaauuggguaaaaauuaaaaaaaaaagaaagagagaaagaaagaaaggaagaaagagagagagagagagagagagagagagagagagagagagagagagagagagagagagagagagagagagaggaaggaaggaagaaagaaagaaagaaagaaagaaagagagagacaaagaaaaagagcccuggccuuuugucagggauuugagcagguucuaaaucccccgaggugucaggugaggggccagcgacuuccuggaagauugcugacugcuaauugucucuggcugcuuccugguacucugcugacauugcucuuuaaaaaaaaggaagcugcuguguuugagcaaguuaauguguuagacuaguggauuuugugucuguaugugugcuguaggugugggugaagugccucuguuuugugguuguuuaucagaaaaagaccacauugauauaaucaucucuggcuaugggaguuggcugauauuucuccugggaauugaugaggccauccagguuuugcaauggacuggcuguucuccuaacaaugagugggugacgacucuagcacucaguccuuccacaucuguuuaaaaguaaugugugauuaauuuaaaauaggcaccaccauacauaguauguuugcacacugagcauuucggugacagguuggauaccaguagaguggccucacccugaagacccugagugcuaucuuucucuguacuucugaaacaguuuaaaugcuggcauuugucaaaacaugcuuggcacuugucuaauggacacuggucaggaugugacuaggucucccuuucaggggacucuaguaccccaaaauuaggcuauaacagcuuagucuucuucucauuuccuuucagcucacaguuggguugagugcaggagggagcagacaaggacaaaggggaccuucaagcugggcugugccucaacaaagcugaaaaguguugagguuugggcccuuuccaagucuucaugccagccacucuuccuucucaagcugucaggccccguucuuaggaaguguauccauugcgaugugcacauucugggcagcuuuugcuuguucgcuugcuugcuuguuuguugagacaggauuucucugcacagcccuggcuguucuagaacuagcucuguagaccaggcugaccucaaacucacagagauccaccugccucugccucccaagugcugcuggaauuagggguuugcuuuuuaaaagacuuuacacucuuagagucugcucuguggucaggaacaaaagcucauuggugaaggcaaacuaacugauuucagaacuuuuugcaggcaaguguagaacacucccagguucauugcaacaccuccaaugaccucaucagaccccaggggaagcaucuuccagcucccacagccagagauugcucggcuuagcaaucaaguuuauuuaauaacugcuaccaaaucuugcaucucugaaccuuuaaagagaagcccagaauguuuuucgugguuagaggcucuagaucaguugaugaggacuuaugugucagucacugagaauauagaaaugaguaaguaaaaauucuucucuggaaaggauccacccaauggagagacacugagauuaacuaacuuaaaggaauguuggcagcccauuucuucaguuacaccaacggaagugaauccagauccaucccgaccguacuguggguccuuuauaccagugcagucuuccccaaguguucccaaguccgggugugaacaugucugcaagucagcgccccaaagcugccugcuugcauuuuugcugcuuucugaggguucccuguuccugccacacagaggaccagccuugcugagggagucugaagaugcuggagugcugaauucuuccuccugcuacggcgagucagcugaugcucucguuuuuuuuuuuuuuuuuuuuuuuuugugcccagacucaccucagacauccccagcacgcuuccacacagugagagaugcuuugccccugccuccaccucuacuccgcugacaaccuguaggucucccaucccuauuuuugcuuuuagaaauuaguacagcuuaaaucacacauaaauaucuacacaaugauggagcaaaaucuagaaauugacaaggagcuaaaauauugcaacuuugcccuauauacaagauaaauguauggcaacuuuuaaaauuguauguauuuauuuaucugcauguaugucuguguaccacacauaugcaaugcccagggagaccagaugaaggcaucacuacauaugguugggaacugccaugugggucugagaacugaaccugaguaagugccugcaaccacugagcgaucuguccagccuugaagaugaaucuguuagaacaauucuaguagauuucuucacuaccucacuguguacuuucuggguuuuagaagucugaccccguggcuugucuacucuucgaucuuagaguuaccucauaagcagagcagacaugcauaauuucuucuguacuugguucccauaaugcuuagauguagacagcugguuuugcaacugugcuuuaaagaacaggaagcugaguagccauaaauauauauucuuuuuucuccagaggauggacagagggaggaggagcccaggaagugcuguguguauuucuggggguuggagaggugggggcacaguugccucacuccuuccuuuagacuucuuucaaaguaguuccugaaguuggccugaacgucagggauaauauguuuuuggaucuauggcauaugcacagugaaacuucaguccuacccugagcaaggauaaggaccauacacauaaggaaagaggcagcuuaggaacaaaaggccgugcuuagcaaacauuaucauugcugaaagagaugugugguccaccaggugguuaauauuugacccaggcaugcucaggggaaaggugaaugacuccuuguuugcccaugauuaguggccuugguuuacaagucgcugccaaaguaaagauccuuagauagguucuccccaccccgucacaugagcacuguauauuaccagccugugaggagccucuagcuucacaccgcaggacccugucuccaggagcacgcagcuggacacauucccagucggaggaaagcuggccagcuuugguaagauucuuccuuguggguguucaacucucugcuucuuuuccucugugcucuuucuagcaguucaucuauuuuagugaaacugacuaacaccccuuacgcuuucuggacucaaacuugcacauuaaaaagaaaacgaguaagaguuaaaauuuaaaaugaaaacaggauuauuuggugugguuuguaucugggaagcaauuaaugggauuucgaucaaggagauggagauauaggaggguuucuucaauugugauuaaaagcccccaaaggcuuaggaagccauuugcagaagggcaugugaucugucguguuuccuccauaacaagcuuggcuuggcaggaauaauaaggaaaaccccgagucuggugguggugguccacaccuuuaauuucagcacuggggugguagaggcaggcagaucucugaguucaaggccagucuggucuauaaagugaguuccaggacagccagggcuacccagagaaagccugucuccaaaaagaaaaaggaaagaaaagaaaagaaaaaaaaaaaaaaaaaaaaaaaaggaaaacccggaaucaggaaguacuuucagcaguauuuccuacucaauucuuuccuaaaaaaaaaaaagaaggaagaaaaaagaaaaaguuauggacgcuccuuaaaaacaaagaggaacaugaaccaagaucaaaagaugcuagguugaggggagaaaggaggaaagacaggaggaagaccaggcacaggguguucuaguccaguuggacuguuaugaagauacacaaaguagggagaguauaccuaggagaaggguguuuaucacauugccaccccagcugcagguaguuugcuacaugucuagucuacauagcacugccaacccggauuccugugagcacuaccugguuaagaauggguaaacugagucugcacaagaguuggaacuauuccacugcagaaauccgaaugacagucauuguuguguaugcgacuaagguucaguaccuuuggccauggcagauuuacaccugcacucucuaacaauaacacucucgcuuguuuucucacaauuauaccuugucuggcuuuggggggaguguuagaguuaaacacacagugagacaguuucaagggaguggacaguagacacuggugguugagguguucugcuggaaguugcucccuggguguuuuagagaaaccauuaugagagacugcauugggugaguugguaaaaauuaauguggaauuucugcaaauuagaagcaaguaaccccuuuccuggccacauaggccugagagcuuucaaagucuaaauagcaaguaucuuuuuaggaugaagaccccccuauguaguguucaugguacagagccuuggcuuacccagagauccuucagggaagauguguuucagugagacuggaccaaggucacccaucaccgauuucuuccaguugguaccuuguaucaucaacuaagguuauauaaauuugccgcugcaauuccaguguugcuagauuuggcuccugaaaccgguaaagaauccauuagcuuaguaagaaccauacacuuucaaagcuggaaccccucucauuuauggaugguaaagcauaggccuaaagagaaaaaggaaggaaacuaucagagagauauugagagccugcugugaagccagcauuaugauucaaguaaagaauacagaucccugucagcuguagauuauagagcagaaggaaguauggacagguauaugguuguuucccuaagaucacaugguguguuuggaaacagcagccaugaaacccaauagcugguaacuguuugcuauaugauagccuuagcauuaggauccuccacauuauugcuuuugcuuugguguccuaaauacccagagccuggcaacuuuaggcacucugagugagccuaccaguucccauuccccgcaaccuggguuuaaguauagguuggcaucuucacaagagccaacaguccugcuacugaauggcaacaucccuauccacugcugccaccugcugauccuuuugaguauuaccagcucuuguuauuuuguuuguuuagguuggagguagccaggcuagucccuaaaccugcccagguccuccuugccugcucugagauugcaggcaugcaugcagcaucacacccagaucuuccuccuuuuaaaagagaaaucacaucuagggaagagcaucccaagacaacauaaagagcucagcaacugggugucaugcagcccggcagcucuggugaagcaguugccacacggaaaugcugguaacucuuuagggguggcugugccuucugcacuugugcaccaucucuucucaauaaacgaaacacacacacacacacacacacacacacacacacacacacacacacacucacauuggauucuguuacagaucauaaucuucuaugcuuuauggaaguuuguuauuucagcgcugugaaaugaccgagaauuugguguucuuuauagccuuauucugagucugugguuaucaugaaacagaaaggaugggcuagugucagaugcuaauuagaagggcaguucacuucccacuccaucaccugacuuacacaugcucaguagagccuuagaccccugaccuccuagauuccaagcuauacuccugacucugcacuacugaccagauuauaggcugagggccaggaccucagccuucuacaaacagacacaugcacacgcacgcacgcgcgcgcgcgcgcacacacacacacacacaguaaaaguaaguauucagacuuacacaugagaaagacacaaaauaaaauuaaugguuaacuuaaugcagcugagaaacaaaaugcagggcaaaaacaaaauaaaacuuacuuggagcugauuuucuccuuaacuaacauuuccuuaggcuggcugaaagaugcaacauucccugcauuuauuuauuuacagacaaggucuccuguaucccaggcuguccuugauuuggcuauagagcccaagaugaccuugaacuuccaauucuucuggcuccaccucccuagaaccacauaaacugggugugguaguucuuaaggaagaucaagaguuugggcccagccugggcuacauagcaagacccugucucaaaguaaaacaaaacaaaaaaaaaucaaaacauaaaaguugauuucuccugcuaaguguaggggcacucauggucaucugauauggugggguucuguguggaggugcagguuuguguguuucucagaagccguguaccauguaccauguuuucugggaccugaaccucaccaauuacaaugcuggcugguagggauccucguguuucuaccuccacagcagcaggauuacaagugcuugucaucgagcccgacuuuuuacuuacuuggccauuucuucccuguggugaacuuuuuuaaguuuuauuuuuacuauuuuaaauuaaguguaugcaugugugucuguuucugugggcagauauguguaagagaauuccuggugcccacagaagccagaggcacuagauuccuuggagccugaguugcuaguggaugugagcagcuuagugugggugcugggaccggaacucaggcccucugaagaguaauauacacuuuuaacugcugagccaucucugcagccccaccaugagcaggguuuuuaugucucaggaugaucuuuuucuauuuucucaaagacuaaggauauuaucagaaauugcuuuauuaucuccuuauuaucucccaguucucaaauuuucaaauuuccuaagaaauaacaauuuaaaaguccauacgaaggucaaacuccagcagaagacaccuuugauccuaugcuggauguauguggugcaggguaaacugagaacucugggaggugaugguaggaaucuccucucuucuccucuucagaaagaucuuacagaaaaauuuaagucccuugccuucaugaagagaucucaguuuuguuuuguguuuuguuuuacaacacugucagaucauuugccuauguuagcaguauuacaaacaugggagacacuagaaaauauucucucagaucauccgaagagccucugaagaugaagcuugaguuccccauuuugcucucuaagagcuucuucuagacccacuucagguaccacacaacguguuccauucucccuaugcacugcauagcaacucugcccucugggagaaguagaccugcacccuucaucccaaggugaucucuacagcuuucaucauuaauguggaacugagcgacugccuggaguccccagccuuggggcaugggcuguccuguguucuugauccccacaagucauuggcucucagcuccuguguuaugauccaucuugccucaggaacccccaugccuccccaauggaugccacauuucuguucugugcuuuucugucuuucuuucuucuuccuugaccacccccuucucucaacccaaaaaacccaaagucuuguacauuauccagcuaggguggaacuucaggauucaagcaauccuucugucucuauuuccuaaguagcuggaccuuacugacacauacugcaccuguccuugguauauauauuaaaugucuuuaugcccuaggaucuagcacaguuucugggcccaauaggacuuggguaauguuuguuaucaaguuaaguaauaggugaauuaagaauauaaauagauucuguuauacuauggaugauggugaaccuaaggaauagagaaagauggcugcgccauggagucuguuaggaaggccaaggccaagauggaauuagguagcugaggacacuguuuuaucaugcucuuucagaaaggaaagucuccacccacuuagucuaaguuagaaagugguucuacagccgaccacuccugcuuuuuugcccuuggcaggaaucucuguuggaagagauggcgauaagcccaggcccguuguucuugaucuucgugcugggucugguugugaucccucccacucuggcucaggaugacuccagguacacaaaauuccugacucagcaccaugacgccaagccaaagggccgggacgacagauacugugaacguaugaugaagagaagaagccuaaccucacccugcaaagaugucaacaccuuuauccauggcaacaagagcaacaucaaggccaucuguggagcgaauggaagcccuuacagagaaaacuuaagaaugagcaagucucccuuccaggucaccacuugcaagcacacaggagggucuccccgaccuccaugccaguaccgagccucugcaggguucagacauguuguuauugccugugagaaugguuugccuguccacuucgaugagucguuuuucagucuauagucagcaggccccuggcacagaccuagcuauguuuucuuuuuaucuccccucauagcccagaacacugguuccaucguucauugucaggggccagaaaaacgaacuaucuaaaacauaugucuccugauuugcaaugcacagaaauaaagaugucucaaaagccauuaagagucagucuggaagaucacuaguucccaguaaauuuagcuuuuccuguuuucucuucuugcuguaucccaggggaaaggggcugggacacagagagauauucuuccuuaccugcuagucauggggaggguagauuucaucuuuuuauggugcuguggaugcuaaauugauuuacagacaggacagggaauuaaaaaagagccaaguugucuauuaaguaauaggucacuaaaggagcccuuuggaaaggaguuuaggaucaagagcacaccaagcacaccaaggguaucccccugccgucuccuccuguacggccugagaccgucagcacccaggggacagcugucauccucagcaaccuaaugcauccccuuaauguuuuuaaggaccucaacucuggccaaaccagauucauaguuucacacagaaaaaaaaaaucgauaccagccuucaugaagcagaguuggagacuuuuaucagugauaauucugacuugucuggguugucaacagaaagguugugagagaggcaguuagggagcgagacauacccaaguguagguauggacuccccaacagagaguaguacauaguuaccuucauauuggucauauguacaaugucucucaagccacaccuuaaaaggucgaaaggacaucccuccuuucuucuuucucucuguuuagaauauuacuuauuuuaugugcauuuuguuuuacuauauguguuuugucugcaugucugcaugggcaccacaugugugucuggugcccagggaggucagaagagguguuggguccccugaccuggaguuacagauggucauggugaaugcugggguccaaaccuagguccucuacaagaacagcaaguguccuaagugcugagccaccucacgaccccuuuuuaucuuuugaucccuaugugggaucauaugguggcucggggagugucuuggguggaauuauaauuugcaaagguagaaucaaguuccaccaggguugcauaagggguuuaguacacaucuuuuugaaaagaagguuucuucuucauucuugaaaagugcaagcuuacuccuggcaaagggugaaggccuuaagcaguugcucauuaugauagaauauuugcuugccagauugccaaguaagggguuucuuccucuucucagagccccuuaaaucccccccccuuuuuuucccauugagugucucccuuuuguucccauuagugcuuuccuuugauacgggcaauuaucacuuaucaaagcaugggcuugaaguagaauagaguaaacccuaagccauuucaguggcgugugugauccagagccgcaacuuugaaggcaagcacaguggauucuguauacaucaagccaucucagaaggagacugcucuuggacugugccuucagugauagaccauuauuuuggggugcccucuucucuuguaucaggaacaauguuuauuugcucaugucaaucaaccugcaagucagucugaggacuggccaccagauggcagcaccuccuagccauucugcaggaaaguaacuggccaugccuuuauuauccuguuuuguuuguuuaaauaauauauuuauuaauccuuuaagaauuucauacaguauauuugaucaucuucacuuuccucucucuauucuucccagaucugucccccacuaucccacccauuuaccuucaugaccucccuuuuuauuuuuuaaaacucauuguguccaaauacucuucugcccaaauacucuucugcccaaauacucuugggugugggguugccuucuggagcauggucaaccuacuggaagucacacacccuuaaagaaagcugacuuuuccucucuaagccacuaccacgaacugauagauucucaguuagcagugauacuucauggccaccucucuccuagaggcugggaucuuguccggauugagucuugugcaugcugucucaacagcugugaguguguaugugcacguacccuguugugcccagaaaacagucucacuguugucauccccugcuucccaccccaucucuccaaaagaucccugacugagccuugggccaacgccguguuaguuuuuaagagaggaguagaguuuccccagaagaugugauuuaguccacuagcacaggagaggagaggagaggagaggagaggagaggagaggagaggagaggagaggagaggagaggagaggaagagaagaagagaggagaggaagagaggagaggaaaggaagaggagaggagaggaagaggagaggaggaagaggaacuagacagaaguuuguucugccuuacuuuccuucauuuccguauguagagcuuucaacucaauaaguaaguuugcuuugaucggagucuaucuacacuuuugggaacugaaguuuccagaccaccaagcacucccuaaagaucauacuagcuaauuuucuuacaaaacccaaauuccaguuuuauguagauuuaucuuuccuuguuuuauacuccagucaggcaggccugggcaacugaccacccagucauguuuguucugacuuguucuguuagcuguacgccugucaauuaguaaagagaacaguguuugcuuucaaggaaggccauguugacaaacuagccacucucagagaaagggguacaaaagggaagagcaggaagaagggggagaucuuaagcagaaggaggggcaagagaggguucuaagaguuuaguuugcuuuucucauuaccucuccagagcccaguccuuaccauccuuucuccuuguuuucuucucaggcacuuucuagguaaugauggaucuacagaggacucaguccuugcuucugcucuuggugcugacccugcugggguuagggcuuguacagcccuccuauggccaggaucgaauguaccaacgguuccuucgacagcauguggacccucaggugacagguggcaaugacaacuacugcaacgugaugaugcagagacggaagaugacuucuguccagugcaaacgcuucaacaccuucauccacgaagacaucuggaacauucguggcaucugcaguaccaccaauauccugugcaagaacggccagaugaacugucacgaagguguagugaaggucacggacugcagagagacagggaacuccaaggcccccaacuguagauacagggcaagaaccagcacuaggcgaguugucauugccugugagggugacccagaggucccagugcacuuugacagauagaugcuguccugcagcuguuacagcugauaguugaccucugagucagugagaccaacaaugagugguggccccaggcuuuguuuccuuugcucgugccuuauacucacauauauccaauauaacccaugguguuaagcgcaucccauccaagggaagaaagaacccacugcucacagcacugauggcuugguucucccagauucuauccccuggaacuuaugcauuacauguauucagauaguaucucaacgauuauagagagccuuuucuguccaagcugucucauuccaguccucuaacaccccuugagaccaauucugccacuguauuuagaagcuuugaguuaaaggauuugacgaccacaaaaaaccaaaaccaaaaccaaaaacaaaaacccaguggaagaucucagacaaaaauccaacuggacgggcuacucacaaaagguguuacccacuucguuauauauacuuucuguuauuccaaaaugucaucauuagggaagccacuaagaguuuggaaauaggggcuggagagaugccucugugguuaagagcauuggcugcuccucuagaggacccagguucaauucccagcgcccacacaucagcucacaacugucuguaacccaguucuaggugauuugauacccucacacagacauacauguagacagaucaccaaugcauauaaaauuaaaauaaagauuuuggaaacaacauauugccaaaaugagaauuacuugguauuauuuuggucuguggcuucuaagauuuuuuaaaauacaugaaaaauguaguaaaucacuaaaauucauuuauccuucuccuuugaaagauuuucaauauuuuaguauaauaaagagcuguauguugagccaucugu

SEQ ID NO: 7433 - RNA, 9007 nt, Mus musculus
uggcucccguggucacacucugugcagcuuuuauaccccacaagccaucccaggugcuuucagaggaacaaggaaaggcaagcaaggggcaggguacaggcgcauucagacccggauuaacaaugcuguucaguuuccucuauaguuuauugucacagcagaaguugugugagacaggaggucacgcucuacacgucacaguauggucagagccugagguagcucuucccacccugaugccaagccccaagcagucggaccuaagcucuuucccuuagucccacuuuaggugcacgcugacagcuauccaaguuaguguggccaaaggacccgggccccucccuucuaccccagcuucaauguguuuaccacuguucuucacgggccaccaucucccauccuuucuuuuuacaugcuggauauuucuaucacauuaaggaucacugacccaccagcaaaccuucuccugauaaacauucauuugggacuauugccuucagagaggccugacacaucaaggcaaagccacugucagcuuuggggaaggagcuccccaucucucaccaucaacccuacacacacacacacacacacacaacacacacacacucucucuccuacccuugcaaauaugggcuaaagagggggagugauggaggccccgugucagcuagaacagcucauuguuccucaucuauagaaccuaggucagggagagaacauacaagccuucucaacaccaaaauggaagaggggguaauuuagggggcccagaucucuaagagauauuaggacaccucaccuaggagcuagaggauaucacagguuaaaggucaagguuaggguagcaauuaaagaucaaggucaucucccugcacaaucugcccauuuuccuugcuuacucuggcccagugcccugauaacaccucuuaaauuaguguugcaggaggugagggcugggauccacaccaaggcaaugagggucauucaacaggagacuuccauggugugcccuggggguccagaagggagagucccagacucgcuacucugcgacagggugcgggaucgggaccgacugccaucgauggaugcugcacuggucagagaugcugugcgagaccgagauaggcgagucaugcaggaagaggccacuguagacacacaaugauaagcaagccaucagagaugaguggggaagacagcugguaacuucuaguggggccuaggugaagacaagagcugcggccagagaaucagcgagcuugccuuguaagaugaugaguccaagaauuagccuaaaacaggucuacccucacagugggaagcccuuccuaauacccucugucccaauacucacuguagcccaugccuugcaggaaguacuugaaagccucugucagcuugccgggcugugggcauauuacaaggaaagagaagagagagaaagagaugguuagauaucuugaaagucacagcaauggcaaagggcacaacacgucccauuuccucgucccaagaugggcacuauacucaccugagucagcuguggcugaccuccagagucggccaucugcucaggaaggaaacacccagggaagaaggauacauggagauaucagacgauccaugccgcgggaaaggggcucucuccucccaggucccucacucagccccuuuguucuccucucccuugacccacaaugaacccacagggcuuagacacuggaauuuagaguauguaugcuccuggacuggggagcggggagcaagugaggcuuaggaggcccgcuaaccuugaggaacgaggucugugugggguccagcuuugaguuacauuccaccuggaauagguaggagacugaaugaaucaggucgcccucuccacagcccuccaagggaccccgaucuuuucccuuucgucagccccuacccaauuacaucuuaacccaagucaaauuccuaagguccuagaguugcuccuccugccccagaguuuucgaguuugcagcuuggcaagguccacagcuugggugaacccaguguugacaagaccccaacauucccucacuaccccaaaagccaccacugaccacggcaucuucaugaggugcuuggucuccaaccaccagcaucacagggcaccuaggggcacggggucagggagaagacagugagccuuguacucucucaccgacacuucccagaaaagcagcuaaacaagugucugccuccgaggaggaggaggaaccaguugccuuucuccugcugacucagcaggaggaucgagagggaagccccaaaggaagacagcuuguuacacagaauggaaucagggagacugguaacuucuccacaaagguuaagagauguugguaccaaggggcagggcagagacaggacaaagccacaugcaucuaccaaugucuuacuugagggucgucucaccaccucgcucaaaguucaggucucggcggcugcaggggguucaaagagaaguuguuuuugacaggcacugcugucuaccuagauaagcuaccuccuccacaggaagcuaucucccuuauuuauagucagcagcuacuggugauuaagagaaaaauaccaagggcugggguuacaacuuggugguggacuaccugcuuagugagcagcuaugagguuugaucuccaaagcgguuaaaaagggaggaggggacaccauaaaaauggcaggcacgguccaagagcacaccaccuguaaucacuugugcccuagaucucaggucagaggcagcuaagugacaggaagggcccaagaaugagagcugcccuuacuccuguccugaagcugaggagcucgcccugccugcagugcacacugcuuacaacccucucucugcuuccgguucuccacaugcacacaacccacucacuuguuguagcuauuccaguagaguucaauguucuccagguugggugcguguuggaugauaccucuguacuuuuguaucaauucagaauuuccagaaagcucuuccuaaagcacagaagagaugaaucaggauuggaaagaggagccggccaugaggggaacuaucuaacacuucagauccugugccaacuaaggaagucaccccgaagcauucaacuccccgcuggucaccucuacuucuccugccucuuacaaccauuuaccuggcugaaaagauguccaagaaucauguccggaauggaagacguaaggccaguuaacuacaaggacaggcgaacaaauucaggauauuguggagaaagagacccaggcgaaacaacccaacuucauuuuugugcccuacuaugcccucucugaagguccagaucuauucaguuacacugguaguaucauccaaggagaguccccacccuagauaucagcacacacagcccugcaaaccuugugggcugcccaguccauccagcccuuggcauugggaucaauguugaugagaacaagaccuucaacuguguccgggugguucagcuaagggauaacagaaaggagcucagaaaaggccacaccuuuguccccgccucccugagucccaccuauccccccagauuccuauauggccuacucucuacccugcucccuaucugcuuccagaauccuggaauggcaggaacucggaccauuccugcaauauucuaucuaacgugggggggcccaccauucccucaucuagcaguuuuugcuccuuacagcauaucgcgacagaauguaggcuccggcuccaacaccaacuccaauuauuguagagaaacuguaaaaaguaaacgugugugucacaggcucuagcagccaaaaaguugucacggcccaaucucuucaaacucaucauccuuccugaggucacagccacagaagaggacagcaaaggacuuuccuuuggggguguaaaaaaggcaccaagcaugccugguacuugguguagaugccugaagucuagccucggcuaucucuuggagaacugguguguggaagacaucucuuccuacacacagaguuuaucaauucucggcucucugaaacgaguuuaacuuguucugagaccugguucuacagaggaacuggaauuauggaccuuaaagcaacguaugaaacaggugugcuauuagucauuugggagaauggaggaggcaagaaaggaagaaaaccagaguugcugagauccauggugcccaggaaagcuaaacccaggaaacaggggauggcaagauggcucagcagucaagagcaccugcuucuuucacagaggaccuaggugggauucccaacaccuccuugguggcucucagccaucuauuaugcaaguuccagagguugcaaugcccucuucuggccccuauagucaccagacauauguguggugcccauacaugcacgcagcagucaucaaauaaaaauaaauaaaucugagaaagagaaaacgcccaagaaucagcauuucccuucgcaugccagagguccuuguggggcuuauuuuucuucucccacugucuaacacaccugucuucugguauaccaaaugugaucccgggagacaggaauggggaccgagacaggucugucuaguuccucagggaugaggucacacguaccuccucuugccuaacuuccagaucagagaagcuuccccuaagccugagacggggccaagaacaaacccuuuccuucucuuucucccuaucaguaguaagauuccucugaucauucguuccagacaagaguccaagcccacugcccuuccuaacaauccaggugaaaaagccauagaaggggaagauagacugagaccaaaaucagaccaggaaccauggugaccacacucugggggcucccugaugcugaaagggaaaguuugaaggacuccugaagccucucacuuuagguacugcaggaugcaaggaaucaugucagcaagcugguccagagauggguacugauaucuggaaaagaggaaaauacuaguuaccagucuguauucauauaccucuucucuggagcaaccuccgcauccucugccagagucuucuacgccuccugguucacugcacuugugcacuaccuugcucacacacaagccccaacacacacaccaacauacacacacaccccugcuuaguaaggaacucauucuuaccccagaggaaacacaggcgcccccucuuccaugccaggggcauccacaugaacccgcacgaaguucuguaugaucucuugcauauccccgaaccgaaacaguggcuggaagcaagacuuaucuaaagagaacccacauuccccacccaaccacaaaaucagaaggaaaaagcauccgcucgucagaacccacccucuugcucugaugccaccacacuagaggagaaucucucucugaugugccaccacugggcucccggucugaccauacugacuaugccccucucccccaaacacacacacauugggcuuucuccucccauggcucuucccagaaagaggcaggagaagaaaugaaggucuuacaguugaggccuacaucaugguaggugaauaucgccgggcguuuggguuugggggugccauacacaguaaaagugaccgagccauaaggugucuccacagagugagucuguaagaaaagagcuuaccaucaggggagaaauauacugagaguucuucaaagagggaaaggcaaaaauaagugaaccaucuguugaaaacaggauuaaugggucuuuagggaaauaugacgguggaauuggaucugaggguagaaaaaucaugaaagaccagagauuaaggaauucaaauagaaaaaaggagggaagagaggauaaaugggagggaugcagagggccagauuggggcccucucaguugggggacagaagagcuucuccucccacccuagcacagccccccaugguuaccugucccugguccaggaggaugcgggcagcuaacucggccuccuggagagacacgacacacagacacacacagacacacacggacagagacagacagcaaauggagagacggacacaaaaagguagguaaagagagaccaacagacaccaaauacagaaagagggacaaaaaacaagacaggagaggaugaagguuaguguagugacgggacgaggucuggcgggcucccuuguacagugucuaggccgagagaugggaggagauggguggagaggggcgugcauuagaaugagagccacgggccuggggagguggggaggcaaggggggauguucagagcaugggaccgaggcagggaagucagagagucucuguaaaccuuggcagucucggguguuuguccuggcaacagcggcuucuccucggugaucugcaccuccugaaguucugccaugguggccuggcaggauacaaaaacaguaaaccagucaggcagugguggcgcacaccuuugaucccaauacuaaggaggcagaggcaggcggaucucuugaauuugaggccagccuggucuacagagagagcugcaggacagccagggcuacacagagaaacccugucucaaaaacaacaaaacaaaacaauaagcccuggagggaggcagcuuagccucuguacucucaguccaaugcaaugcaaugcaaggugcagagcaacaccagagcugaaaacgccaagacacacggagagcuuuucuggcucccccgccccacuuccagggcaauaccaaacaggacagcacaucucuucagaccaccggccccauggcugccggcugccccucaaccccaacauucucaccucguaccucacaaugcuccucccucuccgccccuggagggagacaccgaggcuggggaagcaauguggcuccaguuucuuaagcuaucuuuaggggacgccccacacuaccucacugacugggcuagagugguaaggguucacaacugaccaugaccuucaacuauagcuccaaugucagcaucuugaggggcuaaaaaggacugaggcagugacuaucaagcacucaacagagggaccuagauauccaauccaaucaaucucucucucucucucucucucucucucucucucucucucucucucucucucucucucucucucucuuguacacaaaugagcgcacaccaacaaugguagaucuagagagcagcagagcaccugugcagacuugaaaaaaaaaaaagaagaagaaaaagaaaaagaaaaagaaaagaaaagaaagcaagccagcagcaugggguggguggggucaauuuacugagcuccuauugguuggauacggugagcguggaggucaggguucuuaguccugacucuagggucugagaaaacacaggaacaaggugaaugacaugggagacggaccugggucuuuuagggacauaaggccagagccaagacccaggauuccagggucacuaacccuuucuaaucuccccugaguccagagaacacguccucucuagguuccaaucaauacaagcuggaggggccugcgaggcaaaacaagcagguccaggcuggguagucuaugaagagagcagagagcugacauggcgauagagcaugacugugucaaaaccucuggguccuacccaagugccacuauuaggugaccuuguccaguuagucacuacucgguuuugacgguucucaguugauauguagguaguacagcaugaccuuuuccuucaccauuuaaaaacaaacaagcuucaagccuucaucucuccccuccacccaguguaauuguaggucggguggagaaaggagagggggggauagggcugcccguaaccuccgcacuuccccggacugccagccaugugccagccgggaaaagaugguuaggacuugacuggcugcucccagaacacgaaaccugaccccuaugagcuucucgcugccguuccucguccgaaccaacacccucucacggcgggcacguagugcccaggacccuguacaucaucucaagagcgccccaaacacgcccugcacuuugcagcucuucugccuuugugcgcagcagcggagcuccucgcucagccagccccuucccccgaacuacagccaggagaccagaaccacgaugcccacccuccgggcccgcgccuugccagcccagaggcgcgcuugccccucccccuaccugcugcagccgccgcggucgcugccaccuucacuugccuuugacuuagguccgcccuagcucuggcuccccacagacccgcccugggcccgcccccgggccaucucccugcagauccgccccgaccccccauaaacacgccccguaacucgccugggcuaccaggggaggggcgagagggugcggcuugggagcacacagaggugaugcucauaggcucucugagugcuccccauaaacccuaagccgugugaaguggggugagcgugggggaucccuuaaacccccaaaugguccccacgcccacaucaacggcgccccuacugugaccuggcucugccaggcucacuuuuggcucucuuccuagccccccagauugaguggcagcgacggguaaaguggggagaccaacccaaggugccuacgucccacgauuucagcuccgcccgcccggaaacagagagcuagaucaaggaagggggaggugggcgagggccaccgcucagacccggucucggggcagguauggguaguggugacagcgugucuggagacggggcgucgagggcauaggaauucccaacaauuggggugcugguaccuccucagccgagucccgccgcuugcucuccgacugcuccgugagaaguuggacaacaagcagggaguuggggggggggggggccgggaaaugcugggggccgcuauaaauagaggaugaacgaaggaggggaaagaugauggccaacagcgacucccgggucaaggccccaacgaggggggcggguagaggaggggcuggggaccccccaagggcucugacuccuguguaaacag

SEQ ID NO: 7434 - RNA, 9007 nt, Mus musculus
cuguuuacacaggagucagagcccuugggggguccccagccccuccucuacccgccccccucguuggggccuugacccgggagucgcuguuggccaucaucuuuccccuccuucguucauccucuauuuauagcggcccccagcauuucccggccccccccccccccaacucccugcuuguuguccaacuucucacggagcagucggagagcaagcggcgggacucggcugaggagguaccagcaccccaauuguugggaauuccuaugcccucgacgccccgucuccagacacgcugucaccacuacccauaccugccccgagaccgggucugagcgguggcccucgcccaccucccccuuccuugaucuagcucucuguuuccgggcgggcggagcugaaaucgugggacguaggcaccuuggguuggucuccccacuuuacccgucgcugccacucaaucuggggggcuaggaagagagccaaaagugagccuggcagagccaggucacaguaggggcgccguugaugugggcguggggaccauuuggggguuuaagggaucccccacgcucaccccacuucacacggcuuaggguuuauggggagcacucagagagccuaugagcaucaccucugugugcucccaagccgcacccucucgccccuccccugguagcccaggcgaguuacggggcguguuuauggggggucggggcggaucugcagggagauggcccgggggcgggcccagggcgggucuguggggagccagagcuagggcggaccuaagucaaaggcaagugaagguggcagcgaccgcggcggcugcagcagguagggggaggggcaagcgcgccucugggcuggcaaggcgcgggcccggagggugggcaucgugguucuggucuccuggcuguaguucgggggaaggggcuggcugagcgaggagcuccgcugcugcgcacaaaggcagaagagcugcaaagugcagggcguguuuggggcgcucuugagaugauguacaggguccugggcacuacgugcccgccgugagaggguguugguucggacgaggaacggcagcgagaagcucauaggggucagguuucguguucugggagcagccagucaaguccuaaccaucuuuucccggcuggcacauggcuggcaguccggggaagugcggagguuacgggcagcccuaucccccccucuccuuucuccacccgaccuacaauuacacuggguggaggggagagaugaaggcuugaagcuuguuuguuuuuaaauggugaaggaaaaggucaugcuguacuaccuacauaucaacugagaaccgucaaaaccgaguagugacuaacuggacaaggucaccuaauaguggcacuuggguaggacccagagguuuugacacagucaugcucuaucgccaugucagcucucugcucucuucauagacuacccagccuggaccugcuuguuuugccucgcaggccccuccagcuuguauugauuggaaccuagagaggacguguucucuggacucaggggagauuagaaaggguuagugacccuggaauccugggucuuggcucuggccuuaugucccuaaaagacccagguccgucucccaugucauucaccuuguuccuguguuuucucagacccuagagucaggacuaagaacccugaccuccacgcucaccguauccaaccaauaggagcucaguaaauugaccccacccaccccaugcugcuggcuugcuuucuuuucuuuucuuuuucuuuuucuuuuucuucuucuuuuuuuuuuuucaagucugcacaggugcucugcugcucucuagaucuaccauuguuggugugcgcucauuuguguacaagagagagagagagagagagagagagagagagagagagagagagagagagagagagagagagagagauugauuggauuggauaucuaggucccucuguugagugcuugauagucacugccucaguccuuuuuagccccucaagaugcugacauuggagcuauaguugaaggucauggucaguugugaacccuuaccacucuagcccagucagugagguaguguggggcguccccuaaagauagcuuaagaaacuggagccacauugcuuccccagccucggugucucccuccaggggcggagagggaggagcauugugagguacgaggugagaauguugggguugaggggcagccggcagccauggggccgguggucugaagagaugugcuguccuguuugguauugcccuggaaguggggcgggggagccagaaaagcucuccgugugucuuggcguuuucagcucugguguugcucugcaccuugcauugcauugcauuggacugagaguacagaggcuaagcugccucccuccagggcuuauuguuuuguuuuguuguuuuugagacaggguuucucuguguagcccuggcuguccugcagcucucucuguagaccaggcuggccucaaauucaagagauccgccugccucugccuccuuaguauugggaucaaaggugugcgccaccacugccugacugguuuacuguuuuuguauccugccaggccaccauggcagaacuucaggaggugcagaucaccgaggagaagccgcuguugccaggacaaacacccgagacugccaagguuuacagagacucucugacuucccugccucggucccaugcucugaacauccccccuugccuccccaccuccccaggcccguggcucucauucuaaugcacgccccucuccacccaucuccucccaucucucggccuagacacuguacaagggagcccgccagaccucgucccgucacuacacuaaccuucauccucuccugucuuguuuuuugucccucuuucuguauuuggugucuguuggucucucuuuaccuaccuuuuuguguccgucucuccauuugcugucugucucuguccgugugugucugugugugucugugugucgugucucuccaggaggccgaguuagcugcccgcauccuccuggaccagggacagguaaccauggggggcugugcuagggugggaggagaagcucuucugucccccaacugagagggccccaaucuggcccucugcaucccucccauuuauccucucuucccuccuuuuuucuauuugaauuccuuaaucucuggucuuucaugauuuuucuacccucagauccaauuccaccgucauauuucccuaaagacccauuaauccuguuuucaacagaugguucacuuauuuuugccuuucccucuuugaagaacucucaguauauuucuccccugaugguaagcucuuuucuuacagacucacucuguggagacaccuuauggcucggucacuuuuacuguguauggcacccccaaacccaaacgcccggcgauauucaccuaccaugauguaggccucaacuguaagaccuucauuucuucuccugccucuuucugggaagagccaugggaggagaaagcccaauguguguguguuugggggagaggggcauagucaguauggucagaccgggagcccagugguggcacaucagagagagauucuccucuagugugguggcaucagagcaagaggguggguucugacgagcggaugcuuuuuccuucugauuuugugguuggguggggaauguggguucucuuuagauaagucuugcuuccagccacuguuucgguucggggauaugcaagagaucauacagaacuucgugcggguucauguggaugccccuggcauggaagagggggcgccuguguuuccucugggguaagaaugaguuccuuacuaagcagggguguguguguauguugguguguguguuggggcuugugugugagcaagguagugcacaagugcagugaaccaggaggcguagaagacucuggcagaggaugcggagguugcuccagagaagagguauaugaauacagacugguaacuaguauuuuccucuuuuccagauaucaguacccaucucuggaccagcuugcugacaugauuccuugcauccugcaguaccuaaagugagaggcuucaggaguccuucaaacuuucccuuucagcaucagggagcccccagaguguggucaccaugguuccuggucugauuuuggucucagucuaucuuccccuucuauggcuuuuucaccuggauuguuaggaagggcagugggcuuggacucuugucuggaacgaaugaucagaggaaucuuacuacugauagggagaaagagaaggaaaggguuuguucuuggccccgucucaggcuuaggggaagcuucucugaucuggaaguuaggcaagaggagguacgugugaccucaucccugaggaacuagacagaccugucucgguccccauuccugucucccgggaucacauuugguauaccagaagacagguguguuagacagugggagaagaaaaauaagccccacaaggaccucuggcaugcgaagggaaaugcugauucuugggcguuuucucuuucucagauuuauuuauuuuuauuugaugacugcugcgugcauguaugggcaccacacauaugucuggugacuauaggggccagaagagggcauugcaaccucuggaacuugcauaauagauggcugagagccaccaaggagguguugggaaucccaccuagguccucugugaaagaagcaggugcucuugacugcugagccaucuugccauccccuguuuccuggguuuagcuuuccugggcaccauggaucucagcaacucugguuuucuuccuuucuugccuccuccauucucccaaaugacuaauagcacaccuguuucauacguugcuuuaagguccauaauuccaguuccucuguagaaccaggucucagaacaaguuaaacucguuucagagagccgagaauugauaaacucuguguguaggaagagaugucuuccacacaccaguucuccaagagauagccgaggcuagacuucaggcaucuacaccaaguaccaggcaugcuuggugccuuuuuuacacccccaaaggaaaguccuuugcuguccucuucuguggcugugaccucaggaaggaugaugaguuugaagagauugggccgugacaacuuuuuggcugcuagagccugugacacacacguuuacuuuuuacaguuucucuacaauaauuggaguugguguuggagccggagccuacauucugucgcgauaugcuguaaggagcaaaaacugcuagaugagggaauggugggcccccccacguuagauagaauauugcaggaaugguccgaguuccugccauuccaggauucuggaagcagauagggagcaggguagagaguaggccauauaggaaucuggggggauaggugggacucagggaggcggggacaaagguguggccuuuucugagcuccuuucuguuaucccuuagcugaaccacccggacacaguugaaggucuuguucucaucaacauugaucccaaugccaagggcuggauggacugggcagcccacaagguuugcagggcugugugugcugauaucuaggguggggacucuccuuggaugauacuaccaguguaacugaauagaucuggaccuucagagagggcauaguagggcacaaaaaugaaguuggguuguuucgccugggucucuuucuccacaauauccugaauuuguucgccuguccuuguaguuaacuggccuuacgucuuccauuccggacaugauucuuggacaucuuuucagccagguaaaugguuguaagaggcaggagaaguagaggugaccagcggggaguugaaugcuucggggugacuuccuuaguuggcacaggaucugaaguguuagauaguuccccucauggccggcuccucuuuccaauccugauucaucucuucugugcuuuaggaagagcuuucuggaaauucugaauugauacaaaaguacagagguaucauccaacacgcacccaaccuggagaacauugaacucuacuggaauagcuacaacaagugaguggguugugugcauguggagaaccggaagcagagagaggguuguaagcagugugcacugcaggcagggcgagcuccucagcuucaggacaggaguaagggcagcucucauucuugggcccuuccugucacuuagcugccucugaccugagaucuagggcacaagugauuacagguggugugcucuuggaccgugccugccauuuuuaugguguccccuccucccuuuuuaaccgcuuuggagaucaaaccucauagcugcucacuaagcagguaguccaccaccaaguuguaaccccagcccuugguauuuuucucuuaaucaccaguagcugcugacuauaaauaagggagauagcuuccuguggaggagguagcuuaucuagguagacagcagugccugucaaaaacaacuucucuuugaacccccugcagccgccgagaccugaacuuugagcgagguggugagacgacccucaaguaagacauugguagaugcauguggcuuuguccugucucugcccugccccuugguaccaacaucucuuaaccuuuguggagaaguuaccagucucccugauuccauucuguguaacaagcugucuuccuuuggggcuucccucucgauccuccugcugagucagcaggagaaaggcaacugguuccuccuccuccucggaggcagacacuuguuuagcugcuuuucugggaagugucggugagagaguacaaggcucacugucuucucccugaccccgugccccuaggugcccugugaugcuggugguuggagaccaagcaccucaugaagaugccguggucagugguggcuuuugggguagugagggaauguuggggucuugucaacacuggguucacccaagcuguggaccuugccaagcugcaaacucgaaaacucuggggcaggaggagcaacucuaggaccuuaggaauuugacuuggguuaagauguaauuggguaggggcugacgaaagggaaaagaucggggucccuuggagggcuguggagagggcgaccugauucauucagucuccuaccuauuccagguggaauguaacucaaagcuggaccccacacagaccucguuccucaagguuagcgggccuccuaagccucacuugcuccccgcuccccaguccaggagcauacauacucuaaauuccagugucuaagcccuguggguucauugugggucaagggagaggagaacaaaggggcugagugagggaccugggaggagagagccccuuucccgcggcauggaucgucugauaucuccauguauccuucuucccuggguguuuccuuccugagcagauggccgacucuggaggucagccacagcugacucaggugaguauagugcccaucuugggacgaggaaaugggacguguugugcccuuugccauugcugugacuuucaagauaucuaaccaucucuuucucucucuucucuuuccuuguaauaugcccacagcccggcaagcugacagaggcuuucaaguacuuccugcaaggcaugggcuacagugaguauugggacagaggguauuaggaagggcuucccacugugaggguagaccuguuuuaggcuaauucuuggacucaucaucuuacaaggcaagcucgcugauucucuggccgcagcucuugucuucaccuaggccccacuagaaguuaccagcugucuuccccacucaucucugauggcuugcuuaucauugugugucuacaguggccucuuccugcaugacucgccuaucucggucucgcacagcaucucugaccagugcagcauccaucgauggcagucggucccgaucccgcacccugucgcagaguagcgagucugggacucucccuucuggacccccagggcacaccauggaagucuccuguugaaugacccucauugccuugguguggaucccagcccucaccuccugcaacacuaauuuaagagguguuaucagggcacugggccagaguaagcaaggaaaaugggcagauugugcagggagaugaccuugaucuuuaauugcuacccuaaccuugaccuuuaaccugugauauccucuagcuccuaggugagguguccuaauaucucuuagagaucugggcccccuaaauuacccccucuuccauuuugguguugagaaggcuuguauguucucucccugaccuagguucuauagaugaggaacaaugagcuguucuagcugacacggggccuccaucacucccccucuuuagcccauauuugcaaggguaggagagagaguguguguguguuguguguguguguguguguguguaggguugauggugagagauggggagcuccuuccccaaagcugacaguggcuuugccuugaugugucaggccucucugaaggcaauagucccaaaugaauguuuaucaggagaagguuugcuggugggucagugauccuuaaugugauagaaauauccagcauguaaaaagaaaggaugggagaugguggcccgugaagaacagugguaaacacauugaagcugggguagaagggaggggcccggguccuuuggccacacuaacuuggauagcugucagcgugcaccuaaagugggacuaagggaaagagcuuagguccgacugcuuggggcuuggcaucagggugggaagagcuaccucaggcucugaccauacugugacguguagagcgugaccuccugucucacacaacuucugcugugacaauaaacuauagaggaaacugaacagcauuguuaauccgggucugaaugcgccuguacccugccccuugcuugccuuuccuuguuccucugaaagcaccugggauggcuugugggguauaaaagcugcacagagugugaccacgggagcca

SEQ ID NO: 7435 - RNA, 525 nt, Mus musculus
acacacacacacucucucuccuacccuugcaaauaugggcuaaagagggggagugauggaggccccgugucagcuagaacagcucauuguuccucaucuauagaaccuaggucagggagagaacauacaagccuucucaacaccaaaauggaagaggggguaauuuagggggcccagaucucuaagagauauuaggacaccucaccuaggagcuagaggauaucacagguuaaaggucaagguuaggguagcaauuaaagaucaaggucaucucccugcacaaucugcccauuuuccuugcuuacucuggcccagugcccugauaacaccucuuaaauuaguguugcaggaggugagggcugggauccacaccaaggcaaugagggucauucaacaggagacuuccauggugugcccuggggguccagaagggagagucccagacucgcuacucugcgacagggugcgggaucgggaccgacugccaucgauggaugcugcacuggucagagaugcugugcgaga

SEQ ID NO: 7436 - RNA, 525 nt, Mus musculus
ucucgcacagcaucucugaccagugcagcauccaucgauggcagucggucccgaucccgcacccugucgcagaguagcgagucugggacucucccuucuggacccccagggcacaccauggaagucuccuguugaaugacccucauugccuugguguggaucccagcccucaccuccugcaacacuaauuuaagagguguuaucagggcacugggccagaguaagcaaggaaaaugggcagauugugcagggagaugaccuugaucuuuaauugcuacccuaaccuugaccuuuaaccugugauauccucuagcuccuaggugagguguccuaauaucucuuagagaucugggcccccuaaauuacccccucuuccauuuugguguugagaaggcuuguauguucucucccugaccuagguucuauagaugaggaacaaugagcuguucuagcugacacggggccuccaucacucccccucuuuagcccauauuugcaaggguaggagagagagugugugugugu

SEQ ID NO: 7437 - RNA, 616 nt, Mus musculus
gggccuucguguggcauguagaggccuguaguaggugggacuaguuugagaacuaagucccuaguagagaccaaugauaccuauaggcucagcaucaugcuugcgggagcagagcaaguacagccuuugguuggucagggugcuguuauagcuacagcugguuggugccuguugaugaaccagggugcagauugugacggggaaggaguucugagugagggugcaguacucguuguaguuuucacagaagcucucgcuguauuuacagaacuucuggaugucuuccaagggggcguggaccacauaguggaucuuagggcaguaccaguccugcaguuugccucucacguaggccaugaggccauuacaguauccguggaaucccuuuggguaguuaaccaugggguagucaacauguaagguucggaaguucuugauggccgucugaauugugaugccugucaccagaguuggccggaagacaagcgggaggacaaggagccaggccacaucuggugccaugccuucugcuggcaggguuaaaguaauuagaggcacauugggcuaacgagaccugcccacgcuucccagagucuccggucuucuccagcuuccc

SEQ ID NO: 7438 - RNA, 6253 nt, Mus musculus
ugccuucuuagacaauuuauuuuccaccucucaagggccucaucauuuuagaggucuugugcaugacucuauuuucgccauaugauucaguaagauaagcagaagaagcaugguguaauggccaugcaaaugaaguguaguucagacagaucuuaugcgcucaagcaacagagccagaaucuaggucuccugacgccuggucuuguuuuucucccacuaagaauuucacacggaagcucacugaacuaaacaaggagaaauaggcaugguugcuaguagacaaaucccaacugcggagccauucaagcuucaccacaaauuuccaaccuuuuccuuaaauuguuugcucccccucauauucuauaguaucuuccccaggaaacugagugaggcuuuacgacuuaauuuggccaaccaauugugauggaaguuaacauguauccauuuggcgagcagcacugcagaauucauaaacaauucuucacacuuaguucacgauguagugggggaggcaaacuuauggugacacaguagggucuucauacaguaaggcucagucaagcauggugaguggcacgugccuuuaacuccagcacuuacaggcauguggaucaaggucuacauggcaaguuccaggcaggcaaagauacaugugagacccugccuuuuagaaaagaaaagaaaagaaaagaaaagaaaagaaaagaaaagaaaaggaaagaaaagaaaaggaaaaaaaauugagccuccagcaucuuaggaucuuaauaauuuacaaugaacaaaggcccuugucgguuauucuggacacaaaguaaugagaaauaaaaccagagguuuuggcccugaguguucagcauuguuaagagacccauuuauacgguccuugaguuucucuuaagaugcagaaugcaauauccagguuuccgauuaccgcgguaaaagcuggaagacagcuaauugcuguuuucucuuuauaguuucuuuggccacuacguccugacuuugaagaaaaauauucuuuucucagagcccuucacuaucccugcaguuugauugggggaagagaaaacauggaggaggcccggauugcguucucuccauuccagagccugaucccagaucugucuccacccacuaauacucacacguaacuuugucauagggcgacuauuaccacucccaaggugucacaaacagaaaggaucugcagcuggcgccacugcaaugucaaggcaagccagccaggcugcgcucuagccucacugguaccugggcuugccugagcccggagaagcagcauucucuagggaaaagaagccuucucaagugggaacaaaaaugaaugugaggcgaacacccaucccgggcacuaugugaauuuggggugaguucucuuaggccuagucaaucucuacuuuuuagcagcuacuaagcuguccccccucuccccggugcuauugggauccaccguuuuccugggcuuucuccgcucccccaaaccaaccgagucuaucaucuuuguacacuugcagaggucauaaguggugugggcacaguacaaaaagagcuucagcgaccguaccgcugcagggaucaaaggcccgccgggggcggccgaaaggcugagccugcgcaguccugcucccgccuuggaaaggguggcggccacgcgggcucgguccaccagcgugcucgcuagaggcgggaaagucuuaggucgguacccccgccugcccagccagccuguccucuccagcucccggcccgggggggagggggcgaggagggccggcgccucugacucaucaucuccaacccccuucucgcgcgcgcuccaagucucaggacuuugaaccugggcacucgcgcgaggggcgcggcggcagcaccaggggaagcgcggcuuggcccggcgccgacccccagccuuugucaguaccggcagcugcgggcacgagggcuagagacccgcagccgguggcggugaccuggccgcgguggcggcgccucugugcgcgacggcccucccggcgccuccccgcacgcggggccaguggucgcguccgaggaaaacucggcuaggccuugcucccagcgccuggcgucacucagcagaugcacagcgcccccgccgccgagggaaggcucuuuauuuugcaguaggucacgggguagcggggcauccugggauuuguagucucgggugaauuaggcaggacccggauccaagggagaccuggagcacaaccgacgcggauucuggguuggcuggugcagcaacccggcuuggaguggaugggauugugaaaggugaacagugagaggaggcagaugugaaaugaagcuggauggagaggcagggaggaagaagucgaagaaugcaagggaggaagcugcuugacgaggcgugaggugagggaggucucuaguccagaaauuaucucccucuaguggggaagagaagagaaaugggccuggguugaggggaaauugagggcacucugggcuucaggcacauucugggggaaguccaguuauaguccaagggaggugcaagacgcagaagugccuggagaugucccccuuggcguagggggacaguggcaccugucuugcccacucacucauccguccuauuuccugugcuagccaccacgggaccauucuccaaaccagaaaccuccuccaucucagagaggcccugaaaacagaugcgagcaaauuuuggggucaaccaaggggaaaccccggguagaagcaacccccuuccaguuuuuccagucuuuccaauaguacauuauggcagcuuccuaacguuuaugcacgcguguagcuccagucauuaaauacccaauucuuucacaaacaucauuagggaacuaacguccaaugccagaaagccaaucaguuucagcccuucacuucccuacggcccuacuaugugcucuuaagccuacagacaaggacagccagauuaaaaguuagcuggaagcuggcugcuucaugcuuuccucccuguacccccuaccuccuguagcucccgguacugcagccuugaccucuugaaguauccaggcuuccucuggcucagcaagaacagggcauauguggagaccagcacucccgcuagggugaaggccuccgcgcucagcuccagcaccagcaacccugucgacugcaggucguagggugaggaugcuuuuguggguauagccccuguuuucuucugcccuuccgccuucauuuaccaguaccugggaggaguccauagaggcaguucccaaggcugucuucaucaccucuaucaccaccgcaacgaagcccaagaucagguugaagguguuggauaucaucauggcccgcaccuaccagugagccagcucagcccugaccagcuugggagacucacugcaaacucaaacuccaccuacgaccuagcugaaaacaaaacucaggcacaggacuaguggaggccuguaauccccgacacuugggaggcugaggcaggaggaucaaaaggucaagaccugauugagcuacaggauauguucaagaccauccugaguaacuuaugggggugggggcugaggcuuuagcccagggcuaguguuugccuacugcgcauguguuucuggguucagucucacacacacacacacacacacacacacacacacacacacacacacacaccaaacaagcaacuaacaaaugucugcuccuauuucccuacuuucaaacaggaugguuagcuuucugacauucuuacuuaauugcuucagucagggacagacaccugagaggauaaaucccuuuuuugguugaggugugugugugugugugugugugugugugcacugggagaaugggaggaggccucuauucucuugucucaccuuccagaugcaaggugcucuucggaguucaagggugauaaugccagugaggaggcccuaaaugguuagaagggcaaacugugaacucuagcuuuguuagagaggcccccccccaaccuuucucucacccucccuauggugggucuuaccgaggcuccgggccaaaguggcagugcugugaccaggugacaggcagaggucaagcaggaaacugagauaguaaaggggaccauagcuauugccagccacacuuggcucaccuggaagccagacagggcaguuagaggggacuacuggggacuuuucccucugcacaguauuuuccucguuuagauaucauuaguuaggauaaaugcuuaguaaaguaccugugcgaaggcagacuaaaaauugagauuuuuuuuuuuuugguuuuucgagacaggguuucucuguguaacccuggcuguccuggaauucacuuuguagaccaggcuggccucgaacucagaaauccgccugccucugucuccugagugcugggauuaaaggcgugcgccaccacacccagcuaaaaagugagaucagaaaugagaugccccuuuguucuuucugucucauuuuauaguucgcuuaccuucauguuuuccccaaagguaaaggcaagcuacuuggaaaugaaggguuuugcuuuguuaauuuguacauuucuuucuuccccccacccccaguccccagcacaguuucuggugcaugguuugugcucacugaacaugaguggaauugaacuguguacagucagcgaaaaccugaagcggggcaaccuggccucaccgccagcaccaguaggcguccacuuugcuugugucuugcccagugcuguagcuuuuccaggcgaacgcugggucucuccugucuuggcugauuagcauuuugauccauugcucgcuugacuguaagagugguauuuccuaggcugcaaaaaauucauuauggggcuuuucaggaaaugggaacacacaacaucucuuucauugaccccucugcccacuccuaauucaggguugaggcccagaaaccuuacaccuaccugaagcggucacuccaauggguugcaacuccgcugggucacaguacuccuuaggggccugguagcucagagcagacagucuuuuccuggcacauagucugucagagagcugaggugugguggggcaaaggucacuaugagggccuaaagauucagggaguggccuuccuagacaggagccucagcucacuccacuggccggccacccagccugccucaguagucccccuuuauugcccucuuucugcccuuccucaggguucacuuacuucaucgcucuggacaaaaucguccuagaccucagucucccuuauuuccauucagucuuuguucuuuggcuuccuccucaaguuacucauucugcccuagugagagucuguguuacugucuggauugcuccacugggaacccuguucccagaccaguuuucauccccgcuccccugguuucucugggcaguuucuuuuccucacuuuuuucuaagggugacacuaaggauccaucccaggguuuugacuaguugauuaaagggagggaaagccuuguacacuggggauuguuucugacccagugaagacccgguaccuaggugcugguuuggaaaagaucuauaccaacaauauuuuugcauuacaaaggucuccaaaggccugggcuagaaucgcaguucugucacccuuucaggaccgugaccuuggcuacauuauuuuaccuaauugaacuccacuucauucccugauaaucagaacuaacuacaaucucccccucccccaaagggaaguugauuccuggguggguagggcgccauuaauggugcugagaaggucauguacagaugugauugcuguaugugauugcuguacauauuaccacagggcuugcccagaagcuaaggugagaacauuuauuuccacauuuaagaaagagagccagcuggccugaauguauaccuuaccgagcuaguacaggaaagagccugaggucucgagaugauacucccugugccugggucccuggucuaucuggcugaccucagucaaguugcuuaaucuguuuccuuaucuguaaaaaggaaaugaacaauaccaaucucaagggguugccuugagcaugaagagaaaaugcauaggaauuagcuuagcccgguacacaccacagaaggagguggcuauuauuuauaaccaccauaaauaaaagaaacugagccagaagaucccagggagcggaggcccaggaggaagggggagaaaacuagcuuuccucaugagccacuucugcccuacug

SEQ ID NO: 7439 - RNA, 1619 nt, Mus musculus
aagugaagggauuaaaaguaugagucacuauggcucccaggaaacaaccuuaauaaaacugucuguuucugauaggaaaauaaauuauucacaaauuucaaauuguggauaaaguguuagaucaaagccaugauuagucuugaccagugaaugcaauuaagcaagagcagaagaucuuucuggacucguggucucugugaaaccaacaguucuucuuguggaugguuacaaaagcgccuccagaccagagggugugauucacaggcugagcuugagagcacgcuuggggacagcaccccagaaggugcagcucucuuuccuuccuaaagacacgagucucaagaagaccaucuguggugguuugaauaucuuuggcccaggaagugucacuauuaagaggucugaccuuguuggaguaggugucgguuuuuuggaggaaguaugucacuuuaagaccuuuuuccuagcugccuggaagccuuuccugcuugcuuucaaaacaagauauagaacucucagcucugcccgaaccuugucugccuagacgcugccauacuuccaccuugauaaaaauggacugaaccucugaaccuguaagccagccccaguuaaauguugucccuuauaagagcugccuuagucauggugucucuucacagcaauggaaacuguaacuaagaugucaucccauugcuuuccagccccaaacccuccuuagagccuccuucacauccuuguuucucaaagaguagauuaagggguucagcauugggaucaccgcuguguagaucacggcaacugugcgguccugggucaaggaguagcuggacuuagggcgcagguacauaaaaaguguugugccaaaaaagaagcacacagcagugaggugggaggagcagguggagaacgccuugaaccugcccugguuugaacgcauuuguaggauggcgaugaaaauuaguaaguaggagaucaagauggugagaguacagcucaaaagguugaagccggcaaaaaugaagagcaagaucucacacagcgaaguguccacgcaggacagggacagaaugggcgguccgucgcagaagaaaugagugaccacgugagcaccacagaaguucagacugaagaugcagcuuguauggauaagagaauugagaaacccugcuccauaggagcccccaaucagagaggcacagacauugggagacacuauggucggauagaggagaggacugcaaacagcaacauagcgaucauaggccauugcagcaaugagauagcacucgcugguggcgaagcccgcaaaaaagaacaucugagccaugcagccaaaguaagagauuacuuuucucucaaccaagaaguucaacaguguuuggggaaccaccguagaagaguagcagaaauccaggagcgaaaggcucuugaggagagaguacauaggcgugugcagggugguacucacauggaugagaaagaacaugaccagguuccccagcacagugauggcguacaugaccaggaacaccacaaagagcagcuucuggagcugggggucacuggugaggcccaagaguucaaacuccaucucguggcucagguuaguucuuuccaug

SEQ ID NO: 7440 - RNA, 609 nt, Mus musculus
guuuuuuuuaacuuuaucugcauuuauuuaugcugaauuuauucccgggccaugaguuuuauuucuucaguuucuucugggauaucuuuuucuucugugcagccuccucuucuggcuuuggaacgaucuguuccuucucaaugaggaucaucucacuguggcagggggagcucauggauggguuaauccggccaugagcucuguggguucgucggcgcaucuuaggugccuuguucaccuggauguguucaaugacuagagaaucuacaucuaaacccuuaaguucagcauuacucucugcauuuuuaagcaugugcagcaaaaauucagcacucuuuuggccaccgacccuguguccagccccacuguuuggccugggcgcacuuaccgacuccaccauuauaccgccggaauggcacacauugcuucuuuaaagugacguccuucagauacuugguggcuuuguggauaugcauacccuugauggccugcacaguuucccggguguucuuaaagugaacacgaagguuugaaccucuugauuugcaugauuuugugggguuuucugggucaagagaauagugaaccaucuuggcaggugaccuguga

SEQ ID NO: 7441 - RNA, 10463 nt, Mus musculus
caaccggaaguggcuuuucaucuuggcucuauccggcuggccuucgggcguccucgugagaauuagauguuucuuaguucuaggcuggggaggugcuaguccgccgcgccugauucgagccgaguccgcgcugggagcuaggaugucggacacguggagcucuauccaggcccauaagaaacagcuggacucgcuucgcgagagauugcagcggcgacggaagcaggacucugggcacuugggugaggugcgggguggucggggcgggccugggcggggcgagagacuccuggagaggaagacagccccgggcucugcgcccuuuccggagcagcccuuuauuggacuccucgauuguugguuaccccaucuuucccgaguagcugaaacgcaugcccaccugcgggaaagcuugcagugccuccucccgggcgucgguuuuucaagcguaacaccacaccaacauggguccacuccucuccuugggucccauuccaguccugucuaggagaauguugcguccgugaagccucucaguaccuuauuccgagagccagcaaaacccguuuuguugcuucugugccuguuuuaccuuaguuguaacguuugcuuugucacugucuuuucuuucccaugugggcggggagcaaggauugcuucuguauaucuauccccagagcccgguuuagcagccacaacaggguccucacuaggaccuucucacuaggaccuuaaugaaugaguagugcaaguguuuacaaacguagcaagaaucugaaaacacuugauuuuggucuuuaaacauuuucccccucccccuuguaugacaaaguuagaaaaauugaaggcacuuaaaagaguacuacccuaauagccuucuccagcacaagcucaauuauuuaagguaaaccaguugcaaagcucugcgagaauaccgaauccauacuacauguguggguagcaugucagugcuuugcaguauucacagcucacaacagcagaccuuggugaaauucagucucaccguaauuugugaacauuuauugcauaucuacacuacucauggguuucggcaaaaagaagacacugcuguuaccuuaaaggagcuuaaaaaucuaugugagaaucaaagaagauuagaagaaaaagcagggagaaaaacccuucaugguggcucaugccuguaaucccagcacuuuuuuuuuuaaaagauuuauuuauuuauuauauguaaguacacuguagcuguccucagacacuccagaagagggagucagaucuuguuacagaugguugugagccaccaugugguugcugggauuugaacuucagaccuucggaagagcagucgggugcucuuacccacugagccaucucaccagcccaucccagcacuuuuuuaaacaagagggauaucugugaguuugaggccagccugguauacacagugaguuccaggacagccagaacuaccuagagagacccugccucaaaacaaaacaacaaagccaaaaaaaaaaaaagaaaagaaaaagaaagaaagugucacagcuacaguauuauauauguaagaugcuaaaugaauggguccacagucgcuacaaugacuaagaaauggggcaagcuuaauggggacuuccuacuggaguugccaguuaaauuuggccuugauuuuuaaacugcauuagccaauacaagauuuaucagauuacauaauuuaaaaaagauaauagggcauuauggaacacaaagugcaaaacauaggaaaagggaauaauuagaaaccaagauuugagaguucgaagccagcaugguguacauagugaguuccaggauagccagagcuacacaguaagacccuaucucaaacacaccaggaaugaagaacaguaacacuuuaaucaaaaaauguaacaggcacagcaguuagauuccuuguuuugaguugauagauucuuuguuuuguuugaaauaaaccuaauagcaaaaaguuuguuuaaacauauuuggcauuagguaucauugcauauuucuauaaaauaccaguuuuaacuauauuuguagcuugaaaagcagucuauguuuccacauagaauuucggcuagauuacaucaaaaaggauguuucuuuggcuuuaauuagaaguuugaaaucauggaaaacacucaagaauuuaagacuuauuuacuaacauuuguuuuggucauggacagcuuucccaaaguaugcucauuaaauugggcuagacaaaaaaaaaaaaaaaacccuacaaagucaauguauaauaagaauugccauguuggguggugguggcgcacauacaaaucuuaguuugcacuuaggaggcagagucaaaggcuagccuggucuacagagcaaauuucaggauggcuggggcuauacagagaaaccuugucuugaaaaacaaaacaacaacaauaaaaaagaauugccuggaguuuugauuaacaaaauaaacauuuguaggaauaggauuguauuacacagugcuuggcacacauguuuguuuguuuuuuauguaaguguuuugccuucacggaauuaugugccccacaugugugcccaauacccuucaaagccagaagaaaucuuuggaucccaugaaacuggauuacaaauaguugucagccaccauauauguucuggggaccaaaccccagguuugaacagcaagcauuuuaaccauugagccaucuuuucagccuuggccacauaauugaguauaaauggggaaaugguuaauauaugacuuaaaaccauuucaaaaucuaccuaacaagcuaggcauggcauuacaugccuauaaccccaucaggagguuagaaauuuuuagguuagcgugggcuaaguagauccuaucucagacaaacaaggccaggcaugauaguucauaccuguaaucucaguacuuaggaggcuaaggcagcagaguuugaggcuguacuggguuacauaguagguuccagaccagccuggacuaaauaguaagacccugugaaaaaaaucaggcaucuccaugacaaaguagugauauaauuugacuuacaacuuaccaauaauaggauaguuguggugguauaugccuucaguuccagcacuugggagacaaagcgaggcagacuuuuggacuacauagugaguuccaggacagccagagcuacaaaaaacaaacaaaaaaaaaccccaccuauacuuuuauagucccuaucaaaaaaauccuuuuuuuuuuuuuuuuuuuuuaaggggaggggaaaaugucucaccauguaacucuggcuggucuggaacuuacuauauacaccaagcuggccucaaacucagagcuaacugccugccuccgcuugccugggacuaaaaggcaaugugcuucuaugcccggcugccuuuuuaaauguauuauuuugagaaagguuugcuaaacugucuagacuuagacaugaauuacucuguagcccaaagcuucugugauccuuccugccuuagccucccaagcuuacaggccuggcuuccacaacuuauacauuagcccccuuggcauacuuugaaucaagaaaacacuuuaacacuuacguuuguuaauagaaucugaauuccuuuuugaaaagagcucguguuuccuuguuacaguggcuuuuaucaucgugcauauuugcucauugaaaguaaauuuuugguacuucaaauuuauaacuucaauaagaaaguucaggauuugcuccuaguguaugccucuguuuuaguucacauuuauuagacuuguaggaucucugaauuccaagagucuaauauccaccagcacaguccugcugaaggcaaguauuucucuuaacacuguuguaagugugcuauguagcaauuauuacuuacauuucuuuguauacuuuuagcuaaggccaauuauuuuaaaccauccaaaccuuuacugugcuuccaugaccuuuucauguguacagugguggaguaagaucauauagugggaauaugcugggaccaucauuugcugaucaggccuuuggccaaguauuccaagggccugguguuuauguuuaugaagcauauucuccauggccaauagccauguuucauuaaaauuucagauccaucccugggaaacauaaucacaucccaggguuuuuguuuguuuggguuuuuguuuuguuuuuuuuugguuuuuuuuuuuuuuuuuuuuuuuuuuucauuuuuugagacaggguuucucuguauaacccuggcugucccggaacucucacacuguagaccaggcuggccucaacucagaaauccaccugccucugccucccaagugcugagaucccaguuuugauuauugaaaauacucuuuuuuuguuuguaaauuuuaguuaaaguauggguuuauuguaucauuugagaggaggagaagguggcagagaccugccuguaaauguaccaugcuacauuacuuccuuugaagcagugagggcagagaaucagggaaagauugcucccccaacagagaaacggugaguaguucucuggaaaauccaggauuauuuuggcaaaacagcaagugcugccaugugaaugaaaggugaucuagagcuaacgcuggucagagacccugcuugaagugaaagaugugugugcuagcgaugcuggacaguugaaccccgaggaacgugaacacugacuggacugacccuuuccacuuuauuuucuuccuuguagauuuaaggaacccagaagcggcacuguccccaaccuuccguagugauagucccgugccuacugccccuaccucuagcggcccuaagcccagcacaacaucuguggccccugaacuagcuacagacccugaguuagagaagaaguugcuacaccaccucucagaucuggccuugaccuugcccacugaugcuguuuccauccgucuugccaucucuacgguaaucaccugaugaaauuggaauuuaucccgaguuugcuuuuguucauggugucuuaucgucuucuccuuucuuuagccagaugcaccugccacucaagaugggguagaaagccuucuccagaaauuugccgcccaggaguugauugagguaaagcgaggucuccuccaagaugaugcacauccuacucuuguaacuuacgcugaccacuccaagcugucugccaugaugggggcuguggcagaaaagaaaggucuuggagagguagcagggaccaucgcagggcagaaacggcgugcagaacaggauuugacuacagugaccaccuuugccagcucuuuagcaucuggucuggccucuucagcaucagaaccagcuaaggagccggcuaagaagucaaggaagcacgcugccuccgauguugaucuggagauagaaagccuuuugaaccaacagucaacgaaagaacagcagagcaagaagguagggaccacgcgaacacgcucacauuccuuaguuacaguucugauuuguuacuguuugcacaaggaguauuucguagaauugagacguagagcaguguuucucaauggggaugauuucuucuaccauuaccucuaccccacguucggugguuucuguguccaguguuaucacaguaugguagagugcuguuggcacucaauagagagaggaucuggaaggugggggcugaaacuuuugugaaacaugcuacaauguauaguaggaccccuccccacuccuccuuccccagaugaaacugucuagucuuaaaauaucaauaaugccguuucgaggaaguccuuauuuacagaaucuggaagaauucucaaaagaggauucagaaaacagaaauuuaaauaaguacucauuuggaccaaguuauauaaguugaugaaauuaucaguacaaugguucugauuugaacuauauuaaauucuuacuuguucccaauuucuaguuuaguuuuaaaauguuaguuuggucuucgaugacgauaaccagaguuguucuuuacagaacuauugaauagagugagcuaagcaauagaagacuagugcugugccuuucuuaguugucuaaucaauccaaauuagcuuuuuugaggggaaguuacacucuuuuagggagguaagaucggcuuacugcuuaguuguagaaaccaggcucuuugcauuugaauuacauucuaaaugcuugugaggaggacugagccuauaacaacucugcuacauuguucauucauauauuccucauuagacauuaagugauuagacuuauggaggcagucaguuuaagggcuaauuuaucuacaaacccuuaagaccaaggcuacuucugucacaggucagucaggagauccuagagcuauuaaauaccacaacagccaaggaacaguccauuguugaaaaguuucgcucucgaggucgggcccaggugcaagaauuuugugauuaugggaccaaggaagagugcaugaaagccagugacgcugaccggccuugucgcaagcugcacuucaggucucuugggagggaaugagguggggaggguuccgcaggagcagcaguuccuuugcagcauauucuuccugccuuuggaauggcuacugcaugagaaggaguacaggcucacuugcaaguaaaaggaagauuuucuagccaagcaucuggaucugaguaacaaugaaaguuaaagucuggaaggcagagaguccuaggagaagucaggaaccugggcguagggccgguguuuacucuggaguaaggaggccuuccuggacgauauccuucccuuuaguaagagaagaaagucuguauucuguugucuuugagacaagguuucagagcuccggcugggcacgcugaggaugggcuuucugauuuucaggcucugguuaucagugcuaggauuauaggccuaagccgcugcccccagaucaagucuuuagucaggagaacgaaaguccuuuaguuuaacaaugcagaaaauugggggagaacaagaaauuuugaauuguaugaucuacuuuugaaguaccaucuugauucugauucccuuuuuuuuauuuucccagacgaauuaucaauaagcacacugaugaaucuuuaggugacugcucuuuccuuaacacauguuuccacauggacaccugcaaauauguucacuaugaaauugaugcuuguguugauucugagaguccuggcagcaaggagcauaugccaagccaggagcuugcucuuacacagaguguugggggugacuccagugcugaucgacucuuuccaccucagguaccuacauguccacacagcccgggacaaccuauucuaagcuauauacuuaaacugggugggguauccauauauguagaaaaauagggaauaauuuagcaaucuggcuuacugaugggagcacaaugggauaggaaugcuugagguagaggguuugggacugugaaaucugugaaagaaggaaagaugaccaaauacuaccuccugcaguggaucuguugugauauccgcuaccuggacgucaguaucuugggcaaauuugcaguugugauggcugacccaccuugggauauucacauggagcuaccguaugggacauuaacagaugaugagaugcgcaggcucaauauaccagugcuacaggaugacggcuuucuuuuccucugggucacaggaagguaauauaauccagauauguagguaugggaaauacagcagagugaaaacuggguaaaguccuggguuucucaggcauuugauuaaaugucacuuaggaugccugccucuucugagggguuugauguuuuuagcacuaauacuugggauuccugauuuagaaaaaugaggucuuucagauuagaugcugcugcuucaucuuuuuucacuguugccccaacagcaaugaaugcuucuguuauuuauaauacaugugacauuuugaaggaaaaaauaugaaaaugugggcagauaaauuguuuaacccuuccaucuuuuuuuuuuuaaagauuuauuuauuauguguaaguacacuauagcugucuucagacgcuccagaagagggcgucagaucuuguuacagaugguugugagccaccaugugguugcugggauuugaacuccggaccuuuggaagagcagucgggugcucuuacccacugagccaucucaccagcccccuuccaucuuuuuagggccauggaauugggcagagaaugucugaaccucuggggguaaguagaaauuauguugccuuuuuuaggagaaauguaacuugacaagucccuucucucaguguuccugccaaucugcccuugugucuugugcugugccucagcugugaagcugguuaaagcucagguucucuccuaugcuccaguuaugaacggguggaugaaaucaucugggugaagacuaaucagcugcagcgcaucauuaggacgggccggacgggucacugguuaaaccacgggaaggaacacugcuuggugaggaacaggaggaagagggggagcugcuuaggagacugaaggcugugguuguguaaacaguguucucugugaugagcagguugguguuaagggaaauccucaaggauucaaccagggccuggacugcgaugugauuguagcugagguauguguccccugugcaucuaaagcuuucagacuuucacucaauacuccugucagucuccauuuuuuuuuuuuuuuuuuccucauuuggguaacacagaccagacuagaauugcaaucuugaguaacuuuuuaaaaauuuauuuuuauuucauguguaucaguauuuugccugcauguaugucuuuuugagggugucaugagcuguaggucuugggaauugaagccagguccucuggaaaaacaaccagugcucauaacugugagccauuucucuaucuauuaagcaaucuugaauaacuuaaaguagcuugaguuuuuauuuucuagguucguuccaccagucauaaaccagaugaaauauauggcaugauugagagacuguccccuggcacccgcaagauugaguuauuuggacgaccacacaaugugcagcccaacugguaacauuaagagaacaggcucuugccucccuaccuccugcccgucccucccccaaaaaacccuuuauggacaaagacagaugucacugaguuguauacauucugguagucuagauggcuuaagcuuuaccagaaucuacaacauucauuagaacccaaagggcuguucuuaaagcucuaacugcccaaggaucgucagcuauucugugggcuauauuaaaucugcccccuaguggcuacuaaguauuuauucaaucugucaguuuuaauguuugaugccaauggugagcauuuuaauuauccaaggacuauucacuagcagugacugaaugaaguaggccuggcuaccaucaauuacuaauccuuagauagacagauccggcuggaucuuggggcaugagacugaagcaggaggauugcaagcuuaaggccugccaaugcuuauuuagaggucucaaaaggggaggggggcugguaguguuaagaguuuaagaguguauauguaaggugccuagguucaacucuuaggaccaccaaagaaauuaaaauccaaucaguuuuuguauugacacugccauauuauuugcucugaucuuuuuaaaaguugauguaggccgggcgugguggcgcaugccuuuaaucccagcacucaggaggcauaggcagguggauuucugaagccagccuggucuacaaagugaguuccaggucagccggggcuauacaaagaaacccugucucaaaaaccaaaccaaaccaaaccaaaaaaauugacguggacugggcauaguagagcacaccuuuagccucagcacuugggaggcagaggcaaguagaucucugaguucaagguuagccuggucuacauggagaguuaguuccaggacagccugagauagguaucaccagaaaguagaacauuuuaaguauuaagcccuuacaggauuuuugguuugccucuucuuucccccuuguuuuaggauuacucuuggaaaccaacuggaugggauacaccuacuagacccagaugugguugccagguuuaagcaaagguauccggacggcaucaucucuaaaccuaagaauuuauagacgcacuuccuuacaaagcuaagcguucagagccaugggcuacaggccacaccuuaagaggacuguuuacgcaauaguguccccuacccuguauauaaauaaauaaaaguuuguauuauaauuggaauuucugaagugaaauuauggcuuuccacuuaguguguguccuugugcuacucuuauuuagcgugauucauuauaaguaaaagaagaauguuagcuaccuagcguguuagaaaagacuacacagguucacagugcuuagcaauuaauaugcuauaaacaggauuaauuugaauuuuaccaugcauaugg

SEQ ID NO: 7442 - RNA, 936 nt, Mus musculus
ucacucuuagugcuuuggcuuccuaccauucuccucaaggccaucuucaccuccugguuccucaggguauagaugaggggauugaggaaaggugugauggcuguggggaagagagcagccgccccauccaggaugccauggcugucaggucgcagguaggugaaggcacagggcacauaguacacaguaaccaugguuacaugggccccacauguugaaaaggcccuucgccucccaucagcugugcggauucucaggauggcccgaaugauauagauguaggaaagaaggaucagagagaagcaacuggcaaccaccacuccaauguccacaaaggugaacaacucauugacugugguaucugcacaggcuagcuucagcacugcaggaaugucacagaagaaguaaucuaccugauugggaccacaguagggcaagcggaagguuaggauggcuuggauugcuccguggauuaagccagccacccaagcuccagccacgagcaagguacucaacuuagcagacaugaggacuggguaacgcagggguuggcauauggccagguaccugucauaggccauagugguguagagauaacauacaguacugcccagaaagugguagaaauaaagcugagccacgcaucccccaaaugggaugggcuuaaugccuggagugaaguucaucaugaggcgggggacgaugaugguagagaugcccaugucgaugacggaaagagcaccaaggaagauguacauggggcgagcauggagcugcgugucggugcagacggugaucaggaugaucauguuccccagcugagucaggauguagaucagcaaaaagaacacaaacaggaauguccucagcccgggagggugggggaccccugugaggaugaacucagucaagacuguauaguugacucuuuccauc

SEQ ID NO: 7443 - RNA, 944 nt, Mus musculus
cucagaccucacucuuagugcuuugacuuccuaccauucuccucaaggcuaacuucaccuccugguuccucaggguguagaugaggggauugaggaaaggugugauggcuguggggaagagagcagccgccccauccaggaugcuguggcugucaggucgaagguagaugaaggcacagggcacauaguacacaguaacaauagucacaugagcuccacauguugagaaggcccuucgccucccaucagcugugcggauucucaggauggcccgaaugauauagauguaggaaagaaggaucagagagaagcaacuggcaaccaccacuccaauguccacaaaggucaccaacucauugacugugguaucugcacaggcuagcuucagcacugcaggaaugucacagaagaaguaaucuaccugauugggaccacaguagggcaagcggaagguuaggauggcuuggauugcuccguggauugagccagccacccaagcuccagccaccagcaagauacucaacuuagcagacaugaggacuggguaacgcagggguuggcauauggccagguaccugucauaggccauagugguguauaggaaacacugggaacuucccagaaagugguagaaauaaagcugagccacacaucccccaaaugggaugggcuuaaugccuggagugaaguucaucaugaggcgggggacgaugaugguagagaugcccaugucgaugacggagagagcaccaaggaagauguacauggggcgcgcauggagcugcgugucggcgcagacggugaucaggaugagcgcguuccccagcugagucaggauguagaucagcaaaaagaacacaaacaggaauguccucagccugggagggugggggaccccugugaggaugaacucagucaagacuguguaguugauucuuuccauc

SEQ ID NO: 7444 - RNA, 4487 nt, Mus musculus
uguguguguggucccugagccacuggcuacuucucuccacccacaucccuucuaccugcuguuagccucuucagggcagacuucacuuccugguuccucaggguguagaugagcggauucaguaauggagugacaacaguguaaaauacagcaacugcuccgucaaagggacucuuggaaccugcccgaagguagaugaaaauacaggggacauaguagacggugaccacagugagaugggagccacagguggagaaggcacgcuuccugccaucggcagugcguaucuucaggauggcaugaacuauguuggcauaggagagcagaaucagcaugaagcaacuggcagccacuaccccaauguccacaaaggucaccaguucauugacagucguaucggcacaggccagucucagcacugcaggaaugucacagauaaaauaaucuauuugguugggcccacaguagggcaaucugaaggucagagugguuugaauagacccauggauggagccagccacccaagcuccagccacuaggauugugcauaauuuuccauucaugagcacaggguagcgaagaggcuggcauauugccagguaccugucauaggccaucaaaguguagaggaagcacugggugcugccuaggaaguggaaaaaauauaguugagcugcacaaccaccaaaugggauagccuugcuggcaggagugaaguuuaaaauaagucgaggaacaaugacugaggagagccacauguccaggaaggagagcacacccagaagaauguacauggggcgggcaugcagcuuggggucagcccacacagugagcaggaugagcagguuccccagcugugucaggauguaaaugaggaagaagaccaggaagaggaaggcucuuagauuuggggggugagccaagcccaggagaaggaaaucugucaccacagcguccagcgauguguuucugguucuucucaugucuuagucuguuaagaugaaccaugaaguuagacaagggaaaugcagagagggaggagguaaggugaugcuuuuguuugaugaccaguggcuagcaggagagaaauauauguguauaaaauuguuuugaaagaagaguuggugucaccuauuaauuauuuagguuuaugugggggaaaaauuacccagaggcuggcuguuuugguggauguauggaaccucuuguucagugaggggcagcaaggagcaauauugcacagaucaaggaacagaagaaacugucagcuauaggauggacugauaauuucaaucagaaaggauuuuaaugaagggaggcuaaagcaaaugcagggcuaaaaucauguguucccccucacugaccucacugucacauugccuuuuugucuacaguuaagaaucagcuauacucaccauagcaugcaaaaugugcagugucuggcccuucuucaccauucuguccauuuccaccuaguguuuggugcaucccugagacugaaggcucuucugaagugugcuccuguauguguuuugcacuuagcauuucccugggugggacccguucuucccuucagccuugcuuaggggaucauuaccuugaagaauucuuuucugauuauugaugauaaugauauacaccuuuucaauaacuaucuuacucuauuuacauagucuaauuccucaucaaucuuuccauuauucaagugcuagugaauuaaaagugauaaauaauucaaucucgcuuguuggacccuucuacuucuuugaggccaaagucagucuuugggauuauacaauauggaucuaguuucaugauaacaaauucuaacgaucauucaugcucuuuaguauuucagaauauuguuucauuuuauugauuuauaugucuauugauuuagauugaauuuuguaaaaugcagaauugcaaaggaacuuuuuauuguguguuauaaaaguauugaccagcacaugguuguuagcaagcuugugcauguauauacacacaaguuucuguuugccauccaggagcucuuucuaaagaauguuaaagauuucaaauaccugacccaaccaggcgacaaggaaaugcuuucauacugcuucuugcuuaccaagaagucaccaccaagguuucucucacagagauucucccagguacacagggccaagcagacauguaccaaacuaugaaccaaauaucuuuccucucuuaaaagaaacaaaaaaacaaaacccccaaaacuagccaaccaaccaaccaaccaaccaaccaaccaaccaaccaaccaaaaaacaaaccaaaccaaaaaacccucccaaguucccgaaaccccuaagaucccacccacaacagcagcagcagcagcagcagcagcagcagcagcagcagcagcagcagcagcagcagcagcagcagcagcagcagcagcaacaaccacucccaaaauaaaaacaaaaagacaaagaggaaagacuuguuaauucauuguuuuugcugaauaaagauuuuuuuccuaucccagaguuuaaaaugcauucaucugccauuuaaccauaaaguaucuauaguuuugugaguauuuuuuagaaggcaacaaaauuauagccauguuuaaccauuuagcugccaucaaaaacucucacaggggauggcaagaugguuuggugguuaaaggcucuugcugacagacugacaacuugaguucaguuccugggacccacacagaagagaagaacaaauucuugaaaguuuuccucugaucuucauacccaugccuguguguauacacauguacacacacacacacacacacacacacacacacacacacacacacacacacacacaccuacuucuccaaauagauuuuuauuuuauuuucuaaaauaagaauuucuguguuaaaguauuaucccuaaugcugcugcuacugcugcuguucugggacagucucacacauguaaauaaagaaguucaaaacuugagguaugguauucaggacauaucuuggauuuuccagauauagauuuuuagaacaauggagcauguuuuugccaaagauuuggaucagauaaugagacuagaacaggccaggcuagcuuaaaagaagcaaagacgacuacccaggauccuccugcacugccucucccauucuuuagcuuccugugugguuuguuaguuucuuucuuguuuuuaguuguugaaacuuucaaaaaauguugcaaauaguuugaguauauccacucuggcugauuaaauaaucaagauauucuaaaaaaauccaaauauuauuuuguaucugauaaugauaaaauuauguugaaauauggucaaaucuaaucagaacacauaaaaacacugaaugacuaaaauucaauauaaaggcacugcacaauaaaacuccagugacaucagagacuaaauggcacaucucugaaaaguaauugcaguuaaaguuuuaggaaggcugugaggauagucagaagagugccacugagguguuuaaggaugcgaaggguagggaaacauuacagagaccucuuacaucuugggaccccaggaugagcugcuugugugcauccuggaccuacgucaggcuucucugaugugagcauauuuccuggggagguuuaaagugugugaagcaguucccuagcagagugaaacauuggauuucuacagugacccuggagaucugggguacuaggaaaaaacagguaagaaaugaagauggggagggaaacuggcugagugcuguguucagugugcucaaaggacgccuauuuaugauggggcaaguaucuagucugaaucuguuucuggcaagggcauuuaccuuccuccuccuucauucaguuagauguccugguaaggacaggcagaucaaagggaauguagaguauccugggcacacuugaaguacuccacagaguagauuucuguccuuuaccauagauaaaaagagcuuaccuuggaagaaaccuagccccucuucaauggagaggaaagugcaucuggccugccuuuguuucugcauagcuaacaacaccuccuccugagcuauucccggccuuugccuuucauugcuaucauaauaaaaagagaaaguaaaaaaagauauuaagcucucugaguccucuuuucaacuuuauaaaagucaaacuuauccuaguaguuggggaaaguuccagaaagaaaugggaagagacuaauguuuagaccauacaaucuggucuccaaggcugguugugcucucuuggguggagcgcuucuccacacugcuuccucuuagacuuaccuguauagagcugcagaauugguugguugucccugaguggacuuguccugcagauagagagaugccguccagaggcucaguccagccugugguacagggcuccucucucuguuuuaaaaaggauuuagcauucuuucaagaguuugcccuguaggcaaaugcccuucauggcucuccaaggagugug

SEQ ID NO: 7445 - RNA, 2845 nt, Mus musculus
gaugguagaagaggcccccauguucaaaguacauggcagccugggcaucagagugaagccuguaauacgcacaguugauacauagcaagaauaauguaaagaguuguccucauaggugccuuccugaggcugcuugcuuauacaagcugggucauuuuucuuuccacuuuguuucaaaaaauaauugcgguuuuacucuugcauuucaggcaguuccuuuuagucuagacagcguugcaaauuccauucacuccuuauuuucggaggaaacaccuguaguuuugcaguuggcucccagugaggagguaagugacaaaguuuuuaucuaagagccuuauaaagaaguguuauuuaaugauaguuuuaaagugauugugugagaacugcuauguacuuugucugucuguuggacuuaaucugcagaaggcagcuaaccuagcauucuugauuguccuuguagagaguguauaugguggggaaagcaaacucggcguuugaagaccuuucagucacauugcggcagcuccguaaccgccuguuucaagaaaacuuccuucucaacucucuuccccucaauucucugaguaggaauaauaagguaagugguucauuuguugagugaaucaaauacaugucauuauuaaauucccauuccauaugcuacuugaaaccuuagcaagacagaaguuguagagaaugaagaauugggcucacuuacugcuggggcacgcucuuucuucuguuggggcaggguucaugacuaaaugcaccuuuucugaacugccauuuaguaaaucauuuuccuaccaguguugccaguugauccagacaggucacaaaccagucuucuuggagguugguugagcuaugaagaucuggugacucgaugucauuauucauagcuguugcuaauguggacucacaguuuuugcaucauguucucagggugcugcaguagagugacacuccugcuuuguucauuuggguuuuggaguugguuuuuuguuuguuuguuuguuugguugguugguuggguuuuuuuuuuuuuuuuggagcuacacuuacuauuuaguaccggcuggcuuggaacuacagaugggguugaccucagacucacagagaugugccugcuuccuuuucuuggguacugcaugcaccaccaugccugccagccaucccugcuuggaucucuugcccuuuauagcuauuguggguagcuaggaaccauucuuccuaauucucugcuuugggaaguguucaaggcaaguaaguaaacugguccacugguaggaucuuaagacaguggggucaaugcucaggcauggcuucguuagaaguaagagcuaucaagugguagucacuagacuaguauuuauuagggagugaccaucaccuuuuugguaggaaauaaugguucaugugcgugcuuuucugauaaugggccuugagccuugcaaauaguaagcauuucucuaccacagagcugccucguuucaauuagagugaacuuacaaagggaggaaaauaauauacauuuaccugauuaauauucauacuauguuguacuuuccuugauaaguuaaguccagaucucugcuguguauuuaaagccauguccacucuuuggucucugaagguugaccugcucuuucucuccgaacugcaagugcuacaugauauuucgaguuugguaaguaggcugcuuggacuuugaaguccuaucuguuuugguuccuagaaaucuuuaaauaaaaucaggccaguugaaaagcuuaaguaugccccacauuuaugaucccaggaacacugagaaaaaaaucuaucugcaaguuaucuuguaguaagugguuuuuaaaaucauccucaugccugaaauagaucuucuuacuugccugcuagcuucugaaguucuuugccaaaccuuuuuaucugggcuggguucaaggaguuugaaagcuuagugcugggggcuagggugguacucuggguggggaugcuggaggaagacacugaugguuccugaauuccucacaccauauccguccaaguaguuacugcuucaugcauugucucacaucuaaguuuuuuaaacuaagcaaugagauuuguguugaacuuaucagaaacucauuuaagggagcucucuuugcugccauuuuaaacuguuuuugugcuauagugcaguggugugcuucuguggccagcuaacguagucagguauaaaacuugacuugguugcauuugacaucgccuuuguucauuuguucuauuuguuugucugaaguugucucgucauaagcaucuagccaaggaccauucucccgacuuguauucauuggagcuggcagguuuggaugaacuugggaagcguuauggagaagacucugaacaguucagggaugcuucuaagauccuuguugaugcucuccaaaagauaaauagcaaugcuacagguucagagguucaguccauuaucaucaaggugagagcauggcagcauccaggcaggcauggugcaggaggagcugugcauucugcaucuugagcugacugcagccaggagaaaagugaacaaauugaauuuuuaaaaaucuuuuauuguguaggagacauuaggaugcaagguggaucuggaaggacugggaaguaaggguaaucaggaugcauuaugugaaauuccuaaauaaucauuaaaaauacuauguuaaaacagaaagauuuuagaggaauuuuaaucccgcaacacgucuccucuggcaaggaaucacaucugaacaacuuguaggucuguuaccuggcuguaauaacaugccuuuaaucccucuggaauacagacauccccuua

SEQ ID NO: 7446 - RNA, 708 nt, Mus musculus
cuuggagaaccagugaguuuauuuggguuccuuccauggaugacaagcaugaaugacugagagucacucagcugugguuuccuccucagcaucuuacagguuugugcucagcucccccugcagccccacacacugugcgcucacagcacagaaguacacagccgagucgcuccagugcacagaggcuuuccgaagguggaaggaagagucgcucuugcugaacucagccuugaagccguucacuccuugaaccacuggguuucccgaauaguacuugaggagaaacuggaggccacggccauggugcuggauguaccaggagagguaaauggauccaccauaggaauaguugcaucucagcuccaccgagucuccuucgaagacagugacaugggcaucagacugggaaacugucuguguuuggacaucugcagaaucaaugauaaauucgugauugugaugcaggcuucaugaugaaaacuauucuuacuaaaauuaaguaagagaaagagugaauugugugcaucuacuacugucaggauauuugacucacccaggaagaaauguaucccgaggaacgagaugagaaccaggagcauggcugcacacuggaaacagcucuggugccuuucuggaaaaaccuggcucgugcaggaaagaggcugcuguucccaguucuuggagacaguuggcauaagguuuacuaga

SEQ ID NO: 7447 - RNA, 1769 nt, Mus musculus
uggacugccggcuccggguucugcgaggagccuccugccagccgccgcgucucccugcccucgcugccccuccaugugcccgggcgccgccgcuccgccucgggccgcugcucaccccgggguuuauggaagugauggaaggaccccucaaccuugcucaccaacagagccgccgagcagaccguuuguuagcugcugggaaauacgaagaggcgauuucuugucacagaaaggcaacaacauaucucucugaagccaugaagcugaccgagucugagcaggcucacuuaucacuggaacugcaaagggacagccacaugaaacagcuucuucucauccaggagagguggaagagagcaaagcgagaggagcgguugaaagcgcagcagagcacggaacgagauggagccccccaccugcaggcaccucccaggcccucugaggaugcugaaggccagagcccucugcuuucucagccauacaucccuuccacagagaggcgccuccccgaggugcagggggucuuugacagggauccagacacauuguuguuuuuacuucagcaaaagaaugagccaucagagccuuguauuggaagcaaagccccaaaagaugauaaaacgauuauagaggagcaggcaaccaaaauagcagauuugaagaggcauguggaguuccuuguggcugagaaugaaagauuaaggaaagaaaauaaacagcuaaaggcugaaaaggccagacuccugaaaggcacagcugagaaggaacuggacgucgaugcagacuuuguagagaagucagagcuguggggcuuaccuucacacucggaauccgccgcugccucuucaaccuggcagaaguuugcagcuaacacggggaaagccaaggacauuccaauacccaaccucccuccucuggauuucccaucuccagagcuuccucugauggagcucucggaggacauucugaaaggauucaugacugacuaagauggaaggccauuggagaggcuggcgacaguuaauccagaaaagaauauaaagggaaagccacgccccaggggaaugccagagaugcuccuucaucugguaugcugugggagaagaggcggugccaggaccugggaaagucacugugaaacaucacuuaccuuugucacgacuaaagcucaugauuccgacucggcagacacugaacucuuggcgguucgcuuucuuaugauacaaaccaaauggcuaccuggaauaauuuuucaaacaguuauuuuucuucaggguuaaauguauaaaaguaugucauuaaucuauaaugccauaaaugauaaugcaaaagcuaaauaugguggccugagaggcucacuuguauuuggaacaugcuuucuaucaugcguugacuguaugcauuuucugcacauuguguuuguuugagaugugguguguaagauacacgcuuccagauggaacuguacgugccacguuugcacuacucguaacauaaugagaaccucaagacuaucaggagaaauauuuaaauuuccauuuuaugaagaaaggaaccaaauuauuaguuacgcuuuuuaaagaaauuaccaguuuacauaauuaaucagggugcauuuaaguucuaacuuuguguuauaugaugcaucauuugaaaauacugaggcacucuccuuugugcugaaugaugcaugugugaaagcaaugcuaguuagcaguauuugauuguaagaaauaaauaaaauaauuguguuucauacaaaaaaaaau

SEQ ID NO: 7448 - RNA, 1293 nt, Mus musculus
ccauacaucccuuccacagagaggcgccuccccgaggugcagggggucuuugacagggauccagacacauuguuguuuuuacuucagcaaaagaaugagccaucagagccuuguauuggaagcaaagccccaaaagaugauaaaacgauuauagaggagcaggcaaccaaaauagcagauuugaagaggcauguggaguuccuuguggcugagaaugaaagauuaaggaaagaaaauaaacagcuaaaggcugaaaaggccagacuccugaaaggcacagcugagaaggaacuggacgucgaugcagacuuuguagagaagucagagcuguggggcuuaccuucacacucggaauccgccgcugccucuucaaccuggcagaaguuugcagcuaacacggggaaagccaaggacauuccaauacccaaccucccuccucuggauuucccaucuccagagcuuccucugauggagcucucggaggacauucugaaaggauucaugacugacuaagauggaaggccauuggagaggcuggcgacaguuaauccagaaaagaauauaaagggaaagccacgccccaggggaaugccagagaugcuccuucaucugguaugcugugggagaagaggcggugccaggaccugggaaagucacugugaaacaucacuuaccuucgucacgacuaaagcucaugauuccgacucggcagacacugaacucuuggcgguucgcuuucuuaugauacaaaccaaauggcuaccuggaauaauuuuucaaacaguuauuuuucuucaggguuaaauguauaaaaguaugucauuaaucuauaaugccauaaaugauaaugcaaaagcuaaauaugguggccugagaggcucacuuguauuuggaacaugcuuucuaucaugcguugacuguaugcauuuucugcacauuguguuuguuugagaugugguguguaagauacacgcuuccagauggaacuguacgugccacguuugcacuacucguaacauaaugagaaccucaagacuaucaggagaaauauuuaaauuuccauuuuaugaagaaaggaaccaaauuauuaguuacgcuuuuuaaagaaauuaccaguuuacauaauuaaucagggugcauuuaaguucuaaauuuguguuauaugaugcaucauuugaaaauacugaggcacucuccuuugugcugaaugaugcaugugugaaagcaaugcuaguuagcaguauuugauuguaagaaauaaauaaaauaauuguguuucauacaaaaaaaaau

SEQ ID NO: 7449 - RNA, 18628 nt, Mus musculus
caaacgcagggcggaaauaaggcuauaguacacgucuccagagggggagauaggcccugcgcaggagcauuaauuuauuuccguuuguaguucucagucuggguaugcagccugugucugcgcauuaauugugacgcaccaaggcuggccuuuacgccggagccaauuggcccgccggugugggcguggcuagggcccgcuaacgcgcacgcgcgagccacaucgucuguggucguccgguauccgaaguccccguguucgucaugucggcgucugugguguccgucaucucccgguuccuggaggaguacuugagcuccacuccgcagcggcugaaguugcuggacgccuaucuccuuuauauacugcugaccggggcgcugcaguucggcuacugucuccucgugggcaccuuccccuucaacucuuuccucucuggcuucaucucuugugugggcagcuucauccuagcggguaaugauucuguauccuggucauaaugucccacuuuggcgcgcagcuucguccucacgguacccuuugguaguuuguagaaggccgucgucugugaagucacgcuuacuucuugggauccaggaagcaggcucagaaaugucacguuucuaaugccuaacaggaguugaaacugaauauguaaagaaauagucuucugguguucgucgcaauuaauacuucucuaaggaaaaauauccuaccuugaugaaacuuuaacacaaauuuaaaguugguagagcuuuaaauuaaaaugccaagcugagacauuucuaucacuuuggccuaaucccuacuucaucuaggagaagacuuuggugauaguauaggaauauaaauauuagugacugcuugugaggaggcaacccaauugaugcuggcuuuuuaguugccccuacuuauuucugugcauaauuuaugugcuuuuucucuuuacccucaacucaauuuuuauucacacaauuguguauuagcucuucuuucuucuacacauuuaauaaccuuacagacuuccagguuuaaugaggauugccgccauggauuucaucugaagucugacuuuucuugccccauggaacugagagaauacugggaacagguuuggcuuaggaauguuacuaccaaauguaucauggucagucagcaguguuuuggggguuuauuagcaauuguuuuccucagugaauuacagcugguuugggcagagacaaaauauagcauuggacuugucuggagacuugauuuagugucuuaacauaaaccucacgucacauguacacauucacauugcuaggucaggcccacugggaacaauuuuacuuuucagaacuuaaauaggccccagccgacuugugccccagucagagcuagagcugcaaagucagcuuauucaguggucaucauagugucuuugguuuuugguccaguuucuggaggcuacacccuaaccaucaggauauguuagcaccauuagccaggucugacaaaccucucuacugugcccaguacuguucccgacagagaacaguaagaggcugagaaccucuuacuuauuuagccucugguuauggaaguguaggaacagaguggggcuaacagcugauuuaaguaaggucucuccuguugaagccacccaucuucacaagccucugaguuaaguccugacuuaccagaacuacauagaaaaaaagugauuugcuggaaaguuagguuagugcgcucacacucucucuuucaucccaucugucuuucuuuuuuuuuuuuuuuugguagaugacuuuugcuuuuuuuuuuuucuuuuaaagauuuauuuacuuaugugaguacauuguagcugucuucagacauagcagaggagugcagaagaucuuauuacagaugguugugagccaccaugugguugcugggaauugaacucaggaccucuggaagagcagucagugcucuuaaccacugagccaucucuccagccccagccccagcuuuugcuuuuuuuuuuuuuuaauguucuuuuaaaaguauuuuugugagcaucuuugugugcauauaauguauuguaaagugucauuaugugucagugugcauguguguguauauggagguuaaagagcagaaguauucauuggcuagacugaacuggcugguggauagagaacucuggggagggagugucuuccuguuguauggugucuugucugccucucuccaacucucugcaacuccacaguuaaagaugugccagcaaaccagguccuuaugcuuugaggcaggcacuuuaccaacugaaacaccucuccagcuccuaaguccuguuuuugugccuguugaggcugaaaugaucagguuucagugggagguauauauauggcuuguuauugacuagacugcuuagcaaaggaacacuguuaguagugaggucauuauuaggagugagggcauuauuagugaggacauuauuagugaggacauuauuaggacauuauuaguacugaagucauuauuaguaguaagauugguguuaguagugauauuuacaaaucuuuuagguaacagggaauagggugagagaaauaaaauuggguuuaaggaaaagaaaaaguuucugauaauucauuguugcugaagaaaguuaucauuugcauucucuucccuucagugaacucaggguauuuugucacugagcuaaauucucagauccauucaucauccacccaccuauccauccuuucuuuuuuuuuuuuuuuuuuccuuuuaauuucuuuuuuuuuuuuuuuugagacaggguuuuaauguguaucccugccuugcuggaacuguagauuggguugaccuugaacacagagaucaguguaccuccauguucugagugcugggguuaaaguuguaucagcagccuggcugccauguuucuuuugacaguauucauuuuacuaagcccaacuucuuuuacuaggccagaucauugccugguaacuuguuuggccuucgcucacauuguugagacaggagaccucaggccugguguuuuugacuuuucuguggucuuugggaagagacuggaaggggcagcuuuggugagggagguuauaggaaauucugggggaggauuuugaaagaccaaguggcacuaaugcuggagcuuuggccuguuucuguaggagaucaucugagaauuaacagugacagcacaggcagauagauggcucagugggugaggguccuugucaccaagccugagcaucaccugaguuugaucccuggggccugggucgggaggagagaaccaacuccugcauucuucucucaccuccacauggacacacucacacuaaguaaagcguaaauagcaugcacaccugcuguccaacaacaguucucuuuuuggaagugaaggggcagacuugaaguugauguuaguugcauguccugggggagggcccucuuuggauugagucucuccaugcuuuuggcugguuguuucuuuugcauguacauuugcucuuuagaaauugguuaggacacuguaaaugaguuuagaaugcuggcaucaaacaucugaauccugaaaagacacaaugcugucuucuguuuccucauggcuggguggcuuauucagggucucaggaagggacuugaggugagagggcacuagggaugggcuuguucagcagcggauaguguaguagguuuuuagaggaccucagggaagucauuuuccuuucucagccaugcucagcagcugucuuuuaucuuccuguuagcuaucacuagaggaggaacaucugucgagucagaguuaacauuccaguguugguagucuuuguaguuuccuuuuguaccuagcugggaucugcucaucucaagaacuguuuagggagauuaaguggcaauuaguuaagucugucuuuaaaguaagucuuacuaggcagacacgccaccacugagccucgucccuagucugugaagucauuguuuuaaguuacuuuacaacuuugguucguccguacucaagcuuaggaaacaguuuuaugggccggagagauggcuuaguugguuagagugcuuacagcggugaguucagauaccuagcaccaaugucagaagcuaggcaugguaccuaugccuauaaccccagugcuggagugggggugggaggcgcagggcagugucuaagaggauugcugagucuugcugccugccagcucagguucaaugagagacccugucucaaaggaauaaggaugaaagagagcaggacacccaauguccucggccucugaaaguaugcacacacaggcacgugcaucuggacacacgugcacacacgccacacacacauauaccacauucaugucucugucucucacacacacacacgacgacauuuacaaaguaaaguuuuaguacucgcaguuaagaaaucacagaggaguuugcauuugagagacacggagacuaacauggaguguuuuuugucucaaggaagccauuggcuuauguggacugggguggagcuacuuuagggaguguccuuugaucuuuggauuccucucagcuacuguccaggaaauugggaguuugccaacuucguggcugauugucugguuucuaaauguccuauccaucacuuuuuuauucucggugucucaggcugcuuccuagcuuugcagcccgugcgugguaucucuuuuagcuugaucugauuugcacgccugaucauguuacuuaaccaaauuugucugugguuuccaaaguagaguuuguguuuuguuuaguuuguuuguuuuuucaggacacaggcucuuuugggagcugaccuuguuaacaccaccuucuucaucauugucuagugucaguaagucauuugccauuccgagguucuugucccuuuacucugcagagcuugguucacaucugaccccucucaguucacgguuguugacucuuccaguggacccagggcucucuuguccuugcuugcguguguaugugggggaugagguaaggaagaggagaggugggacucuuccaauagccuguauuucuuguacuugucugcccucugggaggcgagggcaggcgcuuucaugccugcauccuugugcuuguuaaauugugagcacagcugucuuaauuuaaggaagauggaggacuguuugccagguucugugcuggugugcuguggauucagcugugaggaucacagaugcggcuccuccuuaagagucuuacagucugaaggaggaugcagacaggucucuguggaaguauugcuagugaggacaggagccuaauggcucccuggcccuuucagugcucaugcagugugucccuuguguguccacuucccagaaugugcuucguaacuucucacaguuuucuccauuucuuugccuguauucacaguuuaucuuauauauuaguuuuuuacuagcaaagugagaguagccaggagucuguucaucuucuaguggcucacaccugcuccugugccucugcuguuugauucccucccaugucagcucuugcacuuacauacacagaggcaccagucuucucuugguggcugaacagcuucuguggugaucccuucauucagcauuguggguuuucucuauugagucauucucaaguuuuagacuugcucuaauauugucuaaucuuacaguugaaccaggcacgguggugcauacuuuuagucuuagcucuugagugacugaggcaggaggauaucuaugaauuugaggccaggcugguuuacauagugaguuccaggccaaccaagacccugucucaaaaaggaaaaagaaaauaaguuccagucgaucccaggcacugcuagcaaccaucgcuagcaucuuuuccuucucccuuguuguagagcuucuugaaggaguaguugcugugucucccuuacccccacauauuucucagugcucuugugcuguggccuguccccaccacuucuucaaacuauuuucccauguggccagauggaguagucaucugccucacuuuaccugacugcucagcauuaguauuuagcucaaauggcugguucuuucugagugaaacacucgcuucucagcgcucuugugacugccucuuccucguuccuccucaccuccugcuggcuuuuccuucccacugugcugggcacuucauuuuguauuucuuuccauaggugaauuuuuuuuuuuuuuuucucaacaggguuucucuguguagcccugcuguccuggaacucacucuguagaccaggcuggcuuugaacucagaaauccgccugccucugccucccgagugcugggauuaaaggcgugcgccaccacugccuggcaccauaggugaauuuaaguucuguauccuguccaguugguucaaaauaccaaauccacuugcugacguauuucucuuugaugucucuucaaucgcucauguuuacauaucccaaauggacauuccccuuacccuccuucccagccaucugcuuuuuuaccagccaguguacagugucagcccuggguagguuguucagccagauauauaggaggucuuuuugaucucauaauuucucucaacucccacauccauuucaccagcaagcuuugucuucucuggaauauaggcugucucugucucuguuucugccuacuuuuaccaccuuaacccugagcucuucauuuccuaagucauucaucuuuaguccugcaaaccauucuuauguugcagucuggccuuuuaaagaaugugagucguuguugcuuggcuagucgaacccuugacuguugcuucauugcccuuuggcuaagucuagacucuguccugaguccucaauaucagugaccagauagcuuggaaguggcaagacuguuuuuacuaucuguauugcucugccccagaucuuuaugugccuggcucuuuagccuuuaaauggucuuuaguagcauuuuuaaagacacgacuacuggauacaacagccuucuagucuccuuaucuugcuacauuuucuccacaguguguaccccacacagaauuuccuugcugguuugcagacuugugacuggagacacuuguuugucuccacggacuauaggucccucgggagccagaguccuguaucugguccugccaucuucccagcgucuagagugaugcuugacucauagcaggcgcuuguuacagcuuuugcuaaacacaugagccuuuaaggagaugaugagcagaggugcuggaugggcagucaggaggcugucgguuuccgucucuggaaguccucagggagacgcugaacccucauuucuggagcacuuucuuuaucugucuguguccaagccagcugagggauauggcauacuuacgagugacacaggauuuggaggguuggugguucucaugcucaucaaauccaggaccugguaaguguccuucagacaauuucccaggcucuucuuuggaggcugcuuccagcucaccugucucccaccacuuccuggacauugcucuaguuugcuuucuauggcugugauaaacuacgaccaguagcaaccuggggaggaaagggcuuauuugacuuacauggcauagcccuuuaucaagggaaguaaaagcaggaacugaagucaagaccauggaggacugcugcuuacugcuugcucaacucguuccuuacacaaccaggaccaccugucuaggggggauaguugcacugccuacagugagcuggguccuuccauauuagucauuaauuaggaaaaugcaggagggaugacucagcaguuaugaauacuuuuauaguugcuuuucuagaggacccagguucgaauugaaccuggcaccuugaggggguuugacaugcucuucuggccuccuaugacaccagguacacaagugauacacagacuuacaugaagacaaaauacccaauaaauaaaauaaauuuuuuaaaaggaaaaaaaaaugcccccaacccccccagccuagucugauagaggcaacccaaagccccacaugcaguucccuagcugagguucucauuucagcugacuaguuugugucaaguuggcaaaaagaaaaaaagaaaagaauccaacuagcauaggcauuuuaugcaccagaugggguguuugaagggcuagagaauggcucagcaauucagaguguuggcuauucuuccagaggacccagguuccauccccagcacccacaugguuucucacaaccauuuauguaacuucaguuccgggguauccagugcuguccaguaaccucaaugggcaccaggcgcacacagaugaugcauguauacacauguaggcaaaacacucauacacauacacuaaacaaguuuuuaaaaaugggguguugaucucaauggccucugagguccacuggauaguugugggguugacuugugcacuguaacuuaauuugaguuguuauagucauuuuaaggugacuagcagcucaugacuguauccacuggcacaaagcuuuucucuuguccccucauaguuacuccagacacuaccucauuuucuaucccagugcuguuaacaguucuguaucuauuucucuagaguuuuugcuagcugacaaguaagugauagacuagauguaaaguaaauaugaacauaguaauuauauauaaaaguuacaguuuuagaaagagcaguuuggggcccacggcagagcagcugcagaagcaggcagaccugaguuaaggucccagcacuccaggucugucacccaggguggaggaaggggaaggcaggcagaccuugaaccucauuggcuagccagaccagggagucuaagcuucaaguagaaugucugugagaauccaugaguucauaagaacucccuucucaaaaauaagguagguggacuggaaagauggcucagugguuaagaucacuuccugcuuucagaggaucugaguuugauucccagaauccacauccaaccuccaggaaugcccucaucagccuuuuaggagcaccuguauacacaagucauauagacauggcacacagugaagugcgcgugcgcgcacauacaugcacacacagauacacagagacauacacacagauacacacacacacacagauacacacacacacgcaugauaaaaaugaaucugaaaaaaauuaggugggaugugaaugaggaagauuccugaauuuaaccucugaccuccacacacauguaugugugcaccuacccuuauguucagcacauaugaacauguacauauacauacacaaaauacagacauuuacacgcaauacuacagacacauacaaaaagagagcugacaugaguuagugauuuugacuauuuuuuucacucagugaaaguggauagcuuucuuguuaguguauagagaauuucccuuagucugaauaauugcauaggauuucauugcagguguguaguaugauuuaauuauuccccuuggugacauuuggagcauuucuuuuuguuuucuuucaauuuugcaaaccuacuguguuuuguaagacacauucauuguuaaaagguaaaaacauuuuaaauacuaagugguauugccaguggcuuucccccagagguggacuagccuggccuuuuacagcaaggcuuuaagugguuuucuuacuccagccagugcccuucauaaaggucagugcacuuccgcagugugucugugcuuagguugaugggaacuguugccauggugaugaacucuggaggacuaaucugaucauucugucuucucaguggauucuuuguuaauguuggaguggaugcuagccugaagcaggugcaauaauuuauugaagccauaaaagguguuugagcagagaaugccccuggagcugcuuuucaugucugggugacuggcugccgccucguuagagacuucagggauacagaaacgugggaguagagaucacugucaagagucuuguguguuggaucuucuguugucuuuugugacaaauaaagccacuagaacuuuaccaaagacaguguaucuacagcaggaggcccuuguggaccuucagcuguacuccugaucucugccguguaucuucugguagaagaugauuaagaugcuauagggucaucauucaucccagucuucguuacugcugcaucuguagcccguguaggcauaauuagacaccuugaagucaaccagcuuaagagugcuuaggcaguuaggaggugugaguaagcuuacagcuuuagcaccucugauguguuguuuucccccuuuauuguuccuuuaauaacggaaaguuaagauuguaaagguauauaauuuuaugaguuuuaguuuucuauuuacuuuuuucaguuuuuaguuauuggaugugugugugcugucaggcuugucggcaaauguccuccccagaaagcuaccucacaaucuuagugugauauuuuuugagacagugucugauguagcucagguuccccuuggacuugcuguggacuuggagaugaccuugaaugauucgcccuuacaccugcuccugcagugccaggcugcagcggugcagcaccauaccuaguuuggggugagguuuuagacacuccggucuaacuaugaugacuuggaucaggacagaacguuaucacuacuguacagguuucuugcauuuuaagccaugauucuguccugagagaugaaagucacuaucugucuuaugcuacuguagauuuacucagccuauuuuguuuauuuguuuuuguugucuugacuuuuugagagagugucuuaacucuguaguccagacuggucuccgaacuuguggcuguccuccuucagacucucacguucugggaucacagguguggaccaccaggucuggcugguuugccugguguuaaggcuccuuauguaugaaucaucuagugugcacucuucauguuugaguugugcugcauagcguggugaauuccaucuaacuuggauguagcagaaguuccuuuucauugccguuuaguuuuuucuugucuacaugugguauguagucucccuguacuguuaauagacauuaacuucuagacgguguacagacaucacaggggucacuccugugcgugccucuuggcugugcugcuuucauuuuauuagagacuuuccaucacgggauauauuuguguauugauuagcaaucauuuguuuuauauuucugaauaaugacuuuuguguuuuguuucuuacccaguuugccugagaauacagaucaacccccagaacaaggcggacuuccaaggcaucucuccggagcgagccuuugcugacuuccucuuugccagcacgauccugcaccuugucgucaugaacuucguuggcugaacuccgucuccuuaccguggaguuggagguuggcggagcguaaguggccaucccagccuugugcugcugugcugauuccagcagguggauuagaugggcugguucugguccuggucggccgaguucccaugguacaguaggguguuugcaggcuugcccagcuucagcgggcagcaguuucaucgcgcucgucagccuguggguuacaggugugcucccaaaggcuuuugaagaaagauaaacugcaaguuuugcuuuuagauuuguucuugaguuuuuucccaauucugauugccauugauguuaaauauuaauuauggccauuguugccugguagguacucagaguagugugaauguaugacagcugcuucuuaggaaugugugcccugaacucaaaugguaaaguuggauuaacuuaugagaagacuuaggaccagauggguaacauucgguuuguuugcuucaucccuuguuaagcacgaagccaucuugccccccccaaacaaacuuuacagaauuuuaauagggaaaugcagguaggccuagaucucuuuuguagagcugaaaauucucucugcccucccuucauagguugugugcccuccucuccacucucccgucuugucucaguuacuucauuaaugcugugacaagacaccauggcagaggcagcuuguggaagaaaguguguaauuugguauugauugcugcaaagaguuagagucuauggcugucaggguggggagcauggcagcaggcaggcuugguguuagggcaguagcuggcagcuuacaucuugagccacaagcuugaaacaaagcuaacugagaguggcaugggcuuuugaaccugaaagccuacucacagugacauaccuccuccaacaaggacacaccuccuaauccuucccaaacaguuccaccuacuggguggaagcauucaaacauaggaaccuguggccauucucauucagcccucuacaucccagaagcagagucuuaaagcagugaaacggacaugauuuuucccaacacauauuuuuccuugaugagagaaaaugagccgggaacaaugcaguugcuucccagaugcacaggcgcacgauguagaguauccucugccgcuugauguuuggcccuaugcucaugcaacucagggacgaaugccugugcuuuuccuuuccuuugcacaauaagauuucguacuauugcuuccagguggcaagagaagagaaucuuaggaaauaauaaccuuuugggagaaaaugucccagguccacccucuuuacaucacuacauggaaaccuguguguugguacugagagccucagaaaccucacacgagaaccagggaugcauggugugugcagaaucgcccagucccagaucgcagugcccguccuuuguugaaaguaguaggcuccuagaaaagguggggaaacgcucuugucuggggaucgcccugcacauuuuccagagaccuuugacccgauacacgcuagcuacccuguggucccacacaucugucugucccaucugugugguuuucauucagcugugugcucuaauggucacacuaacucagaagguaggaugaaaaggaaaacaaaaacaagaccacucagugcgcuuauaaaacacucauuccuaagacacuggcgguguugaugcccuuauucugugaaaugaauuacggggcuauagggcagcacaguuggggcuagauucucauguugcugccuaacagucuccuuauuuuccaguugacagaugggcauuuuaaaaaauuuaaugaauuugaaggugguauuuaaaaccaggaagaaaaggcauaucaaaagaaaauggcauugcgcuguaaaagucagugugacuuaggggggccagugaagggcaguugcuucaaguggcgcucacugcauguccuacaagugcuugugaguaucauuugacuuucaaauggccucaagcaggcgagccugccauucccauuugcagacugggcacugagagacccagagagcacaaggagaaaucuuucauuuguuuuugcuuugaaacagacucucauguaggacaaggucgcuucaaaucaguuauguacugaaggauggccuuguguucuugacccuccaacccuugccacgugcugggauugcaaguauagguccucaguuccugggcccaauuuuagauccuuuuucuaauuuaaaaaauuuuaauuuuaauuugcauauauguauaugucuuguggguuuauguauguuagugcagguucccauggcgaccagaagugaugggucuccuggagcuaguuauaggcaguuaggaacugcucauugucguguuggguaccaaacuugggucuuuugaaagaccaguuuauaaucuuaacugcugagucaucucuccagcuccaguuucaagauuguuggcuuguuuguuuguuuuucuagacaggguuucucuguguaguucuggcuguccuagaacuugcuuuauaccagccuagccuccgacucagagauccuccugugucugggauuaaagaugugugccauagucugcccgguuucaggguuuuuaaaagaaaggaugaaaagggagauggcgcaccauuggguugcauuuggggaguucacauaccuggcgauaugggccaugggacuggggaaagugacgugggcaccaagaauaacacaacguuagugugcuugccuuccuagauggagguuguugccagaagccugggcugaaauuuuguuaguucugcuuuuuuaauauuauggggagagucucuuacuaucuuuaaaauuucguagcauuuaauccuagcuagugcuagaaggcuaccuuuaauccuagcuagugcuggaaggcuaccuuugagcugacaguacuguuuauuacuaggcaauucucuuucuuucuuucuuuuuuuaauuuaucauaauuuaguaaucuagagaauuaccuugggaagggacucaaacuguguuccuuuuuuccaucuccaucuuuauuuuuaauuaauuaagagacagggucuccuuaucccaggcuugccuggaacuugaaaaaaaaauuguuguuuaaaauuuauuagauuuuauugaggggggaggagcuggugugugugugugugugugccuagaacacauguggugaacaggacugacuaccucugaaagcucucuccaccguguggguccuagggaucacacuggggcaucagcauccagggaagugcccauccucccugagccagcccacuugcccuggacuuuaaagaaaaaaaguuuuaauuuauucuuuaacaauuucacacguuuguaguguauuuugguaguaccgccccuaccuaguaccccaccacaugcucuuuucaaauuauuuuauaaccuaccgaguccauuuagggcuuccugcaugcauaugggcauggggccaucucuucagucuagaugguacccucugcacucugccgccaucuaguggaugcaccuuuccuaugcugggaguggaucacaaagcauaggaauuguauuuugguggaacaacuaaagcuaguuccuuucccgucaugggagggcagcaaaggcccagguaaguguaaaugccgaccagggguuucuuuccauccuggcuaggagauggcagugcugagcuagggauccuuagcaggacccaggcuugucuuccucaccugugcugauaaaugcaggauucacaggguucccuuugucagugucuggacuuggcuuucauucauucuagacccuuuauugccuccagcucggagugcccccuggcaauacuguucaguguuuaguugaugagcgaguggguccccuaacuguaucucggugccucagcccucagggggcuggaaagucagguaacuucuuuaugauuggucucaauaguuccuaaaaagcauuaauugauucuuuuaauuuguggcugaauuauucugguuggucuuuugaaggcagagagcuagacagauguaguuagauuuauucguguguguguguguguguguguguguguguguguguguguguggugggggugugugucuguggauaugggcagcauggcagaugauccaaggacaauguucggggguugcucucuccuuccaccauguggguccuggggauggagcgcagguugucaggaguagcaggaguacccacugauccagcucuuuuuuuuuuuuuuuuuuuugagauagucuuguucuguggcccggguucuucuugaacucacgauccucuccuuugccuccugagagccaggauauaguuuacugggggauccgugaagaauucgguuccuguccugaccuagcuguuuaccuccggcucuggugacuccagcccuaagucauuguuacccacugggcugcacaggcgccuggucccugggcucucaggcccacagugcacaccucuugaacccugcauugucacauugcuuuaaaguuguuaaauccuguuccugcuccaccccccccccaccccccgcccccagguuccugaagguagggaccuuaaggccgaucccaggccucaguuucccugccuguacagugaggagcuuggccuucauuguaaucucuuacagcuguuaacuuucacuaauacaguuaugaugggcacugugcuguggacuccauuuugguucgaguucucucucucucucucucucucucucucccccccucccuuccucccucccucccuuuccccccuccaguuguuacuuuuuauucauauucucaugggugacugaagggagaacauuaaaguucaaaauaaaauguccaguguuacagaaccguccaucuauaagaugcuucgucagcaccacaucuuuaggauuccugugucuuccacaugcaccuuauaucagugcauauaauuccccugucugcccugugcgcggggagacagauagcuguguaugugccugcuuugaaccugaaggaacuuggccuccgcaaaauuucaguuggcuuuaguccuugguacuaagugacugagugggcacuuaauaaugaauguuuggauccuaagcucugauguucauugcucucuauuuucaaggacuuuugaguaaugauuuuauauauauauauauguguauaugaaugauuauauauguauguuuauguguacacacauacuuagaggauuguguuuguuaaaauauuaaacuugcuuaaaugggaaagguuacgagugguuuauaagaagggauaaagacagauaacccagguguuucugcaaaggcggcaucauuaccgugguacaggagaguuguaggagcaugcagcuugggagagcugaggugaccucacacagcaccuggguccucugagugugugugcgccccacccacaacaguggucauuggucacaugauuaauguugcuugguggacuucugaaaagggacucaccaaccaaggaacuaaguuuuaauuuccuuaauuuauuuauauuuuauuuuuaucauacagacucuucugaauccuuagcuagccuugaacucaauccauaguuaaguucugacccuccugccuccccaaggccugggacugcggacgugagccagcaugccugacacugugggcucuggguguugugaugcuacagcacccugccaccuguccccgcagcccugccugcccgugauuuaaggcgguuuuaaccagaguuaaauacauguguguagcugcuggguacuguguuggacagaauagcuguggauaaaauucccaagcuaccaaguuguagauuuaucauuucuaaaggagaggauuggcuuaguugcuuucuggaguguccuucauuuuagaaguuaugaucugugccuuguaauauuagagugauucaacagugcucugcucucgggaguugagcacaguugucucugauuuauaucacccuaguuccagcucugauuggguggucaggauccagggaagggcagcauuugaucguaucuguccaauaauaaugacagucuagagaagguucugggaaagagcccacagucccaggagcuguuguuauuuucaucuauagaaugaaauauagaaaaugucauuuucauuauuucuuguauuuuuccuugcuuucuauuagggugauuagaauaggugggucagaugguacuguuucuuccugggggacagacuggggacccccucaccucucucaguaggugucuuccauucugcguguuucagugacaucagggaggagauuuugaggcaguuuuugauagcagccuuuauucugcuuguagauauaaaagcauucuugugaguugcucacugguccauugugccagcauuucagaaaccccaaggccucuguuugagcacuugccaaguuuguccucacuggagaagacaaaacaggguuuucuggaaacuaccaccaaagacccguucuuuccugagcuuuuccuuucugguggacuggccuugguguguaagggucacauguuuuaguaucagaauccacccugcucuuagcagcaaccuggccccacugcaggcauugcucaccuuacccaaaguaacuuaugagaagugagaacuaaauuaccucuucacagaccugacucuuucugagguuucugagaaguuuuauccacgcucuuuagucuguccucaaacuggacauuagugcuuugaggaaugugagggccaggaaggugaguggcugguggagaguuaggauugguaagucaagagcuggcugccagucuccagcaccucaacggccuuuuuuuccuuuucuuuuugugagcuuggaauuucugugugagcauaguccuucuagaggcuacucucauacaacgcuugugaaacauuggccauguucugguuauuguagccugggauguaacacugagaugcacuuaggagugcggcagcugucauguggguugagaguuuagauggaaggauuugggacaugacacaccuuugugcuucuuucaggcucacucuuugacguccccuggaucagcauucuugagcuggcagcuuguugcacauggcuucuucagauucgugcuugacuacgagucucacugguugugagguggcacguccagagaacucccuucgcucuaucggaccaacuccacaguguacggcuguuaacacagaaucugccuccccucacuguagcccuuacuuuccauauuaaaaacauuucagccuccaagugccau

SEQ ID NO: 7450 - RNA, 418 nt, Mus musculus
cacacaagagaugaagccagagaggaaagaguugaaggggaaggugcccacgaggagacaguagccgaacugcagcgccccggucagcaguauauaaaggagauaggcguccagcaacuucagccgcugcggaguggagcucaaguacuccuccaggaaccgggagaugacggacaccacagacgccgacaugacgaacacggggacuucggauaccggacgaccacagacgauguggcucgcgcgugcgcguuagcgggcccuagccacgcccacaccggcgggccaauuggcuccggcguaaaggccagccuuggugcgucacaauuaaugcgcagacacaggcugcauacccagacugagaacuacaaacggaaauaaauuaaugcuccugcgcagggccuaucucccccucugg

SEQ ID NO: 7451 - RNA, 418 nt, Mus musculus
ccagagggggagauaggcccugcgcaggagcauuaauuuauuuccguuuguaguucucagucuggguaugcagccugugucugcgcauuaauugugacgcaccaaggcuggccuuuacgccggagccaauuggcccgccggugugggcguggcuagggcccgcuaacgcgcacgcgcgagccacaucgucuguggucguccgguauccgaaguccccguguucgucaugucggcgucugugguguccgucaucucccgguuccuggaggaguacuugagcuccacuccgcagcggcugaaguugcuggacgccuaucuccuuuauauacugcugaccggggcgcugcaguucggcuacugucuccucgugggcaccuuccccuucaacucuuuccucucuggcuucaucucuugugug

SEQ ID NO: 7452 - RNA, 47689 nt, Mus musculus
  misc_feature (9161)..(9260): n is a, c, g, or u
  misc_feature (15640)..(15739): n is a, c, g, or u
  misc_feature (19478)..(19836): n is a, c, g, or u
cuuaggaacauaacuuuuuuauuguuuugcaucugugacaguuuuguguuccucugaaggagacaaguuuggagcauuguuggcccuuguaaaggaaagaggaguggguggccacacccaggugcugccaggacugccccaaaauggccuacuuccugccacagucugcaucauccauuuaugaagucugaaacauguagcaaaacaaauaaauuacucuucaucccucaaaagcaaguucagaguugaagcugccaagcuugggcuccuggaccgugccuccaggguucuggccaaugggagauacgaaacacccguucuguccacaccucagaaucccuugcucuauuuagacuugggaucuuguuuggacaacucuccaucuuccaaguccauuucugcagcaacugacauacagaggaucuggagguaccgugugauagaggcuacaaagagaauugaauuuaauucaggaguuaaaacugggaacagguucagggggcugaguucagggcaccaaaggggcuccaggaaggagugauucaauuaagccauaugguuaauggcaggagccagcuaugguaagguuugcagaaaagggcaaaaaccaaucuauucggguagcugacccacuugguugugccaagcuuaccuacaauccugcggaggaacaguggucguuugugcucuggcacucugaugaugaagaaguagaagggcaggccugagagugcaaugccaaugccgaugagggaguugauggugucgcuguaaaguggaacagccaccaggaagauggugcagaggcagaagaugauggggaagaaaaggcugagcuaaggguacagaggaaacaguuagcucagcauggguuuguuucuugcuuguuauuucaagauagucucacuuuguagcccaagcuagccucaaacucaucagccagccucagccugagugcugggauuguaggcaucgacuggucccuacacccaguaacucagaauugcugacaacccaaacaaccuuuaucccacaaagauaagagcaccaaagggcuuagagacaggacacacugguaaagcacugccuucccauugucugucccauaaccucaagacagagcuccauuuuaaugagguaccuaaaggccugaagggcuuagccaauuaaacuccucuuccccagacacuccucccugcaaaagguauuaaaccucaggcccaaccugagaaaguaggguacagucuuuacucaucaacuucccgccaugacacuaaauaucuuaaaaccauggacugucucuucaucggaguccacugugggaagcaauggagcacgccuucaucuaaagagccagccaccguuaaauaaccucucacugucucggggcucccagccucaaucuccaccaugccaagcuacucaaaaggacucucuccuccccgagggacccagccagggcuguccuccugcccuuuucccuucagcaccaggcuagauccagcccacagggcccucacuccauucuugugggaagccacaugugccauugcagaguggcacugacuacugcuggccaccacgcauaaguuuggacaaacaaccaauguguacauaugcaguaaaguuuuuugcaaagacacugccuagcccgggcaugauaaugagguucuguaagguacugagaguauaaccaaucagaugugagacaugcaaaugagguaugauaaugagguucuguaagguacugagagaguaaccaaucagaugugagacaugcaaaugagguaugauaaugaggcucugugagguacugagagagaguagccaaucagaugaggaacaugcaaaugaggcguagugcauaaccaauccggguguaagacaugccucuccuaggucuauaaaagcagcacuaguucugggcucgggucuuuucgccucuacaaucaagcucucccaauaaacgugugcagaaggauccuguugcagcguuguucuuccuggccagucaagcgcacacaagacauucucagcucuuccauggcauccagcagcaucuguggugcccaagagucugagaaccagauguccucggucgccgcgcaggcugggaccccccgagccaacucugccaguccccagggaccucagacuguauucccccacccccggagcagcauucugagguuucucagagcccaaagccugcucagcgccagccugaggugcgcacugucaaaacuccuguaucccaccucacccagcgcuggugccccgagcagacacaggaccccaccuuuaacccacaggggugggggugggggcugcuuauuuuagggcacugggaugagacagugcugaagaccaacccaaggccuuguguaugcuagacaaguauuccaccacugagcuguacugagcuucaguccuuguugggguuuguuugggguggggggcagguuguugguuuuucuuucuuucuuucuuuuuuuuaacuaaaagaaaaaaacaaacaaaaacacagggucucauagccuagccuagccguuuacaacuggucuucaugccuuuaccucccaaggguuaggguaacgggcaugggcuaccaugcauggcuuccuagcccuuuuguuuuguuucagggugguauuuugggguuuguuuuuuuaaugcauauuuugcugcaugagaagcuagagaggguauuggaucccuuggaacuggaguuagaugguugugagccaccaugugggugcugagaaucaaagccagguucuuuguaaaaucaaguacuuuaaccacugagccauguuuccagcccaacccuugggauuuaaaaaaaaaaaaaaacuauauauauguguguguguguguguguguguguguguguguguguguguguguguguguguguguguauacauauacauacauacauacacacacagacauagaguuuuauuuguuuuucugguuugguuuggguuuuuuguuuuuguuuuuuuuaauguucauuaguguuuugacugcauguguaagggugacagaaguccuggaacuagauucacagacagguugagccaucauguccauucugggaacugaaccugagucccauggaaggacaaccaguguucuuaaccacugaggcaguucucucuagccccaagcacuugaugguuuuuguauuuaaguacacugucacucuccucagacacaccagaagaugucaucagaucccauuacaaaugguugugagccaccauguggcugcugggaauugaacuuaggauuucugauuucuguaagagcagucuguguucuuaaccgcugaaccaucagccccaacccuuagguuuuuuuguuuuuguuuuguuaauugcagauaagugcuacuaugccuggccuagggaaaaaauaacuucuuguaaggucccugcaguggcagcacuaacuguacuaaauggcgcaaaggucaguaagggggauggauuaccuugagagggcgaggccggucgggguccuuccagcguagauaaagcugacccacaauagaaaggcccacaaagaaccaguagcugaagcuauaguaguuaaugagcuggaagauguccuccacgcacagguagaccagggacaacacacccuguugguacaaguccaaagucagcuccucucuggcuuccuucccacucagucccucccaggucacagcuucacagucugcaauucggccuuccgcccccaaacucuggagcacucuugguacgguaccccucucuauuaaaagauaauugccagcugggcagugaugacgcacaccuuuaaucccagcacucuggaggcagaggcagguggaucucugaguuggagaccagccugaucuacagagcaaucuccaagacagcuagggcuacagagaaacccugucucaaaaaacaaagaagauacuugccucucaauuaaauuuuuagugcauucuucaagcccuugccagguuaacccuaacacuuuaagugucuuaggcagaagucuuagguaaaacccuguagacucuccaacuaacacuccuacuucgaugacacagcuccacaaagcuuugucacaggacuucaugaugcugccugccuuaccuaaaacccauuuccacuacccuaaccuuuuucucuuaaagaaugcaucgcacccuauugugacuguuacucauuaccauguagccuggcucucacuccuucucuugggccacaugcaguuggcacuuuucacuuccauccgcagauagcccagugcaucaggagguuccaggccagaacccucuuuauggcuuucaggagcccagacuagccacaucuaguacuaguaagaccccaccaccaccuggcugucaggcucacucacauugaagaguagagaaggcacuggugugaaccguucaacaugaaccauacagauggcgucagggagguggccuucucucgagcccacaaauaaaagccuguugagauacaauaagagaagcugacagaacuauggggcacuuagggcagccugggucaccugccacagcauucucccucucugguaucccuuccaaaggucugaauaacagaagggaguucaguguggagcuuagaacugggggcggcuaaugggaacaagaagaaagggauggggaauacuggcaacuugggucccaguccuagaaguuuaacuaucucuaccaaagcuauucaugacacccacgcuaugagcaaaaagugacagucauaccuggaagcagccacgauggaggcguugagcccaccaaagcaagagaaugcaaccgcuacuggaauuauccaauugaauacuccaaaaauuugaucugcaaaggucuaggaaaaaguagcagaagucauuagcagauccuaacaggacgcccagacauaugcccaaaguccucaggaauccagucccucccacagugaagguaacaggaccuuccugaaagcccaguauccuugaguucuuaucaggcugucuacuccccucccaggacugagcgaacuggaacauguccagaagcccacaacacacccucaaccugcaagugaaaauccuuuaccacggcaacagcgucacuggccaggauuuccuuuaugucuagcacacuguaauaggccacauuggucaagagguagaugauggugacgauuggcauggaaaugccaauggagaggggcaaguuccuacagccaaacagaaaggaaaaaggaucugucagucccaccauugugucccuaccucucuguccuuaggucugccaugccauccucucuagggaugcagauggcugugguucucggguccuuugccuuugaaguugccuugaaguauuggcguaagcuuuaaacccuuaaaaacuaacaaguacuaggggagaaauacuccguuacagaaguuaugcagagacggugacacugcacguaguagcucuugcuuaugguucccacuacccugaaggcucaguaggaggaucccgaguucaagaucugcagggaccauucagugaaaucgucucaaguaaaaacaggcuagagauggcucaguguugagagcaucuguugcucuuacagacaaccuggguucaguucccagcacccaugugguagcccaugguggucuguaacucuaauucuagaagacuugaaacccucuucuguccucugaggacacugggcauaccuauaugcagaaaacaaaaaaacaaaaaaacacccacacaaaaauuuaaaacuauucuuaaaauaaaaaaauaaagcagggcugagggcagagcuuaguguaaaguauuugucuagcaugcccgaggguccuagaccaaaucuccaguaccacuggaagacagcaacaaaagggggggcugaccaagguuacauuauguuccagcauaacaggaaggugggugugauuccuuucuacaaccaguagucagguaaggagucugucucugagcucugccaguguagcuuccagguaaggaacagaagaaacuagagaggcagauuguggacucucacuucuucaguagaaagaacggugugugcauccaaacaaggaagucauuucagagaauuccaggugccauucuaaguggcagccaugaaaaaggcacaaugacaccuuaaggucucucaagugcaaaaagaucacugucuguauaaaugccaaaaaugaggaauaaauaagggaacuggaucugggauccaggacacauuugcagugguucaaccuguggaucucgaucucauucauccuacagauagauauuugcauuacaauucauaacagcaaaacuaguuaugaaguagcaaccaaaauaacuacaguuaggggucaccacaacaugaggaacuguauuaaaggguuguagcauuaggaagguugagaaccacugcucuuuaaagccuugagcaugauaacaaaugcucuaccaugagcccugccccaaucccucuguuaauauugacugggucucaguaaguuucuccgagaggccuugaauucacucuguacuuggcuuugaacuugggaugcuccugccucagccuccagaguggcuggguuacaagccuuuaccaugagucaggguugcaaauuaucuggagucauucagcuccuugccaguagguggaagcaccacuacccagucucuuuucccuucuaguaccccugcuccuuggucacagugccagcagcuguauaccagaaaagcggcucgguuuucaaagccaaaagcuaacugguaugagaauuguuauaauuuaggcaaacuauuuccuggcaaaucuuaguuucuaggaucauaaucuuuuagagccaggaaaggccauggagauccuguaauuccacccucuuaauauuauauuaccgaagcaggcaagggcuagggaaauggcucaguccaugaagccacuugcaaggaggggcuggguuugaccucagagccuacauggaaaggguuggugcguuguggaggauggggugcccugauucugaucccagaaucagagaaucaggaacagaaggacccuaggguuccacagccugccagccuugccuaauuagcaagcuccaagucacugaaggaaucagucuccaaaacaaagaugggagcuggagaaauggcucagcugcuacaaacccaaguuccuccagaggaccuagguucuguuccgagugugcaccuuaauggcucacagcuaugcacucagguucacacacacacauauaaaauaaauacauuguuuuaaaguacacagcaccuaaggaauaacaccaaagugguuuccacaagcaugugugcacacaccccgggcacauacuuauacaaaaaaagcacccggcaaacuggucauugucaagaagguuacagauucaaggccagcauggagugcacacauagugagauaauaucacagaaaggaaagaaaaaaaaaaggaguuuuaguaaagaaaaucaaggaauggccagguauggugauguaagccuuucaacccaacacuugggaggcaaaaagaacuagaucucugugauuuuuugaggccaguaccaucuggauagugaguuccagagcagccaaggcuacagugccacagcuugucucaaagcaaaaugaaggaagaaaacagaacagcaaguucauggcuacaaaaaaggaaaaaagagucugucaaggaaauccaggccccaagcucaccacccaaagcucuucaucugcaccacggcagggcaguucagagcagugcuggugaggaaauccagugaauggcuggaacaguuccacacuaucggcaggaaucaggacagagggaaagaacccagaagggaaaccaaagaagaagucucauagacgguaguccuaugaccuaaaauuaucuguaugggguaagggugagugacgucugaagacagacaaagcuucaugagauuaucucaguguuccucagauuaggucacaaaccugucgguaaaagcgaaccucuugcuucacccucuugaguagcuggcaaggaccuugcaggugucuagaggcauauuuaagcacaaaguauaaccugcuuuauuuuagguagaaaugaguacauguacaaaccuuccuaaaaggauuuauaaagcauaugcaagaaagcgcacaucugcacacagucacuacauacagccauggacaaguuauaucucuaggucuuaaaucuguuaaaauucagccugguggaaugaaucagccaggcauggaaacaaugcuacccccuaguguggccggguggcggggagguaccuaccucucgggguuccugaucucuucggugacauaguuaagggugucccagcccgaguaggagaacagggcugaguagagugccagagcaaugucacccauugcaaaggaugagcccucaaaggaguucucaaaguuagcuguggcuccuggaaggugagaacaacagaagacacgaaggggauacagucaugacaggaagaagucaagugacugaccaggguaagaaacucccacagggcccagcagggcuagaaacaggugguguucuucucuacacugcaggcugccugagcccuaccuacucucuaacacuagucagggauaacacgggaagagagaagagacgagauucaguaugcccaggucaacagggggcguugggaaggcuuuagcccuggaaaccaugugggagagaugugaaggagugcucaucuccaagggcagaaguggcagaggcagagcaauagcacuaggcccagcaaacugggaaagccaauucccagggugcagcagcugucagccccccugccaaggucaguuuccuaugggaggcagcauugccaaaggaggaggacaggcuuaggagugucugcagggggcacacguuucagcucuucuacuuaaccacugggaacuugcacaagauggucaaccuggggacuuuguuguuuugcuucaaaauagggucucgcuguguagcccuggcuggucuggaacucgauauguagaccaagcuggccucaaacucaaagaugcucccaacucuaccucugagugcugggauagagcaugaacccaccacaccaccaccaacaccaccaccaccaccaccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccaccaccaccaccaccaccaccacccagcuuuuguuuuuguuuugagauaggcucuucugugucccaggcuggccucgaguucucuauguagcuguggaugaucuuucacuccugagccccuuagugccaccucccggggacugggguuauagguacguccaucccguggccuguuuccucacuuauauaaaaggaauaacagugcugaccacauaugguauuuggagguuuaaauaaggucaguuagagacuuauacccggugaagguguagaucugagacacaccgcuugcccagcagggcccagaacucugggucugcuccccagcacuccaaagaaaaagaaaagaaaaaaggaaaguuuaauaaaguuaguugcuauuuuuuuucuuacccuggccaagucuaacaaugccugcaaugaugacugcaaucagcgccaacaccuuagcauaggugaaaauaucuuggaccaggguuccccacuugacauaggcacaguuaaugaagguuaagagaccugaaagaaaaacaacacugaccgugaccuacccucugcacuugaagggccucagacucccaagcagcuuccccagcgccacucguggagaugaacccaucauggggagucagcuauguguuuggaccccgauuauccucagcuucaucacugcaaggcacuugcugagcaccuguuguuuacacugccacauucccaagcccuagccccuuaaacuagugucacagaacaagauggcaaaauuccuggucacagaaguggcaagcaccugggaguuguacagauuacagguguauucuaguccuucauucuuuaaaucccuucucuccuuccuaucacauacauacacacacacacacacaggucuagaacccaacaucuuggcucuauacuguuguuauuaaucuugccaaguacugcuguaauuuauccagugucuaggucagcaggucaguauguguguccaaggauuagaauagagaccaaacuuccagcccccugcccaccggccugugcauuguaaaacucgugcagcuaaaacaaguuuccgcagaaagagagcggggcacuuuuccugccagaauaaugcaacaguaugagccauaaacauuccucaaguccuuccaccccgggcuagaggcaaucccucugccagggggaacucagggaaaguucacagaccauacucagaguaaauguucgcagcagggugugacagucucuugccaagugcuguggcguaugaacguacacauucuucgaaaaacgagucccuaucuuucgucaaaaucugaguaguagcugaggguguggcuugguuguagaucguguguugcagugcgggaaaguccuggguucaaauccuuucaccccaaaaaauaacagucucaggaaaauccauuagcccaaaagcuacacucuauuacuugggaagaaauucaagaagggaagccucgaaugcuaugaggcugacugguagcucggggggagggggguacuggggaggggggagcaagaggcagaggcagcaacccugcggcccaucaugcagccucuucagcaggcagcaucugcaccccgcacccccaacccugcgcccaccccccaugccacagggaaucaauggccagcuucuucuagcucagcgacuggaacgcccccacagagcacuugacugucaagucucccuucgguggcucucagagcaaagcuggccuugccagugaggaaagggaaggccaacguaggucuugguugauucgggcuaccaauacaaucuuuuaaaaauaaaaaauccaaagaaaacaagagaaaccacuccaagcccaagggcagcagcucaggcucucacgcagaagacugggacaggaucuccuaguccaaaggagacuccaauuccccaaaccccaaaacacaauccaaauauccagaaaugggcucaaccuggacuagaggaggauuucuggagguuagauaaaauccggcauuccucaggacccuacaaagccagcuccccucuaccaaaaggagucuuuccccaucacuggcagaggauacaaauggcuaccugugguaacuauucgcauacgcgcauacuggccucuaggcucccucaguaccacaggcaccugucaaaguccacacuagcaucuagcuauucucaccuccuccucucccuaaauucccuccaguucacaggcuucccuccccucccccccggggggggguacucacucuucuuacccucccacuugucucccccaccccucacucagcuccaccccccucugcucuugcuuuuuguucuauucucuaucccugcuauccuccccucccuccagauagcccugccugaguccagucugcuggccauguucagucuccugcuuguucucucugcucuggacucuuccaggggccucugguggaucgcuuucucuugucuacaauaaaaacccuccccuucaccacaccauggagcaguuccugucaucacuuuauacacccacaaauuuuaaucugaggucaccuuggauuagauagugacuccuaaacuagccuggacuauagagaccccaucucagaaggaaagaaagcaaucuuacuaauucggaguccugacaaugcccccaggcuccacagaccuccuacaauuauuagguccuggccuuguugugauucugguccagaggccuccacuaagaaacagggagaauaagccaucuucucuuccagucuuucuucuaaccuuacugugucuguguguaugcgagugcacacaaaugaggagugugugcucaccccuacaggcacaugagugugcacucaccccuacaugcauacguggaagccaauaucgggugucuuccuccaucaccucucuaccuuaucuuuuauuauaguuauucccacguaagugugcaugccacagcacacacguggaggucagaggacaacuuguaagagacaauucucuccuucugccauguggagcucaggggucaaacuuaggccugguggcaggagccuuuacuggcuaagccacauugucagcuuguccgcccuacucuuuuuugagauaaucucccugcaccuggaacucaucgauuucccccagguacucagcaagcugacucuuuaagcaggcccugagggucuaaacucaggucuccuuucucgagcaccaggcacucugcccagugagccaccuccccagcucccuuucuacguauuacccacguuuuuuucuguuuucuucugaggagauuucuggcucuacucaaauacaugucuuugugccuaauagacauaacaguaaacaaccaaaccuuaucgaaaggcugagcaaacacguacccaucgcuccaggccaccccggugcuaaguuaaucauuaaagacgguaguguacugucuccucaguaaucccacaaaauaacgugucuuuaucuugcccuccacaagccugucagacacugcucuuccucagccagugguccaucccucgcuacccacuggacuuccauccugagcuauuucaacaccacgagaaaccugucucucccuaucuggcaauggccacucuccaccuuuaggcucugcaagccaaguuuucauuagaaacgccaaacacagaugugcuuugccuauguaugcucaggagagugggggccccuagaacaggaacccccuggcaggaaugaagacauucuaaagugaaacuuauaucucuccccacuuuuggcuagcagaucauuaagccguggucccaaguaaguuggaauuuccuuaggcaucccgugcguagaaaagaaaagggcugaagccuggugccggcugcaggaaaaccuagugacucaaagugauuucacacagcguggcaucuucucaggccacuuugcuagagacauuagaacuaaggcgaugaggaccagggugguggagaccauucuuuuaccagggcugcuuagcugugcaugucucucacccucuauuuagaccuaagccucauauuagaaucuacugaaccucuuugcuuguucguuucccuucccaguguugccauacugagugcaucucccucugcaucuacucuuacuuugucucuuugaguggccaacgaugccccagggugggccagccuagcaggguaaccauaggucacagcaugggacuggaauagacuuaaaggacuacuucugcuucgcagagucugcagcuccaugucacagggcacuuugucuugguucuguucacggucaugagcacagacaagacagcugacucacgccuuuucuuacagcgaccccggccaggagaaugcggagcagcgguucucaaccuuccuaaugcugagacccuuuaaugcaguuccucaugccacagugacccuccccaaacaaaaaauuuuguugcuacuucaccauuuuaauucuacuacuguuaugaaucauaauguaaauauauguuauguaggguaucugacaugugaccccugugaaagggucauuggacccccacgcacacucaucgaggucacaacucccaggcugagaauguugauauuuugaucccuacggcuaggaucacuucaucccuucuguuaccugccauguuccccacuacuggggaacaacccccagucacagacccccaucaugucccggucugcucucuguacugaacuugaggaggggaggcucaauuugaaugcaaaacccuacacacagagacgggagcacugagagaaccggcugaagggagcuggcucacaccuugcacagcucccagcuuccuccagagagccuggcccugggaacaggaaaugaauaaggcaagccucaaugcugacuaggcucuuuguccccaccccuaacagauacagcugaccagaguccccaaagcucagccaaaaguauggcucuugaagcaaagccccaccuccugcugcggagucagaggaaggagaccucaggguuagaauaauagggauggaugcaaguuagccuacagacaaagacaccugcccuucuaccccggcggguaauucaguccccacccaauacugagccaaguccaugggaggauugccuaaaaugaccuuuaaccuugacccagcugcuacucuaucccugcaaggcagcugcugggaagaugacacuccugcaaccugaagaggcacuccaggacaggucaaccccagcagacacaaagucucuggggaggaugcugucaugagggcccagaauccgcucuagaacaaaauggaaaugcccagguuguucugaaaagggaaggugggagaccgaucaguuaagaguacuugcugcucuugcagagaacccaugucuaguccccaacacccacacaacuaacuacccauaacuccgguucuaggggaccauacacaauuuucugaucucugcaggauccuccaugcacacgacacacacaugcauccaggcacauacacauaagauaauuuuuaauccaaaaguagcaauaccuuuagccugcucugaucaaugcccagguuuaacuucaaauagucuaaagucucaccaacaaacugugaguccuuaucccguagagauuaauccugaagcuuacaaguuaaauguuaaugaugcuuagauaagcuucaguacucucacgggaugggaccacagcagcgacaacguacacugugcuggaguaacaaacguuggucucauuguucacucuacuuuugcauuaauaugugcuugcauuuuuccacaauaugcucuucuuaauucauagaguucaaaauauaacagaaugaaauuaauaccaucaaaggaugucagggaagcccugucuccuuucccgcuucuuacauguuuuguaaucuuuauugggaaagcaaacugccuuuuucuaaucugacaaugugugccacacgccacaaguccagaccgucuaucugguccugcaccuguucuagccuuccugucugcaugugcaccacaugagugcgggugccugagaaagccagaggccugagcuacaggcgaccugugugagccacucccugugggugcugggaaucuaacccagauccuguacgagggcugugacugcggagccaucucuccagcccugguuuuccugcacugauggaagauggcuuacaucgcaauagcagacccuguguguggugguguggguuggccuuuaaugccaacacuggggaggcagagaauggugaaccucugguuuugaguuccaggcaggccaagggacauaguaauaccccugucucaaagacagagagagagagagagagagagagagagagagagagagagagagagagagagagagagagagucagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggaaaaguccaacaaugaaaguaacccuucucccuaagguaaggauacaaugaagaggcuggcaucuuugugucccuucuaagauaugggccacauuuuguaaguaacaaaggaagaccuuucuuuucucuuuuccuuuuuccuuuuuccuuuuucccuuuuucccuuuuucccuuauuuucccuuuucccuucccuucccuucccuucccuucccuucccuucccuucuccuuuccuuuccuuuccuuuccuuuccuuuccuuuccuuuccuuuccuuuccuuuccuuucuuuucuuuucuuuucuuuucuuuucuuuucucugagacaggguuucucuguguagcccuggcuguccugaaacucacuuuguagaccaggcugaacucagaaaucugccugccucugccucccgagugcugggauuaaaggcuugcgccaccacugcccggcaggaagaccuccuuuuaagcacaggaaccagccucccugaucgcaggcagagagcuguugguguuuagcggcacuguuuauuacaguaguuagaaaguaaagaaaaagaaggggaaaaucucuggacaggucucaguaucuuguuggacugaacuuuuuuuucuuacugcaaucaaagaauauuaaaugugaucuuggccgaaggggcaggggcacuaaccagagugcugggauaccaaacucuggcccugugcaagagcagcaaacacuguuaaccagugagccucaugcaagucagccucucauucauaucguacaccccaguucuagcaaauacauccgagugugauccuucaccaccugacucuaaccaagucccacuccgagaaagagagagagaagcugcugguuacaccaacacacaccacaaacaagcccgagagacaucuucaacuuuuuacugacucuucuuuucugaugucccccagguguuguuccgggucacagaaacauuucacugacucaugugucaugggggaagaagauccaaacacagaguggccaugggucacugaaucagaccccucccaguguccuuucuagaauucagucagcacuuuaaacacugcggcuguggcaucucuaaggaagcaagcacaugguuuauacauuccccuagauuucuaagcaaccauaaggcaggcaagaugacucaguggauuaucuugguuaucaagguacucacagccaagcccgacaaccaaagucugauccccaggaccaacauggugaaaauagagaaacaacucccacaaguuguccucugaccuuucacaggugcacccuggcacaaggccugagaagucaccugccacgcacgggaaggcuccugggcaguucugacuugggaaguuggaacagagcuucccagagcagucugguaauaugccgcuuugcauuuaacugggguaauuaccucaugagauaaucacaugcagaccagcuuagggcagaacaugccugaaccuuuccuuagccugggcuccuacaucucuguggcacauugucacugcuggcaaugaagucaaagccucugaggcagcccugcugucaccaaguuguuaaaacucagguaccauggcaacacugagaccugcucuuccaucuccugcaucaggagacccccccagcucuccuuaguaguaauuuguuugguuuccucuagucuugcccucccacaggccucugccuugucugucuaaguggcucagauacccccaagcagggaggauggaaggaauguuuuggaguuuuuaauucuuuggaugagaguaauggccaacgccuuucaucaugccgaucucuguaaguuugaggcuggccugaucuacauggcaaguuccaggccagucaagacuacauagugagacccugucucaaaaggggguugguguguggcuacagagauggcucagcauuuaugagcucuggaugcucuucuagagaaacaggauucgauucccagcacccacagggugguuuacagccaucaguuccaggggcccagcaccuucuuucagccuccaugggcacugggcaugaacauacuguacagacaugaaugcaggcaaaauacccaugcacauaaauaaaucuauauuuuuaaaauucucuugauaaucccaguguacagcuaagauucagacccacuguuccaggcaauucucccagcauuccucuagaacaucccuucgguacuucugaaguggagacaaagguaacagagaaaagggcccaagaaugaaccccuaagagcuauauggguuaaacccucacacagcugugccccuucacuucuggagaggaauuugcacugauccuauacuaggaauaacccuaaauucugaugccacccuaauugcuaaggugacugugggacaugaccuaacucaaacuuaagauggauggauccuuggaaaaccucuccaagauaggaaacuaacuagcuuccaagaagaaauucaaggggcaaaagucagcuggaggcccagcuguuccgccucauuagccauaagcacaugaggucagucacucuagucaggaaaaacugcacgaggacauauggucaaagaucucagacagacacacacagagauccgaaguccuucacaguccaccaucuggcuugucagcucuugaugaacugucuguccuucccucugcccagcuucuacagcagaccacaggccucagccaggacccuagagaguccaccgcacgaaaugccccaucucaaagaugcugaaucuugaguucuggcuucuguauagucagcaagucagcgucuacuaaggauccuauuaguacauacaguucugcagggccaaguccagggcaugcaaagaugcuaugcccuguucacagcccucaguaaaugcugcugguugacucaggcagucggcugacuagagacauguccugucaacaaagagggggaaagcuaaaccaaaauaacuaacuugaaaugaaugagaauaggcaaggcgagaacagcaacguguagccgugcucaguggccagagcauccugccuccgcagaaggcuguuugggcaagcauggaccuccagaugcuuauucaaccugggccagccuggucuacauagugaguuccgggccagccagugcuacauaaugagaaucugaagagauagacagagacagagacagagacagagacagagacagggacagauuaucgccacccccuucccuacaauggucuagcaucuccccuccccugccguccaucgcacucaagguuccuugaguuccugcuuggaaucuguuaauuccaaaugacuaaccaauuucuucuagaaagaccgcuuugaggaugaacgcaccagcccuggcacgccgcuccucugugccgccccccccccccuuccucgauacuacaguggcuuagaaugguuuaugugccuaccuugagauacguaaagaaagaccguuuaauggaucugucuccccuaggcacagcacagaaauaagcucauaacaacacugaguagauuuuucuuggugaaauaguucugaaauccaauuccaaccucacugccuugaaauugccuuaggagaaagcccacgugggaagucaccacuggccucccuguaacucauccuuaucuagcuuggccgcuuagcgaaugagacacugcugcucacugguuauuucucaaacugcucucucccggucaccaccucucugucuccccucuuannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaugauaaaauagaguaaggggguuggguugguggguagagagcugguucugguucuugcagcucuuacagaagaccuggguuuaguucccagcacccaugugguggcucacaaagcuaucuuaacuccaguuccaagagaauucagcacucucuccugggcucucuggacacaaagcauucacccaguacacauacacacaugcaggcacuuacacacauaaaauaaaaacauuuuuuuaaaaaauagacuaaaggagccaggcauaguagugcaugccuuuaaucccagcacuugggaagcagaggcagguauaggucugugaguucaaggccauccuggucugcauaaauaguuccagaacagccagggcuacauagaaagacccuacucucaaaauaaauaaauacauaugaaguuuuuuagaaguaaaaaauaaaaauagacuaaagggaugcaugaccacucagccaacuccacagaggauaucugaaagaaucuuuuuagaccgaagagaaaggcaaguccauccaugaggccacaagaaaugaacgaauagaauuaacauucaauaaggaaggaagagaaaaaacaagugcuacaaacaaauggucaggaaucgacacacagcuuccaauaauaacgcugagcacugguguccucaauuccccagucaaaagauacagacgagaagacuggauggagaaccaggagccaucuaugugcagccuccaaggaauuccccucaccacagaagacaaacccagccuuagguugccaggcuggaaaaagauuuccaagugcacugagcgagugaacaagcagcuguggcuguccuaacaacagacagaguuccaaccaacacuggugagaaaggaaaacgccaccacuucaugcugacugaaggaccaauccgccaagacgacaggaugguucuaagcacuuaugacccaaacaaaggagcacucaaugucauaaaacacacaguagcacaguuagucacagaguggccccagcagagcagucacgggagguuuuaguaacccccccccccuuuucaggaaaaggcagggcacccuaacaaacaaauaacaggcacagcacugcaugucgucucucauaugugguccuggcuuugaauuuuuagauuucuguguuuaaucuggagugucuacagagcuccagaggcuagagcccgugagagggagguggggucccaaaugguacaaggggaagccugcauguaugucuguguagcaugcuuggaaagccugugaagucagaagagggugucagaugagggauacagaugauuaaaagaaaguguaagaugaaggaacccggggcuuuaaguacccaagcaggauugggggacacgggagaggaggguuuggggguacaauaguccaaacuaagaauguaugaaaauuccuuauggaaagccacuauuuugaggggcugagagauggcuugguggagaagaccugagcugcauuuucagcagccacaaaggcagcucacagccagccaccuguaacugcaguuccagaggaucugacacucucuucugaucucauaggcauuccaugcacgcuacacagacauaugcaggccaaacacccauacaacauaaaaauaaacaaguaaaaaaaaaaagguucuaauacaaaauuuuuaagggaauuugaacacaauaacccuucauggguggacaaugggucucagaagacacgggucauuaaauaaaaaucucagcuccaggccugggauaaaucaucauacucaguuacuacauacugaguacugguuaaggaggccccaaacaacaaagacuauugauauuacucuugguugcccaacucaacuagauaagacccuauugcuguaggcaccacacagaagaggaaugcccuggaaacagaauuauaggcacugaugaguuaccauguaggugcuagggauauaaaaacccagguccucuacaaaagcucuuaagaacuaagccauguccccagcccugaaagaacuucagaauggugucugccuuggcuuugcccagguuccaauccagcuauacugguucccuauuuaggauaagucugaacccccaggaaggugcaacucacaaucuccuacaaguacgcauaccccauauuuucucucaccugugugccuuuccccaugucuagaaagucucaccaccaacaccccuucuucaaaagauguaaugauuccuagaaggagaagggcauggaugucguacagagggcagaguaaacacuaagcaaagcaaagugcuuauucccaugauauuugccugguagaggaaaagguggacaauaagcaaaugaaucacugaugcuggguaguaaugguaccacagagcaaaaugaaccagggagcugggguggggcucgggaggagagagagagagacagagagggggaggaagaggaagaagaggagaaagaggaaauacagagagaagagagggacccaucgagauggcucaguggauaaaggaaccuaccaccaagcccaaugaccugaguuugauccccagaauucacacgauggaaggagaaaguuuauuucuggucauuuuucucugaccuccacacaugugcuaugcacgccuguacacacucaccacaccaauuuuuaaggaggggcuggagagaugaugguucaggaguugagcauacuugcugcucuugcagacuggcauucgguucuccccacccacaggcagcucauagcaaucuaacuccagucccaagagcccugccugaugccuccugguguaaccucugaguguacccauacacacuuggcauucacagacacacacacacacgccacacacauacacacucaaaaauauuucauaaagugucuuaaagaaaggaagaaacaacgcgggaugagaagccgaggacuuacucugguccuucugcuuccuuguuugguucugguguugaggaucaaacacagagcccaacacaugcuagacacaugcucuaccucugagcuacaccccaaucucacaagaaagaccauugugacccaucucccagagaagugcauggagcgggucugugaacaucuggggaaaagagccuuccugguaaaaggaacaaaccaaacccaaagcagaaacacaccaggcagcauuuagccaaagcaagaacaagccugagugcagcaaagagaccaaagaggagaaggcaggaagccaggcaaggcagaacacuuaggcacgguagaaaucugagugcuucagcccaacucugaccccuccaucuuucaacacagaugugacaccauccacugaguguccaccccuccuagaaacugccacauacauugcuggguauauauuugccuggcuccucuaccacacuaccaaugacauuucagauucauguuuuauaaagccugcuacaaucaauaaaaguuuucuuuuuguuuuuugcuuguuuguuugggauuuguuuuauuuugguuuuuuuguuuguuuguuuucuguuuuaguuuuguuguuguuguuguuguuguuguuguuguuuuugagacaggguuucuauguguuggcccuugcuacccugcaacuugcucuguagaccaggcuggccauggacucaagagaucugccuaccucugccucccaagugcugggauuaaaggcacuucagugacaguuuucucagcucagauuuuuaaccauuguccugauucuguguucugcaggcaacuuccuggugacuacuuugugcuucuguggcuuuucacucugcuaaggaaagggggugccuucacagugaccauuugcaucuggucauagcaauuauacacacaugcucaccacuguacccuaacaccuggcaugucaauuucuuuuuaaauuaaacaugacucagcuucccggaaaaugaccgaacuccaggucacagugacccuggggaggcauugcuuguaagaacuaagguaggauagaaggucgagggaagggggagagggggaaaucaaggggacaugagaagggaagaagcccucacaccagagucuacuugaaauccugcaccagcugacgguggagaauuuugagacaacugagaaaauuugccacaaagaucaccuaaagguacaacauuccuuccauguagaaauaauucaaauaauguuaacauuaaaauggaccaugcuuuuaguuuaauuucauucuuuucccccagaugcaaaccuguaauuuuuugaggaucucacuaguacaauuauuaacuuuguuuguaaucaaaacacauuucuuagcucccuugugaaccaugaaccacccuaugaucucauuuaccaaagaggaggggaaagaaguucuuggaaacucuuugaaccacaucacuucagaaaccauccaaaguauguaaauggauauuguugagagcuuaagagcaagcuuuucuagagaugcucacaaccacauuuggguaauuagccccuuuuccuaaguaucuuucuuccccuuaauggucaugcucaaaccuauauuaaaaccuuuuguuuagaaacuccaacuuugggggcugcagagaugacucagccguuaagagcccuuggugcucuugccaaggucuggguucaguucccagcaccaacaugguggcucacaaccaucuguaacuccacuuucaagucguucugaugcccucuucuugacucuguggguaccaugcaagcaagugguucacuugacguauaugcagacaaaacacccauacauacaauauaaaaauaaaguuuggacuggagcagcucagcagccaagaguuaauuuuaaggaccagaguucagaucccagcaccucuaccaguuuguucuaacaccuguacuccaacuucaaggucucugaugcccucuuuuggccucuaugggugccugcacacacaucugcguaaauaaacucacauacacauauacaaaggacacacauauaaauaaaauaacaagaaacuccaagucuccggcugcggagaggacucaguggccagcgugugugguggacuugcagaaaccuaaauguuauucucaauaccuauuucagguggcuuacacacaccugugaucccagaaugcaaugccucuguccucuguaccauccacacgcacaugcacauagccacauacaagcauacacauaauuuuuuuaaaaaucuuuuaaaacaauauagugaaugccaaaugugauggugcaugccuuuagucccagaacucauaaggcugaggcaaguggcucucucugaguuuguuugagccuggucuacaguuuuuuuaaugccaagccauggugucauguguuuaaucucaacacucaggauacagagggaggcggaucucugugauauagagaccagacuggucuagugauauauagagugagacccugucucucugucccucugucuuucucucucucuucccccucugucugucucccugucucucugugucucugugucucucugucucugucucugucucugucucucucucucucucucucucucuaagaugagacccggcuucucuugaauggaacucuacaaagaacuccucagguggcugcagaugcagcaugggucucuuguugacccaggaccaaaggagcccaggacagacccaaaaggauugcaggagcccaggucaagcccaaaaggcccuacuuccucacucagcccaucucccuuguuuuaaaguguggucccacccacaacacccuucucacuaccaaagccccagcaauucucuauccaagcccucaucucugucccuaaggccacucacuccuuuucacugcucuccaugaggacucugguuucuguuccugaaugagcaucuccaccuuccuucucacauucuuuccaaaaacacucuccacguggccaccagaguucuccuuggaacgagcuguguucauuucaggaccucuccucuccuucaacuucaccugcuuugcaaaaaaccagcagcgucccuacccucaagauccaguccauauuaggcaccauguagagccaucuucaucccaggccaucucgcugcccagcccacauuccagccauucaacuaccuagaacucucugaacauuccacacacugaugagucucugcuucuccacaaauaggguuuucacugagaaauuagcugcaugucuccucagcuaagacucaugccugaaccgagaaauucugccaggaaugguaagucaacacuugaaauaaccagcaauggggagacugagacaggaggccagccugggcuacauuuucaaaacaaaauaauaaaauaaaacuaaaguuguccuccuggcuucugucaugccugucaccacacuuacauuacggggcacacuguuggguggcauaucugucugucucccuucugcccugugaggucuugaaagaacagggauguccauuauuauucuuucccagcaccaaguguaauaucuagcacacaguaugccuacaucgugcuuccagaagaacagaauaaaugagggcuguauauuaaagucuuucucuuguuaaacaugaaaaauuagcuugaguccucacuuaggccgcuuagaaucucagcaucugacuugugccaugagcuuaugaaacgguaauggaaggaccgagcuugugaauccugucuuuggaguuacuaaagacagaacaacguccagauacggccuguguaaugacucgugcacaugaccacuugggagaaagccaagcugcauuccuguaaaguaaaggccugcaacacgaugagauaccagcuucaagcaucaacaaucaauaccuuacacuugaguucaauguaugguuuucacaguguguguguguguguguguguguguguguguguguguguguguguguguguguguguggacacaguauaacccuuggcuggccuagaacucacuauguagaccaggcuagccuugaacucaaaaagaguucaccugccucugucuccagagcacuggaauugaaggagcacuguaccacacaccacccugcuuguuuuguuguuugguuugguuugguuuuuaagacagggucucgcuacacaggcuaggcugaucuagaacucaugauaaauccacuuuuaccuuccaaaugccagaauuagagacaagagccacaugcccagcuuuuucaccagaucucucagauacguuaucuagaacucccgggcucaaguaauccuccugccucugcuucuagagcagcuacaucacugcaccuagauucccuggcccucaggucauccucacauuauacugaaaguaaaggcucucugcuccuugcaccuagaagcacacaacuguuaggcucagccucaaacacaaguagagcacacccuucacucuaccaagguuaucuuagaagucugccuuucgggcuuuggucuggcagucaauuuagagcaaccccaagguuaaggucaggaucagauccacauaccaacaggucugggcagucauccugccaaagccacaggaaaaaaaaaaaaaaaaaaaaaacccgacaucaucauucccaccucucaucccacauccacgaaacaauuagauccugucccugcacacaggcagacuuuggcucggaggacuugguggcugcacucucuuugguccacacugccaugaagcauggaaaaaaacucaaagaaguaucccuagagggguccaauaaaaggcucucaccuggccucagccuagcaccuugggagggaaaguuguucaacacugagaaacgcagagaguuugaaaccagaggagacucaggagaugacaaccgggccucgggaggggacugcacagaggcagcagaccuccucaguuaauggcagcucuccagccgggaccaaaagcagaagaagugugcacagaacuugcuccugccucaggcccuggacucaagcaggaaccucccacugagaacuccaaggcagcagauugcuacagaugugugcuaaccaucugucucuugcaccuugaguguuuugaauauaguaggugcacaauaaaccauuuugagugacacacacacacacacacacacacacacacacacacacacacacacacacacacgcugcccugaacccacaugcaaaccccgugccuuuuacugacaggggaaguccacagauucuccguagcuauggcuacuuugcaugcuuucuggaacaaguguauguagguggguguucaagaguuugaguacauuccuauucucaaauuagagacaucagaucagaggggaguggcagauguaggcagguauaaugccagaaucaagggaugacaggcagcugucacagguggcacaacuagacaucagggaagaauaaagcccagagaacugaagucaacaguccgaagccccuaaagcagcaaauguucuuuccuacccaaggagccugaggagaccucaccgucacagaaaaaucgagauguguugaaggccagccuuugugauuuagcaagacccugucuuaaaaggaaggaagggaaaugggaaaagaaggcugugcgguaauaacccugagucaucagaagaaaugucaaauuacaaaggcaagcaaacgcaccacuggcuuaaaagaaaugucagcaaaagugguuagaauaauagaagccugucgcuuacagugaugcagucaccuuaaaaauaucacuuagagaaugagcccucucucuacacagcuauguuacuuuucgccacaucugaggagcccaagacuaacauaacagauccuaaaaggaggcuggacagugagugaccuccuaggucacacaaaauugccacgagaaaaauuacagaccacaucagacacuucaggggaaaggccuccccgagagugcccucugcccuuccugacuacagccucgccugacacacaucccccacgcagagaucagcguaggccacaaacaaguaaaucacaaaaaaaaaaaaccaaaaacaaaaaccagucaguuguuuacauagcguaaagcaggggaacggaggaugcggagcagagacagcagcaauaaagaaaguaagagaacaggaaauaagguuaauggagucaggccagugaacaaggcccugguguaaaacuccugcacucccuggcacugcuccucugcaaacagacaagagugucugagcuucacagcugaaggaucacagucauccccaaggccaucacccucugagaggagacuggaaagaagggacuaugggcuagccggcucccaacaccacuaauguggcucucuauucauacagaauuuaagagaagaaaaagugaagauggaucgaaaugucuacaacucuggcccauagaaauacucgugcaggggcuggugagauggcucaguggguaagagcacccgacugcuccucugaagguccagaguucaaaucccagcaaccacaugguggcucacaaccaucuguaacaagaucugacucccucuucuggugugucugaagacagcuacaguguacuuacauauaauaauaaauaaauaaaucuuuaaaaaaaaaagaaauacucgugcaaacugcuucugagcaacuugcuucaccaacuaaacucacacagacuauggugaagagaugaaaacauguauccugggcuggaagagcuggcucagugguuaagagcacugacugcucuuccagagguccugaguucaguucccagcaaccacaugguggcucacaaaccaucuguaauaagaucuucugcacuccucugcugugucugaagacagcuacaauguacucacauaaauaaauaaaucuuuuuuuuaaaaaaucauguaccgggcuggugagauggcucaguggguaaaagcacccgacugcucuucugaagguccagaguucaaaucccagcaaccacaugauggcucacaacgauccguaacaagaucugacuccucuucuggugugucugaagacagcuacaguguacuuacauauaauaauaaauaaaucuuuaaaaaaaaaaaucauguaucaugcaauagaaaccaaaauugaccugaaguaccuguacuuuuaucaaacagaauacaauucaauuaacaaacuuuaaagucucugggugugauagcacaaacuauugaucccaaccauucaggagguggaggaagguggauuucugugaauuugaggcuagucugaucuacacagacaaucccaggcuagccaguacuacauagugagauccuaccucaaacagcaaacaaacaaaaccccuacaaaguugagguaugagggucacaugaacccaagauuucgaggacagccuggguaauauaaaaacuacaaggcgucagauaaaaucaaagccacagugauaaagagaucaauccaacaagaagaaauaauagaagcuagagagaugacccagcagaugagauauuuacugccuugccaaggaccuggauucuguuuccagcacccaccuggugguucacaacuacuucuaacucuguuucuggggggaucuaaugcucucuucuggcuuccucaggcacugcacacacaugacccauacauacaugcaggcaaaacacucauacauguuuaaaaauauguauuuauauaugaaauuaaucuugccaggugauaguggcacacaccuuuaauccuagcaccugagaagcagaggcagguggaucucugaguucaaagacagcauagucuacaggguaaauuucuuuuauaaauaaauaaauaauaaauaaauaaaucucucuuuuuuuuuauuguuuuucuuuugacacaaggucucacuauauauauaaaacccuggcuacccuggaacuuucuaugggacuggccuugaacucacagagaucugucugccucggccuguaagugcugagaugaaaggcaugggccaccacaccuggccuaauaaauaaaucuugaaaagaaagaggaaaaggaggaagaggaggaggagugcccaggucccacccaacauucagcuagcuggggaagauaacaaggguggcauuggugaucagggucaaaagcgaucacuucaacaauuuaacucccucuugcuauucaggggccaaaagcugauggcuucuggcaauuaacuccugcugaauguagcaggagaauuagaaaagaaacuaagcugccugggcucuuuacucuuugacucaggcaucuagcuauccaggcaagaggcuccgaguuccuuaacucuccaugagccagagagaaaaagaaagaaaaaaaaaaaaagucagacacacacacacacacacacacacacacacacacacacacacacacgcugaaugaaggagaaaagggcuacacuaccacuuuauucuuguucuugguuuuuauaccuucccgggauaauugaucacaugguuuucuaagcacuuuuacaucccauaaguucauacuaaguuuaaggcaacaguucgugucgauaaggcuuaaggaguuaccacagaauuguuuacauaucuuuccauuaagacuaguaccuaacuaaacauucauuuuuguauuuuauggcaccacaagcucauuauacguuuaaagcaacaguuuuuacaucacaaguuagcuggguuuugucaaaaaacuaaucaucugccuugugucuuauuauuuuugaagucucguauaaacuacuccauuacuuauuuccuguccuugcaccuacaauaaauugcucauucccaguuuauuaccuauaguuaccagauaguggccucguuccuaaccuagaaggaauguuuuucuagguuguaaauuuguuccacaccuguuuucuuuuccuagugcaacuagccugugacacaugaagguuuacagagcucuauuugcagcuuuuauucuacaggggguuugagaguaacuuauaucaguuuaggaauucuauaaaaucauuaucaggaauuaugaaaucaucaauuagucuauacaacauuacuacaugagagugcauuuucauguugaucugcaagaaauuugccaaauacaguuggguggacuaaugcccaggaaucaucgggcuacguaacaguggcaggaaaggcacaucagcagugagaagcaaugcugggaugaggucucugaggacacugcaucucagagugcacccacugcagucaugcaaaacagugggccaucuccagaaaacucauuugcuugccauagccuuuccuagauggcuucugacagagaaggaggaggaagaagaggaggaagaggaaaaagagguagaggaggaagaggcggaggaggaggaaauaauuguaaauuuccaucaccucugacuuuuacagucuuuccacuccuucuuccacaaaaaucccugagccuuuaaggaagcgaguauaauacaggcaugcccucuagcagcacugagaacuccucagucucuucucugcacuuugaccaguugugcgucuuuguguuaauuuccauuuccuacaagaagcagcuuaucuggugagaguugaaagaugcaugcagugguucagugagaaucuccucacaggcucauauauuuggauacuuggucuucagucuguuugaauauuuaggaaggauggugucaccaggagcaguuuuuaacguuucaaaagacucaugccauuucaaguuaguucuuccucuugcuuucggaucaagauaugugcucucagcuguuccuuccacagugccuuuguccuaccagcauggacucuaaucuugaaacccuaaguccgauuaaauguuuucuuauauaaguugcccuuggucagugguguuuugucaacacaauagaaaagugauugauacaauguguuaaucuacaggacuagcaguaggucauuagaagucaguuuaauguauguucauuuagcagaguaauaguaacagggacuccccaggcccuauggccuauguagccacagggcacagcccugauaacagugccagggauggguuccaucagaugggauaugucuuguuuguuuguuuguuuguuuguuuuaacauguaugaguguuuugccuacauguaugccuguguaccacacaugugccuacugcccauguaggucgggggaaggcaucagauucccuggaaauggagucaaagauaguuguuuguugaucuccuauaugagugcuagauaucaagccaagguucacuggaagaucagcuugugcucugaacugaugagccaucucgcuagcccuauaucaaaugagcuuaaaaccaaccagagaguaaucgguuacuccucuaacauucaugccacuauuguacuuugggcauaucuugaccgggcagauuguuacuguaguucuuaggguuuacaucuggggagaauagccacuguuuuucuccuccaguaauaugcacagcaccuuccagcacuaggaaagcuaggccaauagagaugaagcuuccgggucaguacuacccugacacucaugucuguggugucuucagguggugucuuaaccggcauucggaagggaaucaauggccugucauguuuggaagucuacgguaccucacugaccaacaacuccaaaugguguaacccauuccuggcaccaggcuuuuuauuuauuagccugugguguuuagcaaggacuagacuaaacaagaaaaaaaaaucccaaauaaaucaaaucagacacaaaaaagaaacauuauuagagaaguguggaggaucauuauagaggaauggaaaaccuagaugggagaaauggcuagaucucugaacacauguauucuaccaauggaggcaugagaacacacaaaaccuaagcagaccauuaacaaauaagaagaguggaucauagacuaaaagucucucaagaaaaaacucaugcucggcaaaaaggacucgguagguaauggcugaguuugaauccugugacccacaugguggaaaggcagaacagacucacacaaguuguccucuaaccaaaacacacacacacacuugugcacgcacgcacacacacacacacacacacacacacacacauugaaucacuuucucuuuuuuuuagauuuacuuauuuuuauuuauaugaguacacugcagcugucuucagacacacacuagaagagugcauugugugggaauugaacucaggaccucuggaagaacaaucagugcucuuaaccaaugagccaucucuccagcccauuaaaucacuuucuaguguaaguuauuuacgcagagaaagaagaaaagcagcccacuaguagacagauuugcugcugaguucugccaaccuggagacugagcccaguaccucauaccugcuaaaaaacaaacaagugcuccaccacugagcugcucccaucaccaacuguguuuguugcuguuuuguuuggaggggcugaagagaaagacuauggaaaauagggaguaggacaguggaggauggggcagaggacuguaaaacacugucucuggacuccacaugccaucgcauccgugaauccucugcaguugugguugccugcacaggaguugcacaaggugaagccaggcaacccugaaucaaggguuggggaggggcucaugucccugagagacuggaggaggaauucuuuccuucagugguccaaccacuguugcaccaccuaugcaccaguaaauaacucccaccagcgcucacauaaacaagccuuacuaaacucagcaggggccaaaaaaaaaaaaaaagcugggaaaguaggagggggacuuguugagaaaaagaggugguucauaagaguggggagagggcaaaagaagugaaaaugacccaaauuaauuguauacauguauaacauuaucaaaauuuaauauuuuuaaagacacccuuucccaggcagauggugaggcccaacaucugauuuaucuucugacuccauucacaaacucuggcacaggcacacccacaccacaauugaagguguguauacagagagagagagacagagagagagagacauauuacagggcuugcacacuaggucacaaagcaaauugagaccaggcccagguacauagucagacagaccucaucuuauaaaaaaaaaaagaguaaccuugaacuccugaccuuccuguaccccacuaccaucacaagcacugggauccaggcaugcaccucaugccucuuacagaauccaguaugagaccugcuggccauaagaagaaggcaugugaagaaacgggggcacugacacaugggaagggaagucaagcugucccuguugucacaugacacugcgguacacacagaaaaacucgagacuccagccaaaaacuguuagaacugacaaauccagugagguuacaaaauacaagaccagcuuuuuaaaaaauugcucucuuacauaccaauacugaaugaaguugcuggaagacaaaucaagaccuauucucauucacaacagcugccaaacauaaggcccccagaauaaaugugggcaaagagauuaaugguuucuacaaugagaaucacaaaacaacacuaaaagcuaaggaggauacccauaggcacaccacacacacacacacacacacacacacacacacacacacacacacacaggagccaagcaugguggugcauaccuuugauccuuugaucccagcacuuaggagacagaggcaaauggauuucugugcuuuugagaucagccuggucaacacagaguuccaagacagacgggacuauauagggagaccuugucucaaaagagaagggaggagaaggagguaaaggagaggaggagggagggagggggagagagagaauggauuagagaagugcuacaaugucuguauugcccaaaacaaccuacagagccagugcagacugcacaaugacauuccccuucacagauggggaaagaaacacgccugaugggagauggcggcacagcauaaggaccugaguucaaauccucagagcccacacacagaucugggcauagucacacuauugguggcagacaagcaucacugggcuugcuggccaccagcuucaauccagguucagaaagucaccuugucccagugggucucaguggaguaaauuagacagcgagagagcaaaacaccugaagucuccauccaggucugcuugugcagacacacagauuauuuuuuuguuauuaaaucacaaaauuuauaugggagggugaacuuaacaauccugaacagaaaugaaacuugggggguggaagcagguuugaagccagccugaucuacacagcaaguuccaggccagccagagcagcacaguaagacccuguguuaauuuuuuuuuaaggugauaauagaacagugguggaaaaaagaaaaaggaggaagagggcucccagaaccugagaggggugaggaaggcaggguggggugugugggaggaggaggaggaggguucccagaaucugggaggggaaaggaaggcgggguggggcguggaggggggauaggaagacugauagaccaagggagcaacuggaaagaacaaaucacuucgaagcuuauauagcacagucagacuccggcuggccagaauuuacugaggacuuugagcauuccuaacacaaggaaaugacagcacacacaugacaugacaggcaugcccaucacccggcuggugaggauggauuaaaaugccacacuggcacuggagagauggcucggccauuaaaggcuaggcucacaaccaaaaauauaaagugccacacugcaucccauaagacauacagcuacucuguaucaauacauacguaauuaaaaaucacucaugagggcuggagagauggcucagcgguuaaaagcacggacuguucuuccagagguccugaguucaauucccagcaaccacacgguggcucacaaccaucuacaaugcgauccgauggccucuucuggugugucugaagacagcuacagugugcucauaugcauuaaauaaauaaauaaauaaauaaauaaauaaauaaauaaauaaauaaauaaauaaauaaaguguuuuuuuuuuaaaucacucaugaaccaggcacaguggcacaugcuuauaacacuagcacuucagaggucgagccacaaagaugccaaggccaaggucagaauggguacuguggugaguuccagguccaucugugcuauacagcaagacccugucuccaaaaaaaggaggagaaaaggaggaggagaaaccaaaacuccugaaagugcauaaaggauaaguaccacagugcaccaucuacccaugaccaucucuaaaucuaagcagccgaaacuaguguacuaggccauagacaggccugcagcaaggacaucugaucaacgcuaggaguuacagcaauacagguacaauggcaucacccuacuucauuuaaaaaauaaaaaaaaauaaaaaauaaaaauguguguauauauauauacacacacacacacacauauauauauauauauauccuugaagaacuauuaggaagagcaugccaauugcaauaggcaaccagcauuagggaacacgugcugagcugcuuucuuccuuuugcaggggguggaagauucaagauaaguuuucucuguguagcccuggcuguacuggaacaugcucuguagaccaggcuggccucaaacucaaagaaauccacagacuucugccuccugagugcugggccuaaaggcgugugccaccacugccuggcucuaccuucauuuuuuaacacuauauuaaguuaaucguuuuuuuguuugcuugauuguuugugacaugguuucacuguguagagcaggcuggccccagaaacccaucuuguugccuucuggaauuaaaggcaugcuccaucacauccaaccuguuugcuugcuuuuugagacaggaucucuuccaugcaaggcuggccucaaacuugcuaagaaagaaaugaccuuaagcuacuggcccucaagaaaccucccagaugcugggguuagagguacuaagcagcacacaguuuauguuguucuggggaaugaaagccuacccucguacaugcuaggcaagcccuuuaacuggcugcuucccuaaaccuuaaacuacauugaacugaauuuucacgcaaaacucuuuaggaguagcacuggccagugagccuggagcuuccaacugaggucuuauuaagcuacacucccgcagugcacauuacuuuuuacaauuaaaaaagcuguuguaggcaaucauuucccagcuccuccuccuuggcuggacucacacacccccacuucuacccaguccuccacaacaccaauccugccccaucucuacuuacagaugcaggcagcggccagcaggcggccggcggcauagggagcgccacagcucgggaagaggggcugcaccauguaguuggcaaaggugauggcaaugacggccuggcugguggguucaaugaugagcagagaaguccagaggcggaugaacgcaaggaaucccccgaaggccuccaggauauaagcauagcuggccccggauuucuuaauggugguacccaguucagcguaacaaagggccccaaagacggagaaaaugcccccgacagcccagaugaccagugagaggccaaaagaggcacuguacaugagcacacccuuaggggagacaaagaugccggagccgaucauguuccccacuaugagacacacgccauuaagcagggagaucuccuucuucaguuugaccugcuccgccacugggcuggccccauccccgagagcagagccaucgucggccucgugcugagcagccacuucauacuuggugcuguugaccauggcgaagagaaggaagaccuucaccagcuugcucgcauugcccucuaaggaagaaagaaggcuguguuggucacugcagaaucucucccucccacaccacagggcccaaggcagucagcacccaccaguccagacacccuccucacuucugucuccccgcaacacccaaggcaugucaaaaugaccccggcuuggcuuuucccccacaaaaggggaaaacaugcuagccuuaggauguagcauaccuuauuuaucagacagcugaacccucaaccuguuaugacacaggacaggcaugaaugaggcaguuugguaaaacuuuuuucugccucccccugacccccaaagucucuccccucugauuucaguuucaaaugucccugcgcugagaugccuguaugaggaaccaacccugaaaccaacugauucgcuagauccucuuuuugcugauuugcuguucuuuccccuaaggagucugugugcugggcugaagcuuuuaaagcgcuccugcuacggaugcacagccaccucccugcucgggaauagccauuaacaaauggucagcuggcaucuuagauguuggcaaagcccaagcagccccacccauccuggaaagaaaaaaaaaaaaaaaaaaaaagacaggagauugauucgcuuuguacugcuuuuccauucccagauaccugucccagccucuagcaucccaggccuccugcugccaaaucucucacaucacaccagccaaaaaguaggaaugaucuuucagaaggguggcccaaacacacagcagaaaccagagaugacuggaggcagugggugguggcugcccacccaccauagacacccaccauagaacugcuggagacauaucaaagcaaaccaaggaaaagaaagagcuaaggccagacagcagaugcccugaaauacagagcuagagacagcugcacaaaauaggaaagcaaucagacaaauggcgaaacacuacagccagaggcucuguagcucgaggaagugacuggacagacagagaacagcagaggguuuagcaaggggacaggguggggcacacucacucccuggcucuggauauaaggagguucccacagcaauggccagccgcagucucugagacaaagaggcacacacacccuccaagaacagagaucugacagcuccuccuuccuccagcaguaagagggaaacccagacaaacgccuaccggauuuaagucaggucaagaagggaggaggaggugagggagcuaggaaaggaaggggugaggaaaagggagaggagcguuaagcaacccucuggguccaagguucacaggccuuucauaucugcgaaaggggcagcuaggagcuccuggcucagcacuuucugugauaagaaggugcucgaucaggaaucuccuuugucagcucugccccgggacaggaggcccagaggaagggacagcuaacuaacugggugugcucucugaaaccccagagagucuaauaaguuaccaaguacagagcacugguggcacagaccucuccccauguguccucccuccauggcccacccaaacuucacuucucucucucacccgaaacaagaaaggcaggaagguuagagaaugggacgcauuguucacaggcugagauuggcggaaguaugggagugguucagacgccccauguggcgcucuaagugagaucgcuguacacuuccccaugcagagaaagggguggcugccucuaaaccggggcaucacccccaaagucugacccucgagcgauuucaaaagaaauaugguucagaaaugagaucaaacuucuagauccaacuccauuccaccauuaugcucuuucauucuuagggaaacacacuacaaccucuggagcgcccaaaacuuccuauguaggucucaguacaagcuuuccuccauuucuuaaaaauauauggaggcccagacgugaauggcucauaccuguaaucccacauccagaagguugagacaggaggguccuauuugguuaaggccagacuagagaccccaugucaaaggugggggagggggagaggggcugccaagaugaagcccaugauggaaggagaaaauuuccuacuguucuacgagcgugcgcgcacuacaauaaaaaaauuagcugagcaccgugguacacaccuuuaaacccagcacucugggggcaaaggcagggagcucucugaguucaaagaucaaggacagccuggucuacagagugaguucuagggcagcaagggcuaugaggagaaacucugccucaaaagaaaaaaaaaacaagcuaacauaauaauaauaauguguguguguauguguguguguguguguguguguguguguguguguguauggaaaguuggaguauagcucaaugguagagcgcuuaccuacccccaaggcacaaaaauaguguggaaauaagguuucacugaacuauguuagacaggcccagaauaaacagaaaaaguucuacaauuugaaaucacaguuuauucuaccuuuauaaucgacuuuaacucugguauacugagccuuuuuuggcagcuuaccuguucugaaacccaacuguguaucccuucuucuucuaccucuucuucacucuuugguuauucuacagaaauagucagagacaguucaucucuaugcucacucacccucccagcccagccccuugauguucuuagcuaaaccgagaugggaugcugggcuuaggccucccaaaaacugugcuuugaggauggagagauggcucagcaguugagagcacuuucuguucuugagaagacccgagcaccacacccagcacccacauggcagcucacaacuccaguuucaggagauuugaugcccucuucuggacuccauagcuacuaauacauacacgguacauaaacacaugcaggcaaaacacccauacacauaaaaaugaauuuuuaaaaaaauuuuaaagauugcauuucucacaaggcagcccuacauacaucugagauccgucuugaagacacugcccuuuccucccagccuccccugaaacacguccaugaugguagugcuaacacugccugaguccuuguccaggccagacaccccacugugcauuucaaugcauuagcucgauggaaaguaugcagccaggaagcagguaccacacacucugcagggugccaaguggagaggaggcaggcagugaagaucacacagcugugcugucuccucagcuuccagcucucuggcccgucauugucucuggucaccagaccaucccuuuagacaggaagccaccccagguggcucccuaaugaguuaccuaccuagggcggacuaagauuagauuggaaagcaaucugcagucuuuagggggacagccuggguggaaucacugucacugccuuccggcugcaccucccauugucauuuggggugaaaaagagaagugacgcccgggcaugguggagcacaccuuuaaccccagcacuugggaggcagaggcugguggauuuuugaguucgagaccagccuggucuacaaagugagcuccagggcuacacagagaaauccugucucgaaaaaccaaaaaaaaaaaaaacaaaaaaaagagagagagagagagagagagagagagaagugacaaugucuacccagaguacugugacuucuauugaagacacagaaacacacaucaagacaccugcccuuuuaggaucaaaaugcccuugccgucaguggaguacagacucaaaugugaaucccuggaaagaauaagggagaaaaggaugugaggguccaggagguugagcucaugauugauaacaaacaaacaaacaaauauacaacaaaaaccagugaaguccuuaaggaauugaaggauggauggaacccacaccccagcaaacagcaugcccuaguggucucuccaggaaguacaacaaauggaauccucuuuccagcugccaguaaggccucugcaaccaggcaagacaggcugccugccauucauggaagugcccccucuuuccucaaccacugccuagcaccaaaggcaagaagacaccccuuuuggcucucacuguaacgcuuccaccacucuagaggaacucagccagggcagauuuuacagaugcugacacacugcuugucguuuucccuuucuuuugcugugcucaucgcuaaggacaucauggcuauuccagaaaagaauacacucauccuagagccuaaagaaguucccaguccaggccuuccagggagcaggcagcagaacaccaggcacggagggccuggcagagcagcuagccagugcugaacuaccaugcuucaugcuucaacagcaccaccagaaaugcccuuccuccgggaaccuacacacagcucggagucuagacuccucugccaagcucagugagcuacugcgagaacacccucucuccccugagagaccccaagccuugccuuccgcucuuuaacuggucugcauugccucccuuaacaacagaaacaaaacagauacaugcuaguguaguuggauuccucaccaggccuccauagcuccauagccccucccucuccaguucuccauuuguuuuucuauauuccacuauagcucaaaccguuccuuaaaaaaaaaaaaaagugaauuaaaaaaagaaaacuguuuacugcucugaccagagcuuccauuaacuacagcugaagucuccggacagagagcucuaccuagacagugccagggauaggggccaagaaauaagguucuucuuccucucucucuuuggccaauuuucagguacuccauccucccccugcgcucccuacacuuccacugcccuugcuuccccuccucuuaccuguccgggagaccucugggcaagugcagggaggagggggcuagcagcacacuggggugaggggugguaguuagagaaugggggugugacuucagcagcuguugacacggaggagcagaaaaggcagagggugccugggaccgaaauggaaaacaggaaaacacaugugugacucuggccggcgguggggaggggccagaggacgagccggagcugagacugccuggucagacagggagguccucagagccugcugccacccgggcaucuccucugccgggcuccuccuccccaccucagcccagagccuuccuuguggcccuagcuugcugaguaguuaagugcaaaggaaagcgcccucccgagccucuccuccacucuguguccuaaaacucuccaaccugccuucugggcuuauuuaugccuuugaucucaagaucccgccagugaaacucagcaguccuagcucaacagcuugugccauuucagcaucuaaaacaaaccaaggaggccaacgaacaccaacaaaggccaccuguggguacagacaaguuuggacucagauaucagcgagcgcgaggucccagcucagaucucuaauuggcugaggaguugucaacaacgggucugaguuacuagguaaaaaccaacuaggccugugccacccugggcacauuccuaaaguuggcagcuuuucaaaccacuguuauuuaaauaucuguuaaauguuuacuuugcagaaacagagaaaaugugacccuggacugaaaacgaggagaggucuggggagauauuucugcaggaaaaacagcuugccuucaaaaccugacaagcucaucuaagccccgaaacccacagaggacagagaaaaaaagccacucccaaaaguuguccucuggccacacgugguaugcaggguuuaccccucuauucccugcagucaggucucugugagcuccugugaguuugaacccagacuggccuacaucgugaguucuaggacagacagggauacauagagaaacuuugucucaaaaaaaauuuuuuuuucaaaguuguccucuagucucuacacaugcacuguggauacacacacacacacacacuaauaaaaaaaguguuuacggggcuggagagaugauucggggguuaagaacacuggcugcucuuucagaggacuuacauucaauucccagcauccacauggcagcucacaacugucuguaacuccuguuccaggagaucugacacccucacacagacauacaugcaggcaaaacauaaaauaaauaaaaaauaaauaaaauaaaacuuuuaaaguuuaaacuagacgaaccucuuuauauucagaaucaaaaauaucauuucuugguaggcauauuaaaccacugaaaauguagaccauacaaauauguguccaggggaguggcacuucacagcacaagaaguauuugcacaguucaggugugacuguggccuucgggcagccagcuguuccauaaauuacuccagauaaggacucaagaauucaggcuggggacuagagaaauggcacgcacugcuaauccacagccgccucaggcaccucgggcaccucgggcagcaccugacugccugcaucucuggccucuaacgacucuugcauucaagugcaguacucacgcacaacucuagcaucacuagauggggagccaaacuauguuaccaaaaggcagaaauccgaaaucccuggcacggaaucagaaguauuccaaggaaacugugaugcucuuuuagaucccaggccacuuccuggcugaccaggaaucuuuaaucuuacuccggggacaagcucagggugucagugagggaaggucacaggaagagagacagagcugccccugcuuccccucacagaagggggccucgcggccucaugcugggaccacacaaccucacucccaccaaagagcuuuugcaaagucugugccauuguuugauugcucucccugcugagaacauucuucucugugacacuuuucauuccugguacuauuugucaacaucucagccaagagcagauaagcaucauaagagcucuguuuccccacuguacccuaagaaggcaggggaccgcacacaagccaucaauauauauaaaaagaaagaaaagagagagaagaaagaaagaaagaaagaaagaaagaaagaaagaaagaaagaaagaaagaaagaaagaaagaaagaaagaaagaaagaaagaaagaaagaaagaaagaaagaaagagggagggagggaagguaggaaggaaggaaagaaagaaagaaagaaagaaagaaagaaagaaagaaagaaagaaagagagagagagagagagagagagagagagagagaaagaaagaaagaaagaaagaaagaaagaaagaaagaaagaaagaaagaaagaaagaaagaaagaaagaaagaaagaaagaaagagagagagagagaacaaacaauacugucucucugauuuccaggcuggcuaggcuccaggguggguccuugaauuugcccuccaggcagcccaguguuacuguguuacuacccuuaacaucagaaccgcccccuucacuaccccuagguuacuuagaguaaggagaauucacggauacuuaauauuucccauuuugaugcauuuauaggaaagagugugguuuucacuuuuacagacuuggcagaguacuuaccuagcaaacacaggacccuggguuccgccucuuaacagccugugcagcuggaaaucugcgaaguuuagggcuagacauggucauuaaaacucagcguuauggguguggaggcugaaagaucuggaguucaaggccagccucaauacauagugagucugagguuagucuagacugcaaagaaccuguuuccaaaaaaaaaggaaggauagaaaagaugaaggaaaaacugaaaagagggaaggaugccgggaggacgggagagacggaucugugggugaaauggcuaagcagcuaagaaugguggcugcacacacagcaagaccugaguucuaaucccagcuccaugguaaaaaagcuacuguggguggagacaggaagauugcugacucuugcuggcugcaagccuaacuccaaauagggugagagaccuugucucaagggaauauacccugcauccucugaugccuguugugcacuggcacaagcaccgccccagggccacacagaaacacacacacucauacacacacacacacacacacacacacacacacacacacacacacacacacacacauacucauacaccacccucaacauacauguacaccagaaauaaaauugucuuuuguuuagcuaauggaaaaacuaaaaggcccacaccuaacguucuuuccuagagacccucaucuagaugagcccaucccccuccaccagcgggcucaccuuugccccucucccacgcuuccucccagcuacucucauuucacuggagccccgucccgcaccucucucuuuuguugggucuuccucuuggucugcggcgcuaaaauaucgaccacucaagacccaaccuagucacaauuacccggcuugcccucgaaugggcaagcgcuuaccagggcugggcucuucccuuuuaucuaagaagcucgagaauaaggaacuguggugaaugagagcgaaggaagcaaaggucugagaucccagagacccugcgagcugacccccggcccggccucgcgccugcucgacgaguccccggggaaugaaaaagacugcggauacccuuagagacguguccucugccccaggcacacucagcuuccucuucccucccucccaguccagcccuagcugucagccagacgcggacugaccaaaaauuccaacccuagacaguccaaccagacgaagagcuggcugaagcucgggagaaacccaggccgggaagucccaggggcagcgggggacaggggaggugccugcuugcagccggggggagggguccccgaacuuuaucucugccuaccucuguguucugacucuccgcccccucggggaagcuguugcaucagcuucuaggucccaaauuaaagaaagugacc

SEQ ID NO: 7453 - RNA, 3321 nt, Mus musculus
ugucuuccuagacucaaaugccuuaucuggacuguuuuuuagcuaccccuauaaucuccuaacccauucaccacuucuucgacuccguuggaugagaaccaaauuuuuccaacucguucuacacuugaucauaucagaaaacaaacguuaaaaugaagcagaaggcugcacaaugagguucguuggaugcgacacuucugaguuacccuaaauuucccaagucuggagaacguccgggaaaggacuuggaaacagcugcgaaggauucggucacagguaucucaaccaccucggagggugcaagaugcacgcgcggggcaguuccuccuguucagaacacucagcccacagcugacucccacuuccguacgauaacgcaagauggugggaccggcgauugaaaaccacauucaagaugucggcuuccgguuuucccggcagcgucccgcguggcugccggggccacgcccacuuccgguucccuugcuccggcauggcugccuuagggaccuggcuguccagugagugauugugggguuggggacacgggagccgcggggcgaccagcccucuaacucccugcucuuccauuagguguccggagauugcacugcagcguaguggcgcgggccgguggccaguggcgacuccagugagugccgugccgggcgggggcgcggcgggaccuaguaucccgccgcguccucacccacacugucucccccacccaggcaagggcuggcugccaacccuuccggcuaugggccccucacggagcucccugacugguccuucgcgggugagccuugaugucaaggguuuuuuguuuuuguuuuuuuuccuccgagaccaccgggguaaggguugggggcgugucugggaaaauagugaaccuuuuacuugaguuggaggacugcagcucuaccuuugccugacuguguagccggguguuaguucaccccugagguuuuagguuuggagagcugaggcagagggauugcugugagguuagugcuauguaaggaauccuugauuauccugaacuacagaaugagacccuguguaucaaucaagaaauaguaauuggcuaaggaaaguuagcugucaggaucguauccugaagguauaaggaaauacuaacgugggcuguucugggcuuggaaguauguaugacuuuuauccucucagaaggauaaaacucucacauguguggugaguguauuuugacaauucguuugcaaauguacaaggaauucuuugaaaagcugcugaaaagaacaccgaagaucccuacaagucugaaauggcagacucaguacagagaagucuuuuucucuuuaaaaaaaaaaaaaaaaaaaaaacuuauggacugaaggaugccuuuaaaaugcggugccuguucuuccggaggacauggguucgauucccaacacccacagggugacucacaauugcuuguaacuccaguuccaggggauccaaugucaucuuuucacuuccaccuuuaccaggcacccacauggugcacagacauacauacaaacacaacacccaagcacauaaaaauaaaacuuuaaaaaaagcaaaauuaaaagagaguagugacgcaugccugcaaucggcacucacgaggcagaagcacugagagcuaggggauagccuuggcuacauagugaaaccuugccucaaaaaucaagagugagggagaaaaaaaacccuauauuucauuauacaaugagaugaaguuuagcaaagagacacauugagugaaggguuucugaagagaaaagugaguucagcuuggcagacggcccuagguccaugcuaaugacaggguuaaaugauaggaagagcgugccuaugaagucauuucgugauucuguuggaccucaccucugaggcuaggugaguuuuaguugugguugugaacugggauccuccucaguauuguuuuugaugagcagaacugggcccugaaccuacagccucacgcacgccagcauccacccaaccaaccauagucagggugaccuggaaaaguggagcuaggggcuuacucuucuccaaucccuaucacaccaguguuuggacaggauccccagaccacauuuaacacuaugccuuuuguuuacuuuugucuguagauggccgcccugcacccccaaugaaaggccaacuucgaagaaaagcucaaagggagaagcuugcagugaguagcugggacucugccaaaggcuguguuuaugacuggaggaggaaaauuuaaaucaucauuuaucuucauuuucuuuaagauugauuuuuacuuuauauacauguguuuugccuguaucaauguauguucaucauauguguucgugguaccuguaguggucagaggagggugucagauccucuggaacuggaauuacagaugguugugagcucugggguggcuacugggaguugaacccuugucccuugcaagagcagagagccaucucuacagccccauaaauuagaaucuguuuuaaguuguguuguacuugagcuacuguuuggcagugcaugggauaaaauccagggcuuccugccugcuaggcaggcacaccagcagcagccauuucuccaguccuuacacccaacuaacuuaucuuuuuaaagauuuauuuauuuuuauuuauaugaguacaauguagcugucuucagacacacaccagaagagggcaucagaccccauuacagaugguugugagccaccgugugguugcugggauuugaacucaggaccucuggaagagcaaucagugcucuuaaccucugagccaucucuccagucccuuuucuuucuuucgaugaggcauguagaccaggccagccucaaacucacaagagaugggccugccuucaccucccaaguacuaggaucaaaggauguaucccccuaccuggccaagcugauguuuuacuacgacugagaagggaagacuggagcggggcacucugcagaaaccaacagcugaccuuccucagcuucacaccgucagcgugaugcaucaguauccagcugaacacuuggcuuuggggggggagggggagaccugcucagugguacauaugccugagccccagaugucaccuacucucuuccugucuguuucagagacgaguuguacugcugacacaggaaauggaugcuggaauacaggcauggaagcucaggcagcagaaauugcaggaagaaaggaagaaggaacaugaucucaaaccuaaagggacuuuacugagaagcccacuuccgaaucaauaaaaagcagcuccugccccacuuucccagacucu

SEQ ID NO: 7454 - RNA, 13847 nt, Mus musculus
uccugcuguaauuggauucgagcugaaacaccacguccccaccgaaaaaggagggcauuggggcgggggcggaggagaggcugugggagaagggagggaccaaaggagagcagagagggcuuccaacucaguucgccgacuaagcagaagaaagaucaaaaaacggaaaagagaagagcaaacagacauuuccaggagcaauucccucaccuccaagccgaccgcgcucuaggaauccacauuccguuccuuuagaagacaaaggcgccccaagagaggcggcgcgaccccagggcgugggccccgccgcggagcccgcaccgcccggcgccccgacgccggggaccaugucucccgccccucgacccucccgcagccuccugcucccccugcucacgcuuggcacggcgcucgccucccucggcugggcccaaggcagcaacuucagccccgaaguaagugagcuccuccggcccuucccggaguuucgcccgccggguaggcgagcccgggggucuccaaggggacagcccccgcugagagaugggcucugggggggcucugcugcgccagccuuucuuuuucuccccucaucugcaaacuugcaaguugauccaacuuuugccugccuccaacaaccccccuuccgccgccaccgacucuuucccauuccucccuucccuggaagaacucugcagcggggcccgggccucgcuuuuccaagcucugcgcgcacuguggcacaaggcgggagccucagagacacuggacuccgcgccguccgggccggugucacacgcgaguuguuccuucaguuuggcagcgcucaggugcccgaggcccugcacggacgcauccguaccaagugggggcgucgggggcgcccaagcuguacccgccuccccuggaccgcccucggugcgggccgcuggcccgggcgucgaggaucgcggcgggccgaacuuccgcgcacacaaagcucuucuugugagcagcggggcucagccuggccaccuccucccucguccuccacaccccuaccggcgccuuggggggccuuuuuguuguugauaauuauuuuucugcauugaucgcggggagacuagggggagucgcucgcucggugaguuaguugaggguuggccugggucuccccugagugucccaacugacucuggcgcccccacccccaucccuaacucuuccgugaccauagcccaccccgguccugaaggaagcggcaugggaguaguccgaggaaguuuucccucccucucuuauuuuggggugaaggugggagacggauuuaaucagcuucuuauuuugggccaucccaacccacucagccuggugaggaccugggugugguagggaagggcugggaagggcccaaaugaaggauacggucuggauuugacucccucuucucugggcccaggccggggcgcacccucagaaugaaccucuccugggcacaugcugccuguaucacugaagagaccuggagcugaaaggccaaguguagcccuaggagucgggccacaguugugcauggaaacuggaaagaguaaaauccucccugagacuggaaaccaaacccaauugucagagagaggaggcaggcuccuuucccaggccuaaagcuaccaucuuagccccagagagugccuaacaaaaggagccucuggaaaacugcccacugccaacgucuuuuuuucccuccccagccuccaguaggugcccuaggggaggcgcggcagcccuggcucugcucuaagugggucaugguccucccagagccagaaccaccauuugcuucuggcacacaguagggugggaaguagggcgggaccgauccagaggccaggauccaagacuugauguugagcuggagagcccccacccucucagccuccgaaagugggagauguuccuugacuuucucauagggaauacccugcgguuauugaucaagacaaugccagccaaccggguccugccacccaccagaguugcucugucuuccggccaagcugaagggagagggguucugaggcagcuagaucccuuucaccgagccuccacagcuccaggacagcccucuccucccaguuggugugucuggugcuugucccuucccccacucagccgcagacaccagaguccucuccugugguuccaguuucauagucugugguuuugccuggcucagagauggagaaagaaacuugcccaguccgggagaggaagaaaaugauggggacaguuucuuuccuggcuuugugauacucuuccggggaguccuuuuccugacaaagcauccauuuugcuccacgggguacuggggccggguuuaugagugugcuuauuuagacuugccugcaucucgaaaggcucauaggacagggauuuauccggaacuccugucucucccgccagccucccuucuccggaauauucuaagagcgguuccucaucugcugaggguuguggaccugguuucacuccugaguuucagcuuggguggggggaagccggccacucccacucuccccuauccccaagcccgaagcagcugauagcccagccggggucagagccuacaggugaggcugggagcaaagggaguuuccugcauacuuggcacaggccacagcacaggucagggcaagccuucagaucggugggaacaacucuggaguuacacaccccgcuaggccucucugacacacaagagguuaaaauccuguaccccggaggagggcucagagauacaggugaugcuaggcuuguuuggccaaccucauuggcuggggaaaggcuggguuguuuacaacucgagcccuaacucuugucagcauaagggaaucacuuccuggaacuguguugcaauuccugcccuuuugggcucagguccuaagucagcugcuccugaaucacccccagaccccacacaagagcgcugcuccaccacgggugccuaagucugaaggagaagagcaucauauggauccauagauccauccuaaugaucaugggcaggcaggcgaugagggcuccaaggcagcuuuuaccauuucccuuccgaaugcucauucuagacagugugaaaucccuuguggacuccuuaagaaggguaaaacugaaauaggaccagagcuaucaggaucgugucucccaacaagaauccaggcauccucauugucuauacauaacauggcuugcuuggcucuccaagccuagauuccuaagucauagaguauuuacuuaggauuaugguugauucgcuaccacccuaaagagcacagcuucccuaucaucaucaucauuaccccugacucauuuucugcccuccuuaaaaauauuucugcugugaggguccuagaagugugguacuuuccgucccggaaacuccuucacccuguucaggcucccucacccccacuguaccauucugccuaccaugggcauaaccuguuuucaaauggaacaugccgggguugggaauuuagcucaguggcagagugcuugccuaacaagcccaaggcccuggguucgguccucagcucugggggggggggggggggaagacaugggacaugccauauuuucaaaagcugacacagaaaagaaaagugcuagagagaaugccagcucuaaggaggcauuuuaagguguggcaaaaugcucacuuugcaagaaugagggccuggauuugaccccuagcguguguguguguguguguguguauaaaagaggugguggugacacacuuguaaugucagugcuagagaggcagaggcagaacaagcccugaggcuugcuggccauccagccuggccuaauaggugagucauagcucccaaggaaugcaccagagauugaccucuggccuccacauacauguacagacaaucuaaaaguaugcuaaaaacuccucucaacuuucugaugcucuuauguccaagagcaccauagcucagucgggagcaaugguuucccagccuuccaucugucugcacccugucaccccugagaacaagccaucccggggucuaggcuaagcucaagucaacaguuagccugagaguuccugccugagucagacuaagaggccgucauagucacugacugacgucaaggacaucuggcagacaucguggagaggcagguggguccccuggaccaagccggaaguucucuaagccacaccauucucccuacaggccuggcugcagcaguauggcuaccuaccuccaggggaccugcguacccacacacaacgcucaccccagucacucucagcugccauugccgccaugcaaaaguucuaugguuuacaagugacaggcaaggcugauuuggcaaccaugauguaaguuccuggccuccacugaccgugcugaauaccaaacaugcuuccacuuguacuugccucaguguccucucccguccaccucaggaccugaccuuccccuacacuggcacacacaaagccucacccaucacugaccugggaccagaggccaagacccugggucaacuacagcacuacacucugucccuuugaagaugguuuuguuuuauauacuacacugaccccguuguuuccaccccagggccaugaggcgcccucgcugugguguuccggauaaguuugggacugagaucaaggccaauguucggaggaagcgcuaugccauucagggccucaaguggcagcauaaugagaucacuuucuggugagucccccagccuagagauguuuuucacaugcagcaucccuccccguuaguuguauugagucaaagguggccugggcuacuguccauuccuagagaguggcucuaauuccuaggaaaauagcucuaaucuugcagagaaguacagccauuuugaagagcauacacucucguggcaacaccccaagccugaagauccccuaagccuuuuguccccugggcugagauacuuauaugcaauagcagggaaccaggucuggcaaggugggcaggcacuucugucagagcuaggagagggaacuuugccuccuuuauccuaauguuucccuucucuacccucacgucuggauguagcauucagaauuacaccccuaaggugggcgaguaugccacauucgaggccauucggaaggccuuccgaguaugggagagugccacgccacugcgcuuccgagaagugcccuaugccuacauccgggagggacaugagaagcaggcugacaucaugaucuuguuugcugaggguuuccacggcgacaguacacccuuugauggugaaggaggguuccuggcucaugccuacuucccaggccccaauauuggaggggauacccacuuugauucugccgagcccuggacuguccaaaaugaggaucuaaauggugaguaagggaaccccggguucuacccugugcagucacuuguaucuagaggguucuucuuccagagucuaagcuagcaggguguaguggccagccugcucuacguaguaaauucuaggccagccugggcuacagagugagacccugucucauaaaucaauaaaauuaaaaaaaaaaaucuaaguguugaggcaggaggauugugaguuugaggccugccuagauuguauaacaagacucuaucucaaaacaaaagaacaagcaacagcuaaguuauuagcuguagaaccuagugagagcgugcaggagucuuauuuuaagcuguuuguuucuguauauuuggucugccauuacagcuugacugacuuaccaaucacagacuggcaagggcucucgcuucucgcccacuuuuccaggcaaacauggugccuagcuucugggagaaacugaguucuacaguguagguuuucuugggauugggaucuggacccagguaccccacuucccccagaggaggguagugacugccuugggcuuccugaaccaaauaggaagcugacccucaggacuuuaucccuugagguggaaaacacgaccagcaagcuucucugugaaacuggagucucugguagagaggcagggagcuuaaccaaguuuucaccaucuccaucccuccagggaaugacaucuucuugguggcugugcaugaguuggggcaugcccuaggccuggaacauuccaaugaucccuccgccaucauggcccccuuuuaccaguggauggacacagagaacuucguguugccugaugacgaucgccguggcauccagcaacuuuauggcgaguuacccauccccauuccugcuccuccaucucuauacuuguccucucuuggccucuugucugcauuuucccuccaucaugugugaagucucuacacacacacacacacacacacacacacacacacacacacacacacacaccacuuuucauugccucuauuagcuaccacuuuuuuuuuuuuuuuuuuuuuuuccgagacaggguuucucuguguaauccuggcuguccuggaacucaccaggcuggccucgaacucagaaauccgccugccucugccucccgagugcugggauuaaaggcaugcgccaccacgcccgguuuagcuaccacuuuuuaaaagcacuuuuuguuuuacauauuuaaguguauugucucuauguauguauaugcaucauguguaccuguggagucccaaagaggacacuggaucucuuggcacugccaugugagugcuggggaccaaacuuggguccucuuuaggaucugcaggugcuccuaaucacggagucuuaucuccagccccucagcucccacuuuuuaagcacaccuguuggacacacccacgccgacuacuucauccuucucuaaagccuguuuacacugacuuuuuuuuuuaaaauauuuguucuuauuagggugugucuguguguccacagagaccagaggcaucugacuuccuagaacucggguuauagaugguugugagccacugguugucggcucugggaaccaaacucccacccucugcaagagcgguagaugcuuuaaccacugagccaucucugcggcacugccacccucgucacaccuuccagggguguugucugcuuaucugucuguccuuccgcccucuuugcuccaaagucuaaagcacccccuauuguucucuuccucaggaagcaagucagggucacccacaaagaugcccccucaacccagaacuaccucucggcccucugucccagauaagcccaaaaaccccgccuaugggcccaacaucugugacgggaacuuugacaccguggccaugcuccgaggagagauguuugucuucaaggugagaggaagagaagugggauuguuggaggggacagaaggacucacagugaggaaaauggauggaaauaauaauggacugaaaacuaaagccauagaaccaagggcagcgggggagcuuuggggacugaggaagacgaagguauaaggcauaauguguucucccucaucuuuacugguuucuaggagcgaugguucuggcgggugaggaauaaccaagugauggauggauacccaaugcccauuggccaauucuggaggggccugccugcauccaucaauacugccuacgagaggaaggauggcaaauuugucuucuucaaagguaaccaggcauuuccuaguccuaggaacuugguuggaagggucuucccggaugacugguuccacuucacucccgaagaccucacccaccgucaggauggacccagauucuucccuucucucguaucccaggagauaagcacuggguguuugacgaagccucccuggaacccggguaccccaagcacauuaaggagcugggccgagggcugcccacggacaagaucgaugcagcucucuucuggaugcccaaugggaagaccuacuucuuccggggcaauaaguaagacuucagcuccuuaacccuaagccucuccacucagaaacuacugccacugccaccccaaauagcccgaucccuaaauucugaagaaagccucaccccgacaagguuguugcccuggaaaaggaacuugcuaauccuuuacuguugccuagcaacagacaguuuuucuuagugcugcgagagugggaugugacccggucaccauuucaaaccuggucauuugaugccuccugcaccuaguacugggccuccacccggccaccaagcacuaucauuaaggggcugcuaguggcuccuuacagccuggaccuucccuuccaccuccuccuuccgccucuuuccacugcaggcccucauuacucaaaaucccuguccccaaccaugacccuagcuacccuuuguccugggucugcucaccucugggggcacgcccaguauccaaccacuccccuuuccuuccccucccccagguacuaccgguucaaugaagaauucagggcaguggacagcgaguacccuaaaaacaucaaagucugggaaggaaucccugaaucucccagggggucauucaugggcagugaugaaggugagugaagcaaaggaaacuauagagaagggcaagcuuggggagccaaggaaaagcagaaaggcaggucuuguggaaagcauugaugguguagcagugggggcugggggcuugccaggaaagagccaaguguuuucauguguaguacccucagucuuuccacucugccaagcugguacugggcugagugguaagcuuagcuggccucacacuaacugugcuuucuucucucuucgggggccuuuauggacucugucccccgaccucuucaccccgucuugguucuuguccucuucauccgucuucuuggggcccuucagucuucacauacuucuacaagggaaacaaauacuggaaguucaacaaccagaagcugaagguagagccaggguaucccaagucagcucugcgggacuggaugggcugcccuucggggggccggcccgaugaggggacugaggaggagacggaggugaucaucauugagguggaugaggagggcaguggagcugugagugcggccgccgugguccugccgguacuacugcugcuccugguacuggcagugggccucgcugucuucuucuucagacgccaugggacgcccaagcgacugcuuuacugccagcguucgcugcuggacaaggucugacccccaccacuggcccacccgcuucuaccacaaggacuuugccucugaaggccaguggcuacaggugguagcaggugggcugcucucacccguccugggcucccucccuccagccucccuucucagucccuaauuggccucucccacccucaccccagcauugcuucauccauaagugggucccuugagggcugagcagaagacgguuggccucuggcccucaagggaaucucacagcucgguguguguucagcccuaguugaauguugucaaggcucugcacuugaaggcaagacccucugaccuuauaggcaacggccaaauggggccaucugcuucuuuuccaucccccuaacuacauaccuuaaaucucugaacucugaccucaggaggcucugggcauaugagcccuauauguaccaaguguaccuaguuggcugccucccgccacucugacuaaaaggaaucuuaagaguguacguuuggagguggaaagauuguucaguuuacccuaaagacuuugauaagaaagagaaagaaagaaagaaagaaagaaagaaagaaagaaagaaagaaagaaagaaagaaagaaagaaagaaagaaagaaagaaagaaagaaagaaagaaagaaagaaaagcucacagagagucugguggcuuggacagccaaguuccucuccacaaagaucugccucuauccaacccagucuggagaacuuccaaaggagccugagccauuaaggacuaaauggguuugaggaaacccuuggcaaacccgaccccugaccccugaauguuagccuugaaugucaaguucaaggcuggaagagcugaaaccagggggaaaggucccggguggagugaggucaaggggagacagcaggaccugaaggaugagccucacagcucaaagcagacaaagaccuuguucaaaugcaagucacuggggcugggacccaaagagagcagucagagagggcaggacacgaaggguagugguggcaguguaugccugggagucugcacagacugcagugcacacacgggacacuaguccccaggagugggcacaucuuauuggaugucucagaaagggccuuaagggaagccacacuggccacuuucuguccccuugcucacaguguagaaggcaaggguaggaauugauacaggagugagaagaacaugcauacagggacucaauggagaccagagaaggcugucagcagccugggcuugcuuagacuuccucacugcccuagugaggcaggugucugggugcuguugguuaggguggccucccuuuccugaugcaggcaccccucagcccauuuuaccuauguccugcccuuccucuuccccgcccaguugacccauuugaagucuccuucagccacugaaggcggucaugguacuggggacuugggagagugagacccuguggagggagaggcgaggagaggagagaaaugucuggguggggguuggggauaggggugaacggugcuggaagcccagcuaaauuucugucuuguuuggguuuuuuuuuuguuuuguuuaauguauauuuuuauuauaauuauuauauaugaaugccauucaaaucguuccuuuuuguuaacaaggggcauggggaggggugggggguggaggggggcugaggcgacugaccccagaaaccugcagggcggggcugggucagugcucucuaaggacauuuuuugaccuuguucaaccuuuccaagaagaauaaacuguguuucacauucuuugugugacucgagcuggguguagggguggauacgaugcgauguggccaagcagggcuagggagggcagacacuaagaacagcauuucccaugaugcagguuuuaguauuugucauaaauauuuauucuuagauugauagaacuuaagaguugcaguuggggaacaagucauaccccacuggagguuagaggagugacuggaagaacccauauuucuccccccaaaagccuuaaaaggcuaccuuugagaaucaaggcugccagaauaagaggaaguggucaagcugaggccauuuggaaaaucuuccuaaauugcauuauucugccgugugaucucgccacauuugaguuuccgcauaaaucugucccuucagcaaggguauucccauggucacauuagucugaaguucaaugacaggccccaggaccuaaggagacccuuccuagggagguccugcuaaagcugggcaugguggcaucuuuacucuauggaggcaggaggucaaggcuagccuggucuacaugaauaagaucuaaacuagcuggggcuacacaguaaggggugcgguagggggcagagagguggugguucuuauaguccugagacccugcuguuggaucaggagucuagagacgaaaaagaaaaaguuuucuucauggucugcgcuccaaggaguguccucucccuggcacaacagaguucuuccauugucccagaagauccaggacccucagguuggaaggguuaaauaacaaggcuuuguuuccauuuuccauagaaacugcugcccuagacaggguuccuaggcuguugacccucccuuccuccaaaaccagccugaagggaggggucagcccagcugcugagucagcucagcugaaggagagcagcccccuucucccgccuucccuuccugccucagcccagucuucccugggcucccgcccagguccuccacagccugccuuccagagccuggcuccacccaugcccucuuccauccagcugcucugcaggguccuugguaugguuacuuuggcagaugggguacccuaccuuccugccagccaacaacccugacccugugccugaucaccugugccucugcugccaacagcuguuugccagggccccgugugucucagugaaguuaggaacagccuccaccgaccgccaccuucaccaaaaagauuuggagcugagguggcccuggggaagucaggggcaucuagggggaaucaagcccguucaugugaccaaaaaaaaaaaaaguaaaagaugagcuaauggccccuuuguguuuuugugguccacaucuggagguaauuacagauguuauccagagggaauucugcaaagcacagcuggagccaguggaagagcccaggagggaagaggagggggagcccgggaaaggagugcgguuuccccaucacgaggaaauuguuuggcugggauucuggaaucacaagaugcucucugaagccaacgagagaaaugggaaugcagaacuggagacaaagggagaugagcuggaggauggauucugcgcagaccggacugugggguggaggccgcaugucuggugcugaugauguacuugagccugcccaccccaccccgggaccuuggagggugccuucguggucauaaggucccacuugagugagccaccgugucaggauaggaugacaggaggcagagggcccucuggcucccaaggaccuaccaacuguuuucacuggccuggccuggccuggccgauuugucugcugggccugacccaguuucuaugguuccaaguuccuuuauucgaaagcaguacuugugaguuggggcagccagaaggagccaguuggaauaugugaggagguuugggcugccccaaggacacugggcuaagaagauacuggagugggaaagaaggccaagaaggagcagcaguuugcccaccaacgcaccccguggggggaggggccucucuuuacugcacucucccuuuccagggguccugauagcagcagguccaaagccucuugggcuaccagccaggcaggccagggaagggacagccuaagaggaacugcacucucugcaagagaagaugucagagagacaucuccacacauuacaauuugguuagccguggugguccuucccugcccauucucaaugccuuuacccauuaaacagacuucccagcuaccucuguauccuugcuguaggccuucaguauacagagcaaggucucaguuggaaccaguuccuuaguucaaauuagccccauaucgggacuaaggacguggcucugugggagaacauuugccuaacaugagcaggacuaaaugugauccucagcacagcaaagcaaaacuaagaccccccaaagaaacuugggugguugcucuauggaagcagauucugacaagguuccuugggcaucucuuccaguguagcuccaugcagccaguaugcuuuggggaacugacaggauaucuguguuugcuuguuggaccaugcagcagaucaaugaaggcaaccaggguagggaggauggggcaugggagagguuccucagaaaggacagccaguuugcacccuuugcuucucagagguagaagcaaguguucagaaggaaggaagguaaaggccacauggacucagaaaccagaggggcuaaaggugcuuacauacaauaguaggggguguuggugaacaccuugauaagaauaggaggcaccaggggcuggagagauggcucagcgguuaagagcacugacuguucuuccagagguccugaguucaauucccaguaaccacaugguggcucacaaccaucuguaaugggaucugaugccuucuucuggugugucugacagcuacaguguacucauauacauaaaauaaacaaaucuuuaaga

SEQ ID NO: 7455 - RNA, 13847 nt, Mus musculus
ucuuaaagauuuguuuauuuuauguauaugaguacacuguagcugucagacacaccagaagaaggcaucagaucccauuacagaugguugugagccaccaugugguuacugggaauugaacucaggaccucuggaagaacagucagugcucuuaaccgcugagccaucucuccagccccuggugccuccuauucuuaucaagguguucaccaacacccccuacuauuguauguaagcaccuuuagccccucugguuucugaguccauguggccuuuaccuuccuuccuucugaacacuugcuucuaccucugagaagcaaagggugcaaacuggcuguccuuucugaggaaccucucccaugccccauccucccuacccugguugccuucauugaucugcugcaugguccaacaagcaaacacagauauccugucaguuccccaaagcauacuggcugcauggagcuacacuggaagagaugcccaaggaaccuugucagaaucugcuuccauagagcaaccacccaaguuucuuuggggggucuuaguuuugcuuugcugugcugaggaucacauuuaguccugcucauguuaggcaaauguucucccacagagccacguccuuagucccgauauggggcuaauuugaacuaaggaacugguuccaacugagaccuugcucuguauacugaaggccuacagcaaggauacagagguagcugggaagucuguuuaauggguaaaggcauugagaaugggcagggaaggaccaccacggcuaaccaaauuguaauguguggagaugucucucugacaucuucucuugcagagagugcaguuccucuuaggcugucccuucccuggccugccuggcugguagcccaagaggcuuuggaccugcugcuaucaggaccccuggaaagggagagugcaguaaagagaggccccuccccccacggggugcguuggugggcaaacugcugcuccuucuuggccuucuuucccacuccaguaucuucuuagcccaguguccuuggggcagcccaaaccuccucacauauuccaacuggcuccuucuggcugccccaacucacaaguacugcuuucgaauaaaggaacuuggaaccauagaaacugggucaggcccagcagacaaaucggccaggccaggccaggccagugaaaacaguugguagguccuugggagccagagggcccucugccuccugucauccuauccugacacgguggcucacucaagugggaccuuaugaccacgaaggcacccuccaaggucccgggguggggugggcaggcucaaguacaucaucagcaccagacaugcggccuccaccccacaguccggucugcgcagaauccauccuccagcucaucucccuuugucuccaguucugcauucccauuucucucguuggcuucagagagcaucuugugauuccagaaucccagccaaacaauuuccucgugauggggaaaccgcacuccuuucccgggcucccccuccucuucccuccugggcucuuccacuggcuccagcugugcuuugcagaauucccucuggauaacaucuguaauuaccuccagauguggaccacaaaaacacaaaggggccauuagcucaucuuuuacuuuuuuuuuuuuuggucacaugaacgggcuugauucccccuagaugccccugacuuccccagggccaccucagcuccaaaucuuuuuggugaagguggcggucgguggaggcuguuccuaacuucacugagacacacggggcccuggcaaacagcuguuggcagcagaggcacaggugaucaggcacagggucaggguuguuggcuggcaggaagguaggguaccccaucugccaaaguaaccauaccaaggacccugcagagcagcuggauggaagagggcauggguggagccaggcucuggaaggcaggcuguggaggaccugggcgggagcccagggaagacugggcugaggcaggaagggaaggcgggagaagggggcugcucuccuucagcugagcugacucagcagcugggcugaccccucccuucaggcugguuuuggaggaagggagggucaacagccuaggaacccugucuagggcagcaguuucuauggaaaauggaaacaaagccuuguuauuuaacccuuccaaccugaggguccuggaucuucugggacaauggaagaacucuguugugccagggagaggacacuccuuggagcgcagaccaugaagaaaacuuuuucuuuuucgucucuagacuccugauccaacagcagggucucaggacuauaagaaccaccaccucucugcccccuaccgcaccccuuacuguguagccccagcuaguuuagaucuuauucauguagaccaggcuagccuugaccuccugccuccauagaguaaagaugccaccaugcccagcuuuagcaggaccucccuaggaagggucuccuuagguccuggggccugucauugaacuucagacuaaugugaccaugggaauacccuugcugaagggacagauuuaugcggaaacucaaauguggcgagaucacacggcagaauaaugcaauuuaggaagauuuuccaaauggccucagcuugaccacuuccucuuauucuggcagccuugauucucaaagguagccuuuuaaggcuuuuggggggagaaauauggguucuuccagucacuccucuaaccuccagugggguaugacuuguuccccaacugcaacucuuaaguucuaucaaucuaagaauaaauauuuaugacaaauacuaaaaccugcaucaugggaaaugcuguucuuagugucugcccucccuagcccugcuuggccacaucgcaucguauccaccccuacacccagcucgagucacacaaagaaugugaaacacaguuuauucuucuuggaaagguugaacaaggucaaaaaauguccuuagagagcacugacccagccccgcccugcagguuucuggggucagucgccucagccccccuccaccccccaccccuccccaugccccuuguuaacaaaaaggaacgauuugaauggcauucauauauaauaauuauaauaaaaauauacauuaaacaaaacaaaaaaaaaacccaaacaagacagaaauuuagcugggcuuccagcaccguucaccccuauccccaacccccacccagacauuucucuccucuccucgccucucccuccacagggucucacucucccaaguccccaguaccaugaccgccuucaguggcugaaggagacuucaaaugggucaacugggcggggaagaggaagggcaggacauagguaaaaugggcugaggggugccugcaucaggaaagggaggccacccuaaccaacagcacccagacaccugccucacuagggcagugaggaagucuaagcaagcccaggcugcugacagccuucucuggucuccauugagucccuguaugcauguucuucucacuccuguaucaauuccuacccuugccuucuacacugugagcaaggggacagaaaguggccaguguggcuucccuuaaggcccuuucugagacauccaauaagaugugcccacuccuggggacuagugucccgugugugcacugcagucugugcagacucccaggcauacacugccaccacuacccuucguguccugcccucucugacugcucucuuugggucccagccccagugacuugcauuugaacaaggucuuugucugcuuugagcugugaggcucauccuucagguccugcugucuccccuugaccucacuccacccgggaccuuucccccugguuucagcucuuccagccuugaacuugacauucaaggcuaacauucaggggucaggggucggguuugccaaggguuuccucaaacccauuuaguccuuaauggcucaggcuccuuuggaaguucuccagacuggguuggauagaggcagaucuuuguggagaggaacuuggcuguccaagccaccagacucucugugagcuuuucuuucuuucuuucuuucuuucuuucuuucuuucuuucuuucuuucuuucuuucuuucuuucuuucuuucuuucuuucuuucuuucuuucuuucuuucuuucucuuucuuaucaaagucuuuaggguaaacugaacaaucuuuccaccuccaaacguacacucuuaagauuccuuuuagucagaguggcgggaggcagccaacuagguacacuugguacauauagggcucauaugcccagagccuccugaggucagaguucagagauuuaagguauguaguuagggggauggaaaagaagcagauggccccauuuggccguugccuauaaggucagagggucuugccuucaagugcagagccuugacaacauucaacuagggcugaacacacaccgagcugugagauucccuugagggccagaggccaaccgucuucugcucagcccucaagggacccacuuauggaugaagcaaugcuggggugagggugggagaggccaauuagggacugagaagggaggcuggagggagggagcccaggacgggugagagcagcccaccugcuaccaccuguagccacuggccuucagaggcaaaguccuugugguagaagcgggugggccaguggugggggucagaccuuguccagcagcgaacgcuggcaguaaagcagucgcuugggcgucccauggcgucugaagaagaagacagcgaggcccacugccaguaccaggagcagcaguaguaccggcaggaccacggcggccgcacucacagcuccacugcccuccucauccaccucaaugaugaucaccuccgucuccuccucaguccccucaucgggccggccccccgaagggcagcccauccagucccgcagagcugacuugggauacccuggcucuaccuucagcuucugguuguugaacuuccaguauuuguuucccuuguagaaguaugugaagacugaagggccccaagaagacggaugaagaggacaagaaccaagacggggugaagaggucgggggacagaguccauaaaggcccccgaagagagaagaaagcacaguuagugugaggccagcuaagcuuaccacucagcccaguaccagcuuggcagaguggaaagacugaggguacuacacaugaaaacacuuggcucuuuccuggcaagcccccagcccccacugcuacaccaucaaugcuuuccacaagaccugccuuucugcuuuuccuuggcuccccaagcuugcccuucucuauaguuuccuuugcuucacucaccuucaucacugcccaugaaugacccccugggagauucagggauuccuucccagacuuugauguuuuuaggguacucgcuguccacugcccugaauucuucauugaaccgguaguaccugggggaggggaaggaaaggggagugguuggauacugggcgugcccccagaggugagcagacccaggacaaaggguagcuagggucaugguuggggacagggauuuugaguaaugagggccugcaguggaaagaggcggaaggaggagguggaagggaagguccaggcuguaaggagccacuagcagccccuuaaugauagugcuugguggccggguggaggcccaguacuaggugcaggaggcaucaaaugaccagguuugaaauggugaccgggucacaucccacucucgcagcacuaagaaaaacugucuguugcuaggcaacaguaaaggauuagcaaguuccuuuuccagggcaacaaccuugucggggugaggcuuucuucagaauuuagggaucgggcuauuugggguggcaguggcaguaguuucugaguggagaggcuuaggguuaaggagcugaagucuuacuuauugccccggaagaaguaggucuucccauugggcauccagaagagagcugcaucgaucuuguccgugggcagcccucggcccagcuccuuaaugugcuugggguacccggguuccagggaggcuucgucaaacacccagugcuuaucuccugggauacgagagaagggaagaaucuggguccauccugacggugggugaggucuucgggagugaaguggaaccagucauccgggaagacccuuccaaccaaguuccuaggacuaggaaaugccugguuaccuuugaagaagacaaauuugccauccuuccucucguaggcaguauugauggaugcaggcaggccccuccagaauuggccaaugggcauuggguauccauccaucacuugguuauuccucacccgccagaaccaucgcuccuagaaaccaguaaagaugagggagaacacauuaugccuuauaccuucgucuuccucaguccccaaagcucccccgcugcccuugguucuauggcuuuaguuuucaguccauuauuauuuccauccauuuuccucacugugaguccuucuguccccuccaacaaucccacuucucuuccucucaccuugaagacaaacaucucuccucggagcauggccacggugucaaaguucccgucacagauguugggcccauaggcgggguuuuugggcuuaucugggacagagggccgagagguaguucuggguugagggggcaucuuugugggugacccugacuugcuuccugaggaagagaacaauagggggugcuuuagacuuuggagcaaagagggcggaaggacagacagauaagcagacaacaccccuggaaggugugacgaggguggcagugccgcagagauggcucagugguuaaagcaucuaccgcucuugcagagggugggaguuugguucccagagccgacaaccaguggcucacaaccaucuauaacccgaguucuaggaagucagaugccucuggucucuguggacacacagacacacccuaauaagaacaaauauuuuaaaaaaaaaagucaguguaaacaggcuuuagagaaggaugaaguagucggcguggguguguccaacaggugugcuuaaaaagugggagcugaggggcuggagauaagacuccgugauuaggagcaccugcagauccuaaagaggacccaaguuugguccccagcacucacauggcagugccaagagauccaguguccucuuugggacuccacagguacacaugaugcauauacauacauagagacaauacacuuaaauauguaaaacaaaaagugcuuuuaaaaagugguagcuaaaccgggcgugguggcgcaugccuuuaaucccagcacucgggaggcagaggcaggcggauuucugaguucgaggccagccuggugaguuccaggacagccaggauuacacagagaaacccugucucggaaaaaaaaaaaaaaaaaaaaaaagugguagcuaauagaggcaaugaaaagugguguguguguguguguguguguguguguguguguguguguguguguguguagagacuucacacaugauggagggaaaaugcagacaagaggccaagagaggacaaguauagagauggaggagcaggaauggggauggguaacucgccauaaaguugcuggaugccacggcgaucgucaucaggcaacacgaaguucucuguguccauccacugguaaaagggggccaugauggcggagggaucauuggaauguuccaggccuagggcaugccccaacucaugcacagccaccaagaagaugucauucccuggagggauggagauggugaaaacuugguuaagcucccugccucucuaccagagacuccaguuucacagagaagcuugcuggucguguuuuccaccucaagggauaaaguccugagggucagcuuccuauuugguucaggaagcccaaggcagucacuacccuccucugggggaagugggguaccuggguccagaucccaaucccaagaaaaccuacacuguagaacucaguuucucccagaagcuaggcaccauguuugccuggaaaagugggcgagaagcgagagcccuugccagucugugauugguaagucagucaagcuguaauggcagaccaaauauacagaaacaaacagcuuaaaauaagacuccugcacgcucucacuagguucuacagcuaauaacuuagcuguugcuuguucuuuuguuuugagauagagucuuguuauacaaucuaggcaggccucaaacucacaauccuccugccucaacacuuagauuuuuuuuuuuaauuuuauugauuuaugagacagggucucacucuguagcccaggcuggccuagaauuuacuacguagagcaggcuggccacuacacccugcuagcuuagacucuggaagaagaacccucuagauacaagugacugcacaggguagaacccgggguucccuuacucaccauuuagauccucauuuuggacaguccagggcucggcagaaucaaaguggguauccccuccaauauuggggccugggaaguaggcaugagccaggaacccuccuucaccaucaaaggguguacugucgccguggaaacccucagcaaacaagaucaugaugucagccugcuucucaugucccucccggauguaggcauagggcacuucucggaagcgcaguggcguggcacucucccauacucggaaggccuuccgaauggccucgaauguggcauacucgcccaccuuagggguguaauucugaaugcuacauccagacgugaggguagagaagggaaacauuaggauaaaggaggcaaaguucccucuccuagcucugacagaagugccugcccaccuugccagaccugguucccugcuauugcauauaaguaucucagcccaggggacaaaaggcuuaggggaucuucaggcuugggguguugccacgagaguguaugcucuucaaaauggcuguacuucucugcaagauuagagcuauuuuccuaggaauuagagccacucucuaggaauggacaguagcccaggccaccuuugacucaauacaacuaacggggagggaugcugcaugugaaaaacaucucuaggcugggggacucaccagaaagugaucucauuaugcugccacuugaggcccugaauggcauagcgcuuccuccgaacauuggccuugaucucagucccaaacuuauccggaacaccacagcgagggcgccucauggcccugggguggaaacaacggggucaguguaguauauaaaacaaaaccaucuucaaagggacagaguguagugcuguaguugacccagggucuuggccucuggucccaggucagugaugggugaggcuuugugugugccaguguaggggaaggucagguccugagguggacgggagaggacacugaggcaaguacaaguggaagcauguuugguauucagcacggucaguggaggccaggaacuuacaucaugguugccaaaucagccuugccugucacuuguaaaccauagaacuuuugcauggcggcaauggcagcugagagugacuggggugagcguuguguguggguacgcagguccccuggagguagguagccauacugcugcagccaggccuguagggagaaugguguggcuuagagaacuuccggcuugguccaggggacccaccugccucuccacgaugucugccagauguccuugacgucagucagugacuaugacggccucuuagucugacucaggcaggaacucucaggcuaacuguugacuugagcuuagccuagaccccgggauggcuuguucucaggggugacagggugcagacagauggaaggcugggaaaccauugcucccgacugagcuauggugcucuuggacauaagagcaucagaaaguugagaggaguuuuuagcauacuuuuagauugucuguacauguauguggaggccagaggucaaucucuggugcauuccuugggagcuaugacucaccuauuaggccaggcuggauggccagcaagccucagggcuuguucugccucugccucucuagcacugacauuacaagugugucaccaccaccucuuuuauacacacacacacacacacacacgcuaggggucaaauccaggcccucauucuugcaaagugagcauuuugccacaccuuaaaaugccuccuuagagcuggcauucucucuagcacuuuucuuuucugugucagcuuuugaaaauauggcaugucccaugucuucccccccccccccccccagagcugaggaccgaacccagggccuugggcuuguuaggcaagcacucugccacugagcuaaauucccaaccccggcauguuccauuugaaaacagguuaugcccaugguaggcagaaugguacagugggggugagggagccugaacagggugaaggaguuuccgggacggaaaguaccacacuucuaggacccucacagcagaaauauuuuuaaggagggcagaaaaugagucagggguaaugaugaugaugauagggaagcugugcucuuuagggugguagcgaaucaaccauaauccuaaguaaauacucuaugacuuaggaaucuaggcuuggagagccaagcaagccauguuauguauagacaaugaggaugccuggauucuuguugggagacacgauccugauagcucugguccuauuucaguuuuacccuucuuaaggaguccacaagggauuucacacugucuagaaugagcauucggaagggaaaugguaaaagcugccuuggagcccucaucgccugccugcccaugaucauuaggauggaucuauggauccauaugaugcucuucuccuucagacuuaggcacccgugguggagcagcgcucuuguguggggucugggggugauucaggagcagcugacuuaggaccugagcccaaaagggcaggaauugcaacacaguuccaggaagugauucccuuaugcugacaagaguuagggcucgaguuguaaacaacccagccuuuccccagccaaugagguuggccaaacaagccuagcaucaccuguaucucugagcccuccuccgggguacaggauuuuaaccucuugugugucagagaggccuagcgggguguguaacuccagaguuguucccaccgaucugaaggcuugcccugaccugugcuguggccugugccaaguaugcaggaaacucccuuugcucccagccucaccuguaggcucugaccccggcugggcuaucagcugcuucgggcuuggggauaggggagagugggaguggccggcuuccccccacccaagcugaaacucaggagugaaaccagguccacaacccucagcagaugaggaaccgcucuuagaauauuccggagaagggaggcuggcgggagagacaggaguuccggauaaaucccuguccuaugagccuuucgagaugcaggcaagucuaaauaagcacacucauaaacccggccccaguaccccguggagcaaaauggaugcuuugucaggaaaaggacuccccggaagaguaucacaaagccaggaaagaaacuguccccaucauuuucuuccucucccggacugggcaaguuucuuucuccaucucugagccaggcaaaaccacagacuaugaaacuggaaccacaggagaggacucuggugucugcggcugagugggggaagggacaagcaccagacacaccaacugggaggagagggcuguccuggagcuguggaggcucggugaaagggaucuagcugccucagaaccccucucccuucagcuuggccggaagacagagcaacucugguggguggcaggacccgguuggcuggcauugucuugaucaauaaccgcaggguauucccuaugagaaagucaaggaacaucucccacuuucggaggcugagagggugggggcucuccagcucaacaucaagucuuggauccuggccucuggaucggucccgcccuacuucccacccuacugugugccagaagcaaauggugguucuggcucugggaggaccaugacccacuuagagcagagccagggcugccgcgccuccccuagggcaccuacuggaggcuggggagggaaaaaaagacguuggcagugggcaguuuuccagaggcuccuuuuguuaggcacucucuggggcuaagaugguagcuuuaggccugggaaaggagccugccuccucucucugacaauuggguuugguuuccagucucagggaggauuuuacucuuuccaguuuccaugcacaacuguggcccgacuccuagggcuacacuuggccuuucagcuccaggucucuucagugauacaggcagcaugugcccaggagagguucauucugagggugcgccccggccugggcccagagaagagggagucaaauccagaccguauccuucauuugggcccuucccagcccuucccuaccacacccagguccucaccaggcugaguggguugggauggcccaaaauaagaagcugauuaaauccgucucccaccuucaccccaaaauaagagagggagggaaaacuuccucggacuacucccaugccgcuuccuucaggaccggggugggcuauggucacggaagaguuagggaugggggugggggcgccagagucaguugggacacucaggggagacccaggccaacccucaacuaacucaccgagcgagcgacucccccuagucuccccgcgaucaaugcagaaaaauaauuaucaacaacaaaaaggccccccaaggcgccgguagggguguggaggacgagggaggagguggccaggcugagccccgcugcucacaagaagagcuuugugugcgcggaaguucggcccgccgcgauccucgacgcccgggccagcggcccgcaccgagggcgguccaggggaggcggguacagcuugggcgcccccgacgcccccacuugguacggaugcguccgugcagggccucgggcaccugagcgcugccaaacugaaggaacaacucgcgugugacaccggcccggacggcgcggaguccagugucucugaggcucccgccuugugccacagugcgcgcagagcuuggaaaagcgaggcccgggccccgcugcagaguucuuccagggaagggaggaaugggaaagagucgguggcggcggaagggggguuguuggaggcaggcaaaaguuggaucaacuugcaaguuugcagaugaggggagaaaaagaaaggcuggcgcagcagagcccccccagagcccaucucucagcgggggcuguccccuuggagacccccgggcucgccuacccggcgggcgaaacuccgggaagggccggaggagcucacuuacuucggggcugaaguugcugccuugggcccagccgagggaggcgagcgccgugccaagcgugagcagggggagcaggaggcugcgggagggucgaggggcgggagacaugguccccggcgucggggcgccgggcggugcgggcuccgcggcggggcccacgcccuggggucgcgccgccucucuuggggcgccuuugucuucuaaaggaacggaauguggauuccuagagcgcggucggcuuggaggugagggaauugcuccuggaaaugucuguuugcucuucucuuuuccguuuuuugaucuuucuucugcuuagucggcgaacugaguuggaagcccucucugcucuccuuuggucccucccuucucccacagccucuccuccgcccccgccccaaugcccuccuuuuucgguggggacgugguguuucagcucgaauccaauuacagcagga

SEQ ID NO: 7456 - RNA, 7366 nt, Mus musculus
ugacuggcagggguggggccaagcuggccgcgccccucgucgccggcugcugggcuucggccgggguccgcuggggcaccgcgagcugugcaaagccgccguccccuaagggccgcggggaccgagccgcacgccggcucggggacgggcaguccacaaaguuugguccgcggaggacgcagcgucgagcccggcaggugcggccgggccuggccggggcgcucgcggccuuccgggcgagcaccgccgggcacugguaaggagcgaucaacucugaaguuagcaagaggcgucacgccuguuccucuccgccgugcguccagcccuggcaccccgagccugggucgcaccggggcuaugcagcccccacccggcgaggagcuuccugccagguagacaagaggcgccccgggacccugccggcaccccuguucaacccaggaugcuaucggcccucccucuucuuuuccuccuccucgguaagaguccccgccccggugucacugcccgccgucccgcgcccuccuuggugacccacgaccccugcgaccgccgccccgucgagccucggccuccucucgggcugucccacacugucccucccacucacagccagggaaggcgaccuuucggcgaggucacgcaccuccuuccggcuccucuaccccuuccuauaaacuguccggaagucucagaugggccuccccuuggaguugcccaggugaagaaaacuugacucucucugcugcccuuucucgauucccccucuaggaggugcucuggcccgcccagaccggaucacuuucccacguucugguaaguaaagcgaguuccuaggguucuggggcaugggaaugaagaugcacccuagagaaaagaaucucuccccuggauccuggagucugcuguaauuuuagaauagguaucauccauuacuuuacagaaggggaaacugaggcucaaugugaacuggcaccugguaguuguuaagaaccaucucguuuuuuuauguguaauauccguguuuugucucccuaguuaggguaaggucuuccugagaguagaaacaguauuucucugccaacugacccuguggcuggcacaaagccuacaguaacauuacuuauagugugaauacuuaagaugaaguauaaagaauauggaaaaggaguaggguugucaacuccuauaaucccagcacuugagaggcagaggaaggagaaucaguucaaggccagccucagcuauauagugacuuugaggauauccuagguuacaaaagguuuuuguuuuuaaacaaacaaaccaaaaaaaaaaaaaaauggagagggaccaguuggcuguaacugguggguggagauuuuugccaucuugaggcauucagaggggaagaagaauauuaaagaacucuaccagugucuccccccccuucucccucuagcuugugaggcgcccccagcugugcucucagaaguacaaggcacuuuacagaggccucuaggccgggacagccgaagcuccccugccaacugcaccuggguuauccugggcagcaaggaucagacaguaacugucaggugagaaauaaggcaaguccccauuucucucuacugccccuucccucucccucugaaaaagccuuugaucaccuuucuaugauauuaccauccuugucagcagaagagaauuugguuugucugggucugcuguaaaggcuuagcuaugguggauauuuagcuuggggacuguccaucucaaaaggacucuagaaauuauucuggguucagcuagacuugugaugagucccugaaucauaguguggccuaguuguuaaucaacuuagucccuuccucaggguugggacuguauuacuagcucauugguggaaugcuuguguggagugugcagaaguccuggguucagucucuagcaaaacaaaccuucucugggucugccuuucugcauugcacuacuccauccuuacucuccccucccccuuccucuccucuuccccugucccuuuuccccuccccucccccuccccccucucucuucucacauccucuccccuuaucucuccucuccucuccucuccuuuuuuuuuuaaagauuuauuuauuuauuuaauuuaucugaauacaccauugcucucuucagacauaccagaagaaggcaucagaucccauuacagaugguugugagccaccaugugguugcugggaauugaacucaggaccucuggaagagcauucgaugcucuuaacugcugaaccagcucucuagcccaucccccuccccuuuuucugguuuugagacagaauuucacugugcagcccagcagguugguauuaaguuagcuccaucucauccucccagauuuugggcuuuccuguggagucacuaugcccaguauuccuuuuucuuuuuucuuauuuuuugguuuuugguuuucauuugguugguuuguuguuugugguuucugugugguuuuggugguuuuuguuuuguuuauuuugcuuucaguacugggaaacaacucagggguucacacauccuagaugagagcacccuaccucuaagcaacaaucccagcccuguaccccuaagacuccucauuggggcccacgucauuuggcaguuugccucauacauuucacuugaugagaacuugcccagagagcaggaugguaguggcacacgccuuuaaucccagcacucaggaggcagagacaagcuuagucugugauuucgaggcuagccuggucuaaauccugaguuccaggauagcuaaggcuacauaaagaaacucuaucucaaaaacaaaauaaacaaaggaaacacaaaagaauuuauucagaaagguauauaaaggagagaacaaucuaaaaagagacuguugacccgugguacagcccuggggacuucagauuuucccuugucacuuauggagcugagcuguugugguuaauugaacagauacauuuugucagcuaacuaccgggcacugugcuuggguuaugguauugccacaacuggaaaguaauaacccuggucucaccuuggucccugaacacaucgguucucucaaaggacucuaggaagggucuuguggucugauggcaccucuguuggaacuuugccccuugcuuauauuuuuccccaucgacucuauuggcugaguucucauuuggcucuuugaaucauggguaaggaagcauuugugcuuccugggcuaccagggaccugucaucaagaggggaggcaggggugggggugggggagcaaaucuccagagcaucucaugucuugcucuucuguaccucauagguuccagaagcugcaucuggccuguggcucagagcauuuaauccugcacuccccucuacagccaccaaucucccugugugaggccccuucuggcccuuugcagcuaccagggggcaaugucaccauuacauacagcuaugcuggggccagagcacccaugggccagggcuucuugcugacuuacagucaagguaggcugaacaggguguguggugggaccauuggaggagaagugggagucccccaggaagaggcaaggauccugggaguucuggcacuucccugucucuugaugccucugcagauuggcuacugugccugcaagaagaauuccagugccugaaccaccgcugcauuccagcugcucagcgcugugaugggauugaugccugcggggauggcucagacgaggcaggcugcagcucagauccauucccuaaccugaacccagcccccgcaccaacucuggccugcaaucucaccuuggaggacuuuuauggggucuuuucuuccccuggauauucacaccuggccucagucucccacccccaguccugccuguggcugcuggacccccaugauggccggaggcuggcagugcgcuucacagcccuggacuugaguuacggagaugcagugcauguguaugauggugcuggaccccccgagaccccucgacugcuacguagccucacccacuucagcaauggcaaggcugucacuguggagacccugucuggucaggcuguuguguccuaccacacaguugcuuggagcaguggccggggcuuuaaugcuaccuaccauguccggggcuacuguuuaccuugggacagacccuguggcuugggcucuggccugggggcuagugagaaccuaggugagcguugcuauagcgaggcacagcgcugugauggcucaugggacugugccgauggcacagaugaggaggguugcccuggcugcccaccagggcacuuccccuguggagcugcaggcaccccuggugccacagccugcuaccugccugcugaccgcugcaacuaccagacguucugcgccgauggagcggaugagaggcgcugccggcauugccagcccggcaacuuccggugccgggaugagaaguguguguaugagacaugggugugugaugggcagccagacuguacugacggcagugaugagugggacugcuccuacgcccugccccgaaaagucaucacagcagcagucauuggcagccugguguguggccuguugcuggucaucgcucucggcugcaccugcaaacucuaugccauccgcacccaggaauacaggucaguuggaggggggcuggcuguggaggagccgggacugaagaugagaugggauccaugcaguuccugggcacugagcaggcccaccucgaggagugguuccugccaucagcuccagagaguagucucuaggaagggagggacaugacuuuggacagaccuggccugggaauggagggaagaggccuucugggccaaggcacauugcccucacguugaguaacuuaugucuaaguggcccuccuuucuuccagcaucuuugccccgcucucccggauggaggcugagauugugcagcaacaggcacccccuuccuaugggcagcucauugcccagggugccaucccgccuguggaagacuuccccacagagaacccuaacgaugugagucauucuuccaaccuuggaccucacggugacagccuuguuuccuaccuagccaucuggccacccugauucugacgucugccucucuccuugcagaacucugugcugggaaaccuacguucucugcuucagaucuuacgccaggauaugacuccaggugguacuucagggggccgccgucgccagcguggacgcuccauccgccgucugguucgccgucuccgucguuggggccugcuuccucgaacuaauaccccagcucgggccccugagaccagaucccaggucacacccucuguucccucugaggcccuggaugacagcacaggccaagccugugaggguggggcaguaggggggcaagauggggagcaggcuccuccacugcccaucaagacccccaucccaaccccaagcacacuuccugcccuugcuacugucucugagcccccagggccacuacccucagugccuguagaaucaucacuguugucuggaguuguccagguccuacgaggccgccuccuacccagccugugguccccaggccccacuuggacccaaacuggaacucacacaacaguccuguccccagaggaugaggacgauguauuguuauugccacuggcugagccagaagucugggugguggaggcagaggaugaaccauugcuugccugagggacucuaggcacaaugguaugauccuuggaagugguucagcuuccccacugaucuauguagcacagaaaguuagugucucuccagcagggagagcauucacuguacacaccuucugguaugacaagagacuucaccaccacccucugcccagccugcuauccagguggcuguguuacaaaaggucccacaagggucacaggcuuggacacuccguucuuuccagcuccccacccaaaaguggccuuaacuacuagacugguuggcuggagaccuagccaccaaggggaggauuuggccagggugaugguuuugccagccuccaucccuguggugccuggcccacuuagaggacacaagugcuuuugcccuguagcugcaucauuguccaggaaaucaagaugacaaaaauaaaggaaucauaaacuucagcccuugguaaaucagcugugagccugcauccugcauccucucuguccaucucugccaugcagggaacccugaggaauagccuucuccaucuucauucaccaggccccaacccugcacugacuggcaucgggcucagucugaacucagugcagacccaguucagagccagcugagcccugaagucaagaaagggucugauuauggaaugcucucacagcacagaucacagaagcagucuguuccuggguaaaaccugggagccacuggcucuccgccccagccaggcaagaaggugaggucuccacuugggcccuucaaagcagguagagaagcagaaggaaagaguuugagguugugaaaucccuggcacgacugaccaaauccagggggucuuccuggaggaggacacaaacugaguucccaaccaugcugucaguaguaagaagaagcagguuaaaacagagaggcuagaccuaccucggugaagcccaaggagagguuggagcugaagcgcugggcauggaugaggggaugagauggaagaaguguuggaacccuggcugauggcagaaguugccccagagcuucagaggaaagucagcauucccuaaaguccccaggaaacuggcuuccucaggcucucccucuuaggacccucaacaacuugaaucagggaaacccuaagcuuugaccuagugcucuccagagacugcugccaggcuagggaaucuuacaguuuucucuuugggcccgcccucccagcuuggacccuucaggugaaaguggugaaacuuucagagugaguucccagacagccaaggcuacccaggcaaacccuggagggagagggagagagaacaugaagugagcugccuggccucucacuguagccaccucuggcccugcugacugacaccuucaucccucccccucccccaguccucucccuuccccggggcauuugcacuguggacagagaggguaaaaagagggcuccugguugggaugcaucgguauguugggggagaggggguggaggggagaggggaggcugggcuucuaggucauuguauguaagucauuguacgugaggguagcaguuuauccuauucuggugcaagcaggaacuuugcuucugccagccacagugggaccccaggguuggugggaagggaaauugaccuugcacagacaauauaaggaagcagauguacuca

SEQ ID NO: 7457 - RNA, 7366 nt, Mus musculus
ugaguacaucugcuuccuuauauugucugugcaaggucaauuucccuucccaccaacccuggggucccacuguggcuggcagaagcaaaguuccugcuugcaccagaauaggauaaacugcuacccucacguacaaugacuuacauacaaugaccuagaagcccagccuccccucuccccuccacccccucucccccaacauaccgaugcaucccaaccaggagcccucuuuuuacccucucuguccacagugcaaaugccccggggaagggagaggacugggggagggggagggaugaaggugucagucagcagggccagagguggcuacagugagaggccaggcagcucacuucauguucucucucccucucccuccaggguuugccuggguagccuuggcugucugggaacucacucugaaaguuucaccacuuucaccugaaggguccaagcugggagggcgggcccaaagagaaaacuguaagauucccuagccuggcagcagucucuggagagcacuaggucaaagcuuaggguuucccugauucaaguuguugaggguccuaagagggagagccugaggaagccaguuuccuggggacuuuagggaaugcugacuuuccucugaagcucuggggcaacuucugccaucagccaggguuccaacacuucuuccaucucauccccucauccaugcccagcgcuucagcuccaaccucuccuugggcuucaccgagguaggucuagccucucuguuuuaaccugcuucuucuuacuacugacagcaugguugggaacucaguuuguguccuccuccaggaagacccccuggauuuggucagucgugccagggauuucacaaccucaaacucuuuccuucugcuucucuaccugcuuugaagggcccaaguggagaccucaccuucuugccuggcuggggcggagagccaguggcucccagguuuuacccaggaacagacugcuucugugaucugugcugugagagcauuccauaaucagacccuuucuugacuucagggcucagcuggcucugaacugggucugcacugaguucagacugagcccgaugccagucagugcaggguuggggccuggugaaugaagauggagaaggcuauuccucaggguucccugcauggcagagauggacagagaggaugcaggaugcaggcucacagcugauuuaccaagggcugaaguuuaugauuccuuuauuuuugucaucuugauuuccuggacaaugaugcagcuacagggcaaaagcacuuguguccucuaagugggccaggcaccacagggauggaggcuggcaaaaccaucacccuggccaaauccuccccuugguggcuaggucuccagccaaccagucuaguaguuaaggccacuuuuggguggggagcuggaaagaacggaguguccaagccugugacccuugugggaccuuuuguaacacagccaccuggauagcaggcugggcagagggugguggugaagucucuugucauaccagaagguguguacagugaaugcucucccugcuggagagacacuaacuuucugugcuacauagaucaguggggaagcugaaccacuuccaaggaucauaccauugugccuagagucccucaggcaagcaaugguucauccucugccuccaccacccagacuucuggcucagccaguggcaauaacaauacaucguccucauccucuggggacaggacuguugugugaguuccaguuuggguccaaguggggccuggggaccacaggcuggguaggaggcggccucguaggaccuggacaacuccagacaacagugaugauucuacaggcacugaggguaguggcccugggggcucagagacaguagcaagggcaggaagugugcuugggguugggaugggggucuugaugggcaguggaggagccugcuccccaucuugccccccuacugccccacccucacaggcuuggccugugcugucauccagggccucagagggaacagagggugugaccugggaucuggucucaggggcccgagcugggguauuaguucgaggaagcaggccccaacgacggagacggcgaaccagacggcggauggagcguccacgcuggcgacggcggcccccugaaguaccaccuggagucauauccuggcguaagaucugaagcagagaacguagguuucccagcacagaguucugcaaggagagaggcagacgucagaaucaggguggccagauggcuagguaggaaacaaggcugucaccgugagguccaagguuggaagaaugacucacaucguuaggguucucuguggggaagucuuccacaggcgggauggcacccugggcaaugagcugcccauaggaagggggugccuguugcugcacaaucucagccuccauccgggagagcggggcaaagaugcuggaagaaaggagggccacuuagacauaaguuacucaacgugagggcaaugugccuuggcccagaaggccucuucccuccauucccaggccaggucuguccaaagucaugucccucccuuccuagagacuacucucuggagcugauggcaggaaccacuccucgaggugggccugcucagugcccaggaacugcauggaucccaucucaucuucagucccggcuccuccacagccagccccccuccaacugaccuguauuccugggugcggauggcauagaguuugcaggugcagccgagagcgaugaccagcaacaggccacacaccaggcugccaaugacugcugcugugaugacuuuucggggcagggcguaggagcagucccacucaucacugccgucaguacagucuggcugcccaucacacacccaugucucauacacacacuucucaucccggcaccggaaguugccgggcuggcaaugccggcagcgccucucauccgcuccaucggcgcagaacgucugguaguugcagcggucagcaggcagguagcaggcuguggcaccaggggugccugcagcuccacaggggaagugcccuggugggcagccagggcaacccuccucaucugugccaucggcacagucccaugagccaucacagcgcugugccucgcuauagcaacgcucaccuagguucucacuagcccccaggccagagcccaagccacagggucugucccaagguaaacaguagccccggacaugguagguagcauuaaagccccggccacugcuccaagcaacugugugguaggacacaacagccugaccagacagggucuccacagugacagccuugccauugcugaagugggugaggcuacguagcagucgaggggucucgggggguccagcaccaucauacacaugcacugcaucuccguaacucaaguccagggcugugaagcgcacugccagccuccggccaucauggggguccagcagccacaggcaggacugggggugggagacugaggccaggugugaauauccaggggaagaaaagaccccauaaaaguccuccaaggugagauugcaggccagaguuggugcgggggcuggguucagguuagggaauggaucugagcugcagccugccucgucugagccauccccgcaggcaucaaucccaucacagcgcugagcagcuggaaugcagcggugguucaggcacuggaauucuucuugcaggcacaguagccaaucugcagaggcaucaagagacagggaagugccagaacucccaggauccuugccucuuccugggggacucccacuucuccuccaauggucccaccacacacccuguucagccuaccuugacuguaagucagcaagaagcccuggcccaugggugcucuggccccagcauagcuguauguaauggugacauugcccccugguagcugcaaagggccagaaggggccucacacagggagauugguggcuguagaggggagugcaggauuaaaugcucugagccacaggccagaugcagcuucuggaaccuaugagguacagaagagcaagacaugagaugcucuggagauuugcucccccacccccaccccugccuccccucuugaugacaggucccugguagcccaggaagcacaaaugcuuccuuacccaugauucaaagagccaaaugagaacucagccaauagagucgauggggaaaaauauaagcaaggggcaaaguuccaacagaggugccaucagaccacaagacccuuccuagaguccuuugagagaaccgauguguucagggaccaaggugagaccaggguuauuacuuuccaguuguggcaauaccauaacccaagcacagugcccgguaguuagcugacaaaauguaucuguucaauuaaccacaacagcucagcuccauaagugacaagggaaaaucugaaguccccagggcuguaccacgggucaacagucucuuuuuagauuguucucuccuuuauauaccuuucugaauaaauucuuuuguguuuccuuuguuuauuuuguuuuugagauagaguuucuuuauguagccuuagcuauccuggaacucaggauuuagaccaggcuagccucgaaaucacagacuaagcuugucucugccuccugagugcugggauuaaaggcgugugccacuaccauccugcucucugggcaaguucucaucaagugaaauguaugaggcaaacugccaaaugacgugggccccaaugaggagucuuagggguacagggcugggauuguugcuuagagguagggugcucucaucuaggaugugugaaccccugaguuguuucccaguacugaaagcaaaauaaacaaaacaaaaaccaccaaaaccacacagaaaccacaaacaacaaaccaaccaaaugaaaaccaaaaaccaaaaaauaagaaaaaagaaaaaggaauacugggcauagugacuccacaggaaagcccaaaaucugggaggaugagauggagcuaacuuaauaccaaccugcugggcugcacagugaaauucugucucaaaaccagaaaaaggggagggggaugggcuagagagcugguucagcaguuaagagcaucgaaugcucuuccagagguccugaguucaauucccagcaaccacaugguggcucacaaccaucuguaaugggaucugaugccuucuucugguaugucugaagagagcaaugguguauucagauaaauuaaauaaauaaauaaaucuuuaaaaaaaaaaggagaggagaggagaggagagauaaggggagaggaugugagaagagagaggggggagggggaggggaggggaaaagggacaggggaagaggagaggaagggggaggggagaguaaggauggaguagugcaaugcagaaaggcagacccagagaagguuuguuuugcuagagacugaacccaggacuucugcacacuccacacaagcauuccaccaaugagcuaguaauacagucccaacccugaggaagggacuaaguugauuaacaacuaggccacacuaugauucagggacucaucacaagucuagcugaacccagaauaauuucuagaguccuuuugagauggacaguccccaagcuaaauauccaccauagcuaagccuuuacagcagacccagacaaaccaaauucucuucugcugacaaggaugguaauaucauagaaaggugaucaaaggcuuuuucagagggagagggaaggggcaguagagagaaauggggacuugccuuauuucucaccugacaguuacugucugauccuugcugcccaggauaacccaggugcaguuggcaggggagcuucggcugucccggccuagaggccucuguaaagugccuuguacuucugagagcacagcugggggcgccucacaagcuagagggagaaggggggggagacacugguagaguucuuuaauauucuucuuccccucugaaugccucaagauggcaaaaaucuccacccaccaguuacagccaacuggucccucuccauuuuuuuuuuuuuuugguuuguuuguuuaaaaacaaaaaccuuuuguaaccuaggauauccucaaagucacuauauagcugaggcuggccuugaacugauucuccuuccucugccucucaagugcugggauuauaggaguugacaacccuacuccuuuuccauauucuuuauacuucaucuuaaguauucacacuauaaguaauguuacuguaggcuuugugccagccacagggucaguuggcagagaaauacuguuucuacucucaggaagaccuuacccuaacuagggagacaaaacacggauauuacacauaaaaaaacgagaugguucuuaacaacuaccaggugccaguucacauugagccucaguuuccccuucuguaaaguaauggaugauaccuauucuaaaauuacagcagacuccaggauccaggggagagauucuuuucucuagggugcaucuucauucccaugccccagaacccuaggaacucgcuuuacuuaccagaacgugggaaagugauccggucugggcgggccagagcaccuccuagagggggaaucgagaaagggcagcagagagagucaaguuuucuucaccugggcaacuccaaggggaggcccaucugagacuuccggacaguuuauaggaagggguagaggagccggaaggaggugcgugaccucgccgaaaggucgccuucccuggcugugagugggagggacagugugggacagcccgagaggaggccgaggcucgacggggcggcggucgcaggggucgugggucaccaaggagggcgcgggacggcgggcagugacaccggggcggggacucuuaccgaggaggaggaaaagaagagggagggccgauagcauccuggguugaacaggggugccggcagggucccggggcgccucuugucuaccuggcaggaagcuccucgccgggugggggcugcauagccccggugcgacccaggcucggggugccagggcuggacgcacggcggagaggaacaggcgugacgccucuugcuaacuucagaguugaucgcuccuuaccagugcccggcggugcucgcccggaaggccgcgagcgccccggccaggcccggccgcaccugccgggcucgacgcugcguccuccgcggaccaaacuuuguggacugcccguccccgagccggcgugcggcucgguccccgcggcccuuaggggacggcggcuuugcacagcucgcggugccccagcggaccccggccgaagcccagcagccggcgacgaggggcgcggccagcuuggccccaccccugccaguca

SEQ ID NO: 7458 - RNA, 4339 nt, Mus musculus
cauuagcauaugugaccucaucaggaggcgggacaauuuccccaggugucuggagcggggagggguggggaauaugaugggggggggcaguauuuaaagggaaaagcugacagugcugcugagugaggaaccggugcucugagccgcugggcugcacucgcacaugcacgccgaugcacacggaccuugacaccgacauggacauggacacagaaaccguagcacuuuguucuuccagcagccgccaggccuccccacuggggacacccacaccaggugagggcuaaggggaguaggauguggcuaaagcugugggugggggagcugaagcuuuggugggaaggucugggcaggauccaacgagaagggaagagcaaaugcggcaagggagaccccugcacuuuugagguccggacggccaaggggaagggggaaagcugccagggugccccucccccaacgcucccagggcuucgccagagaaacuggcacuuggccccuagguuaaccucagcccuguuaggcagagccugccagaagggaagggggaagaaaagaagcagcccacaaaccuaggaauccccagcuaagggggcuucccuggggaccuguuguaagggcuucuucuagcuccaucguuggcugccugccaaauauugauccugugcuauuuauagccucgcuccaucccccuuuguugugucuguuguuguuccucuaguuaccccaaccccugaauugucauccuccucacacacacucuccaccgcuaccuccccacgaacacaacauugucucccacucgccaggacaggcaaggauccaggaggauucucucucacacacaaacacucacgcaugcgaugcucaccuaccuacggggacacaggaaacaguacgcuccccuucuuuagcccuccucccccagaccuagaaauaaggucccugcggaguuucugauucugccuacaccugccagucugggacuggggugcaggaagaaauaggaggcagggcccauuagagggaagauauagcuucccaacucacuaggccuaauguaggggcgugccuaugacgguguaaggugugagugguguguaacccugugcacaggaccucccucagugacacaaguuuugaucauguuguggcuaggaucaacaugggaaacuaucaugccagcgccuugaaaguucauugcuuuugaguuucaggggaauuuuuagugcacaaggcuagacuaaugacucucagcucuuuuggggucacgcucuuuaucuggguguagcugaagaagcagccugaauuaaccgcucauccgaugucuagauauaucucacccauggcuuccuucucucccccucccuagaagcagauacuacacuucugaaacagaagccagagaaacuguuagcagaguuggaccugagcgggccuccuccugcuccugggguccccagacgaagaggaagcaugcccgugcccuacaaacaccagcugcggcgggcccaagcuguagaugaacuugacuggccaccccaggccucccccucuggcuccucugacuccuugggcucaggggaggcagcccuuacccaaaaagauggcgucuuuaaggucaugcucgugggggagaguggcgugggcaagagcacucuagcgggcacuuuuggaggucuccagggagaccaugcucacgagauggagaacucagguauucaggggcacccuggagggcucuagucaggcaugaaaguguuugcauugugaacagucccuggaggacagaaucuaagagaaauuucuccauugcuuucuaugaaguuugccuggaggcgacucccuaaugucaggagguguuccuggacaccaggucucacacguguuggggaaucuccucauguuuucuuccuucuuucccaacagaggacaccuaugagagacggaucaugguggacaaagaagaagugacuuuaauuguuuaugacaucugggaacaggugaggacuaagaugugucugacucugcagggacuggggaagagcagucuggcugaagcugcuggcauuacccauccuggcuccaaccauggcuagcaaugacucugcauuaccacaucucaagggggaaaggcccaccuuggcaggccuaucuuggcucagagcugugauacccaccauuuuccuaggaccuuuuggcucagacaaaaguuagaaucugaauuugacaaacccuucuguuacaagucagguuaauuacacagaaacugacccauucauaaaucugaugugacaggaccggaggucucuguggucucaguaaagggagaaaugugcaggggcuucugaguauaauagcucuauguggaaagaagaggcuacacucuguuacuuuuaaaaauuuaucuaucuaucuaucuaucuaucuaucuaucuaucuaucuauuuauuguucuuuaucacaacacucccuuugccuuagcuugcugugugugggauuacaggcuuacaacaugcuggguacucaggccuuugugcauacuaggcaagcauucuaccaacugugcuauauccccagcccuuccagacuccuuacuuaguugucuaagucuaagagaguagaugguuaaccuacuaugagauccuauuucuccaauucucccacgugggauucacaucacuaacuccccccaccccacacaaggccccugagcauugaaauccugcccuuaacuggcuccuaguugagcaaguagccuuucucacacagucgguuccuggucccuggucccuggucuaggccaucucaaugccucuagcccuaguauuucauaguucucugcucaucugcagggagaugcaggaggauggcugcaggaucacugccuucagacgggggaugccuuucucaucgucuucucagugacagaucgacgaagcuucucuaaaguuccagaaacccuucuucggcuccgggcugggaggccccaccaugaccuaccugucauccuuguuggaaauaagagugaccuggcccgcucccgggagguaucacuggaggguguguauccuaaagccauucuguacuugaaaucuccauaggccuuuuaccccuaacuggugcgugagucacugguacccagcuucuaagugagguccuucacuagccuucacugcuccuccuggguaccucggccacccuuucgaaccaccgcccuaggaucccugcucaguucugaguugggauucgguggucccucccucauuucccgcaccaccugugcuagcccacccuagucucaggcaaagcugcccaacgggcgccuuagcugcuguucccuuccugcagagggucgccaucuggcugggacgcugagcugcaagcacaucgagacgucggccgcucuccaccacaacacucgugagcucuucgagggugcugugcgucagaucaggcugcggcggggccggggucaugccgggggccagcgacccgaaccuagcagcccggacggccccgcgccgccuacgcgccgugagagccucaccaagaaagcuaagcgcuuccucgccaaccuggugccgcgcaacgcuaaguucuucaagcaacgcuccaggucaugucacgaccucucugugcucugagccacggucgccauggucacugcagucgccauggucaccgugcccuccgcucgcccccucaccccacuccuguccgucuaggaaaccaaaaauacccaggaugcccuggugugagcgggaggcggggacggguagcugguagguccaccaccaccaccucuccuggucuuaacagccgaccauucacagagccucaagaccugcaagucagggaagaaaaccgugcugcaagguauuuuuuauuguuauuauuaacuugcaagaagccaccucucccggaaagacacuccaaaaacuagaaccgaaaaagugcuuuguagccuccuggauggagcugaccuccuugguacucggaacaugccuuaccuuuaaguaaguuuuaaagguaaaaacccagagaugacuuuuccagagauaacugaaaauuauccucuguccugguccacuuugcccuuaagaaguucuucagagaaagggcuggaaguuauucuugaaauuggacucugacuuaccauucuaguauggcacguuuccuuuaagguuauugaugugacgaugugggcagacucucugcauuuagaugcccuaagguagaucugagggcuggcagccccuuugccuagggacuaggaggcaccagcaagggccacccuuuccccuuuccaauaaauuuuuuuuucuauugcacuaag

SEQ ID NO: 7459 - RNA, 10195 nt, Mus musculus
aggaaauccuugcgcggacaccucaacccggggugcacaccgcgcuccgcccuucccggaaaguagauccggccaggcagacaaaaguuuggagaaguuggguccgugcaagugagagccaggggggcgggccgggccggcgggcgguggcgcgagcggacgcguggacagaccugcggaggacagccgcuaccgugggcccugccagccgcgcgcggacccucucgcuggggcaugcuucgggaucgcgggcacccggcaccugggccgcucgcugagcccccgugagugacuugcaucccaggaauccgagccccggggaacucgagcccggccucuggccgaaacacugcagcgugccgggcgaggagggggcugcaggccccagauccgugggcauggaacgguuaggggagaaagccagucgucugcuagaaaaguugagacucucggacuccggcagcgccaaguucggccgcagaaagggcgaagcgagccggucugggucugaugggacccccggagcaggcaagggacgcuuaagcggguuggggggaccuaggaagucaggacaccguggagcgaauggggggccuggagaugaaccuuuggaaccggccagggagcaagggccccuggacgccgagcggaacgcacgcggcuccuuugaagcgcagcgcuucgaaggguccuuucccggggggccgccgcccacucgagcccugccucugccucugucgucgccuccugauuuucggcuggagaccacggcuccagcccuuagcccucgcuccagcuucgccaguagcucggccagcgaugcgagcaagccaucuagcccccggggcagccugcugcuggacggagccggggccagcggagccggagguagccggccgugcagcaaucggaccagcggcaucagcaugggcuacgaccagcgccacgggagcccgcugcccgcggggccgugccuauucggccucccgcugaccacugcuccugcgggcuacccuggaggggcuccguccgccuacccggagcuccacgcugcccuggaccgacuaugugcccaucgguccgugggauucggcugccaggagagccgucacucguaccccccggcccugggcagccccggagcucuaaccggagccguggugggaacagcggguccuuuggagagacguggggcgcaacccggacgacacucgguuacaggcuacggggacugcgccgcgggggcccguuaccaggacgagcuaacagcauugcugcguuugaccguggcuaccggugggcgagaagcgggugcucgcggggaacccucggggauugagccgucgggucuggaggagucuccuggucccuucguuccagaggccucccgaucacggauacgggagccagaggccagagaagauuacuuugguaaguaggaaagaagaagcuagggaaccgagagaccggucaaugugugcgguuacccaucgccccgacagcacaaauugcuggggccgggaguugcagguggagaccccagauuuuucuaauauggaaaagggcggacccuagagcacuugcucaguccagccagguuucuaauggaaccaggcugaugaucccugacaaauucaacucuugauuuuucucgggagucccauuuuucucaagcaucguggcacgacggccugucgcaguaggaggccucggaaggaggaggaggcgcugcggggccaggagagcauccucucgcgccccccucgcggcugggcuccugcaagcuccggcgugccgcgcccccacccgcuccuugcuccacccguaggaauucggggaaugcgcggggggcggggcgggcggccgcgugcgugccgacuccugcccuggcgcuccaggugccgugggcgacgcccgccaggcggagggguggggagcgugugcuugcguugggggauguuugcuagcucccgcgcagucuugccugcugucggggaaauggagccugauagggaagccugauaggaaagcaaggauucaaguccugcccggucccgccccaguccugauggugaggugugugcugguggccuuuuaaaauaggccaguaccuauccgccuguuuucaccaguuuccggaaaucagggcaaaaccagugaccccgcuugagaccauuacaccuauuccguaugacuaccaaguuuuaccugucugagucccuccauaacuugaccagcauccagaaggaaguagcccugccucccugcuccuguugaggaaaccuggccauggucucucuccaauacucgaaauuuuaaagaagugucgaucgcuuguuagagcugggcggugggguguuaucaaaacucacagacauuacuuaauuauaaaaaguagucaggauuuaaauguguacucccacucgccccuggacucuggggggucuccaguuuuccaaguaaccucgauuuuuuuccccuagcauucaaguuccuuugccccuccccccacggcuagucguccccccucccccccagagaaggauaacuggaaguucaaagguagcagcagaaccuuaguaggcuagaauucaauacacacacaccuuuuuuuucaccuucuagggaaggggggacgcagggcagacgauauaaaucacuuugaucaagggagacaguagcagggcccauuuaggaauuuccuuuugaggcccaagagugagcugggaaaagaagccucacuggcuaagccaucagagcccaaaguaagaaaggcucagaaagugcuguaaaguggcaggaagaagcuagguguggaugcucugugaguggaggugaggcagacgugccugagcaucguccucuuuccacaguaucuguggcuucccacagaaaggcucugccaggacccccuggcauggcagucuugggcaaauuucccugauccugagagagaacacacaccuuuugaacucagaaaugaggccagguugccuccuuugauagccccuuacaagcagcucuguguccuagugcuagccugaugcuaacccuuuuccugcugccucugguuaggggcccucuuccuuggcuucggcucugcccagcugccagagggugggagcagaacaggccugggcccaucaguugcugcagcugcugcaccagcucccagagccccugggcaaagacugggaugggccccaacaggcagagaguguggcacugugccgagggggagagguggggcaggcccguugggaucugcuccccaaagacaggucuuagcccucagucaugggccuggaauuggggaguggagggaaggaagaacacgcccaggaaaggcugguuccagaaccagguguauguaugcagcuuaguggagagugccagggaagagcagcuaagcccuguuuucacggggcaggaaggagguagggucugcuaccgaccccuccccucaaguccuauacaguccucgucccugaagacccaacuauguucuuagcaguaaguacaggaguguucacguggcccaucuacauaaaaaacccauugcuaggccagaucaaguuuuaugaaugguaaaacugaacucccagaaagacuuaagggggccuggguugcuuccuuuaggaaguuuuucacgccccccaggugcugcagagccccugugugaaacaaagcgucuuuaacuuagccguuuuuuaaauaaauuagguaguaugcuaagcaccaaagacguguuugaagaguauccgguaauugauaagaauggaucugccuagucaagagcgugccgcauccuacuucucucuuuagguuuugagacagggucuuagcuugaucucaggcuucaccugcuggguagccaaggugagcucccuuuguccugccucuauauccugagcgccggccacucucacacccauauuauuuggugccagggauggaauccagggcuuccuccaugguaggcaagcauucuacagguugagcuuacagcuccaaacccccucccccugcaccccguuucuaguuacccuaucuucuccaaaggagacugugccccuuggcacaucaggcaagaaagcuuggggaugauugcuuggguuugggcuggggagauaagagugugacuguccccccgacucuucuuaucucaggcaccuguaucaagugcaacaaagguaucuaugggcagagcaaugccugccaggcccuggacagccucuaccacacccagugcuuugucugcugcuccuguggugaguguaccugcagcuuaagccccccacccccaccggccaaacccugaugcaaaggagcaccugccaggacccauggcugucccauucccuugucugagcacuagcuaccugccuuguccucccccggggcugucucucagccucccugcuccguccucugaaccucucuuucuccugugccucccugccggcccagcuuugggcuccagccccaccucuucuuuggugagguuuggucuugggcagcagaguugccuggggcgacggugaaagacuggaaugugggaagggcggggugugggcugggggaauggggagcuuuggggggugcgggaggggguuuuucucuuggcuggucagaguucagccaccucacuagaguggaggccaucgggccaugccaagcugaugacaucacaccggaggaaugucugcugcugcuguuagcucaggaggcccucggugggggugcucccccccccacacccucccucaccucucauuaucccuuccacacugcuuacccggucugauuccugcuaacccucuaaucuccuaucucugccugucugacucuaccacucagcuuuucccuuccuccccccacuucugccugcaucucucugggcugaucuggcugcccuuuccuuuaggccucuuccuggugugcccccucuuuuccucucccaugucagaaagugagccuuucucgacgaccccccccagcagaacuggaacuggggagccuucuccuucugcacucuguucuucuugcugucuuugaccgcucagaucugauggaguagcuucagauccguuggaguagcuucagauccgauggaguagcuucaugggugucaggcuaaaauggucugccauguagaguuggggaaaaaaaaucccaggagccucugaccccaaagacuuguguuccuugaagcccucaaacaaagcaguagcuuccaaagaugcccugaccaccacagaggcuagacagacgcgugagaauaggauggcuacagugaaaugaagaauccugggcuaaaacaucccagaggcuaaggccuggaaccaguguuccaugcaaaucaaauaauaccuagucuagucagagcuucuuagcagguacaccagccuggccugaccuuggcucucucuuagguggcuccccaugccuugagcccugaggagguguggguggcagacagcuauugaagacacaggagcuagaggaggaaggagcagaaacguuguuccgcuggaaugaagccaaagccaauuggaauuguaucguacuggauuuuuuuuuuuccuuugaggcaggcuuuacuguguguaggccaugcugaccuuaaacucuuggucuuucugucucugucacauggauaugggguuuuuguuuaggaagggaaaauagaccacacuuaggaggaaagcuuuaaauaaaguccagguccaaauguccugucaggauuggggagcaggggccagaagaggaagagcccugugugggggcuccagcguuaaccuccagcgccuccucugcugcuucuaggacgaacuuugcggugcaaggcuuucuacagcgucaauggcucugucuacugugaggaagacuaucuggugagugaagggccgaggcuuggcuuucacagugggaccccggcggccggcggguuccaucacaguuuucagcgugguaacucuguccugucuccucucuaguuuucaggguuucaggaggcagcugagaagugcugugucugcggccacuugauucuagagaagguaaggaacgccccuucagcuggguuuugggggccaccggccugaagggcaagaacuaguggcauugcaaauagagagccuuuugcuagauggucauuuucuuacccguccuccccaaagcugccucacggugauccccugugagagccaguccguagucucagccuccaagggcgucugugaucugucccuucccugauucuggacacagcugcccuccagccugagcuacgugaaucggcucccuuuucugcuacuggucggaaacagcuggaacucagcuuucuuuucuguauaagaagaaggaauuggguuaagguuuacaggauccaugauccuugacuguugcugucuaguagcuaccugggaagaacugacaaaaggaauucauucuggcacccaccucaaauuguaauaaaaaagagggguggucuguuaguugagcgaaugccacaagacagccugggcuccauccucaacccugcgcaaaccagccguagugcggcagagggugucggggucaaagccauccucagcuaugcggugaugagguuuggguuuucucucuauuuuuucuucuugguuuuggguuuucagguaguccuggcuguccuggaacucacagagaucagccugccucugccucccaagugcuagcacuaaaggucuguccugcugcugccaggcuccauagagguuuuuuuuguuuguuuguuuuguuuuuguuuuuguggguuuuuuuuuuuuuuuuuuuuucccgagacaggguuucucuguauagcccuggcugucuuggaacucacucuguagaccaggcuggccuugaacucagaaauccgccugccucugccuucugagugcugggauuaaaggcgugcgccaccacgcccggcuuccauagaguuuuuaaggccagucuuaagauacuuuugacccugucuccaagaaagacuccuugguccccucaaauuagguagcauucuucuaggaggacuggggguggggugggguuggugguggaaaggaacgugauggguagcuggagagaggcuguggggacacugauccuucucccgcccgcccugugagcuagauccuccaggccauggggaaguccuaucacccgggcugcuuccgaugcaucguauguaacaagugccuggacggcguccccuucacuguggacuucuccaaccagguguacuguguuaccgacuaccacaagugagucugaccccugggaggaaaugugggccugggcccagggaguccucagccucacuuaucacugucuucuuuuuuagaaauuacgccccgaaaugugcagccugcggacaacccauccuccccucagaggucaguguauccagaguuccucggggcggccagcgcugccgccucuggggaggagauggggacaugcagccuggcccuugggaaguggcacuucgaaggaaugugcauucugugaaagauucccgugugacucugcucuuggggucaccacccugaccuaaacauccggaccuagacuagcugggcccaggcuccauaucuucugucccccguacagagaacaaggcuuucuuuggaagucaaggucaccagauacagggacugaaaaggggugaaacuguccuuaaacugguaaaaaaaaaagggacagggauuauuugagcuguguguggagaggguaugucuagaggaaaagcuacagccucuuccuuauauuggcuugugcucagccuuugccuuccccugccccucccccuccccccugcuucucagcaggaggaagcuagcaaguaaggcugagccccuguguguggaggggagcuagaggccuggaggcauggacagugccaggguaguggguagcauucugguaggaguugcuuaaaagaucucaaagcuacauguuagcuacguggaaucuaacugcgggaagaggccuuuauaaacccucuugauggagcaggaggguuucugugguaugggauggggauuuggggacaccaugcucugcuuaucccccaugggacucuacguguuucagggcugugaggacauugugagggugauauccauggaccgugauuaucacuuugagugcuaccacugugagguaaguguugggguucggggaugauguggggaaaucggaauuuggaagggggauucuuggaaugacugggcaucugugggagggauuuaggauacagaaaaccaggacacugcagugaccuauguccagucucucuuguccucuagcuuuucuuucuaauccuaguucuuuuuaaaucuggaaucuggcuuccccagccucugaacugcuggaauggggcuugucucaugauuucugcugcugcagcgaccccugguguccagaagaaguauuucucggguuuucacuucaaguccacccuuucacccuucacccucccuggggccuuaccacucacuuguccagucacccggagucucccaggauggccucaggguagggagccuggguggaagugaaccaguugccuucuucccuaggacugccgcaugcagcugagugacgaggaagguugcugcuguuucccucuugauggacauuugcucugccacggcugucacaugcagcgccucagugcccggcagcccucuaccaacuauaucugagcugacguuacugcugccaccaccacuguggagaaacucucuggccagcggaggcaaggaguguauucugcaauccuugugaagaggucucuggggaggccccgaaggccagagacccaaagauccuaacauuccaaaugggcugcggaggaggaaccuucugguugccgggagaguugacugguguucauugcgugcagccugugcuacaguagaugggauguagcacacgcaggcggguuucaguacuuccugaacgccagauuauaauguauuuuuccaguguauguuucuauauacgucacacaauguucuggugcuggaucacaugagggcaucacagaaaccacccccagucuguuguacccuaugcauggagucaguggaaccuuucccacgggauccuaucuuugucugcgcuaagggcuggaagcccuggacuuugugaugagccauuucuuggcucucucccuaaggacuagagagcuccccgugucugucugcugggacugggaccagcucugggggaccuugcugccuguguugccuguuucucagggaccuggggaggcuaacuggggccugucccugguugcuguuuugcucuucugggggaagaaaugagcagguuucuggaugugaaacuugccggugaguaggaugucccugaagcaucaggcuagccccacucccccuguuuaagugcacugagccuguagcccagcauauguggauacauuguagccacgugugccugugcaccucccucccuacuccucuuuucucaggugacuuacgcuuaguucccuagcaguagccuaucuuuugagaccccuuuuuaaaagggauccugcauuggaucugaccuguuacaaccccaccacucaaggcauuggggaagcuggagagaagaaaaauagguugacuugguucuagccgcuuggcugaaacuugaauuccccuuaagcaggaugucuuaaagccaggucacuugcuggcuggaacucaaguucauuugaugaccagguugccaagaguccuguccccuacugaguguucuuauagcugccuacauguuuuguucuuuucauugcacugagcauucagugauuccugccuguucaucaagaguaugucagagguuuguuugguuuuugguuuuucgagacaggguuucucuguauagcucuggcuguccuggaacucacucuguagaccaggcuggccuugaacucagaaauccgccugccucugccucccaagcgugggauuaaaggcgugcgccaccacgccuggcuuacuucagaguuauuagcaaccuacauuuaucaacuuuguggcacuuugugauacaaauguucccugccuccuugggugucuuccuacuaugccauuauuucucugacacuuaagaaagaaaaaguugaaauucuagcaguaaauacaguugaugcagacacuuu

SEQ ID NO: 7460 - RNA, 3912 nt, Mus musculus
gucggaggcaguuccuguugcccuugcuaaacauggcgcuggcuagcguguugcagcggccgaugccggugaaucagcacggguuuuuugggcucggagguggugcagaucugcuggacuuggguccggggaguccuggugaugggcugagccuagccgcgccgagcuggggcgucccggaggagccgcgaaucgaaaugcuucacggaaccaccacccuggccuucaaggugcucagacagcucgcgcuucuccggcaucccagccggaaccgggucgggcggagguucgguccccuccucccgacccuuggcggguucacugucucguagccuuaagaaaggagaggugggcggagauagggggcggugagggaaggagacggacagcguggguuggcuccuaggcgaccccaguuugccccuuuucaggagcccuaccugggaacagcggaccguggcggagggugcgggggggaagccauugucgccguucaccaaaguuuguauaaacugagcuugaugaaguccaggggcuacugaaguggguaccgaacaguuagggucccuguuccagcccuacaauaacuagcucuggaucuuaggcuagucuuuaaagauuuauucuuauuuuuuguauauacaccacguguguagugcucgcaggcgccaaaagagggcgucguguuccuugggacuggaguuacagaccuuugugagcacugggaaccgaaccucugaagagcagccagugcucuuaaccacugagcucucucuccaguccccuuagggugucuuuaucucauuaaacuugcuacuucauauuuaaagugaguaaaagggcuauucauaaaucaggaacugcuguuaaacccgaaugacauuuaacauaagaagucgauuacgccggguggugguggcucacgccuuuagucccagcacaugggaggcagaggcagguggauuucugaguucgaggccagccuggucuacaaagugaguuccaggacagccaggacuauacagagaaacccugucucgaaaaacaaaaacaaaccccaaaccccccaaaaaagaagucgauuccaaaaucccaaaagaugcaaagccagguuaucuuucuguauuuauacaaaaauaaaguauggggaguauuuguggucuuacggggccucucuuuuuguuuucucugaccuuaacuaguuucuccauggagucauuguugcagcggauucccgggccacagcaggugcuuauauugcuucccagacggugaagaaaguaauagagaucaacccguaccuucugggcaccauggcugggggugcagcggauugcagcuucugggagcgguuguuggcucggcagugucgaaucuaugagcuucgcaauaaggaacgcaucucggucgcagcagccuccaaacugcucgcuaacaugguguaucaguacaaaggcauggggcugucuaugggcaccaugaucuguggcugggauaagagaggcccuggugaguuguguccugugagccauggugggaagggguuaaaugggugggagaauugagggcuuuuaacaggugcugggaauggaugcgauauuagguucucagcucuuccuucccuuuccaaggaaggccuuguacggaauaggaaagagcauagaguuagacuugcugugucacucacugcuuagucauuugaccuuagccuauuucuucaucugggaacugguuaagugaaccauugaagcgguuaaguguggugcacauagagcaauugguacaaugucuggcacaacagcucuccuucuuucccaugcaauaaugacuagaaaacauuuguacuggggaauuguaaacuuuaaaaauuguguucuauucuagccaggugugguggcacaugccuuuaaucccaacacuugggaggcagaggcaggcggauuucugaguucgaggccagccuggucuacaaagugaguuccaggacagccagggcuauacagagaaacccugucucaaaaaaccaaaagaaaaaaaauuguguucuuuucuaugcuuggguguuuugucugcauguaugacugugcaccacagugcauucauggugccugaagaggccagagaggggauuggauccucuagaaugcaguuacugaugguugugagccacaugugggugcucagagcuaaacccagguccuuggcaagaguggcccguccuucuucccccugcccugggggccaucuccccagccccccccccacuuuuaaauuuuaaguuaaauuauuuauuuguguguguaugugugaacaaacacauccuacagcauaucugcaguucagaggauaacuuguucaaguugguucucuuguucugugggccgggcucaggacaucaggccuggugguaagcaacaguuauaugcugacucaccucacuggcccucauuguaaaaaauaaauaagccaagugauacacagcugugacccuagagcacuagggagggucaagaguucgaggccagccuaagcuguauggcagaaggacagccuggagcacacagaaacauuguaucucagaagucaguaaaacuaguggaguugguguauaguuaauuuuauauaaaaugcccaaauuauuucucaguaccuggcgguaguaccauuucaaguguugaagucaguuucaugcagucucuagccacuguguugcaugacaacgauaggcuacagaguugucauuuaagcguuaucucccaccauuccugaguccugugcuugacuuggccagcaugcuugccuuuuggaguugccgagagagcaggagggaugguuaacauacugugaggagagaugggugguauggugcucuggaaucuggaaaucucaagauaaauuugacucugucuuucucugauuucuugaaaauuuguuucuuuaugaguuucuguauggguaugugaguguuugcauguguauauguguguauaccacuugcaugccuggugcccacagaggacagaagaagguauugcauccccagagacuggaguuacagacaguugcgagccaccccguguauauugggaacugaaccuggguccuagacaagagcaacaagcacucuuaacugccgaggaagcuuucuagcccguuuuguuuugagacaggguuuuauguagcccaggcugaccucaaacuuaauacauagucaagccuagccuuuaacuccugauccuccugccuucaccucccaagugugcugagauuuguuuuuguuuuguuuguuuguuuguuugguugguugguugguugguuuuuuguuuuuucgagacaggguuucucuguguagcccuggcuguccuggaccucacuuuguagaccaggcuggccucguacucagaaauccuccugucucugccucccaaggagauccuauuuuugucgggguggggcgggguggugugugugagagagagagagagggagggguguuaaaaugacgucuuuuuucucguucccugcucaccucauccccucaggccucuacuacguagacagcgaggggaacaggaucucugggaccgccuucucagugggcucuggcuccguguaugcuuacggcguuauggaucgaggcuacuccuaugaccugaaaguggaggaggccuaugaucuggcccgccgagccaucuaccaagccaccuacagagaugccuacuccggaggggcagucaaccucuaccacgugcgggaggauggcuggauccggguguccagugacaauguagcugacuuacaugacaaguacaguaguguaucuguccccugagggaagguggaugcgguugucugcaucucuaggugggucuccauggcuauaauaaauaauaguaccucuuucagagugga

SEQ ID NO: 7461 - RNA, 10136 nt, Mus musculus
cuuuacaaaauaaaguguuuauuaugaaauuagagauggaggccccuccccuuccuccucuuccccagcugccuccccuuucucccccccccacccccccaaucccuuucccuucuggggccugagaagcacacaagacaaugcccagagcugggaugcccagggcaggcugacagcugggcagagacggccguggggcugaagcucuucccuaggaggugggcuggcucccuccuuccuucuacuagaagccgaugaagccaggaugaggccaugagugauggauggaaccaugcgggcaggucuguaaggaagagagaguugguuuaggagcagaauugggagaguggcuucaguccaccagacuccucuguagucaguccuggccacugaccuggagcagagcaucuccugcaguaggguggggcagcaguggccggaagauucucuuucuuuugggauggauaacagaaacaaacaaacaaacaaacaaacaaaccacaacagacaaacccaaaaagccagucacagggacucaaagagaagggagggacaugugggcaggagacagacagagcuugugugugggcaaggggggcagaaucugagcgaucggaauuacgagacaaaaacagccacagagucacagugagaacagaggucgggggcaguuauaaaacccaacccccccgacagcggagagucacagacagggaucccuggagaaacacacagaccaaggagugggagguaagagggagggggaaaggagggucauauugggccccugggcugccgccgccugccuggacccuguggggcucacucagagggcccgugugcgcuaccccaccgcagcgcagcggcagggccagggccggccucagggggccgggggcuccuuggccccauacagcucugccagagugcggaagaguggaccccagucguccaguggcucggcggggccggggacaccgccagccucacugcccgagcccagggagcugagcgagccgcaggaggagccccggccuucauagccguacaccugcaccgagucauacgggggcacgcugggguccucguccgccucgcgcagccgcaacgccagcaacugcaccacaucggcggggccggguggccugggcuggcguggcgcucggguccgcggcagcacgucgcggcguaccggcgggccggcugcuggaggagcggcuccauccggguucugcaaggcugugaugucgaaggccuccguguccuccucuccgccacccucgucaucauaggugaugauguucucgcggacguccuccuccuccaguaccaucaaggcuuccugcuucugccgccucagggccacgaagagaaccaccagggcugcacaagagcacacaggccaaggagccagcuuguucccaugcagggccagaugagaaagccagggcaguguggccagaguuugcaagcucuaggucugacauuugguaauccuuuguuugaauccugccuuugcccuuuauuugcuaugugugagaaauuuacguugaaaaaaaaaaaacuuuuaucucuuuagguguuugaaagaugaaaaugaaacaucugugucaugcccagcaccacacuuggcacagaauaaggguuuaaucaauuuuuauggcuaguuacuuucauggauuugcagguccaguaauuaugaggacagacguuuuucucuuggaccuuaguaggucauucauguccaauagacacugcuuucccuccagaaaacaggcccagauaccacaucucguccccacuguagcccgacucaccaagaagggugcccauacaugugacgauggcaagcagggcuccagugcugagaccggugggcgauagcugagccucaggccagcaggaugccauggagccaucaggccggcagcgacacacacucacagucaccguggcagugcugcucagggcuggcugcccccaaucccagaguucgauaggaaucagguagggggccuggcgcggcggagcaggacgggaaggcagcagcaggcuggcagagccaucuguggaaaaaggaaggaacgaacaucgcacacaaaaacaaguguaaccauacaccuaccccucugauggguccucaggucgggcaggggcaauggggcugggucaggggugggaaggagaggagggaagacaggcauggguguugaugcagaggcuacccaccucgguugucccggacuguaaaguuggcaucagggcccacaggaccuugaagggagacuuggcuacuguugccaacuucaucucuguccagagcccggaugaccuuaaucaacuggaaagaagauggaagcuuucagaggaauggcugcugguggccuugagauuccaaccugucugucuccacugcuuaccuggccaggggcugcagagucacauacaaagaugucauagggcucagccagcuggggagcauugucauuuucauccagggucuggauggccacuugcacgcgggaugauugugcagagcuaucugaagccaaaauaacaacauauguacaccauacacgcacaugcgccauaccuggucagaggcauagaugcugcauggcaugugcauagaacaacaugaaauagcaugugugauacacgagcagcaaaccauguuuuaaauggguggaaauauaccaagaacauauguguucacagagaagauaugaauauuauacaauacacaugcaaauacaaaaccaaugauucacacacacagcaacucaugcaagauaagcacagcacaugcauacaugaaggguagguagaagggacauacaaggugugugaacagaaaccaugaaacacauagucauaccauagcauguggguguugaaaacaaaucaaacauauaugaagcagguaugcacagugaguguggcauauccuccauccuacccuggcccacagacacauuuuugcaugcgcacacacacacacacacacacacacacacacacacacacucgaguaccaucaaaggucugggaagccauaauaaccacaauuuguaucacugagaguugaccuuguagggagaagagcgucuucauggucuacagggugcagagcccaggccccacccuagguggcucccuaccaggaucuugcuuuauuucucauugccaggucaucuuuugucuggguuuaggccagccagcuggcccuagugacaugggcugaguucacagcccggggcagggcaggcugagugggcugcuuggcccuaagguaacuagagacagaauaacaugaacccagucuuucacugcaguaagggccaugggccaugagccacucgccaaagucagggcggggacaagaacaggauuuggcaagagcacgaguaggggccacacauguacgcagagccacauauaaaaagcaaccagccgggcgcgguggcacacgccuuuaaucccagcauucgggaggcagaggcagguagauuucugaguucgaggccagccuggucuacagagugaguuccaggacauccagggcuauacagagaaacccucuggaaaaacaaacaaacaaacaaacaaacaaacaaacaaacaaacagcaaccagacccaagguaacaaugcaugugacauacaccacacgcagaaucaucucuacagauaugcuugcaucuacaaauacacaguacugccagagaggauauagcugcacagacagacagacacacacacauuuaacagaagaaggaagguagagagaaaacagcucaugcugcugacugacugacugggucagacaccucugccauuuauuuucugugugacuuugaggaguuacuuagcuucuccuugugaguuuccucacuggaaaacagagaacuaaucacaugucccuaaacgguugugaugacugaacgagccaaaccacuuuugguacuuaaaacgauaccuaauacacaauaagcaauaacucaucugucagccaggcaugguggcgcacgccuuuaaucccagcacuugggaggcagaggcagguggaucucucugaguucgaggccagccuggucuacaaagugaguuccaggacagccagagcuacacagagaaacucugucucgaaaaaaaaaaccaaaaccaaaaccaaaacaaccaaaaaaaaagaaaaaaaccccccaaaaaaaccaaaaaaccaacaacaaaaaaaacaaaccaaaacucaucuguccacaaacacacacacaaaguaucaccuauagcuacuuguauacaccacuguacacacacaaauaccacaaauauaauucuaugcaaacauguaucauaucuaagucauaacuauauguguguauauauacauuauauuuuuucuuuauauauaggauucuuauguaccucaaguuguccuugaacuccugauucuccugccuuaguaucccuagugcugagauuauagugugugccaugcggcuguacacgucacacaugaacuauaaccauuccugaguacaugcccauaugaauguauacauacagcucuuugcugacguguacugauaucuauauauauacagccauaaugcuaauguacaguauacaaaacagcagggacaugaacagggcauaaggugcuacuuacagaagggcgaggggcuucccugucucgccagggcagagaacugaaccgggugcugcugaugguggugggggcacaagaugggcuccacacaaggaaccggcacucuugccuacuucaguguguggggacaagucccugcaaggcuucuagaagagcuccuuuuuuugagggcugcugacacacucuugcaaaguccuuuuuuggcccuggcaguuuguuaacacuugggucggaagguauggcucuggguuugagcaaggcagacgaggcauaagugccugcucacgcaggcucccccaccagcccgaggaugccugcuucaugagcugagggucaggagcccaacacagaugagguuguggcuguugcuaccccuuccccgcccacauccagggauagcucucuguauggugcuccuuagggcccagggcuucucacccaacucuguggccagaauggugagguugugccagacacgagccucgcgguccaggcgcacugcuguacggauagugccgucuucgggcucaauggagaagcaacguucuggauccgagugggggaggauggaguaucuagggaagauggacugaucugggaggcgcccccucuccugccuucccuacucuccucucuguucaucuugcugggccucaaggcucaucuugcuagaguguccaaauguuuugaggagagccuuaccagccacucagagcugucccugcagucaggcuggacucccugagaagcccuguugacauagggggaccggauuccacaggaguggaagagacacgcccuguguuucagacucgcaggcucuguucugggaaccuaaggacccuguuucaucccugcucugccucagacuaccugugugaccuugggagaacucuuuugaccuuguuuaaucaacugcaaaaugggagggacaccagcacccccucacagagcugugucagggaugcuggccaggaaguuggaagaguggagauuaacaggguggaccacgccaaaucugaacaucagcucuguugccccacagugggcaaacaacuuagccauucacgguuggcacgcagaacaacuggcaaugaugauaccuacuucauagggacauuaugacaauuaaauguuaucgaguggguaaaaugugaagcacuuagggcaugaucaauagagauccauuuaucagaugagaaugcauuugcuuggccugccacuaggaggcgccacucccgucuagccaaagaaauagguggagagagggacuguaguuaggccuccagaguuccuccggcacuuaggccugccaaccagcaagcuggcauaagaagagagaacuuugcuaagugauauggcuugucauguagacagcacaccguguauacaaggaagccuugucccagcucacagcccagcuaaccugauggggcuggcgggggaguccaggucacuggcugagaucuggcccaccaggguuccaggggccuuguuuucagguacugccaggugguagguggccugggugaaggcaggcggcucuggagcauccugcacagucacucguaccgaggccacauccuugaagggaccucgccgcagauaggcugggucgaugaguguguugguggcuucuacacggaagguguaagagcgacgagucucgaaguccaggggcugugaggaggggagacagagaauugagguacugggaaaccggggugggcccagcucacaggaguaaagucucuuugcaugugcaccccgugcucaggagagguggcccuggagaggcauggccucaguggucauggugaguggcacauggcguagcugguaauucuaaaagguaagauuguuaugauuuccccccagcuccaacacaggggaucuaagcgugguuguaggaaauuaguuaaaagcauuggcagugguggggcagagccagggguuaagcgagcugcagugcaggggggagggaguccucuguuuuuguuuuuuuuuuucuggugcugggaaugaaaucuuggugcauaguaagcaagcucccuaccaaugagcuucguacccacagcugcaucugcagguagcaggcagaaagcuaaccuugcggacaguaaggagcccguccuggcccugggagucugugcugaugcugaagaccucugauccuuccccauucaggaugcuguaugccacgagagcauuauccccuaggucuggguccugggccuuaagccggcccaccaggguuccagguccagcugucuccaccacugagaacugguauagaccucaggggaaggaggagggaagauggguucuuaagagaagucuccaguccuccucccuaccccaguacuuccuuuccccggggucuguagguaggacauuaaaggauuguuugggcacagaacugccccccuuacucugagggaacuuggggggguugucguugacaucgcugagggugacugucacuguagugcugccugacagcccccccauguggccacccauauccuuggcuugaaucaccaccaagaacuccucuugggucucccgguccauguuggggauggcuguacgaaccacuccuaagggagagacacugggucaggggugcuuguucucauggcugcccugugagacucucaaguucauucuuaccagucuggggguccacagagaagaaaggcagcccauccagcaccguguacacaaguuuggcacuguuuccauagcugggaucgucggcaucgugagcagucacuuggauuacagacgucccugcgggagagccccauaacccacucagcagcagcaaggccaggaaaagaagaguagacugagggaccccgcaugugaaggaggcugaguuaaaggagaugaauuccaggguagacaaccaaagcagauggaggaguaaaagaaccccagguaagcuagggcacccagaacuggggugcucaccaacauuggacaucucaggcacgguggcaugguagggcccgaggggaaacacaggcggauugucauugaugucuugcacuuugaugaugaacuccgauggggguuccaggggccgguuagaggcacgguccacagcuugggccagcagcacauauugugccuucucuucccgauccaggcucuuggucacauggauauugccuguggccucaucaaucacaaacacagugccugcccccuccccggucagcagguacuuggugcggcccucaccccggucaacaucugagugcagcugcaagagucaagagaaagcggcagaaagcuccaagugcagagcacacgggguuagagccuagguuugggugguacgugaggaaugccaggggaccaaggucauugcagacugaugaaguuucuggggcagggccuaagggucugacagacucgucacggagaggguugauccuuaccuugccaauaaggacaggcucuggaccagaauauuccucaaugacaaagaacugguuccagacccagcuccuucggguccgcagcaguguaggacccgaguguccccuggacccugcccaggcugggacuggagcugccaggcgccccaugcagccccagccacccagccaggccagcaggagccucacaaggccccacauguuuguaauccagccagggcucuuguucacuggccccaggugccgaggcugggcagggccagguggcccaugagcuggcuggggaagacgcguugaggcuaccccauggauccacaccuguaggacagguagcugcucaggaucaaggaaagccugaaucguacucuucucccgaauuagauaccgaagcccagcucucuaagaaaccagacaccccacugcccagaacccaguccaagacagacagccugagccuuccucccaggcucugccuggauccaccuccagccccuccaagcccauaaaucucaggucggccaacucuggaaagcugucagggaaaaggagaggagaaugcugaagggacuuggaauuucaaaucuuguuccuuuucuagccugggcacacagcuaggggacuagaaaagguagauggaccgacagaaagggcuuaaaacugagagguugguauucaucaacacacagccuuccuuauccagagggucaggcucaaagacaaggagugagugcagcuugagucgggcuggacucaggaaagccuccccugccccugaggaaccccacgucuccagacugucuccagcccauucugccagucucggucuuuaaggggaauuggucuaagggaacagaguggggcuacaucuggaagaauugggaacagggcugcaggcagugcagggggaccaagagaggugaaguggaggcugacccaggggccagagacagcgugauugaaggcuuggggccaagaaucugggagggucuggcagauggggaagaccagaugagaaacagacagaccacggagagagaagggcagcaagagagaaaagcaaagacaucagggaagcagccugagugucugaaaggcagagaggaguccuggguaccaggcuugggaacugguaggggcaggugaaccuuucucucucucucucucucucucucucucucucucucucucucucucucucucucucucucucucucucucucucucucucucucucucucuguguguguguguaugugugugugugugugagaucaggccucggaacuucauucugguagaguaagcuacuaggagcaguagagguagggaggggcugcgggaaaggagguggagagagaggacccuucccauuucucucccuccuccugaaggggcccauggucagguagcugugccccuccuccuuccccagagcagacacacaccugacaggccguuugcuccccagagaaaagaagccagagggcagcaggggaccagagagguaggcgggacgaagaggagagaaggaaggaaacggaggaguggggaaacaggauagcaggagggaacgaggagaggagaggaaaggagagggagguaaugagagagaggaaaggagagcgggaaaagaggagaaagguaaaggaagaaaaaggcagaagaggugggaagagacagggcaagagggagagagaaggggcagagaggcggaagggugaagaaaaaucgggaggcaaagggagagaggugugugagaugggagagagcagagcgcgggagaaccgagccggcacggcucucagccagagcgcaccgcaagcugcggaccccccgcugcccccgcgaggauucccgacccgggcaggcgcccuuaccuggcacuaccgaggggcccgggaccgcgaacagcgccccgcccgccuccgucgcuggcucccgggggcacagccccaagccgauccaagccggcgccgcggcuccgcugcaggucugagcggccccggcgagaacaagggagcg

SEQ ID NO: 7462 - RNA, 44807 nt, Mus musculus
augcuagucaaaacuaagucagauuuuuauuuuuccauagaccacaucauuuaauaauaaaaaaaauaaaaauaaaaauugaacaaaaggaaaagguggcuauaaaguggaaccagcgggcaagagacugcaggccagagaacaggggacugcaggggccugggacucaggagaggcugauucagcucauaggugacccaguccuggccccagcuguccccaaaaggcugaguaccaagggaggcggaacgcaggauggagggaaaaugagcgugggacacugguuauucccacguacggccacaucuucccuucauagccuagcucuucccucucagacuuaacaggaagaaaggagagggccaaguuccaagaguuagguuggggaacagggagauugccacugcuccauuugauaugaggggacguguggcaguuauaguucagcacugagcaauggugugagacccuugguuccagggugguggugacuguaccuaucccucuguggccuuugaccucccaggaccaaguggcagguaccugcagcucucuaguguuuucuuggcuagcggcgcccaccccggucccguacaggugugcuucgacuccggcuucugcuguggcgcuuggugucucugcgaucccucucccugccucggucucggucucgcucccucucccgcucucggucaccccugucccgcucucucucccugucccucucucucucccugcugugcucccuccucuucucccguucuagcugccgguuccguucccgcucagcuuccuucucccguuccuuuuguucuucuucuucucguucuuuucgccgcuucucccgcuccuuggcccguucagcuugcucugccuccuucugaacaaucuguggucagacaggaaggacagaggcagagaagugugucacaguccugucugaacugaucccaggcugugcuucuggggucacugucaguuucuauuaacaggaaaagggcagacaugcaggaugaggugcaccaccaacauccuuaaugcaugguagggcugcuggcaccagucucugauaugucucuagcuuucaucaugcuacacacacacaaagcugaguagcauuaagccugaauuucucccagaaagcccuugccacaaaagccagacaacuuaguucagcccuggaguccauggagagguggaagcagaaccacacccacagaccugaccuccacaugagcaacauggcaagcgcauccuuuccuguccccaacauacacaccaacaccacacgcaagauucucauagaaaugccaacguacaagacguuuauaacaaagcuuuauaagacacgcauugcuuggcuaacgaaucaagcuccaagaagcuuggcuaacaguuucucaaacccacaagcucuaguuccugccuggcggccacuuucacccucuccacagcucccuccucucuuccucuccuaagccaaugccagggccuacacugugggucaugcucaucuccugggugcaaagacagcuccagcugcugacaaugggagaguacucacuuggcucucagucagagggagccaauagaugcagggagcugccuuagucuuacggaagaggucauccagcagcuuggcagguggcuccuccugggcuuuuucugaggcgggaggaagagaaccagaucugaaacauaaaauccugacccaacccaccugggucccugacccuccagcccagagacaggcacauccugccuuccucccagcuaaguaccuuucuuuucacucuucuuuucuuuagauuuugcucgcucuuuccggcggcggucacgggaccgugaucgggagcggggucccucucgaacuuugucccgaucccauucucucucagaccgaguccucucccggcgcuccauuucccguucccguucugcccauugcucucgaacagcccuuuccugcucccgcugcucagcccggggguggggcgguggcuggacugggggugggggugggggaugcaggggccuuggugcucccuguuccucugccuuaguuucagauggccgaucuaccaagaguccccggugauaguccagcugugggcagagggacaaggacaguuaaacuagagauuaagauuacaucauucccaacaagggagcccagguaccagcgguagagagaggaaaacccaaacucuuagcaacugcagguuuggugaaggucgucccagaauugaccgccucggcccauucccuccuuuucugaggugucucaccucaucuugcucagcauagucagcacaaaggaauuugggguuggacuggggccacuugaccccgugcagagcugugcggguggcaacggcuuccucuacuguagaguacugguaggaagaggcagagaggcauggugcaccuuuagucucccugcugcugcaaugcccuccaucugcccacacugcucacaggacaaaguaugugccugaaaccagagucagcccccccgccucaccgucacaaagcaaugagauuugaucuugucuauccagaaggccucuuccaccaaaguuccuguacgccccaauaauuccuucagcuggccuaaagugaagggacgaaccugccaacgaaaaucaacuuuucaaggucuuaaagaaguuaagaacaccuauacaucuagcaugaagucuccuaugugugagguguguguguguggggggaugauggugcaugucuuuauucccagcacuugagaggguggcagguggguagccugaguuugaagccagucuggucuacacugagaaaccccaugugggguucuggggugggaaugaucuccauguggggcuggagagagggcucagugguuaucaacccuggcuuauuuuuccaggggauccaggcuugaguccagcacuacuaaguggaugcugggaacugacuuaaguccucuucaacagcagugaggcucucaucacugaggcaucuccccagcccccaaguaaaggagcuugcgguacagggaugaugacuuaccagguuggagauguggacaauguuacugaucuugccccuggguggggagggcaccugggcgguccggacugggucaucaauuguaauggaaacuccagacuucuguuggcugauggaccuccggguuaagguaucuccuaauguuacuaaaaagagagcggaagaacagcuuucagucgcagcacugcuggcucccuuccuuuuacucucugccgagcagccagccacuccccucuauccacacaugccaagcauccauaaugugguaaagggcaagcguagaaccucacugcgagacucggacauuugugagauucaaacccagggggguuggaaauggguccaaacgugggccucacucagagaaugcugacggcugcugcaccucacccaccuuucuuuacuucgugcuccacaggugggggcaaggcaaccuccacugacaccugggguggcgccggcagcucggcuucaggcucuuucucuucuuccucuucccucugcccauucuccuggcccucugcggguacuaccuauaagacauagaagacagagguggugcucucuccccacacuggcaccuucuucuucuccucugacuggaucccagagagacggcgaucacauuaaccuccccacugguggggguuauucuccauacccugcaccuuuuguuuuaugguuuuucgagacaucaucuacguaguccugguuggccuugaccucacagagauccucuugccugugcuuccuugggauuaaaggcaugugcuaccacgccuggcuaaacauuuuuuuaaauugagaacaaaccaagcauuuacuuauuugugugcucuuaugcgccaugagcauaugcagugaccucugugugggcagcuuugggagcuggcucucucccucacacgggccgugaggaugggcagcaugcucugcagcagggcccuuuacacauggagccaucuugcuggccugaacuauuuuucugcaugaggcaagauguuauaugaggcuuuaucaacuuuaguuuucaauucugguucugugguacaagcugcugaaacaagagcacacaaauugcuauagcuugguucuaauaaaaccucuuuugcaacuagcaguguuugacguaauccggcccuuggcauaagaguucccuuccagaacauuaccucagcuccuccgcuguccgccguugcccacugccucacccgaugcugggcacagcacacgggguuaccugagugacuguccggcauaucuucagucccuugucaugggucccaucgucgccauuacgcucugucucauccucagagauucgggagucaucggcaugaagauccacaacagccuccugccccgccagggguuugaugucggggaugaggcucugggacacagacacccccgcuaccccguuacacugggcccaugucuacucccaccugaacauuucuuacccucccuucccuggcuccgcccaccucaccuugagugacucaguggugauacugauggacgguuucuucugugucgcggcagugcuggcuccccaacggcguuuucggccaggcuggccccccucugugucacuguuuccagcuugcacccccuugguagcugcuguccccaaaaaauaggacccaacaguuagauggucuagguuccuaacuagcucacaccguaacacucauauguugcuuuuggcugcaguuuaaguaaaagguuaacguaagaaaagauugggggaguggagauugggaaacuaaggcuuaaagagugaacaaaacugauguuguaucuuuauuauggcugggaacuauuugcgcacagaaaggagaaggcggguaagcaguuggaggagcacuucagacuuaagugcaggagagccagacgaacacgugacuacacuguaagaccaugugcuccuuacugggugucugcacauggugguacacaccuuuaaucccagcacuugaaaaugagggggaaaucucugaauucaagaccagccuggccuacacaacaaauuucagagcagccagaaaacaaaucuaccaccaaacuaccacugcccaaguuccucagugggcaacaauugcauguuuacugucaggagggcuuacagauuaagagcacugaauguucuuccagagguccugaguucaauuccuaacaaccacaugguagcucacaaccauuuauaaugugaucuggugcccucuucuggccugcaggcauucaugcaggcagaacgcuguauauauaauaaauaaaucuuaaaaauggaaagcaucacacaggcaucucucuaacuucaaauucaaggucagauaccagaaaggaugcauuccucuaaguugggcguguagcacacgccuguaaucccagcuacuugagaggauguagcaggauucaguuuuuagucagccuggucuacacagcagaaaccuugucucaaaaauaaguaauaacaagagaauagauugaaaauggucugagguacaaugcucuccuuaaaagguacuuuggaguuggggaaacugauguggcauugugugccuagcaugugcaaggcuguagguccaauccucaguaacgcgcgcaagcacacgcgcgugcgcgcgcgcacacacacacacacacacacacacacacacacacacacacacacacacacacacacacacacacagagcuggagaaacaggacugguuaaaaugaaaaccacccagauucuccauguguagggagagcagagucucacuagguggagggagaacugcacccuaagacugauacugggaggaaaugaaugcuaaucaucugugcaguuuuuaugacuucuaccagggauuuggggcuagacuuacagacaacggagauuuuccucuugaaugacuugggcaucgaacucuguauggagaagauaaggaagagagagagacaccccacagagagggggaggagguuaaaucaggcaaucuuagcauaaaugccaaagacacacagagacagagagagagagacacugacagauagagaccaaaacagaagcagcaaacggcaaaaaacgaagcagaaucaaugcaaguuagaggaaaauuaaaccaaacgucacggggaaggucaucuaugucaccucacaccaguguauuagcuuuaccagaaauaagauggggaggggcuuaauaaccuccagcuacuuaaguaguuuuuggguuuuuugaaacagggucucacuuuguagcuuaggcuacaucaucaaacuuuuggugauccuccugccucagccucccaagcacugggauuacagacaugagccaccauguccggcuccgucagcccuuuuaaguugcugaucaugcucucaacuguaucuaagggaugaggacacgaaacccagcgagcuaugcccagacccagguaacuggguccuccuaaguccuuccuugccaauuugaaagauacgagaaaaacccacucuugagauggcaacuucaacaagcuuccuguacucagcucccagccugacaucuugacaggaggugggacacuugaagaccacucagagcaacaccaaggaaaagaauuauacaagguucacugcagaugaagggcagguagcagagagaauuuacaaggaucucuugucuaaggaggcucugguaaaggccagcugcuccagggaaagccucggccuccccaaccaccacccuuacuccagcagagccuuaacgcucccccuucaaacagggcucaaaugcaggggcucuggcuaaggaccaaaaccaaaacaaaucccacaagacagauuugggcaagccucuuuccagacacacaguggagugacacuacagacagagcaggggcacuuuuauaggugcuuauuucuggaaaaacuaagaccacccuaccacccuucuaacggguagggcaggacccccuuaaucuccuuuccccucccacccccagccccaccugugucaucuaaccaagucuccuuggucuguguuaagagccagccugaccccuagcuagguugcucacgauggguaaguuagugagaaaaggaaauaaauaaaaaccaaaaaaacaaacaaacaaacaaaaaaaaacaaaaaagaaagaaaauaaaagaacccaaaaaaccaauuaaacaaaauaacuuaauuaaaacaagaaaaacacgaaccaaauaaauaaacccaacaaagaaauaaaaaaauaaauuauaaaaauaaaagauuaaagaagagguagaaaauaaaagaauaaacuaggaauaugacaaauguuccagguaccaucucacaccugggaucuucaguucagccaaucgcaccucacuguguacuguaucuagucaaccgccguccaaucagaaugagcccucccugcuaggcgcugugcaauuggugggggguuggguuggcaaaaaaggugggcgcacggcgugguagucagcguggcacugccagaguccucccaggggcgcagggggggcgggagggaaucguguggggggacgcugcccaguuuccaagaugucaaaacaguucacuggcgauggccagccucagcgaggggcagaggggggaaugggggcagagcaucaguccuggcccuguagggcaucaucuugcagucccugaugaaugagcaagcggccugugagcggcaggaaugcuccuugccuuucuuucaugaggcaggcaggacccuauguccaccagugacaagcugcagcagugccacuagccaacacuugggauccaggugacaacuccaaagucccuuccuccucugaguguaacuggggagagguccugucaccgagcaggaucauggagccucugaugaagguagcccggggguggcaguagucaauuuccccaggaccugguacacauucagcagcaagcucagaguaugucuuccgguuugucguuggcaccuccucagggacugcagcugagacagugguuccgguugggugggugagugagucccugccuccagggauggaggagaagcugaagcgaccgacacgaugcugcccuucaccauggacagcagggaccaaaggaaaguccaucugaagagcaaguggugacacgcgggcugggcugccaucagcuuuaagccccuggguacagacccccagacuucucugcaggguuucuagucaacaaagcuuaggccaccggccccacucaaguguuuacagcucggcacugucgucauaaacaucugacucucuuagguuucuuggucccuagauggggaucccaacagucuguagcaaacaaggcaacccacagucucugacagguaagggcaugugggcaggcaccccagcacuggcacaacucuucuuggggugucccgaguagggcgaugauucaaguccaccccuuuccaaaugcuucuuguucucaguacaagucucuccagaacagugcucgucucagccccgauguaagcaagaagggaggcggggcccaucacagacgcccacagacacgccccucuggccaagacaccgggagcacacucggcucugauugggcggcucgguagcagcggguggguccagagguagaggcggcaucagcgauuggccaguugggcaggguuauauuuuacgggcggauuaccguacaugagguacuuggacaaaguuuuacggggaagaaggaccuuguaauaaauaauauucugcacaucaaaucacuuucaccggcccccacccccgcaacacacaccagagaaaggcuacacacacaacagccccucccacccuguaauaauaccacucccaaacccagcuaauucuauuucuuuaagggucaagaagaccucgcuggcuccaaugggggaagccucuugaacuggguauaggaaaaagugguaauauuugugccaacaaaacaaaacaaaaccuaagagggccuugugguucaccccuuggauuucuaagaagcuacacuuccguaauuagaccacuggggggcagaagagcaacaaaaauuccucagcauggcugacucgguaagagacccaaagccccacuagguggcgacaagugccauuaagcuuuuaaaaaggagggaaagcucaaggaguuagcuucacagaagcuucagcagcaagaaagcugcacuuggguuuuuugguuuuucucucucucuccucucucucucccucgccucccucuccccccucucucucuaaaaaaaagggccauuaacagacuuccaaauuaggagccuggucuauaucacugcuucauguagggaaaggaaaucaaagaccuugucuguuaucacaaggggcaucccuugcuaaaccagcgaauucucccuugcccuauccugauccaaggauagccuuauccccuuuaggucaucccacuguguaagagggauggcugagauggucuauucucccuaggcccacgcucggcccacccuccccaacagguggcuuggcuaguuaccucuuucuuuuccucuucuucagcaccacccucugggcgcucaucauugcugacuuggucugcaacaggcagaggaggcucaggcaccucauuuucaggucuguuuucacugguguccauggucacuuccuccuucucuucacugacaggauggaagagauugaaggaaaggguaggagagagugaaggggaagagagagcaagauguuagcuuuguggacauaaaaucccaauggcuccuuacuugggcgggaucagacuagaacuuucccaugggaaagugggaaugcuuucuuuagggaaaaagcacaaauuacaguggucauggccacucaguaccagauggggccuuuaugugggguucccagcacucagaguucuuagacacucacuucacagcucucuugcacgaaaccaacagucuccucugaaaaguccuucaaaagugaccucaauuugucuagaaggcuauagccucucuacucacuaguuaaggcaucuuuaauuuaccaagaaccuaaaggaagcccacuuccuuuauaaaaaaacaaaaaagcuaaaaaacccaagacuuuggaaagggcauagguguagccaaugaccccgaccuuguguccaaucaacuguuaauuaguaagugcccggugauccacagggccuccagacaccaggaccaguaagagugaggauggggcugguaagggugcccacuucucucucacccuaggaaaaccugaggaauggcugucaccugcucagagcagagacuguucuuacauuugacucuuacccagucacucccauugcucauuccaacuuccaagagauaaagagagcaggccucccaagucaguaauacccuccuccacaccagacaacucccccaaaacauggaacccacucgcucacaaguuagcacucacuucagacaaagaaauccagagacuccaucaaauaaacuaucuuccuaccuuucugccaccaucccuaacuucuaacccugacacucccuaaaacuagauuaaaaauaaucaaaaucaggaugaucagggguacaagugacagaaaagggaaaccaagccucuccagaccaggaacuaguaccagaaaauacagcacucauucucaccaggcugugugacacacaagaggucagaaaagccuccccaguguaggcagggagagaugcaaagcugagggggagggggaaaccaggacugggcccccagcuaacaggaccccauagaacacgugauuuuuugcuuaaaucuugaagaaaggcuuaucaaaaacccaaaccaaaacaaacaaccuacugcucagagagggcaacuggggccaauuagaaaccgagcagaaaggacaaagggagaaagcggaaugccugaaaacagaucaaaaugaaagacagugcgaggcaugaggaagcuggggaggaugaggcggcggggcgggggggaggggggggcaggacacauggggaugcgagccucucacccugcucugcugucugagaacaucauuauuuuuuuucucccccuggaagugcuguuuaucccuuucuggaauggaagaaauaacaaaaaccaaacaaaaaaauccuaaaaaaauuaaaacaaaaaucccgaaucagacaaacccccuuccuuguccgcagcucccaccaccuccucccagccacccgauccagagagagaaaaucaagaugcagcaacuggggaauccaaaaaaaaaaugguaaauggaaggggagguggugguggagcggggaggcuaaaauagaucgggcguuuaagagauaagcguuuaaguccucacggcaaaccccgaguucggcuggacuggucucucuggaggaagaggaggaagagggccagguugcugguaguaagcagacucuauuguauugguaaagcggcagcgaucagccggagacaugcaggggagccaucuugccacuuacccagcagcccgugugugcggaugggggagggcccugaugcagcaggggaggggaaagagggagggcgcugagugagcaagguucuuauccucuggcaggccacagggagucaaguggcuucagaggccaggccuuucccuucuuuucucagguuacagcagcuaagaggucuacugguacaggccagggugcuugcucccagucuuccaaagggcaaagaaggggccagguggggagaacagacagcugccugaccgaggacccaaaguaaguaauggcaaauggcagaguugggaaugagaaacgauuaaagccaaagcaggaacauuuuuaaagaugaccaaagcuucuaucuacccucagaacaucaagacagcauuuucuuaugugcccaucacugucccacccaggauaacuaacucgcugcucaccucugccaaugaucacguggaaccucucucucuguuuucuagaaaaguuggagggaaguggauaagucugggagaguuucuuuuccaaaucagaggaaagguggaugucucugaagagagccagaguucccagucguuaacaagcccacucagccucagggugccugccuacaccaaugaggagaagacaaguggacaugcacagcuaaggccugaaggcauccaggucgacaggaugcugcaggugaaagguguuccuuggggucaggguaggugagguaagcccaacagugaggcugggagacaacaaagaccaggcaucucggccaucuuccacacaagcagaugugagugugaaacagaccuuaacaaaagauucaguccuacuacaacccuaguacacgagagacuagggcauguuguguuacaaaauacaacaacaacucaaaccaaccccuccaacaaccaccaccaccaccaguaauagcaacaaagaacugcugaagacucaacaagcuaaucugcggacugaaauggccucaguuccuuuuccuaacagcagaacgaacccucuucagacagaaauccggagacuccaucagauaaacuaucuuccuaccuuucugccacuaucccuaacuucuucuucuuuuuuuuuuuuuugguuuuucgagacaggguuucucuguguagcucuggcuguccucaaacucagaaauccgccugccucugccucccaagugcugggauuaaaggcguacaccaccacgccuggccaucccuaacuucuaauccugacacccacuccccaaaugcuagauuuaaaaaaaaaaaucagggggcuggagggguggcucaacgguuaagaccacugacuccagagguccugaguucaguucccagcaaccaucuguaaugggaucugaugccuucuucugauaugucugacaguuacaguguacucauauaaauaaaauaaaucuuuguuuauuuuuuuuuguauuuuuguuuuuuuggagacaggguuucucuggguagcucuggcuguccuggaacucacucuguagaccaagcuggccuugaacuaaaaaaauccgccagccucugccucccgagugcugggauuaaaggcaugcgcuaccacgcccggcaaaauaaauaaaucuuuaaaaaaaaaaaggucaggaugaucagggguacaagugacggaaaagggaaaccaagccucuccaagucaggaacuaguaccugaaaauucagcauuucuaccaggcaguuugacacacaggucagaaaaccucccuagggggugggggugggagggagggaggggcagagaaagacagacacagagacacaugggcgggggaacagggggagggggaggugaaaaagcuuguaagaacuuuugagaacaggucgguguggguuaggccagccuugaacucagauccuccugccugugccuucagagugccaggauuuacccaaccucauuuugaucaaagcuuuuagacaagaaucaaauuuucucugugcugcuuaaaauccuaaacuuacaugccaaaaaguguaugcuacagugguguuuauacauuaaaaguuuccuuuuacauagugaugucugcucaaagguaaggcaagauccgguauggggguuaaaaaagaagugaauccaggaaugagacugguccuaccuuuuacaaacugugugauagugacgacauuucggcuccucuccuauacucuguaaguguugcuaacaauaauacccaccucagggacagugcuagcucuguguagucuggaugcugaugcacacagagaccagcgugugcaggaaacgcaggcacaggcagcagucacugcaguuuuuuuuaauucaauggguagacacuuuuucucugcugguaaaauauucagugauggggaugacagguuuugacaaugcccuuaucacucugaauaauaaucauuagguuacuugccaccuaccuccacucugcaauguuccucagggguagagacuugugccuuggucccuagcucagacuuuaagacaaguaacuacguaugcacuucuuaauuacgauauaaugguggguaacaaguggauacuuaaacauuuguucaucuaaaagauuguuuucucuguuucuucauguauguacgagcaguggaccgcaugcauguaugggaugucguaccugugugagccuacacuguggaggcaagaagcuaagguuaggaaucacucuucuucccacaugauucaaacagaugaagguacaaacuguaaucccagcacccgggaaacagaggcaggcagaucuuggugaguuugaagccagccuacaagccaggucuacacaaucaguuaguuccaggacagccauggauacagaaaaacccuaucuugaaaaaugaaaaugaguaacagggucucucugagaucuggaacuggaugauucugccaguuuuucuggcuagcugguaaucccugacuuggggaggauggugcaggugcagcaugccuaccacaugugugugcccaugguucugggcaucucuaguccuuacacuuguugacaagcacuuuaaccacagagccucucagccaagaagccguuucuggaagagcauuuuuuuuggggguuuucgagacaggguuucucuguauagccccggcuguccuggaacucauucuguagaccaggcuggccucaaacucugaaaucugccugccucugccucugccucccaagugcuaggauuaaggcgugagccaccacguauuuuguuguuuuuugagauggucucacuaugcagccccagcuguccuggagcuugcuggguagagcagacugccuugaucuccgagaugagccugucucagccucccucccaggcacugggaucaaaagugugcaccaccucagcugaucccugcacagcuuucccacaucaucgucccucagaauguacaucuacuguucuaaaguacuuccugcuguuaaaaggccucuacaaguauuuguaggaagcuuuuuugguuacggaauuuuguuccuauggacuuuccccagucucacuaaguaaagaacgccugcugcgaucacuuggagcgugggccacuaaguuagagccuuccuccugcugagaugacccaagauccucccgucaggcuuuugcauuuuccuuuuucuuucuguugagaaaggggcuuaucccugguuguccuggaacugguaauguaggccuugagcucauagagaccuucuugccucuuccuacugcugggauuaacagugugugccacaacuaccuagcucuggcucugaaaauaaaaugaacaaucccauuuucuccuugacuuucauaaccuuuucauagauuuguccuucuacuuuccuauacaugugcauacacacacacacauacacgcacacacauauacacaaugcauauaaagacaauuuaugaaaaagagaggcuacgaauuugaaagagaacaaggaaagguaugugggagguuucacagggggaaaagggaaggggaaaaugauguaauuaucucaaaaaaaaaaagaaaagaaaaauagauacauuauuuuauauguauaugcacaaugugugccuggcguccagaggucaaaagauggcacuaacaucccuggagcuggagucaccaugugaaugcugggaacuagacccagguccucugcacaagcagccagcacuccuaaccucugagugucucucuggccccucccuucucccuuugauggaauuuuacaggacccaagaauuccuaagaugcuauuuucagaagacaauaaagaauccuuaaaacuaucccaucuuuuuuagacaaaggcacauuucuccaugucaugagcucuugaacaaguaucucugaccugucaaguugcaacaagacaagaccagagcuagggacccccuuguucucugggaacaagagcuagggacccccacacaagcccccuucuaacacagagcagcaucacuuagaagggaaggagagaauuacuuagauauuaacauuauauuacaguaugaaugauuugagagacacuaaugggaaggcaauuucuauaggcguauaaguuuaacccuaguuagugcuggaagccuaagaugcugaggacccccaugaaacucaguaagaagcacugacacccaggagcucaaucacaagacaaacaagggcaguuuaucacuuuauccuuacauacaaauuacugaguaagcaaacucugauaauaaacuaggcuuuuguuuguuuguuuguguaaaauaauguaccauuugggauacuggcauucgucuccugaggagcagcagccugcuguacugauuuacacaaguaucccauuccucuucucaaggcacagagacagcuaagcacaggaucgcgagccucacguugcuauuggcuacuaggcugugcauacaaaaggcugugcuuaggaaaggcuggguguaagaauaaacugcugcccaugaacaaaugcaccuacaaaaaacccaaaaaaacaaaaaacaaaaaaaaaccuaaaacaaaccaggccguuguggcgcaugucagcacuugggaggcagaggcagguggauuucugaguuugaggccagccuggucuacagagugaguuccaggacagccagggcugcacagagaaacccugucucaaaaaaccaaaaaacccaaaaaacuaaaacaaacaacaaaacaaaacacccaaacuuuucacugcuacuauuguuuuuuuggaaacagccucauuauacugcccugccuguccuggaacucucuauguagaccaggccaucuucacacucacagaacccucacggcuaccaccaccucugccugugugcugggacccgagggguaagccauaaccagccuaucuauuauuauuaaccauuuagagcaccucagauacaaccagaaucaaaacagguuuaaccaaccuauuuaaaaugauuuggaagugauccuugaagcaaauucuaacuuuuuccuguuaccauuuuacugcuguguuuuguagcuaugugauauugagauagguagggaaaacaagauuuaagccaccaauguucugcuuaucuaguauuuuaaaacgagcuuacuuuuuaaaaguucuagagggcugccaggcugcuaagauugggagcgcugucaaucaaucaguugaaauauaggaaaaccacaaagacuuauuuacuaaauucuuugugagaacagauauaugggcuuaggcuuugaacacaucuuuuuguuagguugcugaacagacugucuaccauagaucaaggaagacgauggacaauuucaguauuugcccaagcuuuuaccuugucagaaucaauaugacuggauuaucuuagccauaaagugaaggucaaaaucaccuuuagcaguaaaaaaauaaauaaauaaauaaagaaacccucuguauauaacccuaagcuucauauaucccagaaugaaugggaaaaauccagaaauaaaggccuuuucagacaacaagcuaaggcccucucuugcuaugguuuuacagaccaaccacugaaaggcuggcaggaacaguucuccaaaggugucaacaacuuuauuucuguuccuuucuuuuucugguugcugagacaggguuucucucuguagcccuggcuguccucaaacucaaaagaucccccucucucugugcccagagugcugggauuaaaaguaugccccacaacaccaggcaugaaaaaccacuuuaaaacugccagugugcaaggccauggaccgucauggaccagggauggacacauuauuuugaaugccauacaaaggagcuuucacccuucaccauggauggugugagcuggggauucucaagagucccugaaguuucaccucaugguccuagaagaaaaauaccuuccucaaacgauaacaaacuugucuuacaaugggagaaaacuaaauaaacuuuuucaaagugagcaagcuucugguuugugaaucaaaaaauauaauggccacaagaugacagcagaggcaagaauaugagaagaccacuagaacuaccacaguagagcacuaaaccauaacuagccacaacuagaaaaugagaccaugccauuugcucaccacacccaaacuagacuuaaaagacagcugggaccaaccucucguaagaguguaagugaccagacuguuacucagaaggagguaguacuggcagcagaauuuaaaaacauacaaguaaauacagagcaacagagcacuuuccacaguaagccacaauuccugucgaacucagaaauccgccugccucugccucccaagugcugggauuaaaggccugugccaccacacccggcuccugaucuuuuaaaaagguaagcaaucucacucuuucaauacuuaauuuuuuuuucauuuuucgugaguuucagacuuugaaguugggauucagaguaaguaaauaaauguuuacagacaggguuucucaccauagcaggucagaauccaaggaugacauucaauccuccugccuccaccgagugugcaccccaugcccuuuuucuuuucuuuugggaggcagagugcaucucuguaauaucuaucccaggcuagccuugagcuuucaaugguucugccucagccuccauaauacugggguuggaggagaauacugggccucugggugugugcaugacccuguauuauuccaguaacuuaguuuauaauacaaagcucaaaauaacgaguaucuaacuacaaaauuaaguagacaugaauauuccuuuuacaaauuaaguacuaaaaagcucacauuaaccguaagagcggugucuuaagaaaucacuucugaugccagggcccccuaccugccguacacuacuugcucucaacugguacaaacugcucagugaggcgacagccagcaaccagggaaaggcaagcuucuaggcauuacaauuagucuuugcuuuugcuuguuuuguucugagucaggguauugcuauguaguccaggcuggcccuaaacucacacucugccugcccuaggcuccaaugcagugccaccacggucagguucucucucucucucucucucucucucucucuuuuuaaaagauuuauuuauuuauuuauuauacauaaguacacuguagcugacuacagaugcaccagaagagggcaucagaucucauuauggaugguuguaagcuaccauaugguugcugggauuugaacucaggaccuuuggaagagcagucagugcucuuaaccacugagccaucucuccagccccagccccccgccccccaagagacagugucuuucucuguagcccuaguuguccuauaauuuguuauacagacagacuagccuccaacuaagugaucugccuaucucugccucccaagugcuaagauuaaaggcagaugccauuaagccuagccuaaaggacuugauaugcagcacugguguggaacucgccaacagggcugacuucaaaucuguggcaauucucuagucucgucuugucuuccugagcauucuuaggugacucgccuauugauugauuuugcaauagguuuucaucuagcugcugucaaucugccgugugccugcugucauuuaauccucuugcaccucccucacaaaugucuagcuuguagaccaccacucuuuauuaaaccgaguucuuggacucagauaugauuagaacacugaguuaggauccuguuuuaagcagcaggguuacacucaggugcuuacuguuuaaagcgguuaccuauuucagcucaaagauuccacauguuuuuuucuuacccggaucauuacuuuccaaaccaccuuaaaguucuggaaguugaggccuaccauagugacauuaaagucuggccucucucuauccaugaaacacuuccuucauguuuuaaaaggaagucaggacugcugaguaaaagaaacccuauggagcaaagccuggucccacacuugccgcuccuuguuaucuccuuacuuacacagugugaugaguccuuucugauucuagcagaugagagaucugagucucugagguuugaggcuguguggcagcugguggcucugccucuucagcuucacacuucuuugggcuccccuguuaauagagagcaaaaaccaaacaaaacaaaggauuuaacccuguuugauuaauuuucuuuaacuugaagcuaguaaaagacaguacacgacauacauaguagcaguuucacauaaggcugucuuuguuauuuuagaauguggaauggaauguggcuuaagauuguuccuauauaaauuaguucuguuuuuuuuuuuuccuuucagguucucauuuuguacuucuggcuggcuuggaacucacuaugcagaucaggauagccuugcaacuuacugauacucacccaaauacuucugccuccuacaugcugggauugaagcuguaagccauaaugccuggcuaaagguagcuacuugagacucgcuaggcugaggccuauaaucucagcacucuggaggcuacgccgugaggacgggcaagggaugaacaagacccugguuuuguuuuuguuuuucucaagauaaggauucucucaguggcucuuggccauccagaaaaucacucuguagaucaagcuggccuugaacucagagaccugccugccucugccucccaagugauaagacugaaggugugagccaucacuaccagcucccauaaccuuuuuugagacagggucuugcuauguaggccagacuggcccugaacacaaaguaauccuccuuaauacuaagauauaagccugugcuauugugccuggcucuugaauuuggggaguaaggugguacaugccuuaaaucccagcacuagggaggcagagcagacagaucucugaguuugcggucagccuggucuucaguuccaggauagccagagcuacaaagagaaacccuuucucaaaacaaccaaaccaaacuaaauaaagccacaagaaacagagucucucuauuauacagcccuggcuguccuggaacucacuauuguagaccagacuguccuugaaucucagaaaucugccugcuucucagugcugggauuaaagguauaugccaccacauccagcuuggaauucaguagcugaugaccugaguucuagcccugacaacuacauggcggaagaaccaagacuuggccucugaccucauguacacucgccaauccuccaacaaacaaacaauuaaguauucucaaccgucugcauuucuugacugucguccagacagaucucugaauuugauggugaagacacucacacaccuguaauccuagcaagugcgaggcgaaggcagaaccauuagucugacgcuggccuguaagaugcugucucaaaaacacugaacaaugggaaacuccggccuaccugcuccggcugcaaccucuggaucacgugcuguugcucuggcucaggauggcucagaugccucccccggacagaugcugagaacgugggagccuucuccuuugguucaaggaccugcagcuguggcccagauggagcugcagccuccugaccacaagagggaucuuugguuucaguguagcugguguugcuaucucuggagacuccagggcucagagacuaaaaacacaaaaggaaacacaaaagggaaauuauuuuauacuccaaauauuucggaaagauuaguaugaguagauccuguauauacaggagaccacuagauuuuuuccaguuuuggugacccaguccagucugggucuuuuuuuaucuucuugauaaagagauuuaaguagcacaaacagguauuggacuugaucuauagccucuaccucccaaacgcugcaaguacaagcugauuaggaauagcuggucuuccucuagaucucuuugucucguguguguacugccauuuaagugaauaaucuccaacuacauauucaacaacuuuacuaaguuucauccagaggcuuacacucucaagaagcuuguacugaugaaagauguauucaguaugcuuugcaaucaaagggguucagaacgggcagggaccccagugaccacugcccugacucuguaaugaaggaaaaguaacaguggagucugcaggacucuucuauuccuguuagaaaucauuacagguuauucugaguuucaaaaugaccagagacaggauucuccauacucacuuuucugcugcugcuugacgcggaacgggaacgagaucgggaacgugaccuggacucugaaguugaccuggagcccaucuugggucucucgugaggguuggcaugaacucgugcuugggcuccaucucucugcuuagauccuggagacgacugugggcgggaagccacacugucaggagauggagaucuggauggagagcuggaggaugaaggggaggaggaccugcuagaggaugagucggcugacugcuucccacugugcucugggaagagagcaugggaggcucuucugcccuccuucuguuccaaagacuguuucuucauagguuccucagugaugccuuuggcaggugcgaacuccuccacuguuagagggaggggagcagacuuuucacgcucacuuucaacacccuucuggguggagcauucaggcagugagcuuuucugagccagaggcaggacacucucaucugacacucucccugcuggagacucugcuuuggugucuguaguaccugacaaaggagacaggcuucuuagcagcugcgcagggugaggagacgcuaguggcucccuggcuccagcaucuguguuaggaggagacaacugaaugaggacagggggugcugggccuuccacuggcuccaucucuuccuggaguuguauaugaguugguggagaugacgcuuccuugguaaguaaagguggggguguuuccucuucacugacuaucuguucuggcugcagcacaacaggggccuucucuaggucuucaggaagcggagguggggagggagacugggauuuuuccuccaaacuuugugaagacuuuaccucauuuucuucuugagggagagaaacaauuugugucucuuucucuuguugcugucuggccagaugacuucuucuagcuucuucuugggaucuaguaacucgcccuccuuucucuaacucacccuuuuccugggaucugauguuuagggguuucucauccaccaccuuuucugguuuugcucugguccucucuuccccuucuucauccucaaacugcuucaggguuggugccucagccucucuagauuucugugccucaucuaccuccucuuccucuucaucaucgucaucuucuucuucuuccucuucuucuuccuccuccucuauuuuuaaauuucgaucugcucugacccucagguuucuagauggugucucuugauccucuuccuccucagcagucugacuguacucagggaguuuagauuuugccugaaagaaaagauauacaucuguuugaagugaacagaggaaaaguaucucucaaggcacucuugggaaggagaacuucagcaacucggcagugggugagagaguaaccucugcugagccgggcuccucaacaaaucaaagcugaggaaccaggagcacgguaaggaagcugcuucucauuugugcuuuagcuuccaaucuccuauguucuuaaaaagauguauuuuauuauuuauuuauguacauguguuauccuugugagcacaagugccaucagaggcagaagagggcaccugauuccugggaacugaaguuauggauggcugugagcugcgugccaugugggugcuggggcuacaacuugacucuucugaaagagcagccaguguugggaccugcuaagccauuucuccagcccugguuauaaauguuuuuaagguuuauuucauguagaugaauauuuugcucacauguauacagguguaucaugaaugugccuaggaaguaccugaggucagaagagaucuucaccacugagccacuucucuacagacccugacuuaauuuuaaacuuuuaacagaauaucuacaaaguagaagagagaucuaaccuauuguuacuuagcauuucuuuaucacuuuggcuuuuuuccccuuuucucuuugagaugcaauaccacacccuguuucucaucuuccuucuccuucucucucuuugaaacagggucucauguaggccaggguggccucaaaugcagugagcuaaugucucuguucccaggugcugagaaucaagugcucuuacccagugcugucacaacuuugcggucaauuauccugaggcuaaacgucuacauuguucuuccuuaacacuggcucagauagucuuaauugaauaaucaagucacaucuugucuuauuauucagcuaauauaguucagccuacugacuuucauauuuaaaagauucggggugugugugcgugugugugugugugugugugugugugugugugugugacucaagaggacagcuugauggagcuauugcuccccuucugcugugagggucucagagaugaaaucaggccaucaagugccuuuagucauucagcccucaguuagguucuaaaacccacguauacgguuauggcgucacagaucuguaacuccagcacacaggaaaccagacaacaggauccagugagacugucccccccccaaaaaaagaagaagaaagaaaguaaguuaaaaaucuauuauuugaucagaagccugaaggccagagcagaucuaaccuacaaaacaaaagcaguggcugagacuagaggauggccgcacaggccgagacaccgacucugccacagcccaagaugcagagagcagcaggcacgcugggggugggggugggggugggggugggagugggaguggguuaccugucuaacucuggaugaucgucuuuccccuuuccucggcuucucaucaucagauucuccuuuuucuucagaaaaagaggagcucuuuccuaucaaaugaaagaaaaucaagucauauuugugacacgaaagccuugauucacgacuuucuaaaauccaaccaaucauugccuacgagguguugaguaaaagaguucuacauuuuuucacauauaugcuugaggcuacacaaagguucuuuuuaaauaacucuugcuaugaggcugaagagauggcucagcaguuaagggcacugacuacuauccuagagguccugaguuuaauucacagcaacugcaugguggcucacaaccaucugugaugugaucugaugcccucuucuggugucugaggacagcuacagcauauccacauacauaaaauaaauuaaaaaaaacaaaaaaccaaaaaccaagaaaccucuugcuaugcauucugaagaauauuuuaauaccucaacucaaaaguaaaguaaccuccagaccgcccagcaggguacagaaauacaaagcaucccuaguucuauaaugucuuuuuauauucugaagcagaauuucacauuucaccauucugaaggcaggaaugguuggucacucacacggacaaugucagcccuccagagguugaggcaggagcacugucgugaauucaaggccagccugaguugcucuauguugaguuccaagccagccuggacuacaauaugagccugucacugcuuuguacccacuugccaaaguuacuuuaugaguauggguguuuuuugccuguaugcaugauuuuuaccuugugccuuccgaggagguaagaggguaucagauccccuggaguuggaguuacagacaguuguaacccaccauguggguguuaggaaucaaacucagguccucuggaaaagcagacagugcucccaauuguaaaggcaccucucuaguccuguaucacgucugaacaaugugucuaguaguaugauuuguuagucccucuuaccccaauacuggaaauuaaaacucagggccuuaugcaugcucaacaagcacucuagggagcuggagagaugguuuagcaguuaggagcauuggcugcucuuucagaggaccuggguuugauuuccugcacauacaugguagcucacaaucaucuguaacuccacuuuccggaggucugacaucuucuucuggccuuccuggguacaggcauguacaaggugcauaggcacacagguaggaaaauauucauacauuaaaaaaaaaauuaaacaaaaaccacccuaccauuaaaguauacccucacucuuuugucuuagcuugagaugaggaauugcuguaccggauccuccugccuuugauucccgagcacuagaauuuauaugugugagccaugcuggcucuacugguuaggucugaccaaaauaugauuaaauauaccagucaaucuguacaaucauaaacucaagaaaugaguaaaaaagguuuuuuuguuuuuguuuuuguuuuuguuuuuguuuuuuaaaaagagaaagacacuggaccuggcuuggggccuugauuuauuuauuuauuuauuuauuuauuuauuuauuuauuuauuuauuaauuauauguaaguacacuguagcuguccucagacacuccagaagagggagucagaucucguuacggaugguugugagccaccaugugguugcugggauuugaacuccugaccuuuggaagagcagucgggugcucuuacucacugagccaucucaccagcccuguuuuuaaaaugaaguuaggaauacagcucaauaguaugcaguguacacuuaaaguggcaaagacuaggccaaaacucccagggauaaaagaaggaaaagguuggguggugguggcgguggcgcacgccuuuaaucaagcacuugggaggcagaggcaggcagauuucuguuggaggccauccuagacuacagauugaguuccaggacagccagggauauguagagaaaucuugucucaaaaccaaacaaaacaaaacaaaaccaaccaaaccaaaccaaaccaaaccaaaaaaggacacagacaaauuaauucaugcuaaacgaacagggcuuuagaacugcguccucuuauguuuuauacauugguauucaagauggaaaguuuuuuuucuucccuucaagggaaagaaagcuugaaaaguaucagccuagaccauucaagucuagaaguuccacuagaacauuacaauacuauauagaagaucugagcacaacuuauucacacacauguggcacugcauggggagguuuaaccuccaaugugggcagaagggauacagaauggcaauacauggauaaggauuaguuuaguaaacagcacgggauggagagaucgauugauggcucaggcgcuuagagcacuggcuacucuucccgaggaccugggcuccacuuccagcuaucaaauaauagcucacaacuggcuguaccuccaguuccaggggaucugaugcccucuucuggccuccacaggcacugcagugugguaugaagacaaauauguagagagaacacccauacaaacaaaauaaaaguucaaaacuggcauaaggacaggagguacucauuagaagaguaggugucuucugaggaaaaggcuugucuaauaaugcaugaagcuuggguucacuguccaagggggaggagagaaagaaaaguaauucuauuucaaaugcuuaauuagcuaagauggguuuaacuuuaauacagcucagaaagcgucaauucaggcuagagcuagagcucagauguuuagcaggcacaaggcccucgcuucaguccugagcaccaccaagaaaguguaaagcauacacaaaucaugacauguaugaacaguauuuaagccagugugaacaauccugguuguuuaagcugacccaggaucugcuguuguuuuccauauaccagcaauuuaaagugaacuaggcuuugcuuuuguaacagacacaaccaaacuaaaacuaauaaaaccaacuagcaagauuacaaauguuuuauaaauguuuaauuccaugaccacuugguuaacgaaaucucuuaaaugauauaauuucauaucugaguaaauaaauauuuauaucacuugcauuaagauuguuuauacaggaucuaugugauauacagugacaauccacacuuucaccaacauaggaggcauccuaagacacuacuagcuggauggauggcaguggcacacaccuuuaauccagcacucagaaggcagaggcaggaggaugugaguucgaggccagcauggacuacuaauugaguucuaggauccaggaaacccuaucuuaaaaaacaaaaacacugcccccacccccgccgugcccccagcccuaaacaauacuaugggcuaaaugacacaaucucaucaaugucauaauucacugaccugaauuagguuaaauuacgaaguaaauaaagcuuaaagcuaaaugcagagaugcuauucuccauaaauacaaaagcagagcacuggcugggugugacagccaugccuucaaucccagcaacaaggcagugacaggcacauuucugugaauuugaggccagucuauguaaugaguuccaggacagccagagucacuuaauaaagagacccugccucauagcuagcaaacaaacaaacaaacacgcaaaaccaaagccagguaugguagcacaggcuuauuagcccagucugugaaaaauaggauaaagaauucagccgggggaucggaggggugggcgugauggcagaggcaggcggauaucugaguucgaggccagccuggucuacaaagugaguuccaggacagccaggaacuacacagagaaacccugacucgaaaaaccaaaaaaaaaaaaaaaaaaaaaaaaagaauucaaggccacucuggccuuccuagugaaugccucaaaaaacaccaacacagcacucacaaaaaaugguucaaccccuaccacugucaaaauacaaaacagagcaaagcaaaacacuaacaaaaaaauaacaaaaaauacagcaauaaaaaaauuguauaugaaguuggccagagauaaauauuaggccaaaggcaaguuucauuaacuugugauuuaaaaauuacauauacccaaguuuaacagauucaaacuguagguuggucuacuguacauuauuuuggauaucauaccauaaaaccucaguagguuucugauuauuucuuuggaagcacuaaguaaaagaucaucaaaaagaucugggaaaacaggugagcuguucagauuuugaccaucacuguuuuguaaaagcuaugaaaaacgggaugggauucucagaacgaagcacagaaucacuaacaauacaaaacaugagguguaggcuagcuuuuucacuaggugauaucaugggagccaggcuugggauagcacacgaccacaugaauguuugaacauugaccaccucaccuacggugaacccaaugcuagcaaugggcuaauaauaaacaagauaaaucuggucaagcuuuauuucuaaaaagcccaaagccagaggagaaaggaaagguggcugcuggagagugaagggcacauuaacauggagaaugugaagggcauuugagagugguuuaggauugcugucagagacagggaauggccauauaguucaggcuaacuccaaacucuccauacucucauuuuagucgcugagugcugggguuaugggaaugugccaccacuaucagcugcaaaguaguuuguuuaucucagaagacaaauuuguggacaggauuuauaggaccuaaauuaggcaaauaugaaucacaacaaagacuacuaacaagguacccuuauauauacacaagcagcaaaaauaaauagaccuaggaaugaaugaugccaaccauaacuacucagccuucuaaggaaugagugagucuguuacucuuacuuccuuagauucucagcaaccuaacuguguauaugugugugugugagagagaacacacacacacacacacacacacagaggauuagaacugaguaaggccaccaugggcucuucagauguaugaugggaagagaagggaaaaauccaauacccucagcauacacuuuucaaaauguuugucuguuuuuccuagauugaguucuuaaaaacaagcaccuacugggccggagagauggcuggcuuauuggugaagaaaacuucauucuugcagaggaccuagcuagguucaguucccugcuuccacauggugccucacaacuagccauaacuccaguucugcaggcaccaaacccauguacaaauaaauacauacaugcagucaaaaacacccucauaaaaucuuaaaaaaaacaacuaucuucuuguaggaguuuugcuaugagguaagcaaaaauauccuaauaaaauauaaccaugagccgggcagugauggcacacgccuuuaaucccagcacucgggaggcagaggcaggcagauuucugaguucuaggccagccuggucuacagagugaguuccaggacagccagggcuacacagagaaacccugucucgaaaaaaaaaaaaaacaaaaaacaaaacaaaaaaacaaccaugaaaaacuguucuguaguuagucauucauacaucaaauuauuugagaaaacuagcuggcagaauaaaauguggaaucucaggacucacacccccaagauucacagaggacccaggaacucaugguuaagcauucuacaaaaacaaaaacaccuuaggugucauuagugauuagcaaauauguuacuagaaaaguuacuucaaccagaaccuuacuacuaaagacuaaagcagacguaaaaggcaauguggcauucuucugacaccuaaauggaggggugguguggaguucuagcaggguugagcuccaucagcccugaucacucugcuacagggauggagaagggcaucugucacaggccaguaaacugggacaaugacagcuuacugcuugggguuuuccuuuucguuuuccgagucuugccaagcagaccuugcuguccugcuacugaacagugcaggcuggccuggggcuuguggcuucccucugccagccuuccuagccugggugcacacagcuucaccauauguuggcuucuuauucacuuacucacaagcauuuaauuguguauaggugagcaugucuauacugccaguguauagaggucagaggacaucuuguaguugacucuccuuccaccaccugaaguugucaggcuuggcagcaaguguucuuccucacugagcuuaucuuaugucucucccccucacucucacaccuuuauuuuauuuuuuuuuaaacaguauuugugacuaaacccaggaccucaugauauuaggcaagugcucugcacugagcuacaucaccagcccuguaccaccucuucaucuuuucuuuuuuaacauuuauuuauuauauguaaguacacuguagcugucuucagacacuucagaagagagugucagauuucguuacagaugguuguuagccaccaugugguugcugggauuugaacucaggaccuuuggaaaagcagucagugcucuuaaccacugagccaucaucucuccagcccccaucuuuuuuuuuuuuuaauuauuaaaauuagcuuuuuauggccagccugaucuagagacuaaguuccaggucagcuagaaaucauguuuuauuuaucguguguauguuuguuuuaaguaugugggcaugcacaugccacuacauguguggagaucagaggacaaccuuugaaaguucuuuccuucaagucuggcaacauccaucuuuacccacugagcccaccuaccccucaccucaucaucgagacaugguuucucuacagguccuggauguucuggaacucaaaauauagaucaugcuggccuuaaaccacccccucucugccuccuaaguacugggauuaaaggugugaaccaucacacucucuuuuuuuuuuuuuuuuaaugccaagcuguccauaacucagaaucccccugccucacucuccugaguagcugggguuggacauguguugcacucuacgaaucaccuccuaccucuucuucuaucagucacaaucacagguaaaauccugcuuaggagcuaaaacaccagacuggcuaguguuucaaaacuuuugcuucugaaccuuauucuauuuaaggacacacugcucauuuucauuucaaauuacauuuagaauggagaagccauguguuugugugcaugcaucuaugcaccagaggacaaacuuuugaguguuugcuugccauccaccuugaguuucaagaaaacuagccaggagcuugcuaagcaggcuugucugguuggccagcaggccucagggauaccagaccacagugcugggaucacaaguacaccacuacauucagcuuuuuuuuuuuuuggcaugaguucuggggcccacacucggguucucaaaagcacuuuauugaccgacugcugccuccuaguccccagaaaaacuuccucaaaaaccacaagucuuuacccuaugagaaccuucaaggguucccuacuuaccuacaaaauguuuaaaauucauauuuacuaguuuggcacuugaagcuuucucuaauauuacuucaaucuaacuuuuaaauuguuguguaugaaaauuaauaacuacucuggugauauuagucuaagucugugccuccuuuaaaaauaguccaggggcuggagacacagcucagcuguugagaguacuugcugcuuuuccagaggacccgaguuuggcucgcagcaugcacgcugggaggcuggcauaccuucagaaugacuccugcuucuggcuucuacugaucucuuaugaucaucuugaaucuauaccucugccaugaagcuuucucuaaugacuacaguugugagauagcucacuuuuuaaaaaaauuaacuauguacauaaauauuuuugccugcauauaugucuauguacuauuucugugccugaugccuauggaggccugaagaggguaucagaugcuuuggaacuagagauacaaauggcuguuaguugucuugugaauguugggaauaaagccagauucccuggaagagcaguccagguuucucacucugaugauauaguaguguauaacuaaaacacuagcacuugggaagcaaaaaagacagaccucaagacugagguuaaccugggcuaaauagcaaagcagccuggcaugguggugaaugccuuucaucuuagcacucagaaggcagaggcagauggcucuuugugagucugaagccaaucugguacacagcaaguucuaggaaaacagagagaaccugucgcagaaaaccacaaagggcagacaauauugcucaguggguaaagacaccaacuugucaagcugaauucaaucccugggacccagcugauaugagagcaaacuuaaguugcugucugaucuccauauaugggucuuggcauugguacacacacacacacacacacacacacacacacacacacacacacacacacacacacacacuaaacaaaugcaaugaaaaaaaaaauaaucccaugguagaaggcuaaggagaugacucaguggcuaagagcacgugccacucuuccugaggacccuaguuugguccccagcauccauguuagguggcucaaacaccuguaauuccagcuccagggauccaaugcacuccugugaacagacccacacagauacacauaauuaaaaaaaaaaaucuuaaaacuaucuuacaguauguuauguguaucauuugugucauguacuuacuaucuaccauuuuaaaguuuuauuuauucucuucaccaacagacauaagaagauaugucuauagcaggaacugaacacauauucucaugacauuuauuugagaaugaugguaauucauuuauaauagagcacccucuuuccuccuggcuuucuaaucuggggacagcagagcagugagggcagagugggucaagggagcauccuacuccuucccuaucugcagaaaaucgagggcuuugaagagugcuucaaucauuccaggguuuucaguguuaacuuuagcauccaggggagcuggcaacacacgcacacacacacacacacacacaccccguaaaaagaauuguuuguagccagcaagaaggcugaagaagauaaagguacgaagacgaagccugacgaccugaguucaauuuccaggaucuacauggcagaaggagagaggugcccucugacagccauacauguucugugccaugcacguucucucucuacacccacuaugccccccucccccacaaacaaauguagcagggggaggugugcuagagagauggcucaguuguuaggagaguuggcugcucuuccagaggaacugagcucaauuccuggcacccaaaugguggcucacaacugucuguaacuucaguuccaggggaucugacaacuucuggccuuauggacaugaggcacacagguagugcagacauacauaacggcaaaacacucagacacaccugccuagcauguacaaggcucuggguuugauccauacauaaagggggggagggggagaaggaacacuuauuaucaacagaauuuucaguuagggcuguagcucaguuguggagugcuugcuuagccaccaugcaggaagcccuggguuugaucucuagcacugaauaaaauaggaugugauggagcauccauaacuuacaaauugggaagcugaggcaggagggucaguaguuuaaggcaauuccugguuucuuagugaacuggaagccagacuagacuacaugagacuguuucaaauaaauaaauagauagauagauaagauagauuaaaaaguggugguagcucaguaguuaagaacacuuacugcucuuacagaggcuccagguuuaguuccuaacauccacaugucaguucaaaauuaccuagaacuccaauuccagggcaccuaauagccucuuauaagucccccuaggcaccagacauauauguaaugcauauuuauauacauaggcaaacacuacuuauacaaacaaaaauaauaaaacaauuuuuaaaaauuucccucaaggacucagacuaggaucaagaaauauagacauuaacuaaucuaagaucuuaaaauuagccuuaaaaguccuucauuuucuuuuaaccucauaaaauuucucucucuccaauaaauaucuccaaaaaaauuaauccuuucuaggaauuacaugcuaaucaaaaaacugaaaacauauauauucugaaaguauuaaguauggaggagggacugucguuccugauaaccaauuguugguuguauugacaaucgaaaauauuuguucauuuacacacugccuuaacuacacugaccuaauguccacuaucacauguauacaaugccuugaaaaccgucauuuuugcugggcgagugucacacgcuuuuaaucgcagcacuaaggaggcuaaggcagguagauuucuguguuuaaggccaaccuagucuccagggcuauauauugagaccuuaugaaaaauaagcaaaacaaauuuaaagucuuuccauaugacaaaggcuauauuuacagccuuuuacaugagauacuauggaaaauuaggcaccuaauaguucuauaauaauuuugcuugaaccaauuauauggagcucuuuauauuuauaaaauccugcacugucuuuaacaguacuuagcauaacuguaauuacacaaucauuuuaucaguguucauuuaccuacuggacugccagucuccuuauggcagacaucuuacucucuaguauauccuggggucuaacacauaccugguauguaccagacauguaguaaaaauuuguugagggugggagagauggcucagcacuuaagagcacuggcugcucuuacagagguacugaguucgauucccaacagucaugagguaguucacacuaucuauagugggaucugauacccucuucuucuggcaugcagccauacaugcaaacagagcacuuauacauaaacacauuaaaaauuguugaacaaugaaacaguagauguccgggcuggagagauggcucagggguuaagagcacugacugcucuuucagagguccugaguucaauucccagcaaccacaugguggcucacaaccaucuguaaugagaucugaugcccucuacuggugugccugaagacagguacaguauacucacauacauaaaauaaauaaaucuaaaaaaaagaaacaguagaugucaaauauggaagugguggugacuagauauauacauacaacaaguagaugaaauaagucaugacuugcuaaauucagagcuauaaaaggcugaagagguauagagaaaucauacugacuuguaagacaccaagcaauuaacauguuagcaaaaccacauuccaaagaggacauacuuucucuaaaaucagaugccaaauaucaguuccacagaauucuccucagacuuucauggaggcuuagcaugaaaggaggcaccacuaccucccccaccaacuacgcaggcuugacaaacagcgcaguggagagggagauacguacggggugaaugugugcugagcuccagcucuggucuguucaggcugcucugaaaaucaggaggcagcagggaagccacucccucaggaugggucaucucguccuccgacucagcugaggcuucugcaaaguacacauugggucggggcagggagggggugaagugcucagcaugugggaacucacagcaguaaaggauggacagcagcacagucaaacacagagacacacacauacagugaaaaggaaagccucccuggagcuaagcucucccucguccaaagggggccacgacuuauuucuaacuccuccucuucucagacucaaauggagcaucucucuuucugacaaaguuaaacuguaacucaucuggcuucacaaaauacggaaagcaaaugagcagcagucuucccugaccucuuccuggaauuaguuagacucgucuacuuggugacagaaaugaaaacauagaccuuguuagaagcgacaauuugggcuuaccuucaaguuccgcagccucccgagcuucccguuccaggcgcugccuaaguagcuccugcugcuuuuccagauacugcuuuaugaagcuguucuggcucauuuccuccccgaucuguguagagaaaucgggaugagaaaucuaagggcaaccgcuaggugauuaaaaagaucucaaugcagguaaaggauacuugggucauaaaauaagaugcaaagcuguuuuucuagucuaaacccugccauagauuuuugguucuauauuuuguuuuugucauggauaugugcauaaaaauauacgcacccaguccaagcaaugugaaagccccauaacaucagaauggcuauucuaaccaaagagaagcucaugucuuguacauacuuugggucugguuaacucagccacacaauauuuuuauuugaaaguucuuuauaauaaaguuauuuugaauuaaugaaagcuuuuuuauuuauuuauguguaucaaguguuuuggcuguaggugugucuaugcaucaccuauguaaaguauuggguacuaagacucaagccuggguccucuggaagagcagcuagugcucuuuaaugacugagccauugcuccagcaaccccgccccaccuuuaaaagaaacagaauacuuuagaaugccuaucacaaauuuaaguuugauauguucaaauguuuuaaagauaauuaugagggcuggagagauggguuagcgguuaagagcgccucuugaguuggucuucuagaggcccuggguucaauucucagcacccacgucugcucacaaaggccuguaauuccucaggucccaggggauccaauauccucacacagacacgcaugcaggcaaaacaccaacgcacauaaaauaaaaauaagucacuaaaauuuaaagcuauguggugguggcacacaccuguagucccagcacucaggaggcagagaggcagagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcaggcacaucucugaguuugaauccagccuggucuacacagagauucaaagacagucaaggcuacacaaagaaacccugucuugaaaagcccaaaaauagaacuaaauuaaauuaaauuaaauuaaaaauaaccacagcugggcggugguggcgcaugccuuuaaucccagcacuugggaggcagaggcagguggauuucugaguucgaggccagccuggucuacagagugaguuccaggacagccagggcuacacagaaaaacccugucucaaaacaaccaaaaauaaauaaauaaauaaauaaauaaaucuacaaaacacuuuaguaaaaguaaaaaagacaaauuaccuuauaaagaaauaugaacuuaaauaauuuuuauaaacaauaaaaucugauaguuucuaaacauauaagacuuuacucuuuagcuagagauuauaaaaagaaaaccaucuaagaaaguauaccaaagaaagaaagaaauuccauggagcaagucuacuccauguuaucuggacccaaaaaauacaacucuuggaaggcucugucuuucugucugucugucugucugucuuucuuuuuuuuuaaaauacuuuucaagacaguuucucuguguagccugggcuguccuggccucaaacucagagaucugccugcauaugcaucucgaguacugggaauaaagauaugcaccaucaauggccagcuaaaggcuuuuucuaagcuguuccuauauuaaaggucagaauccucuuccucuaagcugccagaggucaccugccaagaugguuugcuacccucuugacccagaaaaacccacaaauucaugcaaaucaagagguucaaaccuucguguucacuuuaagaacaccugggaaacugcccaggccaucaaagguaugcauauccgcaaagccaccagguaucugaaggacgucacuuuaaagaagcaaugugugccauuccggcgguauaaugguggagucaguaggugggcccaggccaaacaguggggcugguuggacacagggucgguggccaaaaaaagagugcugaauuuuugcugcacaugcuuaaaaaugcagagaguaauacugaacuuaaggguuuagauguagacucucuagucauugaacacauccaggugaacaaggcaccuaagaugcgccgacgaacccacagagcucauggcuggauuaacccauccaugagcucccccugccacagugagaugauccucauugagaaggaacagaucguuccaaagccagaagaggaggcugcauagaagaaaaagauaucccagaagaaacugaagaaauaaaacucaugucccgggaauaaauucagcauaaaauaaaugcagauaaaguuaaaaaaaaaaaaagguuacaaucaauagcacuauggcaaaaagaauauauuaauauuuuauucgaaauauucagucccaggauugauguuaauacacaaguaaccugaagaauaaagaauuuuagggauuaugcaucuuuuagaaaaaagguaacccuacagucuaggcuggcuucaaacuugcaauccuuuggcaucagcacccuagucugaguaguacaggugugcuaccacaauggacccugucucccaugucauaucaucaacucccaccucuguguguguguguguguacgcuuuauccucaggcugaauuaugccuuuucauuuaaauguuuuauuauuauuuaucuaaaaauaauguacuauuuuucucaaaauugagaagaguugagauaguacauaucuuuaaucucagcaccagagaggcagaagcugguagaucucugugaguucugggccagucuggucuauacagugaguuccagacuaucgagagcuacauagugaguuucggucucaaaaaaagauaagugcuagagagaugaaucagcagagagaagcaacgcuuguccuugcagaagacccaggucugguucccagaauccacauaguagcucacaaccaccuguaacuccaguuccagggcaucugacacuuucuucugaccccuuugggcaccaggcacugauauaguacacaugcauucaugcagguaaaacacucauacaaacaauaaauaaaucugaaacaaauuuuuaaaaacaaggaaaucugagaagaaaaaaguacuaguuucuccaaaaagaucaagcuccaccaagccagaaaaacauccugucauguaucucaaaagaucaagcgcaggggcagagagacggcucagcgguuaagagcaccagcugcucacucuuacaggggaccuagguuugagucccaguguguacuggcucacaaucaucuguuaacuacaguuccagguauccaaugccuguuucugaccccuggggggaccaggcauaaacauggugcauauacacaauugcaggcauaacaaauauaugcauaaacuauaaauaaauauaaaaaacuauuuaaauacauaaaaucaagagacaaaggaaaggaacauacauuaauacuugagagacuuguaacuccacuuccauuaaaaauuaaacaaaauaaaccacagaaagggguguauuuauggcguaugccugcaaucccaccagagaagcugagguuagaaaacugcuguauguuugaguccagccugagcuacacacuaagucccugccucaaaaacuccaaagcaaccaaucagccguuuuguuguuugagugaaaagaaaccucagcacgccaggcuaguuauggcccgugcuuuaaucccagccccggaggcagaggcaggaauuccagggcagccagaccaggguuaccccugugccccuuucuguagggugcaaacaucacucuuuguccuucagcuuucuugucacaaacucuccuccuuaaguccuuacaugccuauagaccuucagaaaugaagccaguccaauacuuccugugcuuucugucauauucucuagcaggaaaugcuuauuucccuuacaguaagucccuuaguagccaauggccacagacaaaauguggauuauaagucugagaaaacaagcguaugugcugcacaaccuuuguugauacaaguaaaacugcacagucuaaagugcgauccaaaauacaacuaugacggaacuaucuuagguuuuuucuuaauugguuuuuaaagauuauuuuacacgccugaauguuuuaacugcauggaugugugugccuauagcagaggaggauagaggaggauauaggauaccuuggaauuggaguuauggaugucugugagccaccauguaggugcugggacccaaaccuggguccucuauaaagggcacuaccgagucaucuucucagcuucauuuauguguguauguacauguaucugugagugcaugcuuguguuugugugcucagucauguucucaggaaccgaggagacauuagaucccauggaacuggagcuacaggugugugugagccaucugauauagugcugagaucuugagcucugguuugagucauugagcaacaagcacucuugacuacugagcuaucucuccgggccguuagguagccuuuuaacgcuguguaaccucccagagcugacuagaugaugggccuagauuugaaugagguauuagggaacaggaagcaccuuuuccaguguccugggcccacaccaaugcauuuuccuuuaagugugugacacacuaaaugaaggguuuaaaagcugaaaaacgcccuacaagaugauauaguguagaaacuuguauuuuguuuuuaacuauacgauaaugucuucaaaauaaaacauuuguagaaaucugggggauggagcacaagcccauuacaccagcacuagggaagcugggcaggggacugcccugagucugaagauagaauagcuugagugcucagccauucuggcuacacagagauacucugauucaacuuuacaacaauaacaacaacaacaaaaacauuuaugcacaaacucuuagaagaaaguuuuuuuccuaagacaaaccggcagaguaguuauaaaacaaugaccuaagucagacuacucuuccuauuacagguaaagaaacaaaggacuccaaguguuaaguaucuuguccuaaguaaucaaaguauuaaagauguuuaagagaaacuacagauuguuaagcaguuaguccuagaacuaggggguuacuaauaagguaucaaauucuuucaaauaaaacuguauuuuuuaaauucuuuuucuuuuuuuaaacuccaugucuuuauacaaaauugagguugauuagaauucaacugucugagggcuggagagauggcucaaugguuaagaggccuggcugcuuuuauagaggacccagguucaauucugcacccauaugguggcucacggcugucuguaacuccaguuccagaggauuugacauccucuucuggccucuguggggacccuuugggaggcaaaucacccauacacauaaaauaaaaauaaaccuuaaaaaaaaaaaaaagacaucaacugucuagugugagaucacuugcaauaaaaauaguuuaagaaaauacugcuucugaugacaaggaaaacaacaccaugucuucccauuuacuuacuauagucuccaaauagcccauucuaucuaaacaaaccuuuucucuuaccugugaauuuggcuggaaugcagcaugggguguugaguguuuuuguaaauuuucuagcauuagagccugguauaaagaagagcaaaaaucagaaaccgggagggggaacaaaaacgcaauccaggucucuaccucucccacagccuucucauucaauuacuuaaauauacauuuauacuauauuccuuucaccgagacuaaaagcccuuuauuaauacuguucucauucaucuucauaagucucuuaaagguagccaugguuacugcucccaaauguaaaacacaggcacacaaagaaucagugaccuggcuaugucacaaaaaucagcaaaaaugacagaaucggaacuagaaucucuauuauugucugcaauuuugacuaggagccacuucuaaauccgguaauacaggcaaaaaaaaaauuccaaguacucagaacaaguuucaaaucacauaaaaccaacaagaggcuaauuuggauuugacuauuauuugauuaguuuuucagaacuacaacuacuuaacugaacuugcacaacuuccagcaguguaacacccggacaaauaaaauguauuaaaaauuucacagggaaacuaaccacagaccuuguaaccaguggucugaccuaauccacacccacccacaaacugucagcuucgggauaagcaacggucugucaacucaaacccugaacugacccagaguccccaucaguauuacgagucacguaugcuaaugaacucuaauaacacuaguucagcucaccuucuuucccuccauuuacaccaaagcgauacacaguauguguaccucccgacaagcucacccucacuacucaaaccgacacaaaauccccagccuaaaguaaucugucucaccucucguaccaauagccaccaaauacuuauccagacugcugcucgauucccuauaaauuagacagccgucucugaccaagucuuucuaucaagguuuccuuucacuuaaucuagucgagcggacauuuuuuacccuaucacaaauguccuauugcagacauagacagcaaccccauccgcccaacuguaucccuaacucggacccagcccugcucgcccccuuaaggccagccacaccggugguuguagagggauuuaacuccuucugcagcgcaugcgccgacaacacagacacaaacaaggagggggugggggaagaaggaaggagcuuaagacacuccgggagaguagcgcgcacccucccauuuugggcucgcgccgcugccguuaaggcgggaaccggcguuaucucuaucccagcgccagccacaccaaccaccgugcgcguggaucugcaggcucgcgcuggcggccugagagagcucgcgccgagcccggacacugcgccugcgccgcggcggagacucgucucuaccggguccgcuccccuccgacaccucggcaacgcugacuucucaccccuuugagccgcuugaccagggcacucuucugcccgcucuuggcuaggccucgcugcuccagugcggccuucaggucggucacccgcagagccugaagaggcuucccguccagagucaccuccuccagcuccgccaucuugcgugagguacucggguccgucccgacggcuucgggcaucuucgguaauuuccgccaacgcccuucgaacggaccggauuggccccgcccacugccauagucuaccccucuauuaccgcucagaauuccccggguuucuccggagcuguucggucguuuccguccccacaucgguaccaaucggcuuuuuccaucuaccuagcggcuggccccucccaucuggcuuucaggcucguuuguuuucggcuugccggggcuuugaaucgaaucucuucggaagcccucgaaucuggcauacccauaaucggagauauucggcuaucuccggaccugggggccggggcgcuggggcacuug

SEQ ID NO: 7463 - RNA, 4221 nt, Mus musculus
aaacaaggcaacccacagucucugacagguaagggcaugugggcaggcaccccagcacuggcacaacucuucuuggggugucccgaguagggcgaugauucaaguccaccccuuuccaaaugcuucuuguucucaguacaagucucuccagaacagugcucgucucagccccgauguaagcaagaagggaggcggggcccaucacagacgcccacagacacgccccucuggccaagacaccgggagcacacucggcucugauugggcggcucgguagcagcggguggguccagagguagaggcggcaucagcgauuggccaguugggcaggguuauauuuuacgggcggauuaccguacaugagguacuuggacaaaguuuuacggggaagaaggaccuuguaauaaauaauauucugcacaucaaaucacuuucaccggcccccacccccgcaacacacaccagagaaaggcuacacacacaacagccccucccacccuguaauaauaccacucccaaacccagcuaauucuauuucuuuaagggucaagaagaccucgcuggcuccaaugggggaagccucuugaacuggguauaggaaaaagugguaauauuugugccaacaaaacaaaacaaaaccuaagagggccuugugguucaccccuuggauuucuaagaagcuacacuuccguaauuagaccacuggggggcagaagagcaacaaaaauuccucagcauggcugacucgguaagagacccaaagccccacuagguggcgacaagugccauuaagcuuuuaaaaaggagggaaagcucaaggaguuagcuucacagaagcuucagcagcaagaaagcugcacuuggguuuuuugguuuuucucucucucuccucucucucucccucgccucccucuccccccucucucucuaaaaaaaagggccauuaacagacuuccaaauuaggagccuggucuauaucacugcuucauguagggaaaggaaaucaaagaccuugucuguuaucacaaggggcaucccuugcuaaaccagcgaauucucccuugcccuauccugauccaaggauagccuuauccccuuuaggucaucccacuguguaagagggauggcugagauggucuauucucccuaggcccacgcucggcccacccuccccaacagguggcuuggcuaguuaccucuuucuuuuccucuucuucagcaccacccucugggcgcucaucauugcugacuuggucugcaacaggcagaggaggcucaggcaccucauuuucaggucuguuuucacugguguccauggucacuuccuccuucucuucacugacaggauggaagagauugaaggaaaggguaggagagagugaaggggaagagagagcaagauguuagcuuuguggacauaaaaucccaauggcuccuuacuugggcgggaucagacuagaacuuucccaugggaaagugggaaugcuuucuuuagggaaaaagcacaaauuacaguggucauggccacucaguaccagauggggccuuuaugugggguucccagcacucagaguucuuagacacucacuucacagcucucuugcacgaaaccaacagucuccucugaaaaguccuucaaaagugaccucaauuugucuagaaggcuauagccucucuacucacuaguuaaggcaucuuuaauuuaccaagaaccuaaaggaagcccacuuccuuuauaaaaaaacaaaaaagcuaaaaaacccaagacuuuggaaagggcauagguguagccaaugaccccgaccuuguguccaaucaacuguuaauuaguaagugcccggugauccacagggccuccagacaccaggaccaguaagagugaggauggggcugguaagggugcccacuucucucucacccuaggaaaaccugaggaauggcugucaccugcucagagcagagacuguucuuacauuugacucuuacccagucacucccauugcucauuccaacuuccaagagauaaagagagcaggccucccaagucaguaauacccuccuccacaccagacaacucccccaaaacauggaacccacucgcucacaaguuagcacucacuucagacaaagaaauccagagacuccaucaaauaaacuaucuuccuaccuuucugccaccaucccuaacuucuaacccugacacucccuaaaacuagauuaaaaauaaucaaaaucaggaugaucagggguacaagugacagaaaagggaaaccaagccucuccagaccaggaacuaguaccagaaaauacagcacucauucucaccaggcugugugacacacaagaggucagaaaagccuccccaguguaggcagggagagaugcaaagcugagggggagggggaaaccaggacugggcccccagcuaacaggaccccauagaacacgugauuuuuugcuuaaaucuugaagaaaggcuuaucaaaaacccaaaccaaaacaaacaaccuacugcucagagagggcaacuggggccaauuagaaaccgagcagaaaggacaaagggagaaagcggaaugccugaaaacagaucaaaaugaaagacagugcgaggcaugaggaagcuggggaggaugaggcggcggggcgggggggaggggggggcaggacacauggggaugcgagccucucacccugcucugcugucugagaacaucauuauuuuuuuucucccccuggaagugcuguuuaucccuuucuggaauggaagaaauaacaaaaaccaaacaaaaaaauccuaaaaaaauuaaaacaaaaaucccgaaucagacaaacccccuuccuuguccgcagcucccaccaccuccucccagccacccgauccagagagagaaaaucaagaugcagcaacuggggaauccaaaaaaaaaaugguaaauggaaggggagguggugguggagcggggaggcuaaaauagaucgggcguuuaagagauaagcguuuaaguccucacggcaaaccccgaguucggcuggacuggucucucuggaggaagaggaggaagagggccagguugcugguaguaagcagacucuauuguauugguaaagcggcagcgaucagccggagacaugcaggggagccaucuugccacuuacccagcagcccgugugugcggaugggggagggcccugaugcagcaggggaggggaaagagggagggcgcugagugagcaagguucuuauccucuggcaggccacagggagucaaguggcuucagaggccaggccuuucccuucuuuucucagguuacagcagcuaagaggucuacugguacaggccagggugcuugcucccagucuuccaaagggcaaagaaggggccagguggggagaacagacagcugccugaccgaggacccaaaguaaguaauggcaaauggcagaguugggaaugagaaacgauuaaagccaaagcaggaacauuuuuaaagaugaccaaagcuucuaucuacccucagaacaucaagacagcauuuucuuaugugcccaucacugucccacccaggauaacuaacucgcugcucaccucugccaaugaucacguggaaccucucucucuguuuucuagaaaaguuggagggaaguggauaagucugggagaguuucuuuuccaaaucagaggaaagguggaugucucugaagagagccagaguucccagucguuaacaagcccacucagccucagggugccugccuacaccaaugaggagaagacaaguggacaugcacagcuaaggccugaaggcauccaggucgacaggaugcugcaggugaaagguguuccuuggggucaggguaggugagguaagcccaacagugaggcugggagacaacaaagaccaggcaucucggccaucuuccacacaagcagaugugagugugaaacagaccuuaacaaaagauucaguccuacuacaacccuaguacacgagagacuagggcauguuguguuacaaaauacaacaacaacucaaaccaaccccuccaacaaccaccaccaccaccaguaauagcaacaaagaacugcugaagacucaacaagcuaaucugcggacugaaauggccucaguuccuuuuccuaacagcagaacgaacccucuucagacagaaauccggagacuccaucagauaaacuaucuuccuaccuuucugccacu

SEQ ID NO: 7464 - RNA, 4221 nt, Mus musculus
aguggcagaaagguaggaagauaguuuaucugauggagucuccggauuucugucugaagaggguucguucugcuguuaggaaaaggaacugaggccauuucaguccgcagauuagcuuguugagucuucagcaguucuuuguugcuauuacugguggugguggugguuguuggagggguugguuugaguuguuguuguauuuuguaacacaacaugcccuagucucucguguacuaggguuguaguaggacugaaucuuuuguuaaggucuguuucacacucacaucugcuuguguggaagauggccgagaugccuggucuuuguugucucccagccucacuguugggcuuaccucaccuacccugaccccaaggaacaccuuucaccugcagcauccugucgaccuggaugccuucaggccuuagcugugcauguccacuugucuucuccucauugguguaggcaggcacccugaggcugagugggcuuguuaacgacugggaacucuggcucucuucagagacauccaccuuuccucugauuuggaaaagaaacucucccagacuuauccacuucccuccaacuuuucuagaaaacagagagagagguuccacgugaucauuggcagaggugagcagcgaguuaguuauccugggugggacagugaugggcacauaagaaaaugcugucuugauguucugaggguagauagaagcuuuggucaucuuuaaaaauguuccugcuuuggcuuuaaucguuucucauucccaacucugccauuugccauuacuuacuuuggguccucggucaggcagcugucuguucuccccaccuggccccuucuuugcccuuuggaagacugggagcaagcacccuggccuguaccaguagaccucuuagcugcuguaaccugagaaaagaagggaaaggccuggccucugaagccacuugacucccuguggccugccagaggauaagaaccuugcucacucagcgcccucccucuuuccccuccccugcugcaucagggcccucccccauccgcacacacgggcugcuggguaaguggcaagauggcuccccugcaugucuccggcugaucgcugccgcuuuaccaauacaauagagucugcuuacuaccagcaaccuggcccucuuccuccucuuccuccagagagaccaguccagccgaacucgggguuugccgugaggacuuaaacgcuuaucucuuaaacgcccgaucuauuuuagccuccccgcuccaccaccaccuccccuuccauuuaccauuuuuuuuuuggauuccccaguugcugcaucuugauuuucucucucuggaucggguggcugggaggagguggugggagcugcggacaaggaaggggguuugucugauucgggauuuuuguuuuaauuuuuuuaggauuuuuuuguuugguuuuuguuauuucuuccauuccagaaagggauaaacagcacuuccagggggagaaaaaaaauaaugauguucucagacagcagagcagggugagaggcucgcauccccauguguccugccccccccucccccccgccccgccgccucauccuccccagcuuccucaugccucgcacugucuuucauuuugaucuguuuucaggcauuccgcuuucucccuuuguccuuucugcucgguuucuaauuggccccaguugcccucucugagcaguagguuguuuguuuugguuuggguuuuugauaagccuuucuucaagauuuaagcaaaaaaucacguguucuaugggguccuguuagcugggggcccaguccugguuucccccucccccucagcuuugcaucucucccugccuacacuggggaggcuuuucugaccucuugugugucacacagccuggugagaaugagugcuguauuuucugguacuaguuccuggucuggagaggcuugguuucccuuuucugucacuuguaccccugaucauccugauuuugauuauuuuuaaucuaguuuuagggagugucaggguuagaaguuagggaugguggcagaaagguaggaagauaguuuauuugauggagucucuggauuucuuugucugaagugagugcuaacuugugagcgaguggguuccauguuuugggggaguugucugguguggaggaggguauuacugacuugggaggccugcucucuuuaucucuuggaaguuggaaugagcaaugggagugacuggguaagagucaaauguaagaacagucucugcucugagcaggugacagccauuccucagguuuuccuagggugagagagaagugggcacccuuaccagccccauccucacucuuacugguccuggugucuggaggcccuguggaucaccgggcacuuacuaauuaacaguugauuggacacaaggucggggucauuggcuacaccuaugcccuuuccaaagucuuggguuuuuuagcuuuuuuguuuuuuuauaaaggaagugggcuuccuuuagguucuugguaaauuaaagaugccuuaacuagugaguagagaggcuauagccuucuagacaaauugaggucacuuuugaaggacuuuucagaggagacuguugguuucgugcaagagagcugugaagugagugucuaagaacucugagugcugggaaccccacauaaaggccccaucugguacugaguggccaugaccacuguaauuugugcuuuuucccuaaagaaagcauucccacuuucccaugggaaaguucuagucugaucccgcccaaguaaggagccauugggauuuuauguccacaaagcuaacaucuugcucucucuuccccuucacucucuccuacccuuuccuucaaucucuuccauccugucagugaagagaaggaggaagugaccauggacaccagugaaaacagaccugaaaaugaggugccugagccuccucugccuguugcagaccaagucagcaaugaugagcgcccagaggguggugcugaagaagaggaaaagaaagagguaacuagccaagccaccuguuggggagggugggccgagcgugggccuagggagaauagaccaucucagccaucccucuuacacagugggaugaccuaaaggggauaaggcuauccuuggaucaggauagggcaagggagaauucgcugguuuagcaagggaugccccuugugauaacagacaaggucuuugauuuccuuucccuacaugaagcagugauauagaccaggcuccuaauuuggaagucuguuaauggcccuuuuuuuuagagagagaggggggagagggaggcgagggagagagagaggagagagagagaaaaaccaaaaaacccaagugcagcuuucuugcugcugaagcuucugugaagcuaacuccuugagcuuucccuccuuuuuaaaagcuuaauggcacuugucgccaccuaguggggcuuugggucucuuaccgagucagccaugcugaggaauuuuuguugcucuucugccccccaguggucuaauuacggaaguguagcuucuuagaaauccaaggggugaaccacaaggcccucuuagguuuuguuuuguuuuguuggcacaaauauuaccacuuuuuccuauacccaguucaagaggcuucccccauuggagccagcgaggucuucuugacccuuaaagaaauagaauuagcuggguuugggagugguauuauuacagggugggaggggcuguuguguguguagccuuucucugguguguguugcgggggugggggccggugaaagugauuugaugugcagaauauuauuuauuacaagguccuucuuccccguaaaacuuuguccaaguaccucauguacgguaauccgcccguaaaauauaacccugcccaacuggccaaucgcugaugccgccucuaccucuggacccacccgcugcuaccgagccgcccaaucagagccgagugugcucccggugucuuggccagaggggcgugucugugggcgucugugaugggccccgccucccuucuugcuuacaucggggcugagacgagcacuguucuggagagacuuguacugagaacaagaagcauuuggaaagggguggacuugaaucaucgcccuacucgggacaccccaagaagaguugugccagugcuggggugccugcccacaugcccuuaccugucagagacuguggguugccuuguuu

SEQ ID NO: 7465 - RNA, 7016 nt, Mus musculus
cuuuuuuuuuuuuaagauuuauuuauugguuauauguaagccauagagugaguuccaggagagccagggcuacacagagaaacucugucuggaaaaaaagacaaaaaacaaaauaaaacaaacaaugagcaaaaacuucaaacaaacaaacaaacaaacaaacuuuaagacuccuguucuauauagcugaagacaggggugugaaugagccaugguacucuuacagagagcucaugaugaccuuugcccuaugaccuggcccaagcucauacucacccacucaauacuaccaggaggucccaggaagaaagcccagcaaagacaccuagcaguuacccuaaguuuggaaccauucuugaggaaacaucaaauaauuuaccugggcaaggguaacggauguggagggagggaaggaggugcacccaaugguaugguggguuggccagagccaggacagaagccccccuauauggagccugacauuucaguagguuccaaguucucuagcacgcaggugggaugcugcuugcugacccugcagagcuggaaugcuggcacaggagacagcaggggaaagucuggggccuuuggaggacaggaaggcacagcauaaugaggaacaauggucuuucccuaugguaaaugguagauauguagcaaaguuuuuaauuuuguuuuuaaagaaaaaaaaauacauaccaccacgguuacacacagacucgugggacuuccugggaucacaauccuacaguccugaacaaauuacugagcuuagacuuauuucuaaaacaggaauaacagugcucaagucccagugccgcuuuaaacaugcauguaaaacauuuagcacacaaaaguuaaaugggagcuguuacuauuguuaauaugacgcaacaauaaugcacacacauuaaggaugauguuguaacaccugacccucaaccccgucucccugggcuccuuguugaagacuagagagugcauuguuugggaguuuccaagagaguucuuccuuuuacuuugcugaaccugaaggugguccacagaugcauccaaccaucuucuucucaagggaagaugaugcguaaauaggcauuuaucugaggcaugaccagaggggccaaagaacgagccccaaacugaauucugaguguacguauagguaccuggcagagaagaggggaagugagaaaccauucaagaugcuggcaauggaaaggggugugggaagccaguuaguuaccugggagguccuuguucaacugugacauuaggaauucuuuccccuuuagagaggugccugaggaagguggaucaacaauggccuuagaggaaagaagcuaccgcucccauccaccucaagggaaagggagaccaacaugggugaagagaggaacuaaagauaagcguccuacauggucaaagaaacaagugguggggggggggagcaaggcaaggcaaacaagcagcaggccugacucccccucaggaagggcauggccugaggguggcuaucacagaagauucccuguuuuccauuucacuggcuugggguauggcucaaaaugccaccuucuggugccauuucguucuuguuuucuaucucucauacccauaauccuuuauccuccagaguuucaacacugucuccuucuagggaucccacgccaacacuuuuccuaacagcuggacucuuccccauuuuccucugggagcccagacuggaagucuguggaggaaagagcgaaauccaaagggcacagggugagcuauggcuuaggagcuacagauccacugggguucucugcuggcugcugccuggguccugggucaucugaacuaugcucaucugcagccacaggcucagggcacuggguaagucuuguuucuucuucuccuucuucuucuuucaauuuucugagagucaaauguagcccuagcccuggcuggccucaaacucaaaacagcauuccuguaugugccacgagacaccuggcuugcugaaagaugucuuucuaaucuauacugugccauaaacagaccauaaaaugccagaaaggucauagugggucagaccaauaacccccagcacagcagaggcuaaggcaggagggcuguacauuggaggccagccugggcuagagaacauguuggagaggagaggagaggaggggaggggaggggaggggaggggaggggaggggaggggaggggaggggagaagagagagguagccuuaagaaagaaacaaagaaaagaagaaaaguagccaaaaggaaggaaggaaggaagggagggagggagagagggagagagagagacagagagagagaggagggagggaagaaggaaggaagaucaguugguccuaagaaaagguagcugaaagaaaggcagccuuaagaaaaaaaaaaaaugagauggcuggugagauggcucaguggguaagagcacugacugcucuuccaaagguccuaaguucaaaucccagcaaccaccugaaaugagaucuaacacccucuucuggugugucugaagucagcuacaguguacuuauauauaauaauaaauaagucuuuuaaaaaagaaaaaaagggggggggugugugaagagauggcucagugguuaagagcacugacugcucuuccaaagguccugaguucaauucccagcaaccacaugguggcucacagccaucuguaaugggaucugacacccuggugugucaaaagacagugacaguguaaucacacauaacauaaauaaaucuagaaaagaaaauaagggaaaaguagccuuaagagagagaggaggaggagagaagaggagguggaagaggaggagagggccuuagggaaccacuuaacuccacuuucuucucacagaggaaaacggagcccaaagacacaaagaaauaugcucaaccauacagauacucagugguuuccucuuuuuaagaggcacgaagaaaaaaucaguagggauuuucaugauucaccgucccuugacauaaagugcuuagagguuuuaagaagacgcccggaaaaguaaggcuggcauucauuuuucuggaagccuaugugaaccccuuagaugucucacuauuuggcuacaagggcagggugggaguuacuuuugccaccguccuuauuccuagugcuugccugguggcugaaggaacucaaaaagaacaaacugucauagcccccggcaaccccuguccuugaagacugaagccacgaacugcugagagacgaggacauccugucauacugccagaaggcaauggucaaauuccuggaguuaagcaaggcaauuucggcucagaugaagcuaggaugggcaggacagagggacguggggugguaaggccaguaagaagcaauccgaaugacuucacugggcuggacuuuauacaucaaggcuccucaguccauaaagguucccagcccaaggaggcuucuugaccuuccagggccuucuaucucgcauucuucgaguuccuuccacuuacgcacaccugcuguuuuccacccaaaucucucugaguuucgcaggcgguuuccagccaccuccgcuugacucugagaccgcucuccacccaucugccaauugugacucccugguuccuggcgccacagccucucccccuacgccuggaugccuccguuuuuuuucccugcuguggccuguaggagccuugucucaaauaaaauggauccagcccuggggcuccgcggcuccggcaccggcaggaugcucgggcccaaggagcgcguagucucggccgccguuguuaucccagaacucucggccgguaacccgguagcgaagggcgaagagcagcguuccgccgaccggaggugcgggcaggcggaaggcgaagcggucagcccgcggcggggacggagcuggacccgcguaggaggcgggcgauucccgcaggcugcgccagccguccgcgcuccagcgcacgcucacgcgcuucucguaggccagguccagcacgcgcgcgcucccggccacgcccagagggcccgcgucugcgcgcuccaggcagaugcgcugcgccugcagccgggcggcgaagccgggcuccagggcuggcuccagggcgacgcgcgccuccugaggagagagggcggggaggcaggucagggcggggacucccgagagggaaggcugaggcccggggccggggcacgacgggacgccuaccuggaggccgcgggcucgcggcgggcacggcgcgaaguggcgcagggcgucccucugcaguugcaccugcacguggcggggcacccggggcgguuccccagggcggaagcgccggaccacggccagcuccagccccagcgcgucggcgaaacgcacucucuugcgagugucagggcugcggcugcgggcuguccgcgccccgccaccacccgcgggcgcagagcgggcccugcgcccccgacccggaacgugagcccgcgagcgggcgccuggccgggucccgcccuccccgggcuccuccuccgacuccuccucgaggcugggccgcuggcugcgguaguacgcccgcucggucaaugccgcuauaaagcucagguugcgggguauauccgugcgcgguggccgcucgugggacaugucaccccugagccccagcggggcuagcgcacagugcccggcgcguccucgcucugcugccggcucuaugcccgagcauaagguguagguagggcugcucagcagcagcuggcugcggacucuccuugcugucagcccgcguacccugccugcucgguuuccuugaccaucuuucccuuccuuuggcggccagccccggugucagacuauccguccugcucgcuuccagcucucugcucugagcgugcgcucagcggcgccgcucacccuucaguucugcgggccucgcugacccggcccccgcccacagcccucugacagguggcugguauccaucuucacugcugcaccagggggcgugacugcuuccaucuggggucccagaugaguuacuccuauauaagaaggguuaaagcaggaagaaaagaguaaccuuuccuuuuucuuuuuuuucuuuuggcacgggaaaauuaaaaaugcugaggguuuaauucuccuuagggcucaguguuuucuuaaagccaggcuacagguuugaagcccgauggcacuggguguagugacugaaagggcgugaauccuagauaagagucuuuaguggaagacucaaaaggaugcgcgguggcauuggcucacuggcuacugagaaaaguaaugagaacacuuagcuuccaguccuaugucccccgcugauuagcugugugaccuugagaaaggaauaacuucucuggaccuugauuuuucucaaucauuaaaacaaacaaaaauaauucugaucucuuaucuguaagucuuuucaagcgugaagacuguuucugauucaugaccguuuuuauacaugguaggucuuccaguuauugagaguugcccuucuuccaagaaggacacaggacaggcuauuuuccauuuuauuuuugaaaaauacacuagugacaaugguaugucaaauauuuuauaacuucucuucugauuuuuuuuucacaaagauuuguuucauuuucaguuaucugcaugguguuaggggguuauguaugcaggaaugcagguacccacagaggccaaaaggggacaucagauagccugggacuggcauuacagguaggugugagcugguauaagugagugcugaaauuacacuagggccucuagaagaguguuaugugcucuuaacugccgagccaugcuccugcuuucuaugggguuuuauaauacagaacacuaggcauuauuauaguguuuacaauuguuacaaauauuacagaaacaacaacaacaacaaggccgggcuugguggcacacaccuuuaaucccagcacucaggaggcaggcagauuucugaguuugaggccagccuggucuacaaagugaguuccaggacagccagggcuacacagagaaacccugucucaccccccccuaaacuaaaacaacaacaacaauaacucaaaaaaacaaaaacaaacaaauaaacacccaaauauuacagaggagaaaauugagagggaaaagaucuugcccagggagugucagauaguuaccaauuguggagcuaggauuaggaccucagcagccaaauucuagaguucacucuucuauucauuuaguuuuauacagcauuaaaauauaaucgauaauaauggcgacacugguauuuuuguuaaaugauaauguuagcaucuaauauagaaguggacaguauggggcuggaaggcuggcucagugguaagagaaugcacugcuucagggaaucuggugccauuuucuagccuccagggacacuugcacucacaugaacauagcucccgcuuggacacacacacacagcacguaauuaaaaaaaauuaagugaccugagcauggagguucacuccuuuaaucccaggacuugggaagcaggaacaagcagggucucugcuugagaccagccugguuuacagagugaauuccaggauagcuggggcuacacugagaaauccaaaauagauagauagauagauagauagauagauagauagauagauagauagauagaauaguauggagccaggcauugugguacaaguguauaccuuuuuuuuaaagauuuauuuauuuacuauauguaaguacgcuguaacugucuucagauacaccagaagagggagucagaucucauuaugaaugguuguaagccaccaugugguugcugggaauugaacucaggaccuucagaagagcagucagugcucuuaaccucugagccaucucuccagcccccaaguguauaccuuugaucccagcacucaagaggcagaggcaaguagaucucugugaguucaaggccagcccuggucuacaugaguucaaggacagcuauguagagagaccuugucucuaaaua

SEQ ID NO: 7466 - RNA, 6071 nt, Mus musculus
cucccucccugcccuccccuccucccuccuuccuuccuucccuuccucccuuucucccucccucccucccucccucccagcuccuccaccaggaaacaaccggauuccggaucccggcugcggccugacccgugagauuccuuaaccuggcuggcgggcgggguuggagaccagcuaagggugggggaaugggaggagcugggccuuugggcugcucuuggggguaccgggaauagagauggugucggcaggaagcccguggucccggguuucccaagagggcagucauuaaacacggaaucggucccacagcuggcaaagcuuuggagguaggggcccagucccaggcgcugcaguuccaguucuuuccgggccagacccaggccuuucccaccuaguucucucucccuccccuuuucagggcuccacucuagccgggaggaugaaaggccucagcugggggcucccugccaccagcacuggguccuaagagcugccauccaggcuggguaaguguccucuuccuuucugccccauuacagcccuuggcuuuucccaucuuccuauucagccccugucuccucccuaucuugugccucugccaacaucuucgcaucaugcuccuggggaggucuuaagccccuuccuauagccaaaaagggguguguguguguguguguguguguguguguguguguguguguguguguguguguauagagguggcauacagcuggugcugucguaugaaaggaaucugaaguagucuaaaaauaagauuuccuguugcacacuuaauuugacauguuauacguggccagcugcuuaugcucugaaccuccccaugacuuaaauccguugcucuuucuuggcccugcccagugccucugagcauuucaccuaucucaggagcuugaucaaauaggaaaugucccuucuugcucucugucaauaauuuccuuauauuuaugucagucugucauccuugccccuuucagccgcccggauggcgaccccagccucaaccccagacacacgggcucuaguggcugacuuuguaggcuauaagcugaggcagaaggguuaugucuguggagcuggcccuggggaaggcccagccgccgacccgcugcaccaagccaugcgggcugcuggagacgaguuugagacccguuuccgccgcaccuucucugaccuggccgcucagcuacacgugaccccaggcucagcccagcaacgcuucacccagguuuccgacgaacuuuuccaagggggcccuaacuggggccgucuuguggcauucuuugucuuuggggcugcccugugugcugagagugucaacaaagaaauggagccuuuggugggacaagugcaggauuggaugguggccuaccuggagacacgucuggcugacuggauccacagcagugggggcuggguaagaaguucucaauugcugcucuccgcaucccucuacaaaguuggucuucaugggaaaauagggccucugaugggaggcugggguugugcugggaagggcugaguucccuuauuuaaguggaaucagacugagagcaucaagcucacaguacuccagggcuaccauguaguaguagcuggaugggcuucacggucccaagcagaagacugaauauagaguuuuauaaacagagaaccuucagcgaauaauugugaccccugcguacauaguauggguggugaggccggucagggaugggucauggcuaggcaagccuuagcaaaggaugccaguucugaacggaacuuuauugccauggaagggauggggcugacaucacguagacagugcagaggagccaggaacgggguucggaggggcuugugugcaguagagcuucggcuggagcagcuggggaugggggcagugcucacaguggauggaacuggaacucuuccuucccucgucucuccacuauccuuuccugaucucccuuucuccuuucucuacuucccuucucucccacaggcggaguucacagcucuauacggggacggggcccuggaggaggcacggcgucugcgggaggggaacugggcaucagugaggacagugcugacgggggccguggcacugggggcccugguaacuguaggggccuuuuuugcuagcaagugagaaagucuagggccagguggggcuagguguggcuaggggccaggagagcuggaacaauagcgaaugcccuuggaagaaacuggauggucacggaacagagaaaggcaggggaagguagugugugugggagcccagcaugccaggcagguggcagggagaaugaguuggaaacauuaaggaauguuucaaggccaagaacccagagaguggagucaucccacggcuugggggguggggguggggaggugggaggaaucaugcccauaucgcgggcacacaacuacccggaacauggcuuguagcuccaaggacggugagcuuacuucaaagaucugugucucgacuagaugaaugggauuuagggagccuagaauucacuucccuuugggauggaagcuuggugaucaggugacugggugaaauggcuguggcugugggcugcaugggcacaccugugcauguaugugcacaugcaagcaugcucaugugcaugcugggcugucugucgaaucugguggugggguacuuagagaaaacauuccuucuugcuauggcaagaacaagggccaguucacugcccuucuccucucugccccuucccuugaccuuacgccuccaggcugagggaggaacacuguaucuagacuagggcucuggugcugccgagaguuguuggcagggcuuuggagagaagaguucugcagcuggccuuguucuucaucaucccccuguugugugcaucugugcaccugggcugaaaaaggguaaggcuguggagccuggguggguagaagcuuugguaguuggacuugccugucaccuuccccuccaacgguggcacaauggugccuaaaguguugccuguuucuagggucucucuauccagcugagucuaaauuggggaucuaguuuuccuuuagaagauacgggcauaaaugcugaucuacaauucaguuuaguuccugaacugucucagugagacugcggauaccuugagaggaccauuccagcucugagucccuugggagugauggggacagguacuccuugacuggccuguucugggugguggguuuuuggugcugcugcucuaucaggggccagggauauggguucuagaguaccugccaugaccuaacgcguuuucuuuugaagccaugcucuuugcauagguugucaacacucgagucucugaagauggucacauuagaacucacaguccaguccccuagaacaaauccagacucuagccuuuucuuuugagggaggaaaugauucacuccaaaugcaugcccugagccagaccucacugcugcacuucccaaggugcuaacauugcugcucuuuaaugcugacuucguucccagugcucuagaacccuaccugccucuccugagcacugaccagcuuggcuagaccacagcugacccaccucuucacuugguccuagaauguggcaucauaucgugcuugcuagaaugugggaccaaauuggccucagguguuuuaguccagacuuuggcuuuugagagaagguugcacuuuuucauagugucuaugggggaugugggaggcugcaugugccaguuggucuguuuugagggugaugaucuaagagacucggagcugucugugacaagcagucagagugggaggcucugacuugcucaggacaaacuaggccagugguuuucaaacugcuuggcagagccccgaaguguccuagggguugccucaggaguccuuagggagaugagggaguggagggcugggcaguuugcccucaaacagaacagcucccccuuguagcugucuuauguaucgggguucaggguaagauuuuauuugugguaagggcuuugcugcugaaaaaaguuagaaaaccacugacuagaccaucagcuccaucuggagccugugcuccuccacguccagggaagucucugcucuacccuucccaugggacaccuaccuaagguagcauuccuggggcccuuuagcaaacaggagcagcaggaaccagggucagguuaccaacaugcucugcuagcagaccuucagccaggugggaggagaggcugugcuaggacaggcuaaaggguuggucuuggucuggauucucagaagcuuagaugggaccacaguggagaguugugaccuguucugcccuucguuuuaagggccaguggaaacccagagacucuucugucagggaaaaccagggacugucuuuuagagccauauaguuccuugggauuagcucuuggccaagaaggcugaguauggcucccaacuuuuaaauccauuucauuuuuuuuaaaugagggaaauggauauaauuuuucagauacuaaguagcuggagaggauguucuugcucuccaaagcccaaagggacaaauagggacuuugcuuaggccaaggcaagagcgcaagugggcacucaguccugcaguuaccaguccuacuccccacuuacacuagggcauacauauacuauuuuacuuuuuuaaaucauaaacggcaggagaacagauuugguuaguuuagaagaaaagaaaaagcucuauaaauauaaauauauauuccuguauuuuuauuuaauaauuuauaaaugccaaguucauuugacuuuuauuuuuguguaauauguaauggucguauuaaaaauaaauaaauaaagcccagaaauuuaaugagaaguacugaacaggguuuugugacuucuauacuguacauccuggguuguagaacucucccuaagccagucauuucuuguggccaugaccuugcuaaggggaauaacuggaguuauagggauuugggaaauaaaguauugagguuaaaaaaaaaaaaagaaaaaagaaaaaaggaaaagaaaaccacgcccaccccaucccuggccaaauacccaaaccuacaaauucuauaccaaccccagccuccagaaacuguaggcacaugugguacaucuagagccccuacccacaaccaccaccuccucaaauauccugguuuggugugguggcaaacaacugcaaucccaguagucagguagagacaggaaggugggccacccaggucuacagggaggucaaggccagcuaaggcuuccugagaccuugccucuaaacagauggauagaaagcaaaagaguaaucaaugcaugcagguuguucuuaaguaauauucucaaauacaaaagcuaggcugugaacucagcugugaguuucuuggcugccaaagcaaccuggaaaacagugagguucaaagcuguccaguuacucagauggcagaguuuucugcaaagauacuuagugacagaauugcaggcaaauagaauaguuuauaucucuguccuauuagcaauaccagguggggauccagaaggccuuagguuugucuaucagccucauuauaauuuaggcuaauguguuauuuuauaauggucugauuacuaaguuuuagacuguccagagggacagaugacuguuuucuuuauauaguucuguguaaaugcaacucauccagauggcacuuuuaauaaaguugggcaacacuuaguuauaauuucugaccauuguggggguagagagguuggguugggguaguccuugcucaugcuauaagucucuugcacuucaggagcaaggacuuuaaguguagaucuggcugggacuacauagagucagcuccaagccaccgggcugcaagguaagacucauugucaggagaaagaacaaaacccaaacccuacaguuucuuucaauuggguagaucauugauauucuuuaucaaguuuuuguucgcguuuucucucauuuuuuuguagcuuguagcccagucuggccucagacucaguguugagauuccaggugugugccaccaggucuggcugaauucuuugaaaauua

SEQ ID NO: 7467 - RNA, 6071 nt, Mus musculus
uaauuuucaaagaauucagccagaccugguggcacacaccuggaaucucaacacugagucugaggccagacugggcuacaagcuacaaaaaaaugagagaaaacgcgaacaaaaacuugauaaagaauaucaaugaucuacccaauugaaagaaacuguaggguuuggguuuuguucuuucuccugacaaugagucuuaccuugcagcccgguggcuuggagcugacucuauguagucccagccagaucuacacuuaaaguccuugcuccugaagugcaagagacuuauagcaugagcaaggacuaccccaacccaaccucucuacccccacaauggucagaaauuauaacuaaguguugcccaacuuuauuaaaagugccaucuggaugaguugcauuuacacagaacuauauaaagaaaacagucaucugucccucuggacagucuaaaacuuaguaaucagaccauuauaaaauaacacauuagccuaaauuauaaugaggcugauagacaaaccuaaggccuucuggauccccaccugguauugcuaauaggacagagauauaaacuauucuauuugccugcaauucugucacuaaguaucuuugcagaaaacucugccaucugaguaacuggacagcuuugaaccucacuguuuuccagguugcuuuggcagccaagaaacucacagcugaguucacagccuagcuuuuguauuugagaauauuacuuaagaacaaccugcaugcauugauuacucuuuugcuuucuauccaucuguuuagaggcaaggucucaggaagccuuagcuggccuugaccucccuguagaccuggguggcccaccuuccugucucuaccugacuacugggauugcaguuguuugccaccacaccaaaccaggauauuugaggagguggugguuguggguaggggcucuagauguaccacaugugccuacaguuucuggaggcugggguugguauagaauuuguagguuuggguauuuggccagggauggggugggcgugguuuucuuuuccuuuuuucuuuuuucuuuuuuuuuuuuuaaccucaauacuuuauuucccaaaucccuauaacuccaguuauuccccuuagcaaggucauggccacaagaaaugacuggcuuagggagaguucuacaacccaggauguacaguauagaagucacaaaacccuguucaguacuucucauuaaauuucugggcuuuauuuauuuauuuuuaauacgaccauuacauauuacacaaaaauaaaagucaaaugaacuuggcauuuauaaauuauuaaauaaaaauacaggaauauauauuuauauuuauagagcuuuuucuuuucuucuaaacuaaccaaaucuguucuccugccguuuaugauuuaaaaaaguaaaauaguauauguaugcccuaguguaaguggggaguaggacugguaacugcaggacugagugcccacuugcgcucuugccuuggccuaagcaaagucccuauuugucccuuugggcuuuggagagcaagaacauccucuccagcuacuuaguaucugaaaaauuauauccauuucccucauuuaaaaaaaaugaaauggauuuaaaaguugggagccauacucagccuucuuggccaagagcuaaucccaaggaacuauauggcucuaaaagacagucccugguuuucccugacagaagagucucuggguuuccacuggcccuuaaaacgaagggcagaacaggucacaacucuccacuguggucccaucuaagcuucugagaauccagaccaagaccaacccuuuagccuguccuagcacagccucuccucccaccuggcugaaggucugcuagcagagcauguugguaaccugacccugguuccugcugcuccuguuugcuaaagggccccaggaaugcuaccuuagguaggugucccaugggaaggguagagcagagacuucccuggacguggaggagcacaggcuccagauggagcugauggucuagucagugguuuucuaacuuuuuucagcagcaaagcccuuaccacaaauaaaaucuuacccugaaccccgauacauaagacagcuacaagggggagcuguucuguuugagggcaaacugcccagcccuccacucccucaucucccuaaggacuccugaggcaaccccuaggacacuucggggcucugccaagcaguuugaaaaccacuggccuaguuuguccugagcaagucagagccucccacucugacugcuugucacagacagcuccgagucucuuagaucaucacccucaaaacagaccaacuggcacaugcagccucccacaucccccauagacacuaugaaaaagugcaaccuucucucaaaagccaaagucuggacuaaaacaccugaggccaauuuggucccacauucuagcaagcacgauaugaugccacauucuaggaccaagugaagaggugggucagcuguggucuagccaagcuggucagugcucaggagaggcagguaggguucuagagcacugggaacgaagucagcauuaaagagcagcaauguuagcaccuugggaagugcagcagugaggucuggcucagggcaugcauuuggagugaaucauuuccucccucaaaagaaaaggcuagagucuggauuuguucuaggggacuggacugugaguucuaaugugaccaucuucagagacucgaguguugacaaccuaugcaaagagcauggcuucaaaagaaaacgcguuaggucauggcagguacucuagaacccauaucccuggccccugauagagcagcagcaccaaaaacccaccacccagaacaggccagucaaggaguaccuguccccaucacucccaagggacucagagcuggaaugguccucucaagguauccgcagucucacugagacaguucaggaacuaaacugaauuguagaucagcauuuaugcccguaucuucuaaaggaaaacuagauccccaauuuagacucagcuggauagagagacccuagaaacaggcaacacuuuaggcaccauugugccaccguuggaggggaaggugacaggcaaguccaacuaccaaagcuucuacccacccaggcuccacagccuuacccuuuuucagcccaggugcacagaugcacacaacagggggaugaugaagaacaaggccagcugcagaacucuucucuccaaagcccugccaacaacucucggcagcaccagagcccuagucuagauacaguguuccucccucagccuggaggcguaaggucaagggaaggggcagagaggagaagggcagugaacuggcccuuguucuugccauagcaagaaggaauguuuucucuaaguaccccaccaccagauucgacagacagcccagcaugcacaugagcaugcuugcaugugcacauacaugcacaggugugcccaugcagcccacagccacagccauuucacccagucaccugaucaccaagcuuccaucccaaagggaagugaauucuaggcucccuaaaucccauucaucuagucgagacacagaucuuugaaguaagcucaccguccuuggagcuacaagccauguuccggguaguugugugcccgcgauaugggcaugauuccucccaccuccccacccccaccccccaagccgugggaugacuccacucucuggguucuuggccuugaaacauuccuuaauguuuccaacucauucucccugccaccugccuggcaugcugggcucccacacacacuaccuuccccugccuuucucuguuccgugaccauccaguuucuuccaagggcauucgcuauuguuccagcucuccuggccccuagccacaccuagccccaccuggcccuagacuuucucacuugcuagcaaaaaaggccccuacaguuaccagggcccccagugccacggcccccgucagcacuguccucacugaugcccaguuccccucccgcagacgccgugccuccuccagggccccguccccguauagagcugugaacuccgccugugggagagaagggaaguagagaaaggagaaagggagaucaggaaaggauaguggagagacgagggaaggaagaguuccaguuccauccacugugagcacugcccccauccccagcugcuccagccgaagcucuacugcacacaagccccuccgaaccccguuccuggcuccucugcacugucuacgugaugucagccccaucccuuccauggcaauaaaguuccguucagaacuggcauccuuugcuaaggcuugccuagccaugacccaucccugaccggccucaccacccauacuauguacgcaggggucacaauuauucgcugaagguucucuguuuauaaaacucuauauucagucuucugcuugggaccgugaagcccauccagcuacuacuacaugguagcccuggaguacugugagcuugaugcucucagucugauuccacuuaaauaagggaacucagcccuucccagcacaaccccagccucccaucagaggcccuauuuucccaugaagaccaacuuuguagagggaugcggagagcagcaauugagaacuucuuacccagcccccacugcuguggauccagucagccagacgugucuccagguaggccaccauccaauccugcacuugucccaccaaaggcuccauuucuuuguugacacucucagcacacagggcagccccaaagacaaagaaugccacaagacggccccaguuagggcccccuuggaaaaguucgucggaaaccugggugaagcguugcugggcugagccuggggucacguguagcugagcggccaggucagagaaggugcggcggaaacgggucucaaacucgucuccagcagcccgcauggcuuggugcagcgggucggcggcugggccuuccccagggccagcuccacagacauaacccuucugccucagcuuauagccuacaaagucagccacuagagcccgugugucugggguugaggcuggggucgccauccgggcggcugaaaggggcaaggaugacagacugacauaaauauaaggaaauuauugacagagagcaagaagggacauuuccuauuugaucaagcuccugagauaggugaaaugcucagaggcacugggcagggccaagaaagagcaacggauuuaagucauggggagguucagagcauaagcagcuggccacguauaacaugucaaauuaagugugcaacaggaaaucuuauuuuuagacuacuucagauuccuuucauacgacagcaccagcuguaugccaccucuauacacacacacacacacacacacacacacacacacacacacacacacacacacaccccuuuuuggcuauaggaaggggcuuaagaccuccccaggagcaugaugcgaagauguuggcagaggcacaagauagggaggagacaggggcugaauaggaagaugggaaaagccaagggcuguaauggggcagaaaggaagaggacacuuacccagccuggauggcagcucuuaggacccagugcugguggcagggagcccccagcugaggccuuucauccucccggcuagaguggagcccugaaaaggggagggagagagaacuaggugggaaaggccugggucuggcccggaaagaacuggaacugcagcgccugggacugggccccuaccuccaaagcuuugccagcugugggaccgauuccguguuuaaugacugcccucuugggaaacccgggaccacgggcuuccugccgacaccaucucuauucccgguacccccaagagcagcccaaaggcccagcuccucccauucccccacccuuagcuggucuccaaccccgcccgccagccagguuaaggaaucucacgggucaggccgcagccgggauccggaauccgguuguuuccugguggaggagcugggagggagggagggagggagggagaaagggaggaagggaaggaaggaaggagggaggaggggagggcagggagggag

SEQ ID NO: 7468 - RNA, 1310 nt, Mus musculus
uauuuggauuucuuuuauuuccaguaucccacuauuaucagugauuguuaagcagaacauacauuuuuauguagguccaaguuugauuacagauagcaguaucacuaggucacaguuuagggcuaugagggcuggcuaggacugguuaaaaagauaaagcaucucucagauuagacauucugaaaggguguaccaguagaaauaaggcacuucuaggcacauuugauuggcagacaaaauuuucgaaugaaguaaaaagacaaucagguugggaagucuguauuugaaguaauaaaaaaacgaaaaaacagucagcucuuaagaacgaaauacuuuuaagaguagacuugagcagaucaaggaguggaagaagucugaaauguggaaaaacagccacugugaaaauaaccucaaguaaucaguuaaaaaauaucuacagaacuuguaagaacuagaagaguaauaaggaaggaaaaauacuaaaauuauuacagacuuuccaggccaaauaacccaaauaccuaggaauccugaaaguuccguguauguuugaaauaccuguccacauaauuaauggagaccagccaaagaacaaaaugcugggcgcuuguuuacaguuaagaauuuuaaggcagugacaaccugcguggaucgggagaaaauguuggggucuccggccuagagaccaggaaaccugacacagaaccugucacaugcucgccccgggagcugagguguccucgcgauggcccaccucugggccaaggccgacaucgcccgccucucuggccuaggaaaccaucccagacaagguaggguuggccuuggacucacccuaguuacucauaaaccaacgggagguggcgagcgacagaagccuagggacggucggcaaagcccagacccaaggggcgcgugcgcacuaaggcaaccggaaaggcuccggggacggccgcggcacuuagggagcguaugcaaagaccaagaaaggaagccaggggucgucagacaagacccccgcugguaagcguguacacagcaggguggagaggcccaggucccaccagugaggacugcuuucgacaggccgcuagcgcuacagccaggggaaaacgguugaacugggguugcugggagcugagggaauaggagcgauugggcacgcaguaaaaaacaaacaaacaaacaaaccacucgaggccaagcgaccuuaagggaccaccucgcagacuugaugucuaguuccgcuacgucuaaugcaggucgcagccaauuccaguccgcuacgacuaaacgccccucuuggguug

SEQ ID NO: 7469 - RNA, 3677 nt, Mus musculus
uagcuccucccuuggacagccccugaugaugaagccaacaccgcccuuccuaguggcaacuagcugggaauggcugaggggguacuacucacgguugguggccggccaggaggaggagaaaaaagggagggggcguggcugaggggggugggucugggccuggagagugaaagcgaaagcuggggcugcuagcccaggcucgagagcugccaaguggggggaagcauggccaagccuugugggguccgcuugaguggagaagcccgaaaacagguaaaugggaaccgaagccaggaaggagugagaaguccuaacggagauaaagcucggugcuccugggcaccaauggggccuugcgagcgaacuccaccggccucucuuucuuuagggcuuucuuucacuucugcucagggauugccagugccguguccucgagccaaucugugcacugagcaggcuccuccagggggaaacuagcuuugugggacagguuugggcuagaguuggaaggcaccuagguugggagugggcccuuauucuauacaaacuaaacccuaaccagcauccggcuacuucugucugugcagguggaugucuucagacaaaaucuuuuccaggagguaagucucugaauucagucgauguaacccagagucuuagugcagaacucuagggccacaagcucugaguaacccaccaguucaccuuaauuuuggugucuccgaaccuucaugcuuacucaaggugaacugcaaugauuuguuucuacuuguaaucugaucaaucuuagaacucuuaacugcuuuugccacuccccuugaauggaaagguaaagaugucgcccaaagggaaaaccccauagcccuacuucugcccuucaugagauugggcaagucccuuuauuuccagggcuaggguuuccucauacgagagucuugagcucagugauuuccaugggccaacuucugauacguaucaacaaaccucuugcaugauuauuuuuguaauguaacuugcaggcugaugacuuccucugcacuuucuugccacggaaaaucauaucccugagucagcucuugcaggugaguaguauagaccccucugcuccaucuccugacaccucucaucacccaucugacgggcaucagcaugcugggagcugagugagccuggccgggugugguggcacacacguuuaaucccagcacucgggaggcagaggcaggcggauuucugaguucgaggccagccuggucuacaaagugaguuccaggacagccagggcuauacagagaaacccugucucaaaaaaaaaaaaaggcuugagccuggguugggaggaagagagauggaaggcugugucuggugaagggaggaggcuggguagugucugagaauaaauucuacaggaggauucccucaauguggccgaccucuccucccuccgggcuccucuggacaucccuaucccagauccuccacccaaggaugacgagguaaggcauucagugugcagagccugaacucuaagccaguggcaacaccaccacaguguggcagccuccaagacuguucuaaagcugcuuuccuuauuuugccuuagauggaaacagacaagcaggagaagaaggaagguaauggagaccuggugaggaggggggaggcuggugcagggaugugggugacauaaaggccccacucucaucuuucucuuagucccuaaguguggcuaccucccggggaacgagaagcuucuggccuugcucgcuuugguuaagccagaagucuggacucucaaagagaagugcauucuggugagccugggcccugggggaggugggaagaaaagcacagcacagcugugguccagucagagaugcaggucuucaacccagagaccuaauauauaauaagacuggcuuuugugucuuggauauauauggauggauauguguguguguguguauauaucuagauaucuagauauauacuuuuuaauuguguguuugugugcacccaggcaugugcagguagguuuuccauuucguguauguacuggaauucacuuuguagaccaggcuggccucgaacucagaaaucugccugccucugccucccgagugcugggauuaaagccgugcuccaccacgcccggcacuuuuuuuuaaagguuuauuuauuuauuauauguaaguacacuguagcuaucuucagacaagagggcaucagaucccauuacagaugguugugagccaccaugugguugcugggauuugaacucaagaccuucggaagagcagucagugcuuuuaacugcugagccaucucuccagccccgaagacucacuuuugauucccagcacccacauagacgcucacagcuuucugugaccucaguccccagggaauccaacacccuuuucuggcccaugugggcaccaggcaugcacaugggacauaggcaugcauauagcuaaauacccauaaaggggaauuauaaaaaacauacacguauaaaaaaauaauaacaagaaauuuuaagaaaagaaguaguauauuaggccucagugauuuuguugagugaguccuccuuuuaacauagguaaucacauggauccagcaccugauccccaagauugaggauggaaaugauuuugggguggcaauucagguaagaauuggugacugaagacagagugggaggagacucaagagggagggauggaaacaaggccaucacccggaggucagaggaagaagaaacaggaaagggggggggaugaacuguugucuuugcuucucacgucucugcaggagaaggugcuggagagagugaaugcugucaagaccaaaguagaagcuuuccagacaaccauuuccaagugagagcagcugcaggaacccagggacccuacagggauucuugaagcuaggcgguucuuucagagugaugggagacgggcgggguggguggguggauguggcuguuuccauucacacacauuccuuccuucucacagguacuucucagaacgaggggacgcuguagccaaggcuuccaaggacacccauguagugagugcacaguccuccaguccuuuaguugaggcuggccccggggguggaauugaggugggaagaaagaggaccugguccugcuuuuugacuuauaccauguggaagauacuauuccaaaaagcagagcugauuagggcucuaauaucuucgacccuuacuuacuuccuuacuuaauacuguguguguuggugcuaagaugggguaaucuuccagcuaaucucuucuauguaugagaaaacaaaguuaagagucccgaccucccauggugcugacucaguuugccuccuccuucccagauggauuaccgggccuuggugcaugagcgagaugaagcagccuauggggcgcuuagggccauggugcuggaccugagggccuucuaugugaguguggagugagcuccugagggacguggaugcagggggcgugggaagccaagaaccuaacuguauuccuuuggccuuccucuaggcugagcuuuaucauaucaucagcagcaaccuagagaaaaucgucaacccgaagggugaagaaaagccaucgauguacugagcuaaggauuagaaggaaaauaaaugauuuauacuuuauguauauua

SEQ ID NO: 7470 - RNA, 604 nt, Mus musculus
aauuuagcugggugagguauuacauaguuggcacaugugagacaagaggcaagaagacugugaguucaaauucaaggccagucuuggugacacugucuccaaaaaaaauaaauaaaaagcuuccuaagagcggcuggagagauggcucggugauuaagagcacugacugcccuucugaagauccugaguucaaaucccagcaaccacaugguugcucacaccugucuucagacacccucuucuggugugucugaagacagcuacaguauacuuacauauaauaauaaauaacucuuugggccagagaucagccuccauccgcucacauguugacuacuugguccucaguggaaccacuugggaugacuagaggugugggguuguugguugaguugugucacuggccaugggcuuuaagguuuccaaagacccuugccauuccuagcuagcacacucucucugugucucaugcuuauaagucagauguaaacucucaaccucagcuccaugcuugccugccuccugcuuuguucucuguugugauggucauggacccuaaaccuuuagaaaugugagcuccaaauuaaauuuugccuuuucuaag

SEQ ID NO: 7471 - RNA, 10682 nt, Mus musculus
cguuggaaguuuuggucuaguuauagaaacccgaggccuguugucaaugcaguuguuuugaaaacccgaguucgcuauugccacacaaacucuggacucugggaacugucggcacagggaacccacggugccgaggcucugucagcgggugcucaggcagacggaagcccagacugacgccagccaccagcuuuccgcaguuuuugaagggaagcaagcugaaucacccaggcgacaggagagacgcagaguaacgcccuuuccgccggaaguugcugucggagucuccacgugccgauccucccccuccccacccggcccuguagcagcggcggcgucggcggcggcucggcagcugccauggagccugcggguuuggaacagauccugaaggagcugcugcugcccgacacggagcgcauccgccggguaugggcaggccugaccgggcuacggggauggggaggcugugggaaaggcccggucuugaccucccagccuuccaucaggcuacggagcagcuccagaccauccuucgggacccugcugccuugcccgcacucuucgaucugcuggcaacagcgaccgacucucaggcgagucaccugccccuccuugccgaaauucugaaauuccucaaugugucccuggucccgcuccagccuccgcccccugcgguccuaaucuguucaucaucuucuuggugccugugauucucauuuggcuggcaaccucuucucaccccagauccgccaguuugcagcgguccugacccgcagaaggcugaacaaucgcuggcgacgccuggcaccugagcagagggagaggugggcuagauuuaggaugggaggggccgggccuagucuacuuuuugacaggccgaguacuaagccuuugccaccugucuuccagccucaagucccugguccugacagcacugcagaaagagacaguguaaguguggagcacccacucucggggguccuaacugauuggggcugagauacuggacuucuaccuucuuuuucagccccagacuaggacuuaauucaggccuagaagguggaacaugugaaaacuaaaguuuuuugugauuuauuuuucauuuuuuaauuuuuugguuuuucugagacaggguuucucuguguggcccuggcaguccuggagcuuacucuguagaccaggcuggccuugaacucagaaauccgccugccucugccucccaagugcugggauuaaaggugugugccaccacugcccaacuaaaacccuaaaguuuuugagaauggcugaaaaugaucagcuaaacccagauagggaaaacaagacugaauugaauucagccuguccaguggugcugaccgagccagaucacaaugccccccuccuuuccucacccccagcugucgguggucuuauggggucugccuuaggaaagaccgugcacauaccugcauucucuuucuggccacuccuugggccuggggcauuguuugcaagggaagggugguaaaagguguuucuauaugaauggaccuccucuuuguaggcauucugugagugucagcuuggcccagcucucagccaccauuuuucgaaaggaaggccuacaaggauggccucaguucaugaaccuucuucagcacagcacucauaguucccauagccccgagaaagagguacuggcacugcccuguuggcaggaaggagggacagaggcuggauagaccacgagaccgucucuucuccccugcuccuguacaggugggacuucugcugcugagugugguggugucuucccagcccgaggcauuccaugcccaccagcacgagcugcuucagcuucugaaugagacgcucagugacgucagcuuucccggagugcucuucuacucccugcgcacucugacugccaucgcccgcuaugucaggccggaugaugugguaaguaagacgcugccuguaucucucgguuucgugcccucgcuuucagaagucuuggcccaagcugcuuucgaguuuuauuccgccucccguucuuccuaaggguugagggcauagcguguuagcugggccuggcuggcuccuuagauggaggcuuugaggaagccuccagcuccuggcuucugggaugagaccaccugcgcuuuaugugauuacgcucauuccugugucuuccagucucuugcacggauguuggugcccaaagucguuacggcacugaggacucugauccccuuagaugagguaaggacagacgggaggggucuccuuuuggaaggaaaauggaggcacaagcaccaugguccccuagaggagcgaguacccugugacuuacuugucugucugcagguaaaggccugugaggcccuggaggcccuggaugaaaugcuggagacagaguugcccaucaucaacccccaccucucugagguccucacguuuugccuggaggugagcccggggugggugcugcuccugcucgcugguuugccguuaaguuuucuugcuuguuucugauucuugucggugucuguauagguggcuaagaauguggcccuuggcgaaccacuccgcguacguguucucugcugccucacuuucuuggucaaagucaaaaguaagguacguucccucuggggaaguuaccccauccugcugucuccgccauuaguuguguuuguaggcuuaguccugcucgagcccuggcccagccuucucucccugccuaggagacggggagucucuggcugggguccuugugguugggaggcugggauuuucccaugagccuguucugggaagaugcucaaggcuagcccuccccucuuaggccuuacuaaagaaccgccucgugccucccuugcugcacgcccuuuucccccucauggcugcugagccacccaugggccaacuggauccugaagaucaagauucggaugacgaugacuuggagaucgggcugaugggggagacucccaagcacuuugcuguacaggugauguauuggccuucucgucacugucacccaauacucagagaaacagacaccuuaaggggaggaaguauuuucauggcuucggagauuuccauuuacuguggugggaaaggaauagccaaacagugguucaggccucggcaaaccagaaccauucacguuauggauagaaggcagagaagggguauacaaggaggagacagggcaagauagcucccauaggauguggccccaacuaagcucugccuucugccuuuggcuccuccuagugacuggcauuagauuaagagauuaacucaucuugaggucagagcucuccugaucuaauuggcucugaaaauaucaucacaguuugucuccuaagcacuucccaguucagucaaguggauuauuaaaaucagccaucgcacccagcugaccugguggacaccuguaagcucaguccccagcccuugggaggcugagguagaacuguaagcuuugggcagucugagccauccugucgccacaaacauagaagcagccaucacagguggauccuggggcuggguguuaaauaagaaguggagguuagagauggagucacagucuaccuggcucuccucagguuguggacaugcuggcacuacaucuucccccugagaagcucuguccccaugugguaagugugacucucuugcucuuacuggcccuagguagguauagucccuuaaagaaagccaaggguauuuggguauagaucguugugaugagccuguugagaaaguagcaggcagacucgugcugggcucucaagaauguuccauguucuucccuagaugcccaugcuggaagaagccuugcggagcgaggacccauaccagcgcaaagcaggauuccugguguuggcugugcugucugauggugcaggcgaccacaucaggcagagguauuauauuccauuccugucucagggugagcagagucacauggagaggguggauguacauccucuggcuguccugcuaccccuguuucaguguaacuaguuuuauugguuauuuuuugcuugcuugcuugagauagggacucacuguguagccuugacuggccuggaauucauagagaacugccuauaucugccucccagugcugggauuaaagaugugcgucaucacaccuaggccagccuuuguuuuguuuguuuguuuguuuguuuguuuguuuguuuguuuuuaauaguuuuuugagacaggcuucuucagggagcccugacuguccuggaauucacuguguagaucaggcuggccucaaacguagagaucugccuuccucugcuucccaagugcugggauuaaaagugcgccaccaccauggggcugagacuaggcuuccucuguccugucccucagacuuuguucuucuguccugccccauucagacugcuguacccacugcuacagauugugugcaagggccuggaugaccccucacagauuguucguaaugcugcucuguucgcccugggccaguuuucagagaacuuacaggucagcaaagcuaaaugcagaugacuaccccucugcuccacccccaaggcugggggacccuugucccuuaaacucucaucucuucggaugcugcugcugccauuggcagggggugcucuguaggugagccugaccaggguccugcuugcuucuuccccagccccauaucagcagcuacucugaggaggugaugccccuucuccucuccuaccugaagucagugccgaugggaaacacacaccaccuggccaaggccugcuaugcucuggagaauuuuguggagaaccuagguagugaugauggcugcugagaaaacgggaggaggggagcagcacacugacuaaaggaggcacauggugcaucuuccugaguugcucgcugccugcugggaaugaggggugggggauggucgcacgggcugucaggcuaaaggaggucaauuuugcaaaagcuuagagaccugaguugcuuaguaaaaaaaaaccaaaaacauucccacagggcccaaagugcagcccuaccuuccggagcuuauggaauguaugcugcagccauugaagaaccccagcaaagcccggaccaaggagcuagcugugagcgccauaggggccauuggugagucagaggaccaaggaggcaaaaguguggcuucgcccagagucugugucaggcagaccccaggccuugcugcuucugacuguguucuauccgguccugcagccacagcggcccaggauucccugcugcccuacuucccuaccaucauggaucuucuccgggaguucuuguugacaggccacgaagacuuucaucuugugcagauccagagccuggguaaggccgcugucaccuggugcugaccugaucucucccagggcacuugggugucuuccuuugaugagcaagugcucuccaugcuuucccagagaguaggguagaauacuccugagcgccuuccacucgccacccuugguuuucuggucucuguccacguaucagugcucuugcucccacagagacccugggagugcuagcacgagcccugggagaguccaugaagccccuggcugaggaaugcugucagcuugggcuaggguuaugcauccauauagaugacccugacgugaggcgcugcacgugagugaccuuucagccugccccgccucucuccugccgccuacucacuagauugacaguccccuucccagauucccagacaccaauccuucagguuuggacacagccagguuuccuggacuuccccccugccuccccccaccguuuugucugucugucugucuauagcaggcaguaccauaccgagucucucuaccuuuaucagguacagccuguuugcagccuuaucaggguuaaugggagagggcuugggacccuaccugccucagauuaccacgcucaugcugcugucgcugcgcuccacugagggcauuguggugagcagagggugggugugcugggucaguuaggccaggcuagcccuguggagggauuucucuccuggucccacccgaggcaaaguccccgaucugcuugcuuuaucuagccacaguaugacgggaucagcuccuuccugcuguuugaugacgacagcgaagcagaagaggaggaggagcucauggaugaagauauggaagaggagggggaugacucugagaucucgggguaggaggggugcucuucuacuugaguguagguuuugagccagaggggguggcacacgccuuuaauucuagcacucaggaggcagaggcagcaggaucucugaguucaaggccagccugaucuacagagugaguuccauacacaaagaaauccuaucuagaaaaaaacaaaaaccaaccagacaacaaauacguggucuuugauggugguuguagccccaguguuaggucugcccccugcuggcaggcgucgucacugccuccccauccuuccuuagguauaguguggagaaugccuucuuugaugagaaagaagacaccugcaccgcccugggggagaucuccaugaacaccuggugagcagcagcccuuccacagugcuggguaccacacccagcaucccucuccucacugcugugugucucuccauaguguggcuuuucucccauucauggaugccaccuucgaugaaguauacaaacugcuggagguaaguuagaggcauccccacgccccaguuagggucagcuucaccuugcccaugccaggcauacaccugcccucuugguuccagugcccucauaugaaugugcggaagucagcuuacgaagcgcugggacaguucugcugugcacugcauaaggccucucagagaagcuccucagaucccagcagcagucccggugaggaggagacguagcaggcugggagcccuggggaguggccgggccugaccaaggcucccaccaauugugucuccaguucugcagaccucccuggcucgagugaugccagcuuacaugcaggccgugaaaguagaaagggagcgcccaguggugauggccgugcuggagucccugacaggggugcugcgcaccugcggcagccuugcacugcagccuccugggcggcucagugagcucugcaacgugcucaaggcugugcugcagaaaaaggugggcaggggggagggaauggcggccaugggaagaggugucgggccccaggagacuggacugucggaggcucuaaguccucugcccaccuuaccccuacuguggaaaggagcagguaggggaccucaagcucagcugaauccgucuuccacagacggccugucaggacgccgaggaggaugaugacgaagaugaugaccaggugagagcuacagauaagaguggccuagaccgagggccagcagugggcgguucaugcauugagcucagccugugggagcuagggcugcuaagagaagcuggugcuuuccagagugccaccuccauccgagaagggcagugaggagcucaaaggccaggcaggcacugaggcugggcaggguugggagugauaaacgacggcuauaaaaaagccaaccugguauuggcagcucagccugugugugaagucagggccagucggcagcccccgaagcgucugcagccaguggcauagcgggguggggaggugugugaucccugaguuggcccagugccucaagucccuuuccuggcuccacaggcagaguaugacgccauguuacuagaacaugcuggagaggccauucccguccuggcagccacagcuggaggacacgccuucgcucccuucuuugccacguucuugccauuguugcuguguaagacggugagugcugucguccagccugacgucggagucugccuauguauacaugcugugccugcacccuuccagcucugccaccaugcugaugugcacuccuucacccucccuauagaaacagagcuguacaguggcagagaaguccuuugcugugggaacccuggcagaguccauucagggucuagggaccgccucagcccaguuugugucucggcuguucccugugcuguuaaacaaugcccgggaagcagacccugaggugcggagcaaugccaucuuuggguugggcguacuggcagagcauggcggcugcccugcucaggaguauccuaugccugcaagaggggaaaugggguuggaagugagcccagagauuuggugaggugcugcugcagggugaagucuaccaguguguguaugcauuccuuaacuauggaccagccacuucccuaagcuacugggccuccuuuugccccugcuggcaagggagcgacaugaucgaguccgugauaacaucugcggggcucuugcccguguacugauggccaguccaguaggaaaaacggagccccagguaaaggacaaggcaucaggucgggguggagggaggccaaggaugggaaaagggacaggacgugugggccugagauuucuguguauccaggugcuggcuacccugcuacgugcccugccccugaaggaagacauggaggaguggcucacuauaggucaccucuucagcuuccugcaccagaacaauccugagcagguaacccuauugcuggagcuaagaaccaagggaguguuaggcuccaagcuaaggcacaggcagaggagauguuacugguaacuggugcauggugaauuucagguuaauuucuggcauucacucuacaggccaggcuggccucaaauucacagagaucugccuguuucugccucccguuucaugccucugcugggaauuaaaggcaugcaccaccacugcccagcugacauucuucuacucuuguuuucauuuugccuucuuccugagacagggucuucugcaucgcugacuggcccagcuucuuacagagcugaggguggcccugagcccucaguccucccgucccucccucugccucccgagcgcuggggucaccggcacggcacacauuucuguuuauaauuuuagcagugcugaggaugacaccccgucuucaugccugccaggcaagcacuccuaccagcugagcugcagccuuggcuucuguuuuccuuuuuguccacagaguuggcauaaaguccgaugaguguuuccccggagcuucucugguucuucucucaggccaagccaccagucacaacuuuccuaggcugcuuuccuaggucagggguaggaaaagcauuggcuagggagcccuggccgcugcucaccacccaccauagauuccaucuggcacauccagcugccucgguggggacccgugcccugcgguucugucaccgugugucuuggguuuuuaguguugggaguauuuggauucuggguuuuacuugcucuuuuguuguuguuguuguuuugguuuuuuguuguuguuguuuuucgagacagcguuucucuguauaauucuggcuguccuggaacucacucuguagaucagacuggccucgaacucagaaauccaccugccucugccucccaagugcugggauuaaaugcucuugaagcugacaucuuugguuacacaucuuaaccucuaaaaagagguuguuaccauguuucuuuauucggguuguguugggugucaguucagacaagcucacaggcuucuguccuugguuucaacggccugcucuaagcccugcuucgcugccccgguugaccaguucuauuccauagguuguggauguggcuucagaacuccugcgcaucugcagccugauccugccggacaaccggaucccuccaggugaggccgacagagggcaagggagaguggggacaggcagggcucagagagccugagguacuaugggcggaggaaccagguccuucaucaggccucucucuauucuacccagacaccaaggcggcccugcugcugcuccugacguuccuggccaagcagcacaccgacagcuuccacacagcccugggcucucugccaaaugauaaagcucaggaacuucaggccaugaugggccucacuuaagacuauaggccacaggggccagggguccgaagaccgaggucagcccugguccaguucaccuuaccaaagacucuauccauugaagucaacugugcuguuuuaacaggggugucucuggggcuggacaucauacuauaauaaagcagagcugugacaucauacuauaauaaagcagagcugugacaucauacuauaaggaagcagcugugacgucauacuauaagaaagcagagcugugacgucauacuauaauaaagguggccugucuucugcuuggacacuagcuuucugcacaaaggcuagagguauguguucagagcugagacugggaagggaggggcugcgcugaggacauacugucccugcagaagucagaaugcgguccacccccacuggacggcucagacagccuugagcuccagagguuuaauucccucauucccuugcacaucuggcuggcacacacacauaauuuaaaauuaaaaauaaaucuugaaaaaaaaaaagaggcaaaguccagugaggcaggauaugguuuaaugaacuugcucaggggaauuuggguccaggacgaaucaggaggggcccauauggcuucuguuguuccacaagaaggaucuucuguguggacagc

SEQ ID NO: 7472 - RNA, 7844 nt, Mus musculus
cgcguccgggccgaccucagcagccgggggcgggugccgcgcucccgcuccccagcugucucucuccauccuagagaggacagcccagccgcgcgagagcccgugggaagccgcccgcgacacaccggcgagcaucgcggagcucuuggcucaggagaagagccuucccgccuucccggagcugagguccccgucggcgaaggcggaagugguaagacugacguguccgggcugcggugcugcucgccgggacgaccacuggcaucgcucgguggcucggggagcgagcaucguggaauccguggccgggccggauugcgggcgaaccagagcucuuccaggagcauucgaaugagccgagggcggacgccggcgacguggcagcagccgcggcaaucaggcgcagcggcggacaacccggaggagguccgucgucagguccuccgcaagccuaccgcuccggcgccgcugucuggaagaccggggcagaagcccaagggcagcuacggggccccgugaggccacuggcgccucuuuggccagccgguaccucgcagugaggacccuggagcugcggcgagugccccuuccguagcagcgagcccgccgggcguugcuauagaaacggguuggcacgcgcagccccgggcuggggaggccuagaggcgugaacccuagguugggaguacuauugagugcacgccaggccccgucuuugggauagauaaguucugugguguggggaucgggaggccgaagggaggagguggagccaaugggcacuugagagaccagaaccgggucaucaugauuugauuccuaguuucuguaaccacgggauucccccaacagguucugcugccuuaaggaugacaguccuaggguacccucgaaguuggagcugccauuguuugccaguccugauacuguugcugggcauaggccaugggccauggguggaaggugucacacacuacaagcccggcgacccugucauucuauaugucaacaaagugggacccuaccauaacccucaggaaacuuaccacuacuaucagcuuccagucugcuguccugagaagauccgccacaaaagucuuaguuugggugaaguucuggauggggaccgaauggccgaaucuuuguacgagauccgcuuucgggagaauguggagaagagaauucugugucacaugcagcucaguucugcacaggucagcugcucuccgcgguacauaucacucagcccuccuugcuagggacuaagggugccuugcaucuaugguaccuuuauggaaauuauguuuggacuccaacuacaaccccguguacuugcuuagauguuccaaacugacuuuucaagauaacauggauccagagaugcagagcggggagcuuagagccuaaggcucuucgcugucaguaauaggucccagaguccugugcaagucucucuccuuccguacaugccucuguuuuuuuccaugacuuuuuuuuuuacuuuuuagccuucccuguuacuuuucuuuuuuuuccuuuagcaaauuuuggaacuucuuaauuccagucuuuuuauacuuugcuccauuuauuuuucugagacuuuauccuagcaaagagauccuuguucuuuuuuggggcuaauauaccagaaucagucagugagucucaauggaaaacaguuuuguaccuagguacuuuggcaguguauaaagacauuugguuugguugguuuagggguuuguucuuguuuugaacauugagauaaggucuuacuauguagccaaggcuagccucaaacccaauaguaaccuucuaagugcugggauaacagguuuguucuauaccagaucucuacccaucaacuaagauaggcuuucucuauguaacaacagcccuggauguccuggaacucucucuguagacuaggauggccuugaacucacaagagaucuaccugccucugccuccccaguccugggacuaaaggcgugcaccaccguagcccaucuuggaaauaauuuugauugucacagcucagugguacuauugguauguaguguguaaggaucaaggaugcugaccccugccaugcacagaucaguaucucccuacaacacagaauuagccaaaccaaaauaggaguaccgccaagucuucaaaacccuguuuaacucugcgaggcuuuguguaaccgacuccuggcuuguucuuuacagguggagcagcugcgccaggccauugaggaauuguauuacuuugaguuuguggucgaugauuugccaauccgugguuuugugggcuacauggaagagaguggcuuccugccacauagccacaagauaggccucuggacacauuuggacuuccaccuagaauuccauggagaucgaauuauauuugccaauguuucggugcgggacgucaagccccacagcuuggaugggcugcggucugaugaauugcugggccuuacucacacuuacagugugcgcuggucugagacgucaguggagcaucggagugacaggcgccgaggugaugauggaggcuucuuuccucgaacccuggaaauccauugguuguccaucaucaacuccauggugcuuguguuuuuacugguggguuuuguggcuguuauucuaaugcgugugcuucgaaaugaccuggcucgguacaaccuagacgaagagacgagcucuggcggcucuagugacgacuuugaccagggcgauaauggcuggaaaauuauccauacagaugucuuccgcuucccuccauaccguggucugcucugugcugugcuuggugugggcgcccaguuccuggcccuuggcacuggugaggggauaugaauugcucucaggguagcagauaggucauuagaaaaguucagugagccgggcaugguggcgcacgccuuuaauccagcuuggucuacaaagugaguuccaggacagccagggcuauacagagaaacccugucucuggaaaaaaaaaacaaaaacaaaacaaaaaaaaaaaagaaaaaaaguucaguggauuuccucuuguguucaaggugagaaagagaccuaagggacucgguagcucuagugcggauguguguggguuuuccugacuccaguagaacuaggaaaaucaccugagggaccuggguuaagggggaugauuucucugaggucgagaagagguguuggugaggccuaacuggagcuuuccacuacuaccuuacaggcauuauugucauggcguugcuuggcauguucaacgugcaccgucacggggccauuaacucagcagcgaucuuguuguaugcccugaccugcugcaucucuggcuacgugucgagccacuucuaccggcaaauuggaggcgagcguuggguguggaacaucauucucaccagcagccucuucucuggugagaacacgcccuguuauugggucugccuggacuuaguaacuaagaacacaucauggguccaggggcagaaucacagugcaggggccauaaggagaaggcuuugauacuuacauuuacaaguguuuugccugcaugugcaacacauauguaacauguacaacauugugcaguucaugcauauagucccuaugguagccuauggaacccuggaacuggaguuacagaugguuguaagccaccaugcgggugcugggaacugaaccccggagcuucaguaaaaaauagcaaaaaauaguaaaaauagcgcuuuuaaccacggaacuuucucuccagccccugggugggauggggguagggguggggaguggggucaaaagacaauccaucggaaagaauauuucuuuaucuuagacaggaucuugaccuauauaguccaggcugucuuuggguuuaugaucuuccaguuuaaccgcuugaguacugcgacuauaacucaggaaaauaccuauuucuuuuugaauaguuaaaaguuguuaagugggggaaaguggcuagacacugaacauuugauacgucaugugacauaggcaauguaguccccguugcacacgaugaggagacuaaacuaggacagggucuuacuguggagcccacgugagccuuuaacugccuccuggguuauaggguugugggugcacaucaccaugccuggguuucagccguuugcauguaugugcucaagcgcuugugcaaaugugcgauuguauguguggaaaccagagggccaccucacauaugaucccucagacacuguccaccucuccugagaaaagaucucucauuagccaaauagucaagacugggcugcuuggcugacaggcuucaguaaugucuccgcugcccccaaugcugagauuacaagcaugcgagccaggcgugguggagcacaucuuuaaucccaggacucaagaggcaagcagaucucucugaguuccaggccacucugcucuacuccuugaguucuaggauagucaggguuacuuagacccugucucaaaagaaaaaaaaaaaagcgugaaccacugucucuagcuuuuuacagggaggaaucugggaauggaacguaggcccucaugauuguaaggcaagcguuuuaucacccgagacaacagacccucagacaugcuuucauuugguauguguacacacauaccuguguaggcuugcaugugugcuguguaugcacacgcauuuggaaggcagaggucaggagcggguccuccucaauagcuucccuuacccuucaaggcagggugucucacugaaguuagagcucacugcauuagcuagaccugaugaccagugagccguaaggauccuccugucucuugcccuccgucuacugugauugugagcucuggccaccgauguggcuuauuuuuguugucuuuaaugagaauguuggggacccaacucaggugcucaggcuuucaugguggggggggcuuugcugacugaaccauucccucaacccuccuaaguagcauucuugaguuuauuuuuugauacuauuuuuauuuuggagguagguucauucuggauuucaagccaguuugccuuuucaaaaacaguaguagucuauauucugaaccuugugauuuccaaucugauguauuugacuucugucccaucccauuuauauauuugaagcauggcuuucugauaacaggcccuuaacccaaaugacuguuuuaugcuuggaauuaucagugccauggcaagacagguuucuguagguagguagauuuguaucacucuuggaccacaaugaugcaacugucuuaauucuuuuuuuuuguuuguuuuuucgagacagaguuucucaguguaacccuggcuguccuggaacucacucuguagaccaggcuggccucgaacucagagauccaccugccucugccucccgagugcugggauuaaagaugugcgccaccacuggcuggccagcugucuuaauucuugaugacauuggguuggggaaugguguuugaaaaauaaagaauaaagaauaaacacauaaaaggacaaugagcuauaaaagggucaaaguggauucaaucagcucuggccaucuggaagcauaggugggcccuguaaguggcaggcuacuucaucccuuucccuuuagguccagucagaguggggugucacggggauguugcuccuacugcugacccuccuuccugcagugccuuucuuccugacuuggaguguggugaacucagugcauugggccaacgguucaacacaggcgcugccggccacaaccauccugcugcugcugacagucuggcugcugguaggcuuuccucucacugucauuggcggcaucuuugggaagaacaacgcuagucccuuugaugcaccuugucgcacaaagaauaucgcccgggagaucccaccccagcccugguacaagucuacugucauccacaugacuguugguggcuuccugccuuucagguauccucacuuuguaccauggccauccauuuuuggugguuuugguuugguuugguuuuggacacuagagaguuuuuuguuuauuuuguuuucuguuuacuuuguuuucuuuuuuugaggcacucauaaggcucaugggcacucggagguagaggcagguggaucucuauuuuuuuuuuuuucuagauuuauuuauuauauguaaguacacuguaguugucuucauacauuccagaagagggcgucagaucucuuuacagaugguugugagccaccaugugguugcugggauuugaacucaagaccuauuggaagagcauucaaugcucuuagcugcugagccaucucuccagcuccuauaaauuugaggucagcauggucuacagaguuucaggacagccacggcuacagagaaauccugucuuaaaaaacaaaacaaaacaaaaaccuuaaguugucccgccuuggaugagggccaccacaccuugcauucagcaggguuuugauucaccuuugccuuucuccgcucucuaaauaccauaacccaguaauaauccucagcucagcccaagcacagaccaggagugagcuucagcucgcucacaugagcguuucacugucaagcucucacucagcaaacugaaaguaaucaagugggcuuuaagccuuguauuggagcuuacagaaccugauuucuguuuaguguucacaggcacagagagcuuaagaccuauguguuuucucauucaguuuguuaaguaccuuuuaaacaauacagaaggaaguaaacaacacaguaucugcccccuccacuucuuucuugcucccauuuuguaguaguggagugugcuuagggccucgugcauccuuuggcaagcacuguucucugagccacaucccagcccuuuuuuaccuuucauuuuaagacugucuuaaguuuuccaggcuggccuugaacuugcuuuuuaaccuagauugacuuugaauuuggcaauccuccugccucagccucccaaauaguaguauuauagauguaugccuacucuaguuaagaugguugcuuucagccugucagggaagauguucaugaaccgagagcaacuaauaaacuaagcuaauaggcagaagccuccuggagcucucuugaucgccacagcgcuaccggaagauguggcugaguuuggcuccgcgugcuguggcuaugaacagagcuuuaaugaugugcauugucuuuuucucuucacagcgccaucuccguggagcuguacuacaucuuugccacagucuggggucgagagcaguacacucuguacggcauccucuucuuugucuucgccauccugcugagugugggggccugcaucuccauugcgcucaccuacuuccagcugucuggggaagacuaccgcuggugguggcgauccgugcugagcgucggcuccaccggccucuucaucuuccucuacucaguuuucuacuaugcccggcgcucuaacaugucaggggcaguacagacaguagaguucuuuggcuacucuuuacugacuggcuaugucuucuuccucaugcuggguaccaucuccuuuuuuuccucuuuaaaguucauccguuauaucuauguuaaccucaagauggacugaguucuaagccacagaacucuggcucuuuccugcuuucaucaugccccauugauuucacuugauagcuucucuucugaccgaauugugugauggcauugucgccuuccuucccucuuuagagaggaccuggaaauuaaaaaucucuauuauauaaggaauauauauauuugaacuuuuuaaguugccuuacguuuugguccugauuuuuuuuuucuuuuuacaauuauuaaaauaaaauuuauuaagaaaaaggau

SEQ ID NO: 7473 - RNA, 2751 nt, Mus musculus
aacuuauagaaaauaguuuauuggcacuguaguuccagagggucaugugcugaacugcgagcagaaguugagcagacucagagccugcuccagcaccaucaguaccacucucaaacaaggucacacauccuaaaccucccgaaacaccgccaccaagugggaaccaaaacuuugaaugccugagacaauguggggccuuucauucgaaucaccacaaccugggauguuuuuguuugcuuugagacagggucucaaaacuaaauaucuuccaauauaagugaugacaccauaacugacuugucaggucccaccuacugaguauguggcccugcuggcaccgcaggcccaaagucuauuggaauucagcucuacaaccugguacgauuaaagaacugcccagaguacaucacaguuaaggagaugcaccccaguacugcucaucaaugugcauuaaccaggccuggauaggugguuugguaauaaacugguaauaaucucucaucacaaauagaagguauaccaauuuguucaagacagagagagagagagagagagagagagagagagagagagagagagagagagagaaagagaaagagagagagagaaacauccaauauuucuaugugaacccagaguauuccagaaaguuaguauaccuggaguagcaucaggauauggcucuguaaggccucguguuaagcuauuuucuacucuacguuguuccaguccaaguuuguuauacauaaaaaucagaacuugucaaaaaaaaaaucaguaguuaagagaucuuugugcuugcucuuccaagauccuggguuuaguuccuagcauccacacucagcaacauguaacucccucuaauucaagcuacagaggaaccaacauccucuucuggccuccuugggcaucccuacaucuguggcauacauacacaauuguuuuaaagcuagauagauaugaaaagguagaaauaaaaacaagagcugggcggugauggcgcacaccuuuaaucccagcacucgggaggcagaggcaggcggauuucugaguucgaggccagccuggucuacagagugaguuccaggacagccagggcuacacagagaaacacaaacaacaaauguagcacaguggcucacccugagaccccuugcugaggcaagagaaucgcuguaggucugaggccagaugaggcugccgagacccgucucaauaaaaccuccaauuaaccaaccccagaacccgauacucagccccuucucuuccugagguacugccgguuuaacaguccuuccagcaguaguuugaaaaauggucccagaggaagguggcucagaggcuagcaaggugguugacaugaaagaguauggggccucuacaucaagaaaaugauggaaaacaaagaaucaggaaacaaaucaagggagcuugcgauuugagaggugcuaagagaagcuuugauuucuggcuucacuggguaggucauccaaagaaaacuccaaagcaucuuaaguuauuccuaaccacagaacucagucaggccugccucaguaccgcaagccuugcacacacuugcagucccagcuacucgcgaaaccgaggcagggcuauugcuucggcagcaguuccaaggccagucaggcaacacagcaagacugacugucuugaggagggcaaaggggucaaaacaaaagccacugugucuggcucaagccuagcuuccuagacucuaaccgcuucaggacaguggguggaucagaaaagaacagucguaggagugaggaaagaauggcugcuugugauuucucucaguacuugcuuccgccagaauagaaaaauugaagucagcuuccuuccguuugcucccauguugccaagugaaagucacuguucaaaaggggcagagccccuucacaacagcuugagccagacaaaaguaacgcguucaaagaaaccugcaaaguuagggagaaguccaaacgucccacagacgaacuugggaacaaaaugacggaagugagaugguaccuguaagcucugaaacucugaaggcggagacucaaaagaccccggguucgaggucugcagggacuccacauucaaaaaacaaaacaaaaaccuacuuccgaucaaaaaccgcgcugucgggcuggugagauggcucuguggguaagagcacccgacugcucuuccaaaggucccgaguucaaaucccagcaaccacaugguggcuuacaaccaucucauaacgagaucugacucucucuucugaagugucugaggacagcuacaguguacuuacauauaauaaauaaauaaaucuuaaaaaaaaaacgcgcugucaacccgcacaacuugcagggugaaauggcaaacuguaggugcaccucaccuaccucccgcaugccuguugccaacaauaaccgguccgugccuccagaaagccucggaggggcaccuuuaccaagguguuggaggcuacaggucccuggcgugggaacgcggcacaaagccccgccccgcccagguuagggacaacuuuccgcguccgggccgaccucagcagccgggggcgggugccgcgcucccgcuccccagcugucucucuccauccuagagaggacagcccagccgcgcgagagcccgugggaagccgcccgcgacacaccggcgagcaucgcggagcucuuggcucaggagaagagccuucccgccuucccggagcugagguccccgucggcgaaggcg

SEQ ID NO: 7474 - RNA, 7262 nt, Mus musculus
cacccucuccucuuuccaccggguucccgaaacgcucaggagugcccucguguucugugucagugggguuguaaagagaaaggcaagucggcuaggaacagccagacggcgcccugagaccccgcgcguggccaccgaacugguguuagcggcgagcuggaacggaacaaacuacuugucccaucaugccuggaggcagcucuguccuuugcauccuaggaguuguaguucuucugccgcucgcacucaacggcagcuugaguguguggacucuguuacccagaaggccuugcacagcgcccgaagcuagaauuccuuggguagucgaguuugcaauuagcggaacucguucgaguggcccugaaggcucaucgaggcugcacgcggcuaguugcuaagcaaaagaaucuuuggucaacugccaccugagucaaagcaacaggaagugaguaccgcuaugccggaagcugguuaaaaucucuuuucucaucccuaaguuagcuucuuacucuaaguugcccuuugcaggggcgaaaaaagggagaguaacuagguaaggaagcaccuucaggaaccauaaucucuucccaauucucccuaaaaaucauaccugggauugaagcauuaggauaauccagacacuggauggucccagggagacuugaagaaccacacccugaucugacuuuacacaguuuaagcgugagaggcgaacuuuguuacuucccagucuuacagccucauuuuuuuuuaaaucuaacuccagcuuugcaucaugccucauauugauaaugaugugaaacuugacuucaaggauguccuguugaggcccaaacgcagcacucuuaagucucgaagugaggugagccaguugucuuccuugguuuuuauuuauuuauuuauuuuuaccucaagcuucuaauggaccagguccaagaaagcugucagguucgagaacgauacauauuuucugaaugaaugaaaucuuaauguccucuuaaugucugcagguagagcucacaagaucauuuucguuccggaacucaaagcagauguacaguggcaucccugucauugcugccaauauggauaccgugggcacuuuugaaauggcuaggguucucuguaaggugagauuaaccuuaugcccccuaccagaucuucucccagcuagcggcuacagaggaauugcaucuguauucccagucucuggcaauuaacagaauguuguguuuacuauuuuuuuuuccauuacuaagaaccauuugaucaguucaaagaucugucugaacuagugagauucaaauuuagaucuguuucaucuuuuuuauuauaaucucccauaaauuauauacuuuaccaaauucuuccagugcccacccaggucaacccaagcacaugcauuucuucagucagucauuguuugaacauuaagcagucacuguuuaguccagaaauuaaauacuguuuugaguauuuaaaaauuuucaaccugggauauuacagaaaaaaggaguuuauuaguuuucuuguaugccuacuauuauuuuaauuuuucacuucuuuaagguucuuuuagguuccugggaguuucugagaucuaucccaaauggaaguuuuguucuuaaauacagauuguucccuuugaaaauggaagacacugcuccugacaguaauaucacuugccucuaugcauguaguugagaagguagauaguugccugggcacuuuugagaacauaaugugcuuugcugauuaauccuaguaucccuaguugguggguucuguuucuguuuguggcuguuggccuuaaagaccuggguuuuuguuuguuuguuuuucuguuuuuguagaauguuuguugugcuuucucugagauugauaauuauggaguuuuauuacuuuauuccuguuaccauuuacuaauucuucaggguuuuggcuauuaucuugucugucuucucugacagguggauuuggggaauuggcaaaucuguuaaaaaggcaugcuauaauucaugaaccuuacugggaaauggauuucaauacuguggacaaguacuacagaaaccaaauuuuagaaauauagccaagucucaauaaugauuaaaaaaauaaauuagauaccaaaaaaaaaaaaaaaaguguuucuugggguuuguauggauuaggugaacuuagcacagcaacauaucucuaagaccugcugaccaccauagcuuuuaugaacuuguugacaguugauuuuuacagagaaagcagaauaccagcuuuuaugcauagaacucccuguggcuggcugauacaugacuuccuuguguuucuucucacuuguaaaaucugugcuguuucaaccaccuguugacucuugggguugcacauauagaaagcaaaaacgccagcauucucaguaccuuccucagaauauugagauauuugcaauuucaggagucagaaguuuuauuuauuuaguuaagacggaguuucucuguauaaccuuggcuguccuggaacuuugcuuuguagaucaggcucucuuugccucugccuccuaagugcugagacuaaaggugugggccaccacugccagagaaucagucuuuuuaaauuugccuaggagauaacauugauauuugcauguuuaugucccuaacauggaaaaucuguucuuuuccagcagaaaaagagaaugguugcaauaguauuuuguugcuccgcuagucuuaagcuuuuuuuuuuuuuuuuuuuuaagauuuauuuauuuauuauauguaaguacacuguagcugucuucagacacuccagaagagggcaucagauuucguuacggaugguugugagucaccaugugguugcugggaucugaacuccggaccuucggaagagcagucagcgcucuuaaccacugagccaucucgccagccuuagucuuaagcuuuuaacugugugugugacuuguuggauuacugccagccaggaaaucaaaagagagaaaaacagauugagaacuggauccucuuggagcugagugaagacaaacucccucuccauuuauccucuuuaguucccucuccauuuauccuccuuaguucuuccagcccuguuacuuguuuuacgguaucaagagcaugucccuaccacuuuuaaggucaugaacaauaaaugugcuagaaggugaaauccaaccugggccacaguacuuugguaggaauaccagacaagugcuaaugagaguaaaggcuguacugggauuguaggacuaacaguggucggagucagcucaaccaugaacuuccuuauacuguucuucuuuccaggcaguacaaagcuauaucucgauagccuaauaaagucucugcccuuuuaaugguucuuuuuucucuucaguucucccuguucacugccauccauaagcacuacagcauccaucaguggcaagaguuugcuagccagaauccugacugucuugagguaacccugggccuacccugcucauuaguuuuccaggaauccuuuuuuuuuugggggggggggcucuuggaauucaaccuucccuauuggccacuuacuaccucauuucugaugcaaugccgcggguugucugaugcuuucuccacagugucuagcugccagcucaggcucaggcucugcugacuuugagcagcuggaacagauccuggaagcuauuccccaagucaaauauauaugccuggauguggcuaacggcuacucugaacauuuuguugaauuuguaaaggauguacggaagcgauucccccaacacaccaucaugguaaguuucuacauuuugcuuuguugagacaaggcuucuguaucucuagcugccuugaaucuaacucuauagaccagucugaucucaaacucagagaccugccugccucuggagcugggauuaagggaugcaccaccacacucuauuaucauuacuuuugucuccucuuuccugacguuucauguuguuauaucaguacuuggucucugcugcaucaugauauuucuauucuacauguuacugucaugauucaaaauucauaguucauuaaucaaggacuuaaaaaacauggaacauuuacaaacguuacccauaccuguuguacauacgucugucuacugaagugguccugugcuacaauugaaaguguuacgugaaagccugacauugauaccuaucuauagucccaguacuugggggauagaagcaguucaagaccagcccugaguuugucucaaacuaacaacaaaaagcaucauauaaaacuauuguuuuauuuuuuagaagcuuauuagagauaaaauccaaggcuucauuuucuucacagcauugaaggggggugucgcacuguccacauucuguugggcagauggauauuuuaacccacauuccugugacuguccauguuuuucaagguagagagcuucaggacugggcagcaguccccuaguaaugaaagggcacuacugucgaucugagugggguuucugacucaacaacugcucuuuaaugccacuuuauaucuuguugcccaccuugcugccuuaaaggucauucugguccuguuuuuacccuagacaauguuguuuccucuauccuucacacuaagucaaaguauguaugugggaugggaaggguaacugggaaucuagguccuuuggaguugguggaaaguccugagggcucuagguacccuuuauuuauaauaggaaggucacaguugaggcauggauuauaugaaagcacaaaagcugcucuccaccaccgacccuaagagugcucuguuuugauuauugucucaggcaggaaaugugguaacaggagagaugguagaagaguuaauccuuucuggggcugacaucaucaaagugggaauugguccugguaagcugguuccuugggaccaucgucucaucugucccguuggaggcaaaaccauaggccaguuuacucucaccucugucccucuucccaggcucugucuguacaacucggaagaaaacuggagugggguauccacagcucagugcagugauggagugugcagaugcugcucauggccucaaaggccauaucaucucaguaagacucaagaccuggagaggguuuguggcugcccagcagccacuguuuucuguaggguggggcucuggugaaguccuggucaggacauuaguucuaguccuuugacaugggcaguugagaagucuugagaaaucuaugcugucucucacagcauuccuuacuuuguaggauggaggcugcagcuguccuggggauguggcaaaggcuuuugguaaggagacugggagggcacggcaggaagauccuguagaagauaaaucaccucugagggucuaagggcaagaugucaagcuagacacagcugaaggagccauuuagaaucauaauauaaaccagugaccuccucaggaaccuaaagugucaccugggaacaagcaaucgaggaaauccugagauuuugacccucccaagcguaagccagagccauuuaugacaugcccuagauugaaaauguagauugcuaaacccuguaucuaaccuacaaaaucacccugaggaacagaacuacaaauauucauuuuucuauucccaaggugaucuuuauaaaauuuggagaccuauugucuuagaaccaaagucauacugagcugggaacuguaaaaugaagauuggaaaagcagaagccagucagggaacuucuaggucuuuaaaacucuuggggaaguuagucccacuggggaccagaggccagaguagaggcagucucaaggaacuuggaucagcuaugcaaacagacccagcaggaagugagacucacacaagcuguuuuuuugauggugccuuuauagguaccucggccagaugcaucuuuuucaacuucuuguuuuuggcaggggcaggggcugacuuugugauguuggguggcaugcuggccgggcacagugaaucagguggcgaacucauugagagagauggcaagaaauauaagcucuucuacggaaugaguucugaaauggccaugaagaaguacucaggagguguggcugaguacagguauguguggaaggcuagcaccugaauguuccuggugacgacucuaugaaagauguugucauacccucuggggaauguacgguaucacuccugagagaaaaacggugaagggguauaaaugucagagacaggaugaguaacugggcuuaaagaguucugcaggaggagguaauaaaaguuuuuguuuuccaagggccucagagggaaagauaguagaaguccccuuuaaaggcgauguggaacauacuauucgugacauccuaggaggcauccggucuacaugcacguauguaggggcugcuaaacugaaggaacuaagccggagaacuacuuuuauccgagucacccagcaagugaauccaaucuucagcaauucccaguagacccaagaagccuacuuuccugaggcagcagcacugccacuggagccucccgacagggcgugccucucccacugcagccccuguggugguggcugccuaauucaguuccagcucucacucuacucacccaugccucuagcugcacaauguuauggcacuacgggagaggcgaggaaggagacgugagaucaacaaaugagacccuggggacagcccccgaagauuaggaagaugcuaauccacacagaaauggcagcccuuggucuggaaagggaaggcugcgggaaucauguuaagcagcuucauuaaaugacaucaucacgugucuaaacagcuuagacguucuucuauacuugaaacacucucauacagauggaugcugggcuuccagcacaggcuggcaucuagaugcuccuccugggauugacccugacccaguaggauccagggaaaugaauguuauucucaggaagcagcgacgccagccuaagcuaacuugguagcaagcaaguuuacaaaguguauucuggccuuagggaugacuguuaggauggcauaaggacaguuucccuuccaggcucucucaacccuucuauguaaaucuaaacucuugccaaaggaguaaauaugagaagggccucaaccagcuaagagaagccuguuauguuucggaggaaugaccuacacagaccuaugcaagucuuuauuccccuucuucccaucaauagugaaacaaaucaauauuuaauuuucaagugcuacaaagcuuucagcaauguagccaggca

SEQ ID NO: 7475 - RNA, 7262 nt, Mus musculus
ugccuggcuacauugcugaaagcuuuguagcacuugaaaauuaaauauugauuuguuucacuauugaugggaagaaggggaauaaagacuugcauaggucuguguaggucauuccuccgaaacauaacaggcuucucuuagcugguugaggcccuucucauauuuacuccuuuggcaagaguuuagauuuacauagaaggguugagagagccuggaagggaaacuguccuuaugccauccuaacagucaucccuaaggccagaauacacuuuguaaacuugcuugcuaccaaguuagcuuaggcuggcgucgcugcuuccugagaauaacauucauuucccuggauccuacugggucagggucaaucccaggaggagcaucuagaugccagccugugcuggaagcccagcauccaucuguaugagaguguuucaaguauagaagaacgucuaagcuguuuagacacgugaugaugucauuuaaugaagcugcuuaacaugauucccgcagccuucccuuuccagaccaagggcugccauuucuguguggauuagcaucuuccuaaucuucgggggcuguccccagggucucauuuguugaucucacgucuccuuccucgccucucccguagugccauaacauugugcagcuagaggcaugggugaguagagugagagcuggaacugaauuaggcagccaccaccacaggggcugcagugggagaggcacgcccugucgggaggcuccaguggcagugcugcugccucaggaaaguaggcuucuugggucuacugggaauugcugaagauuggauucacuugcugggugacucggauaaaaguaguucuccggcuuaguuccuucaguuuagcagccccuacauacgugcauguagaccggaugccuccuaggaugucacgaauaguauguuccacaucgccuuuaaaggggacuucuacuaucuuucccucugaggcccuuggaaaacaaaaacuuuuauuaccuccuccugcagaacucuuuaagcccaguuacucauccugucucugacauuuauaccccuucaccguuuuucucucaggagugauaccguacauuccccagaggguaugacaacaucuuucauagagucgucaccaggaacauucaggugcuagccuuccacacauaccuguacucagccacaccuccugaguacuucuucauggccauuucagaacucauuccguagaagagcuuauauuucuugccaucucucucaaugaguucgccaccugauucacugugcccggccagcaugccacccaacaucacaaagucagccccugccccugccaaaaacaagaaguugaaaaagaugcaucuggccgagguaccuauaaaggcaccaucaaaaaaacagcuugugugagucucacuuccugcugggucuguuugcauagcugauccaaguuccuugagacugccucuacucuggccucugguccccagugggacuaacuuccccaagaguuuuaaagaccuagaaguucccugacuggcuucugcuuuuccaaucuucauuuuacaguucccagcucaguaugacuuugguucuaagacaauaggucuccaaauuuuauaaagaucaccuugggaauagaaaaaugaauauuuguaguucuguuccucagggugauuuuguagguuagauacaggguuuagcaaucuacauuuucaaucuagggcaugucauaaauggcucuggcuuacgcuugggagggucaaaaucucaggauuuccucgauugcuuguucccaggugacacuuuagguuccugaggaggucacugguuuauauuaugauucuaaauggcuccuucagcugugucuagcuugacaucuugcccuuagacccucagaggugauuuaucuucuacaggaucuuccugccgugcccucccagucuccuuaccaaaagccuuugccacauccccaggacagcugcagccuccauccuacaaaguaaggaaugcugugagagacagcauagauuucucaagacuucucaacugcccaugucaaaggacuagaacuaauguccugaccaggacuucaccagagccccacccuacagaaaacaguggcugcugggcagccacaaacccucuccaggucuugagucuuacugagaugauauggccuuugaggccaugagcagcaucugcacacuccaucacugcacugagcuguggauaccccacuccaguuuucuuccgaguuguacagacagagccugggaagagggacagaggugagaguaaacuggccuaugguuuugccuccaacgggacagaugagacgauggucccaaggaaccagcuuaccaggaccaauucccacuuugaugaugucagccccagaaaggauuaacucuucuaccaucucuccuguuaccacauuuccugccugagacaauaaucaaaacagagcacucuuagggucggugguggagagcagcuuuugugcuuucauauaauccaugccucaacugugaccuuccuauuauaaauaaaggguaccuagagcccucaggacuuuccaccaacuccaaaggaccuagauucccaguuacccuucccaucccacauacauacuuugacuuagugugaaggauagaggaaacaacauugucuaggguaaaaacaggaccagaaugaccuuuaaggcagcaaggugggcaacaagauauaaaguggcauuaaagagcaguuguugagucagaaaccccacucagaucgacaguagugcccuuucauuacuaggggacugcugcccaguccugaagcucucuaccuugaaaaacauggacagucacaggaauguggguuaaaauauccaucugcccaacagaauguggacagugcgacaccccccuucaaugcugugaagaaaaugaagccuuggauuuuaucucuaauaagcuucuaaaaaauaaaacaauaguuuuauaugaugcuuuuuguuguuaguuugagacaaacucagggcuggucuugaacugcuucuaucccccaaguacugggacuauagauagguaucaaugucaggcuuucacguaacacuuucaauuguagcacaggaccacuucaguagacagacguauguacaacagguauggguaacguuuguaaauguuccauguuuuuuaaguccuugauuaaugaacuaugaauuuugaaucaugacaguaacauguagaauagaaauaucaugaugcagcagagaccaaguacugauauaacaacaugaaacgucaggaaagaggagacaaaaguaaugauaauagagugugguggugcaucccuuaaucccagcuccagaggcaggcaggucucugaguuugagaucagacuggucuauagaguuagauucaaggcagcuagagauacagaagccuugucucaacaaagcaaaauguagaaacuuaccaugaugguguguugggggaaucgcuuccguacauccuuuacaaauucaacaaaauguucagaguagccguuagccacauccaggcauauauauuugacuuggggaauagcuuccaggaucuguuccagcugcucaaagucagcagagccugagccugagcuggcagcuagacacuguggagaaagcaucagacaacccgcggcauugcaucagaaaugagguaguaaguggccaauagggaagguugaauuccaagagcccccccccccaaaaaaaaaaggauuccuggaaaacuaaugagcaggguaggcccaggguuaccucaagacagucaggauucuggcuagcaaacucuugccacugauggaugcuguagugcuuauggauggcagugaacagggagaacugaagagaaaaaagaaccauuaaaagggcagagacuuuauuaggcuaucgagauauagcuuuguacugccuggaaagaagaacaguauaaggaaguucaugguugagcugacuccgaccacuguuaguccuacaaucccaguacagccuuuacucucauuagcacuugucugguauuccuaccaaaguacuguggcccagguuggauuucaccuucuagcacauuuauuguucaugaccuuaaaagugguagggacaugcucuugauaccguaaaacaaguaacagggcuggaagaacuaaggaggauaaauggagagggaacuaaagaggauaaauggagagggaguuugucuucacucagcuccaagaggauccaguucucaaucuguuuuucucucuuuugauuuccuggcuggcaguaauccaacaagucacacacacaguuaaaagcuuaagacuaaggcuggcgagauggcucagugguuaagagcgcugacugcucuuccgaagguccggaguucagaucccagcaaccacauggugacucacaaccauccguaacgaaaucugaugcccucuucuggagugucugaagacagcuacaguguacuuacauauaauaaauaaauaaaucuuaaaaaaaaaaaaaaaaaaaagcuuaagacuagcggagcaacaaaauacuauugcaaccauucucuuuuucugcuggaaaagaacagauuuuccauguuagggacauaaacaugcaaauaucaauguuaucuccuaggcaaauuuaaaaagacugauucucuggcagugguggcccacaccuuuagucucagcacuuaggaggcagaggcaaagagagccugaucuacaaagcaaaguuccaggacagccaagguuauacagagaaacuccgucuuaacuaaauaaauaaaacuucugacuccugaaauugcaaauaucucaauauucugaggaagguacugagaaugcuggcguuuuugcuuucuauaugugcaaccccaagagucaacaggugguugaaacagcacagauuuuacaagugagaagaaacacaaggaagucauguaucagccagccacagggaguucuaugcauaaaagcugguauucugcuuucucuguaaaaaucaacugucaacaaguucauaaaagcuaugguggucagcaggucuuagagauauguugcugugcuaaguucaccuaauccauacaaaccccaagaaacacuuuuuuuuuuuuuuuugguaucuaauuuauuuuuuuaaucauuauugagacuuggcuauauuucuaaaauuugguuucuguaguacuuguccacaguauugaaauccauuucccaguaagguucaugaauuauagcaugccuuuuuaacagauuugccaauuccccaaauccaccugucagagaagacagacaagauaauagccaaaacccugaagaauuaguaaaugguaacaggaauaaaguaauaaaacuccauaauuaucaaucucagagaaagcacaacaaacauucuacaaaaacagaaaaacaaacaaacaaaaacccaggucuuuaaggccaacagccacaaacagaaacagaacccaccaacuagggauacuaggauuaaucagcaaagcacauuauguucucaaaagugcccaggcaacuaucuaccuucucaacuacaugcauagaggcaagugauauuacugucaggagcagugucuuccauuuucaaagggaacaaucuguauuuaagaacaaaacuuccauuugggauagaucucagaaacucccaggaaccuaaaagaaccuuaaagaagugaaaaauuaaaauaauaguaggcauacaagaaaacuaauaaacuccuuuuuucuguaauaucccagguugaaaauuuuuaaauacucaaaacaguauuuaauuucuggacuaaacagugacugcuuaauguucaaacaaugacugacugaagaaaugcaugugcuuggguugaccugggugggcacuggaagaauuugguaaaguauauaauuuaugggagauuauaauaaaaaagaugaaacagaucuaaauuugaaucucacuaguucagacagaucuuugaacugaucaaaugguucuuaguaauggaaaaaaaaauaguaaacacaacauucuguuaauugccagagacugggaauacagaugcaauuccucuguagccgcuagcugggagaagaucugguagggggcauaagguuaaucucaccuuacagagaacccuagccauuucaaaagugcccacgguauccauauuggcagcaaugacagggaugccacuguacaucugcuuugaguuccggaacgaaaaugaucuugugagcucuaccugcagacauuaagaggacauuaagauuucauucauucagaaaauauguaucguucucgaaccugacagcuuucuuggaccugguccauuagaagcuugagguaaaaauaaauaaauaaauaaaaaccaaggaagacaacuggcucaccucacuucgagacuuaagagugcugcguuugggccucaacaggacauccuugaagucaaguuucacaucauuaucaauaugaggcaugaugcaaagcuggaguuagauuuaaaaaaaaaugaggcuguaagacugggaaguaacaaaguucgccucucacgcuuaaacuguguaaagucagaucagggugugguucuucaagucucccugggaccauccagugucuggauuauccuaaugcuucaaucccagguaugauuuuuagggagaauugggaagagauuaugguuccugaaggugcuuccuuaccuaguuacucucccuuuuuucgccccugcaaagggcaacuuagaguaagaagcuaacuuagggaugagaaaagagauuuuaaccagcuuccggcauagcgguacucacuuccuguugcuuugacucagguggcaguugaccaaagauucuuuugcuuagcaacuagccgcgugcagccucgaugagccuucagggccacucgaacgaguuccgcuaauugcaaacucgacuacccaaggaauucuagcuucgggcgcugugcaaggccuucuggguaacagaguccacacacucaagcugccguugagugcgagcggcagaagaacuacaacuccuaggaugcaaaggacagagcugccuccaggcaugaugggacaaguaguuuguuccguuccagcucgccgcuaacaccaguucgguggccacgcgcggggucucagggcgccgucuggcuguuccuagccgacuugccuuucucuuuacaaccccacugacacagaacacgagggcacuccugagcguuucgggaacccgguggaaagaggagagggug

SEQ ID NO: 7476 - RNA, 7134 nt, Mus musculus
uaagauuuauuuauuuauuauauguaaguacacuguagcugucuucagacacuccagaagagggcaucagauuucguuacggaugguugugagucaccaugugguugcugggaucugaacuccggaccuucggaagagcagucagcgcucuuaaccacugagccaucucgccagccuuagucuuaagcuuuuaacugugugugugacuuguuggauuacugccagccaggaaaucaaaagagagaaaaacagauugagaacuggauccucuuggagcugagugaagacaaacucccucuccauuuauccucuuuaguucccucuccauuuauccuccuuaguucuuccagcccuguuacuuguuuuacgguaucaagagcaugucccuaccacuuuuaaggucaugaacaauaaaugugcuagaaggugaaauccaaccugggccacaguacuuugguaggaauaccagacaagugcuaaugagaguaaaggcuguacugggauuguaggacuaacaguggucggagucagcucaaccaugaacuuccuuauacuguucuucuuuccaggcaguacaaagcuauaucucgauagccuaauaaagucucugcccuuuuaaugguucuuuuuucucuucaguucucccuguucacugccauccauaagcacuacagcauccaucaguggcaagaguuugcuagccagaauccugacugucuugagguaacccugggccuacccugcucauuaguuuuccaggaauccuuuuuuuuuugggggggggggcucuuggaauucaaccuucccuauuggccacuuacuaccucauuucugaugcaaugccgcggguugucugaugcuuucuccacagugucuagcugccagcucaggcucaggcucugcugacuuugagcagcuggaacagauccuggaagcuauuccccaagucaaauauauaugccuggauguggcuaacggcuacucugaacauuuuguugaauuuguaaaggauguacggaagcgauucccccaacacaccaucaugguaaguuucuacauuuugcuuuguugagacaaggcuucuguaucucuagcugccuugaaucuaacucuauagaccagucugaucucaaacucagagaccugccugccucuggagcugggauuaagggaugcaccaccacacucuauuaucauuacuuuugucuccucuuuccugacguuucauguuguuauaucaguacuuggucucugcugcaucaugauauuucuauucuacauguuacugucaugauucaaaauucauaguucauuaaucaaggacuuaaaaaacauggaacauuuacaaacguuacccauaccuguuguacauacgucugucuacugaagugguccugugcuacaauugaaaguguuacgugaaagccugacauugauaccuaucuauagucccaguacuugggggauagaagcaguucaagaccagcccugaguuugucucaaacuaacaacaaaaagcaucauauaaaacuauuguuuuauuuuuuagaagcuuauuagagauaaaauccaaggcuucauuuucuucacagcauugaaggggggugucgcacuguccacauucuguugggcagauggauauuuuaacccacauuccugugacuguccauguuuuucaagguagagagcuucaggacugggcagcaguccccuaguaaugaaagggcacuacugucgaucugagugggguuucugacucaacaacugcucuuuaaugccacuuuauaucuuguugcccaccuugcugccuuaaaggucauucugguccuguuuuuacccuagacaauguuguuuccucuauccuucacacuaagucaaaguauguaugugggaugggaaggguaacugggaaucuagguccuuuggaguugguggaaaguccugagggcucuagguacccuuuauuuauaauaggaaggucacaguugaggcauggauuauaugaaagcacaaaagcugcucuccaccaccgacccuaagagugcucuguuuugauuauugucucaggcaggaaaugugguaacaggagagaugguagaagaguuaauccuuucuggggcugacaucaucaaagugggaauugguccugguaagcugguuccuugggaccaucgucucaucugucccguuggaggcaaaaccauaggccaguuuacucucaccucugucccucuucccaggcucugucuguacaacucggaagaaaacuggagugggguauccacagcucagugcagugauggagugugcagaugcugcucauggccucaaaggccauaucaucucaguaagacucaagaccuggagaggguuuguggcugcccagcagccacuguuuucuguaggguggggcucuggugaaguccuggucaggacauuaguucuaguccuuugacaugggcaguugagaagucuugagaaaucuaugcugucucucacagcauuccuuacuuuguaggauggaggcugcagcuguccuggggauguggcaaaggcuuuugguaaggagacugggagggcacggcaggaagauccuguagaagauaaaucaccucugagggucuaagggcaagaugucaagcuagacacagcugaaggagccauuuagaaucauaauauaaaccagugaccuccucaggaaccuaaagugucaccugggaacaagcaaucgaggaaauccugagauuuugacccucccaagcguaagccagagccauuuaugacaugcccuagauugaaaauguagauugcuaaacccuguaucuaaccuacaaaaucacccugaggaacagaacuacaaauauucauuuuucuauucccaaggugaucuuuauaaaauuuggagaccuauugucuuagaaccaaagucauacugagcugggaacuguaaaaugaagauuggaaaagcagaagccagucagggaacuucuaggucuuuaaaacucuuggggaaguuagucccacuggggaccagaggccagaguagaggcagucucaaggaacuuggaucagcuaugcaaacagacccagcaggaagugagacucacacaagcuguuuuuuugauggugccuuuauagguaccucggccagaugcaucuuuuucaacuucuuguuuuuggcaggggcaggggcugacuuugugauguuggguggcaugcuggccgggcacagugaaucagguggcgaacucauugagagagauggcaagaaauauaagcucuucuacggaaugaguucugaaauggccaugaagaaguacucaggagguguggcugaguacagguauguguggaaggcuagcaccugaauguuccuggugacgacucuaugaaagauguugucauacccucuggggaauguacgguaucacuccugagagaaaaacggugaagggguauaaaugucagagacaggaugaguaacugggcuuaaagaguucugcaggaggagguaauaaaaguuuuuguuuuccaagggccucagagggaaagauaguagaaguccccuuuaaaggcgauguggaacauacuauucgugacauccuaggaggcauccggucuacaugcacguauguaggggcugcuaaacugaaggaacuaagccggagaacuacuuuuauccgagucacccagcaagugaauccaaucuucagcaauucccaguagacccaagaagccuacuuuccugaggcagcagcacugccacuggagccucccgacagggcgugccucucccacugcagccccuguggugguggcugccuaauucaguuccagcucucacucuacucacccaugccucuagcugcacaauguuauggcacuacgggagaggcgaggaaggagacgugagaucaacaaaugagacccuggggacagcccccgaagauuaggaagaugcuaauccacacagaaauggcagcccuuggucuggaaagggaaggcugcgggaaucauguuaagcagcuucauuaaaugacaucaucacgugucuaaacagcuuagacguucuucuauacuugaaacacucucauacagauggaugcugggcuuccagcacaggcuggcaucuagaugcuccuccugggauugacccugacccaguaggauccagggaaaugaauguuauucucaggaagcagcgacgccagccuaagcuaacuugguagcaagcaaguuuacaaaguguauucuggccuuagggaugacuguuaggauggcauaaggacaguuucccuuccaggcucucucaacccuucuauguaaaucuaaacucuugccaaaggaguaaauaugagaagggccucaaccagcuaagagaagccuguuauguuucggaggaaugaccuacacagaccuaugcaagucuuuauuccccuucuucccaucaauagugaaacaaaucaauauuuaauuuucaagugcuacaaagcuuucagcaauguagccaggcaacucaagucuggacuuccucuucuuuuccacuaaauugcaugcagagcugcagcagaagauggacagagugcagagaauauuccagaggaccugagugagaaccguuuagguagccagaaaggaauaggcaggacacuacgggauguagucacaaaacauggggauauaggugucaaacuucgucuucugguaguuuuucaaaaacuccuauagagaagaaagcauaauuccuauaacugggaacacuucacauguaucccugccuuguucugcccgcccucuggcuuggcuuucugcuucuucccacucaccuucccuuccuucugguuauuuucuuccucaucagaguccaaaaccaaguccccuaugguaauaacagagcuacacgggguuggggacagcacugcaggaaagaaaccacaauuaaaaccucuuucuuagccuagcuugguggcccacaccuuuuaucccagcacucuggaggcugaggcagggggaucucugaguucaaggccagccuggucuacauaucaauuuccaggacagccaggguuauguagaaaaaaccugucucgaaaaaaauaagcagaaacaaaaccuagacccacuuuuaggugagcacaggccuuggaaagucccaacgccgucugguccaaagcuuaccugguuucuugacuguaagaggcggugaugagugucuuagaggauccacgcaauucacacuguuccugaggugaaggcaaaggaaagguugggugaagaagggaagcaggcagggaaaguauuccuaaggaaggagaagagacccuuacuccugcucugcagccggugagucagguggggucuccucuaaugcccuuuuccccaaaggccgagauggagucuuagccuccuccgugcagacuggcucuguucccacagaagcugcugaggccgcaccggguucuucccugcuuuuaggguuagauaagucuugagcugguaagcccauguuccuaaaugggaguagcaugacugugggccgcucuuuauggcacgccuuugccgauguccaaugugaucgggauuuucgcuuucccaaaggggccagauuaaagcgguggccagcuaaguguucugggugcuccagugaagcuggcuggugagggccaagcuuagcuuuaggcagaggacuguggaaugcuggccugguuugcugaugaggacucucuuccaugggcucuaucagauucccugagccagaaguagagcucucugaaagauaaaauaagaugccuuauaaaauuagaacuagguuaaaacucagguuuguguuacaggcccauauaacuuccauucggcugacucagguuugguagagcuaaacacuaaccuccaaauugcuaguuaucuccgcugauccucuuaccuggaaauguccaccccauguccauaccauacuggugcaaagcaaccgaagaagugaugaacgagcccggcugacuccaacuuagagcauccugaagcugugggcaaggcgacagauaggaagaucauaguucucggggaagccacccagccuuccgcccuuaaaguguuucuuucucaacaaccucuugugcucugacuggaggcagugcuuucucuagcugacacaaguauucaaacaacagcuuuuccauggcaacuagaaaggauuccccauagucuuguucuaguuccuguaugugggaaagugaagcaggucagaugaauuuuagaaaacaaaacaaaacaaaacaggaaucccauaacauccuccaaaccaaccauucucaccugcaggcucgaaggcggguccucugacaggugcuucacaagcaagcaaaaauuuucccgugccuccaaaagcuuccugucuucuuuugucuguugaggauauugaagacaggaaaauuugggugaggaggugucgcuaggacccaggggcaacuugguugcaucaggccugaguuuggucugcccaagauagcacucacagcuucgggguccagugguacuuacuguucuggacucugcugggaagugaugcuucagggcauucaggaccuggucccagggucgcgccugcaggaucagcuccaccaccaccugcacgguacagggcucagaacaccuacccuuuuccagccgaucuuagucccaaccagacguccuucucucuaguaccuuggccuuuaggcucauacacaggcguucauggugccgguagcaaaccaagccgggggcagcagcgcgcaaggacugcagaaacuccaccacuuucgggaagugcucuacgcggcgacggcggacuaccagccagcuggcggcggcagcaaaccgcagagacgcgggaccuaccccuggagguggggccauggcccgcgggcgcccuuuccuccuuucguucaacccaggcuucccggacgcucccguaggcggagccccgcuucucucaucugcaccggaaggucggcggaccagcugggcccauuucgcggagccacgggaaccccgcagucuccucucaggcggugacuuaaguguaucaaccuguccagaucacuaaacuuaaaaugccgccacugagggaaacgcaggaguacgucacuuccgccu

SEQ ID NO: 7477 - RNA, 7134 nt, Mus musculus
aggcggaagugacguacuccugcguuucccucaguggcggcauuuuaaguuuagugaucuggacagguugauacacuuaagucaccgccugagaggagacugcgggguucccguggcuccgcgaaaugggcccagcugguccgccgaccuuccggugcagaugagagaagcggggcuccgccuacgggagcguccgggaagccuggguugaacgaaaggaggaaagggcgcccgcgggccauggccccaccuccagggguaggucccgcgucucugcgguuugcugccgccgccagcuggcugguaguccgccgucgccgcguagagcacuucccgaaagugguggaguuucugcaguccuugcgcgcugcugcccccggcuugguuugcuaccggcaccaugaacgccuguguaugagccuaaaggccaagguacuagagagaaggacgucugguugggacuaagaucggcuggaaaaggguagguguucugagcccuguaccgugcagguggugguggagcugauccugcaggcgcgacccugggaccagguccugaaugcccugaagcaucacuucccagcagaguccagaacaguaaguaccacuggaccccgaagcugugagugcuaucuugggcagaccaaacucaggccugaugcaaccaaguugccccuggguccuagcgacaccuccucacccaaauuuuccugucuucaauauccucaacagacaaaagaagacaggaagcuuuuggaggcacgggaaaauuuuugcuugcuugugaagcaccugucagaggacccgccuucgagccugcaggugagaaugguugguuuggaggauguuaugggauuccuguuuuguuuuguuuuguuuucuaaaauucaucugaccugcuucacuuucccacauacaggaacuagaacaagacuauggggaauccuuucuaguugccauggaaaagcuguuguuugaauacuugugucagcuagagaaagcacugccuccagucagagcacaagagguuguugagaaagaaacacuuuaagggcggaaggcuggguggcuuccccgagaacuaugaucuuccuaucugucgccuugcccacagcuucaggaugcucuaaguuggagucagccgggcucguucaucacuucuucgguugcuuugcaccaguaugguauggacaugggguggacauuuccagguaagaggaucagcggagauaacuagcaauuuggagguuaguguuuagcucuaccaaaccugagucagccgaauggaaguuauaugggccuguaacacaaaccugaguuuuaaccuaguucuaauuuuauaaggcaucuuauuuuaucuuucagagagcucuacuucuggcucagggaaucugauagagcccauggaagagaguccucaucagcaaaccaggccagcauuccacaguccucugccuaaagcuaagcuuggcccucaccagccagcuucacuggagcacccagaacacuuagcuggccaccgcuuuaaucuggccccuuugggaaagcgaaaaucccgaucacauuggacaucggcaaaggcgugccauaaagagcggcccacagucaugcuacucccauuuaggaacaugggcuuaccagcucaagacuuaucuaacccuaaaagcagggaagaacccggugcggccucagcagcuucugugggaacagagccagucugcacggaggaggcuaagacuccaucucggccuuuggggaaaagggcauuagaggagaccccaccugacucaccggcugcagagcaggaguaagggucucuucuccuuccuuaggaauacuuucccugccugcuucccuucuucacccaaccuuuccuuugccuucaccucaggaacagugugaauugcguggauccucuaagacacucaucaccgccucuuacagucaagaaaccagguaagcuuuggaccagacggcguugggacuuuccaaggccugugcucaccuaaaagugggucuagguuuuguuucugcuuauuuuuuucgagacagguuuuuucuacauaacccuggcuguccuggaaauugauauguagaccaggcuggccuugaacucagagaucccccugccucagccuccagagugcugggauaaaaggugugggccaccaagcuaggcuaagaaagagguuuuaauugugguuucuuuccugcagugcuguccccaaccccguguagcucuguuauuaccauaggggacuugguuuuggacucugaugaggaagaaaauaaccagaaggaagggaaggugagugggaagaagcagaaagccaagccagagggcgggcagaacaaggcagggauacaugugaaguguucccaguuauaggaauuaugcuuucuucucuauaggaguuuuugaaaaacuaccagaagacgaaguuugacaccuauauccccauguuuugugacuacaucccguaguguccugccuauuccuuucuggcuaccuaaacgguucucacucagguccucuggaauauucucugcacucuguccaucuucugcugcagcucugcaugcaauuuaguggaaaagaagaggaaguccagacuugaguugccuggcuacauugcugaaagcuuuguagcacuugaaaauuaaauauugauuuguuucacuauugaugggaagaaggggaauaaagacuugcauaggucuguguaggucauuccuccgaaacauaacaggcuucucuuagcugguugaggcccuucucauauuuacuccuuuggcaagaguuuagauuuacauagaaggguugagagagccuggaagggaaacuguccuuaugccauccuaacagucaucccuaaggccagaauacacuuuguaaacuugcuugcuaccaaguuagcuuaggcuggcgucgcugcuuccugagaauaacauucauuucccuggauccuacugggucagggucaaucccaggaggagcaucuagaugccagccugugcuggaagcccagcauccaucuguaugagaguguuucaaguauagaagaacgucuaagcuguuuagacacgugaugaugucauuuaaugaagcugcuuaacaugauucccgcagccuucccuuuccagaccaagggcugccauuucuguguggauuagcaucuuccuaaucuucgggggcuguccccagggucucauuuguugaucucacgucuccuuccucgccucucccguagugccauaacauugugcagcuagaggcaugggugaguagagugagagcuggaacugaauuaggcagccaccaccacaggggcugcagugggagaggcacgcccugucgggaggcuccaguggcagugcugcugccucaggaaaguaggcuucuugggucuacugggaauugcugaagauuggauucacuugcugggugacucggauaaaaguaguucuccggcuuaguuccuucaguuuagcagccccuacauacgugcauguagaccggaugccuccuaggaugucacgaauaguauguuccacaucgccuuuaaaggggacuucuacuaucuuucccucugaggcccuuggaaaacaaaaacuuuuauuaccuccuccugcagaacucuuuaagcccaguuacucauccugucucugacauuuauaccccuucaccguuuuucucucaggagugauaccguacauuccccagaggguaugacaacaucuuucauagagucgucaccaggaacauucaggugcuagccuuccacacauaccuguacucagccacaccuccugaguacuucuucauggccauuucagaacucauuccguagaagagcuuauauuucuugccaucucucucaaugaguucgccaccugauucacugugcccggccagcaugccacccaacaucacaaagucagccccugccccugccaaaaacaagaaguugaaaaagaugcaucuggccgagguaccuauaaaggcaccaucaaaaaaacagcuugugugagucucacuuccugcugggucuguuugcauagcugauccaaguuccuugagacugccucuacucuggccucugguccccagugggacuaacuuccccaagaguuuuaaagaccuagaaguucccugacuggcuucugcuuuuccaaucuucauuuuacaguucccagcucaguaugacuuugguucuaagacaauaggucuccaaauuuuauaaagaucaccuugggaauagaaaaaugaauauuuguaguucuguuccucagggugauuuuguagguuagauacaggguuuagcaaucuacauuuucaaucuagggcaugucauaaauggcucuggcuuacgcuugggagggucaaaaucucaggauuuccucgauugcuuguucccaggugacacuuuagguuccugaggaggucacugguuuauauuaugauucuaaauggcuccuucagcugugucuagcuugacaucuugcccuuagacccucagaggugauuuaucuucuacaggaucuuccugccgugcccucccagucuccuuaccaaaagccuuugccacauccccaggacagcugcagccuccauccuacaaaguaaggaaugcugugagagacagcauagauuucucaagacuucucaacugcccaugucaaaggacuagaacuaauguccugaccaggacuucaccagagccccacccuacagaaaacaguggcugcugggcagccacaaacccucuccaggucuugagucuuacugagaugauauggccuuugaggccaugagcagcaucugcacacuccaucacugcacugagcuguggauaccccacuccaguuuucuuccgaguuguacagacagagccugggaagagggacagaggugagaguaaacuggccuaugguuuugccuccaacgggacagaugagacgauggucccaaggaaccagcuuaccaggaccaauucccacuuugaugaugucagccccagaaaggauuaacucuucuaccaucucuccuguuaccacauuuccugccugagacaauaaucaaaacagagcacucuuagggucggugguggagagcagcuuuugugcuuucauauaauccaugccucaacugugaccuuccuauuauaaauaaaggguaccuagagcccucaggacuuuccaccaacuccaaaggaccuagauucccaguuacccuucccaucccacauacauacuuugacuuagugugaaggauagaggaaacaacauugucuaggguaaaaacaggaccagaaugaccuuuaaggcagcaaggugggcaacaagauauaaaguggcauuaaagagcaguuguugagucagaaaccccacucagaucgacaguagugcccuuucauuacuaggggacugcugcccaguccugaagcucucuaccuugaaaaacauggacagucacaggaauguggguuaaaauauccaucugcccaacagaauguggacagugcgacaccccccuucaaugcugugaagaaaaugaagccuuggauuuuaucucuaauaagcuucuaaaaaauaaaacaauaguuuuauaugaugcuuuuuguuguuaguuugagacaaacucagggcuggucuugaacugcuucuaucccccaaguacugggacuauagauagguaucaaugucaggcuuucacguaacacuuucaauuguagcacaggaccacuucaguagacagacguauguacaacagguauggguaacguuuguaaauguuccauguuuuuuaaguccuugauuaaugaacuaugaauuuugaaucaugacaguaacauguagaauagaaauaucaugaugcagcagagaccaaguacugauauaacaacaugaaacgucaggaaagaggagacaaaaguaaugauaauagagugugguggugcaucccuuaaucccagcuccagaggcaggcaggucucugaguuugagaucagacuggucuauagaguuagauucaaggcagcuagagauacagaagccuugucucaacaaagcaaaauguagaaacuuaccaugaugguguguugggggaaucgcuuccguacauccuuuacaaauucaacaaaauguucagaguagccguuagccacauccaggcauauauauuugacuuggggaauagcuuccaggaucuguuccagcugcucaaagucagcagagccugagccugagcuggcagcuagacacuguggagaaagcaucagacaacccgcggcauugcaucagaaaugagguaguaaguggccaauagggaagguugaauuccaagagcccccccccccaaaaaaaaaaggauuccuggaaaacuaaugagcaggguaggcccaggguuaccucaagacagucaggauucuggcuagcaaacucuugccacugauggaugcuguagugcuuauggauggcagugaacagggagaacugaagagaaaaaagaaccauuaaaagggcagagacuuuauuaggcuaucgagauauagcuuuguacugccuggaaagaagaacaguauaaggaaguucaugguugagcugacuccgaccacuguuaguccuacaaucccaguacagccuuuacucucauuagcacuugucugguauuccuaccaaaguacuguggcccagguuggauuucaccuucuagcacauuuauuguucaugaccuuaaaagugguagggacaugcucuugauaccguaaaacaaguaacagggcuggaagaacuaaggaggauaaauggagagggaacuaaagaggauaaauggagagggaguuugucuucacucagcuccaagaggauccaguucucaaucuguuuuucucucuuuugauuuccuggcuggcaguaauccaacaagucacacacacaguuaaaagcuuaagacuaaggcuggcgagauggcucagugguuaagagcgcugacugcucuuccgaagguccggaguucagaucccagcaaccacauggugacucacaaccauccguaacgaaaucugaugcccucuucuggagugucugaagacagcuacaguguacuuacauauaauaaauaaauaaaucuua

SEQ ID NO: 7478 - RNA, 30367 nt, Mus musculus
cucuccaucaccccugcaagcuguaaaccuaggugucugaaucagcgucugccaagcccuucccgggccgccagccgcucccaggaaaaauucugccauuccucucgcgaaacagaagagggcgcucgcucguuucaaaaaaccaaacacaggccugagugguaacuccgcccuccuguccugacucgccggugccuaaacgaauauaguuugaaauauccuagggcuagucaggguucuccuggacaguaggaugacagccguuuuaugcuuuucugugccacaucuuugcuguuucguguaguuuauaauauuuaagggcuuccuuuuccaaguuucuuuugagcacuaacuugauggaguccuuuaguggguugacucuucuugcucuccccaaggacagaaccgggcacacuguguacagcuuuacuuuguugcuuaaauuaauuaucugccuugcccaccuugcaggaauuuuaugaaaccugcccauuauuugaaugguuuccuccauucccagacucauggcucacacuuugccuugguucuccagaucaguauucagagccuuuccagacccaguaccaaaguacuacacuggauguuaauguugaaguggguuuucuucauauuuuuuucugucauuucugaccuuaccacuuucauuuuuucuuuaaagauuuauuuauuuuauguaugaguacacauuacucucuucagacacaccagaagagggcauuggauccccacuacagaugguugugagcuaccaugugguugcuggaaauugaacucaggaccucuggaagagcagucggugcucuuaaccgcugagccaucucuccagccccacuuucauuuuuucuaaagaauuuucccacagagugugcuggugcacaccucuaaaucccggcgugagaugggguuuuuuuuuuucccccuuguuuucaguacuguaaauacuuuacucccuuguugcuugcaugguucuggguagaaguccaaucuaguuacacauuguuuuuaaagcugagaaauuaauuuccuuuuuaaagcuaucauguauuaauuuaacucuuuugauacuuuauuuuuauuuaauguggaccaguguuuugucugaauguaugucugugaaccauguguguggagugcccauggagggcaggugaagauuuaagucuccugggauggagguuacagagggggggggggcaugcacagguaaagacagaacaaguaagaacaugagaaagagccagaagauuagaaaagauugcuaaaguuaguuugaggucaaacagcaauucagagaagccagauugaauuagucagcugggagaagaguuugagccagaacagcugaguugaaccagauggacagaagucagaaagaacuaaaaaggggcgaguuuauucagcaauaacucuggggugguuugaauauucuuggcccagagaguaaguggcacuauuaggaggugugccuuguuggaguagauguggccuugucggaagaagugugacacuguggugggcuuugagacucuucuccuagcugccuggaagccagucuucuccuguuugccuuuggaacaagauguaaaacucuuggcuccuucucuaguaccaugccuuccuggacacugccaugcauucugccaugaugauaauggauugagacucugaacuuguaagccaacccugauuaaaaguugucccuuauaagaguugccuuggucauggugucucuuuacagcagugaaaaccuaacuaagaaaaucucagaggcugaaaaccuuccaggccuagauuagauaguuuggaggcuagacgcuuccauacaaggccuagauuagcagacagagacagguaaauaaaaacuacuguuacacacagugagacuagaggaugaagaaauguuuggagcaaugacuaagaagugucccaaaguaaugauagauacuacacuugaucuuagccaaaaggcugagaagcgauuaaugauagauacuaaacauagauccagaaaacucagaauagcaagcagaacaaauaccaucacaaacacagagcugagugauacucaaccugcacacacacacacacacaaucacaggcaaaaacaaaagugcugaaacuaguaggaaggaaaggaugaaauuagaccagagaacacugucuaauggccuucaagguuaaggauuaaguuaaggggggcuggagagauggcucagcaguuaaaagcacaggcugcucuuccacagacuugaauucaauuccuagcaccccuacugcagcucauaacuguaacuccaguuccagggacucugacacccucauuucagacauacauguagacaaauaacaacgcacauaaaauaaaaauaaauacaguauuuuuaaaaaauuaaauuaaggggauggagggauagucccacaguuaagagcacuaacugauauuacagaggacugagguucaauuccacaaacucuaauguauuccguuacuguacucucuucuuccuguacugucugucucucucucucccuuaaguagcuuuccuuuccucucucuucuccugagaguugggcagauuguacucugucagauauuucucugauccaucauuuugucugccacucaauuaaacuguuuucaaauaugacuguuuccuucaacaaacuaacuuugccuugauuauuugggauugaagguguguaugaaggguugucuguauuccagccagagggauuaaaaguguguacuaagggcugagccacaccacagcuagaaacagguucaaauauccuauaacaaugugugucuguguugaauggacuuuccugggaaggugaaacagcagcugcuuaucccgaauaggacaaugacagaccaaaguaaugauccuacccaagugugguuuugugaaccaguagguaucgccuucaggcauguagguggcccccaaacaacaugccacuaaaaagacucaucuuuccaugaaugacaaguucucuauagcuguagauggagaucucuuuccaguuaaucuuccacacucuauacuauuauuucuaaggagcacgugaaguuagggcccaauuacacacagcuaggacagagguucaggagaguggccggaaucucaggcaagggucucaggacucuuuccccuacuucccuggaggaaugugaacaggcugcacccagauggcucuuacagguaucuuaugguaagcugcucugguuaagauggugauggcugggcuggagagaugucucagugguuaagagcacuggcugcucuuccagagguccugaguucaacucccagccaccacauugguggcucauagccaucugugaugggauccuaugcccuguucugaagacagcuacaguguacucacagacauaaaauaaaucuuuaaaaaaaaaaagaugguaguggcuguucugcucagcagacagcauuucacaacaguaugcuguaccauuuguaguuuaacacuucuuggacauuauaucuuuuuuacuuuccucuauuguuugcauuucaguuuuggaaucauuuccgcuuuuuacaaaaguucuuauacaucccaacgucgccucaaacuugcuauguagccaaggguaucucaacucccuauccuucugccuucuaugucccgggugcugagauuacaggugugcaccaccacucuuggcuuaugugguauuuugugcaugcuugguaggcucuugcaugagcccuagcuuuggaaauuuucauugacauugauuucuucaagcucagaggcucaguuauucuccccaggaaaaguucaugccacacauacacacaauaagaauagaugaugaaguaauguuugaagcaacugugguucuccuucuccuggggguuggguggggagggucauuggccccuggcccgaggacagaggaagcaagagcagagaacagguucagacgacugagacagcuuccgugagacaagucuaguuuauuguuccaggguuaggguauauaagggcucuuagggcuaagaguggagagggccgauugaucguaacaccguguguaauuaucacaagggcaggaaguugugacuugugugcucagucaugcacggggucauucuucagaugaggucacucugcucagagauacucuccaaauaaaguuaggcagagaaaggggagcccugaugagaaagggacuccuccauuuuguauagaguucagagagcuaucaggacaugguggcuugaaaccuuaauagcaggguucuucaacagcaaugacugagaauuguccauaagcacagacccagaaaacucagaauagcaagaggagccaaggcacucuuugucccaguaccaguguuguuuccuuccaguucuuccuuagaauucucugugcacauuaccugccuggucuuccagcucguccacuuuuccuguuagaagccagaguauaguuuuuuguuuuuaauuaauuuauuuuauguauaugagaacacuguagcuguacagaugguugugagccaugaugugguugcugggaauugaacucaggaccuuugcuggcuugcuccagcccaaagauuuauuuauuguuauauauauauauacuauagcugucuucagacacgccagaagagggugucauauggauggcugugagcuaccaugugguuguugggauuugaacucaggaccuuuggaagagcagucaguacucuuacccgcugagccaucucuccagccccagagcguaguuuuaaaguuuuuaguauaauaauuccauuccauuugccaugucugagucugguucuuaugcuugcucugaaaauuuaaaguuuguguguauguuuugcuugggguuuguuuguuuguuuguuuuagcgugccaaagaauuuuuugugggacuucagaucuucagaugugccaauuaaagaaacugaggaaaucaguccuuagucugcgagguuuuuguuuuuauuuggcuagagguuagguuguguuuaguguauguugcagcuguagauguuagacuaaaauuccucuaguacuuaguauugacacauugcuugucuuuaauguucuuuauagauuucuggcggaugccaugcaggaaaagcugaaguaggcaacugagcucccuggagauggcccuccaucuugcuugacuacaaugggugcucucuggugagucauggcacgagagacuucaucccaggauugcuucuugcuacuaaugugcuuucucauguuugucauugccauaauccucguuuauuuggcuuggugugaguggacucugggagacccucacugccuauaaccuggugugauuaccuccugggagauagcccaucccauugggcaaacuuccuacaggucaacaugaagaugaacuuucaugaauuaaugcuguuuagaugaauuaauggcuuaauagcauuccugacuugauuaaaauaauuuuaagaagaaagucuaaggagauaguuuuaguuguuuugccagaaagaugcaagaauaagauguuagaaucaagacuagaaugugcccccuccucauagaauaguaaguaaaggccgcauaauaaggaacacaaugagcuuuuauaaacuguacuaagaagacaaauaggcuugagacagauuugugaucaaggaaaaacauuaguucuaggucagguccaaggaugcagccacaggugugcaccaugguaaaagaaggccaugugaaacuguugcuuugaacuuauaaugagguuauaaaugaaacacugcuuugaacuuacuaucaacuucuguaacuuuccuuuguguaacauuuuaucugugagguacuuuuuuuuuuuuuuugugagguacuuuuauaaagaacuuuuguccaagaagguauaaaaaggcugagagaaaaaaaaaguguggcuguugggucucugcuccauucaccaaauguauaugucucuaugucugucuauauuuaugagcauacauauguauguagguauauguguauauuuaugagcauacauauguauguagguauauguguauauuuaugagcauacauacguauguagguauauguguauauuuaugagcauacauacguauguagguauauguguauauuuaugagcauacauacguauguagguauauguguauauuugugagcauacauacguauguagguauauguguauauuuaugagcauacauacguauguagguauauguguauauuuaugagcauacauacguauguagguauauguguaugcauguguggaauguuaagacugcuaauccacucuucaagacuggggaggcauaauuccacccaccccaacauucuggagccccaaaagaaagacacaaaugugcagaauuauuuuuaauaugccugaacuagcuuaaugguugggccacuccugaaccuccauguggcuaacacacucuccuccaguauucuugaguuauuacuuucgaaaaccuauacuuuaucuuugcuacccaaggcccaaugggagauggccccugaggcugcuuuucccugaguuuucuuccaugguugggucucugucuuccacagcccucauguuuguauccucuuccuaccuucugcccuggcgauucuccuucaccuuguccaguguuuucucuccauaaauccucaaaguccccacucuguccaccugcccagccauuggcugcuggcucuuuauugaccagucaaaaaaacaacuguugacagggacccgcaguggacgugcaaauuccuguguaagcacaaaacaaaaccccaacauuugugcacuugugaaauugaugaaacauguggucaggcgcagacaaggugugugugugcgugugugcgcgcgcgcacgcacauguauaugaccuucucucuauccguuucuuuuccuucggcuucuucaggguuucucuccaggcauucuugcccaccccagauaauuaaauuuuguuccauuagcagugcuaaucccauaaauuguccacugcuaucagcagacaccacccaaaacccauccacugauagcugguauuagccgcaacuccaauuucagacgccccaccucccugccugccuugguuuccccuuuagugucaaaacugaucuuuggcagauuuucuuuucgcuguuuuuuucccuucuuuucaaagauugauuuguuucuauuuuauguguauugaguguuuugccugcauguacauaugugcacacgugcaugccucgugcccgugaaggccagaagagggugucugauccuuuaacugcagucacagacuguugggaaucgacaugugcugugacguguguaguuugacauauagaauugacauguguugugacguguguagcuugggguuuugguuucuuuguucuuuucuuuucuuuucuuuucuuuucuuuucuuuuuuucuccguuuuuuugagacaggauuucucuguauaguccuggcuguccuggaacucacucuguagaccaggcuggccucgaacucagaaaucugccugccucugccucccaagugcugggauuaaaggcgugugccaccacgccggcggguuuugguuucuuuaaaaaaacauaggguguguuuuuguuuuagucccgggagugggauguggggcugcuuccaacuguccacagcagcugacuaugauuugcucuaacagcugcacgagguuucugcaauuguuugacauuugaaauucuggggacuuuuaagaggauauguaauugcuagcgccgcagaggugcuuugggucguuggucacaguuuguuaaguagucaugcacaaagaagaaacaaaaaagaagaaauuauauauccugauggggaacaucaaauuuccccuaggaacuugacaccccuaaucagcaagaaguagucuagcaauaaugucagcccuuuuucaaccccugacuuuguucagggaucucuuucuccccccacaccaccccauccuuuugucucuccuaucuaguauuaggggguugaaaaguagaaaggggguggagaaggguggaagaaaaaaagaauccacaaaguagccaaagaccagcuacagucauguggaugcuggaaaagaaacccugguccucugcaagagcagcaaacacucuuaacugcuaacugcugagccaucuccccccagcuccucuuugagacagagucucauguaguucaggcuagccuggaaccggcuauguucugaggauagccuugaacuuuccauccuaguucuaucuccaaaguucugagguuguggaugucuagcaccacgcccaacuucuagaaacuucugaacauccaacauguucagguuuucucuuauauuccuguuacuuuccaagaguucuguuuuguccuuuaaaaauuauuggguacacguaugcuacgaugaacauauggaggucugaggaccaaucugugaagucaguucuuuccacccaccuuuacauggguucgagggaucaauucauagccaguggcucugccugcagggucaucuucgccagcccuauaagagcucuugugauuaggggguggagaggagucugggagggguugagagcauucucuuguccuacacuuguguaggugucuuuuagaauuugugcugagagcugcgacucucacaaguguuucuuaggcucauauauuccucuugucuccuuagagguaaacaugaaagccagaguaggcuggaguugaguuucccuuguaaagggugggaggagcuaaaguugaaaacaucuccuuuuccagaauaacuggacuuuuagugacuugagcuggugaauucccuuccuuccuuccuuccuuccuuccuuccuuccuuccuuccuuccuaacuuccuaacuuccuaacuuccuuucucucucccuccuccccucccucccucccucccuccauuccuuccuccccuuccccccuuucuuuucuuucucuaucucuucuuucuuugguccuucuuuuuaaagauuuauuuauauguguaagugcaccaagugagccugcugucuguagagggugugugaucuccuggaacuggaguuacaaauggcugaaccuccauguuggugcugggaacugaaccccaguccucuagaaaugcacccagugcucucaaccacugaagagucucuccagccccaggguuaguuucuuugagggcaggcuuuguuccggguggaauaauagcuccagaaguucuuuuauuguacaggagccugaagaggcuaccuccuguagccaggcaggacucccaguggagggauaagggcaccgacccacacacaaaaucuuugacccaaauuuuguccugucaacaagaaguauggggacaaagauggaacagaggcugagggaacugccaaccaaugacuagcucaacuugagacacaucccacggggcaagcaccaaucucugacacuauuaaugagggcuauaacaggaacccaacauaacuguccucugagaggcuccacccaguagcugacuaaaacagaugcagagacccacagccaaacauuagauagaauuggagagucucauggaaaaggugagggaagaauugagggacuaugaggggauagggacucuacaagaaaaccaaaaagucaacuaaccuagaccuuugggggcucccagagacugaaccacaccacccaaagggcauacaugggcuggaccuaggcccuagcacauauguaguagaugugcagcuuggucuucauauggguccucaacaacuggagcagggagcugccuguggauccuguucucuuaacugggccgccuugucuggccucagugagagaggaugugccuaguccuucagugacuugaugugccaggguggguugauaccugggcgggggcucccccuucucagaggagaaguugagggggauggaguuggacugggggacugugaucaguauguaaagugaauaaauaaauaaauaacugggggaaaaaguggaaugaagccuaaagccacaguucauaguucacaccuuagucccaguacuggggaggcagagacaggcagaccuuggaguucaaggccagccugguuuacacagggaguuucaggccagucacgacuauauagugaaaccauaucuaaaagaaggaggaagaggaggaggaggaagaggaggaagaggaggaggaggaagaagaagaggaagaggaagaggaagagggggagggggagggggagggggaggggggggagggggaggggggagggggagggggagggggagggggagaaggagaaggagaaggagaaggagaaggagaaggagaaggagaaggagaaggagaaggagaaggagaagaagaagaagaagaagaagaagaagaagaagaagaagaagaagaagaagaaaagugggaagccuaggggacuuuccuauaguuuucacugaguagcugggaaagcuuccagaagcaaagcugugaacguggaggcgccuaagaauggacccagccccuggagacuagaacucauguuauuuauguggagcauccagcuauuugucccuuguauuucauguguuacugguucccacggaaucccugcucuccugcuguuguaauuccgaaucuuccuccuccucuccaguuuggggagagcaguuugccuugcacucacacguuuuucuuccucucuuuuuuagacaagagucucacucuauaacucaauuuagccuggaacuuccuuuguagccugggcuggccuugaauuuauggucauccuccugccucaguuuucucaguacuugaauuacggaugugagccaccacaccugacuugugcucauaauucugauaaucuacauaguguuguugaccugaaguucauuccauuuuuauuaauuuuaucauucucuguguguguguguuuguguguguuggguacaugugugaacaagccacagagucuguguggaggucaaaugacaacuuuuaggaauugguucuuuccuugcuucugcaggcucuagggaugaaacucagcuccucuguccugcuuggcagacacuuccccugcuaaccugucuccagccuucugugcuuuucuuucuuguggugaugcuacugagagccugcugcgcucuacgacacagggauggacuugaagggggcacugagggaacgaagaaaggacagaaacgcagacacaaguacagaaaggcuggaaucuggugggcggugugcucugauggacgcaccaacaguaacagcaacccugaaacccaguguguuucuuuauggaucgcggaggcggacuaauuauauacagcugaacaaaaaggcaugcguagcaaaucucuguaggagucucuacacggaagcagucuccuacugcaguugucccagaggccauggggacuaguacuuucugcgcauacuuagcauucacgcaccgcgcccaagggaagucucuugucaguuccuugagccugaccuggggaaggcuuugccauuuccaugagucugagacauugggguccuuaucauggcuguguucaugucaaaccauauacauucacucaggacuuaucugcuccccacaguaacuucuaaguugcuucuauuaugaacggaaaaccaaguccucuucccuguuaagaucggcuacucuuucugggcaccauauggugugcauaucaucugucuucacugcacgaugaguuuagacauccaagccagagcccuuaccucuguccuuccuccucugaaaucuaacugaucaccaaucaguucugcuucuacaaccaaggccacccuucuugucuacuauuucuucuauuucagguuugcugucuuucauccuaaggggacuacacucuauauccagcccaaagaugcuuugauuuuuuuuuauuccuuuuuuuuuuuuugucauauugguuucauuaaaaccugguggacugaaaaacugaccauacauccuuaacuuaaagguccccuuugcauuggaagaaaguccagcuguaagacccccgaagcugggccuccucucaagucccgggaugagcuggccagcaccccaaugacgcuagagaaaaccacaccugaugcaaacugcaagagguuuuauuaucagcuagcugaggacgaacuccuucagcugugcagggcaggggaguuugaccccaagcaguaauaguagggggcuuuuaacagcuagcugaggaauugggaggaguugggaggaguguucuucucuuccguauguccuugguaaaauuacauuuaucgcaucucuggcuguaaggcucagaaacaaaaaggcuuuuugcuggcuauagagaacaaagagcuucuuucuggcuguauuuuuagagaucagggaaaacaagcuuggggaacguccaggggcuuuaccuuccagggagaaacacucuaagucagggucucacacaaccaugguagucugucuguaauuccagcagcacuuugucuuucaggccaaccaagugugacaugagauucucucucucucucucucucucucucucucucucucucucucacacacacacacacacacacacacacacacacacaccacacacacuaaggcccaaauccccaaaaagauggcaagagaauuuuuugcagugcuggagauuggacccagggccucaugaugcauguuuggcaaguacucugccacagagauccucaaaacagucugcagaaagaacuuugacugaccuggccaggcugucuucaggcuuauuuaucccuugccucugugcuugccuacacgccagccuucggcacaccgcaucuucccaguguacaugucuucauguuucuuuacacaugaggauaaucaaccuagggcaucaccuaugccaugcaagaaugcuaaccauuuuaguauaccccuggcuuguucugauaacugccuccauguagcccucuugcucaaacaaggaagguuaggcacucucuaggccccuuagcauccugggcgucuuuucaccaccauggccagaucaguucucgucaugcagagcucuuuucaugacacuggugaguggucuucagaaugaagacguuugggacagagccacacacaucuaagguuaagucauccuucgcuacucuagccccuuauauaaaagccucuuaguaguuggggguucgguagauggcucagugauuaagggcacuuaaagcuuggacuaugaugcacagauugugaagagagacuuugcuaacaagccaaucaaucauacagaguaugcagaggacccagcuuugguucccaguacccagaugguggcucacaaucaucuguaacuccaguuccaggggacccaaugccgucuucugaucucuaagggcaccaggcaugugcacacaugguacaaauacauacacguaggcaaaacauucauacacauaaaauaaucucagcaugugcacauaaccgcucaucaucccauaucuuuuuuauuuauauuaucuauuuuuaagauaaggguuuugagugcagacugagcuggaacuugccauguaucccaggcuggccucagauuugaaaccuuccugccucugccugccaaaugguaugacugccaucccaccauccgaucuucuggcuccuuuauagauacuugugaguaugugugagggucauaugcauacuauaggagguuagaggcaacuugcaacuauuaguucucuccuuccaccaugggaggaucuggggaucaaacucaguacucgucaggcuugacagcaagugccuaacccacugagccaucuugcugacccuucuguguguguguguguguguguguguguguguguguguguguguguguguauguguguguguguauaguugggaagcugcucuuggguggaugaguucauuggcuccaaggaccaagaucagagaaguugccauggggaagugggaggggauagaggaagaagggaaaaagggaaaagcacacagaaagaagagggcaaggaagaagaggaaaaggaggaagaugagaagaaagagagagagggagagagcgagagugccuuuuagauauuuuaaaacauuuuaauauuacuuagcauuaaaaaaucaucagaaaauaagucuguuccuuuuuuaaaaaguuaguugcuuuaaaaacaaaaagcaaaaacaaaaacaaaacccauauaucacuauguagccuuggcugaauuggccucccguuucuguuucuggagggcuggcuuuaaaggaaugcccaccacauccagcuacaucacuuacuuuuuuuuuuuuuuuuuuuuuuuagauuuauuuauuuauuauauguaaguacacuguagcugucuucagacacuccagaagagggcaucagauuucguuauggaugguugugagccaccaugugguugcugggauuugaacucgggaccuucagaagagcagucggcgcucuuaaccacugagccaucucgccagcccccaucacuuacuuuuaaagucaugugaaaacugcuaauuuagagucagcuuacuguuaauucucaaauccaaaacaaacagcuaacugggguaccuauuuagccuaucaaaguaaacccggccucuagguuuuccuagugucccucagucccuauccuuugcaggguauggcuggcauacuccauuccuuacccugacuucuccagcccaggggcugggcugcccuucccccugcagcuguucucuauagaauucagccauuuuggcuacacuggcccuuuguacccuuuacuuuccuggccucguggucuuucagucuccugccuuccucugaccucucuucucagggucauguuugcucuggacucuucccggaugugucugccucuggcuaugcucucccucagaucuuccucauaucgucucccccaccauaccuaggaucacucaugcccucuuuuuuuuuuuuuuuaauuucuuuuuuuauucacuuccgaauugacacuaugaaacaccugaggccaugaauacguaacuggaagaguaacuuuuauuccccugauguaauugucaucuuggaagcugacugcguugucugcuaaccugggucuaguccuggcagcuucuagacucuguacuaucuaaucuaggccuagaauguucgcagccucugagaccuauugcugaauaaucuccccuuccuagcucuuucugaacucuggcuggcuggucagcucagcugcucggacuccucuccaugcugacugacucagacuggcuucuuucagcuuccgacuaaguugugcugcuuggcuucccacuaccuuuggcaauuuguucuaaucuucuggcuucacauucucuggcucacuccuucuucacaugcgucuggcuuauucucucucugcagccugugucuguacgacugucccaguaaaacugcccucucuccccugugcugcuuccucuuaacucacuucccuuuccuaucuguucucaccagacuuggguauacccuguucugucaaaucuuucucugauucgucacuuuuucugccacucagacaucacuuccaaacuuggugcuuccuugugcaaacuaaguuuaccuucauuguuugggauuauaaguaugcacuaagggcaugucuguauuccagccagaguagccauguggcuagauuaaaaaucccucuacacacaacauuccaugaaaaaugcaugggggcuggagagauggcucagugguugaaagcacuuguugcuuuaauagagaaccaguguucaguucccaguagcacaugguaguucacagccugcuucaacuccaguuccagggcaccggacagucucuccuaaucuccacagguaccagaacacacaugauaugcacacauacauacauaaaauaaauugaaaaggaaaaaaauauauuugagccagauaugugagcuuuuaaauggcacuuggggaacuggggcaggaggagugcaagguugaagcauggacugugauaggcagauuggaaaaagagaaucugcuaacaagucuaccauacaaagaauuggauauaugccgugagcuacagagaaaaggaacagacagggaaaaggaguuuauguagguguuuuuaaauggagugguaaggagggucccaucaaccuggaccacaaagaguaaacaggggugaaggagcaagacauugagaugucugggggaaggacuuguuccaguagaggaggaagucacacagagucccugaaacagaagcacagacaagaaagccaaagggcaaagcccagaccaggacugagacugcaggacaggaaggugcgggucagaggaacaagucagaagagccgggcuuugaagcacgcuaggcuuugagcagaggguggaugugaccauucacuguauucugaugguggcugagugaugaacaaagagagggcaaguggggagaauaaccaggaagcucaacacagugaucuggggaaaggauggaagaauaguuggccgcugcuggcugcagaugcagugggcacagucagcuucagggcaugguugcguaaagaaagagccaccagauuagcccagacugaugguagcaugcagaagaauguaacuucaagauuuccagugcaaggauuuggggacagcagagccguuacuuacagagauggggguggcugcaggagaauaugauggagagacaggaauuuaauuuuuagucauauuguaucuggaguguccaucagauaucuaguagagguacaggaaggugguaaauaagcaagcuugagagcuggugguccuuaaaaccacaaggauggcuaauauuguguagaaggucuagcuggauaaggaaguacuucagggaacccccgaguuacuuacccagcgcccauugacugaacagagauggcugaagccacagagguucaggagaaucugaaaguggcccagaagcaaaacuaucgucuuaucuucucucucucuuucguuugcuuguuuguuuguugagacagagauucacuaugugucucuagcugcucugaaacuugcuaccucaaacccagaaaucuaccuaccuccgcccugugagugcuaggauuaaaagugugcggcaucauguccaacugcuugcuggcuuugagguagggucuugcuguguagcgcaggcuggccucaaauucaugauucuccugccuuagccuucugaaugcugccaugcuguguauguggaggucagaggacaacuugugagacucagaaccggcucccuccuaccauugaguccuggagauugaacuuagguugucagucuugguagcagcaucuuucccuauaaagccaccuuguuguccccuguuauaucugcauacuuccaacacugaacauaauuacuucuauuaaaguucugcaaauuuuuuucauucuagugcaauggcuucaaauccagguccuuaagugcaccaggcagacucugugccuggucuucuauuccuguacuauaaucucagagcucuuuucacuccugauuuugggacacaguuucccuaaguuacucaagcugccacugaacucacucuguaacucaggcagguauuaaacuuuagauccuccuaauucccaaguaacugggaucacaggccugugcuaucacgccucauuuagacaagaauauuugaaaauacaguuugggcuaggugugguggccaucaauuuaagcaugcuuuaucuccagggugacugagauggcaccuuccagccacaauccucagaauuagagccucaagaaaagucaaccuagcugggcggugguggcucacgccuuuaaucccagcacucgggaggcagaggcagguggauuucugaguuugaggccauccuggucuacaaagugaguuccaggacagccagggcuauacagagaaacccuaucucgaaaaacaaaaaaacaaaaaaaaaaaaaaccaaaaaaaaaaaaaaaaacaacccuccagcacaaugugacuccauacuucuuggccuagacagacaggacuacuaaacagcaucuuuauuaaaaaaaaaaaaccaguuuauuaucagcacaaaugaagagcgacugccuccccaggugccccagucuuccugucugagccuggggagcuacucugugguggggccccaucuuggggcaauguccuuguucaucugauuccagucccauugcuccuggcccaggguuaagcuccaccucgauaugccauagguauguucuccccagagcgacugucaccuccagcaucugagaaaccgcugccuccagaggcuggggccacauccacuugaauaacaccgugcacuugggaaagcuguggacuguccaggcuggcaaugagcuggcgggggccuggucgcacgggaacaaacgucuggcgcagugugacugucucauuacccccgaugucccuguagacagagacagugucaugaaccuuggcuacggguagagucaagcaaggacugacccaguguggccaggaaggaaaaagcaagagguggagcuuaacacacagguauuucuggguuccccuggaaucuacacccacaacccggacagagccuccgccccggggggccgccuccacccuuggccaccuccacacagcuugauggcaccuacacacccagcuacuugcacuaaagccuccccggcaccucaccuccucccucccucucccaccuggauggagacugcugaugcucuccacaguagccuggacugcucuucucuccacugcugcccuaucucaagcaccccaccucaccagggugucaaggccaagggcacuuuagagcaagaccuggaggcccaacagggaucccaaaugcuuucaguuuugccagaaaucugcccaguuguccucacaaagaaggaacaacuuuauguacugaaggcuguuuguuagccaggaaaaaggacauuuggcauuucuaaaaugacaugcguucucauaucucugugugugcaugugugugacaccaaagugugacaccaacaccuuugccuuuuccucagggagcucugaaaauauauacccgaacacccguggcagucacggguucuccagacuccucucggcuuuucccuagccugcugcugcuaaucacugggaagggagcuaaaucccucaagggcugggcauccuuggcgcucacugaaagagaagucaacucccuaaccugacguacaggcucacucugacucagcccccacccuggcgcagcugcaucacccccaccauucuucccguggaccugccccaccgaguaucuucuccucacacaaacucaccuccaccucguucugcaugguuggccggccgugccugcccugcccugagcuccuagcucugccacuuccauccuuauucuccagguccuagcucacaccccaccccagcaccuccuguccccaagagaaucaaucuuuucuuuuucugggcauuuccuucaaccuacguacuuuauucuuugaccuauuggguuuuuuuagaggggaucucaagaagcuuagacuagucucaaauucccuacguggcugaggcuagccuugaacuuuccacccucucaaguacuacaguugcaggcauuuaccaucccaccugacacucugcauuuuaaguaugaacaugguugcauuuauauggagucuauucauggcuuuuagaaaaucucccaauucuuccuaaaccugcacuuccuauugccaauucaacccacgcuugccuuaggguuccuuuuuggcccuagaccccaugaagugggcugccuagggaacaagcuggcaccucuaauuuugaagaugagcauuccuuggggcaaaacacucagcuuggcggcugcuucugaggagucccuggaccugacuaguaguccacuaguuaacuguguggcuuuagacaagcuacuucuuuggcccucgcuugcugguucauaacacagacaugcaucaaagugagaugagguggucagaugguuucugaaguguuccgacaggaagcaaaauuaagccuauaauuuaacagguuaugcuuugacuggccacaccuuuguguccuuaguuuucccccauuucucuauagauggacaguuaaagguugcuuagccuuacaggagccuucaaacgucuacuauaaaugaguuguuguauuucagaagcugaucuuuauauuacaaccacuaauauuauuucugcccucaccccccccucccaaaaaaaacugcugucuacuuucaaaguaggaaugucaaaaucuuccccagacucauucugauagcucagaugagacccuugccgcaucgcuucuuguuguuggugguugguuuuuguuuuuuuuccgagacaggauuucuuuguguaacagagccuuugcuguccugaacucacuuucuagaccaggcuggccuccagcucacaaagaucugucuuccucuuccucugaaggggugguacuaagagcgugugccaccaggccuggcuuccaccccugcuuuugaguuuaagcugagagcaagucagcagcuaaagcugggcugauccuuaacugcuggcgaugaaacuguccuuggcaacugauacuccagcucucuggcuccuccucccucuccaucccucacaggcagguacaggcacccaugucuccuuuguguuaugcguaauuucuaaaugauacagacauuaauaucuccuugcuuguuuuccuugguaauuaaucuuuaaauggcuuuggccuugucuccaaagucaagcccaccuuucgagaagggauuuaggccauuaaagauuuugagagagugugauucugcuucugggggaaauucccaagaacuuccagccucuccggugacacagucaacuggaggagugaguccuggaauguuuauuuaguggccagucaccaggcuggggugucacaccuggugguauaauugagcuccauaccacagccuuugauguguaaaugagaggcauaguaacacccaucuuggaauccggagcccucagaggagaggaugaggguacgguagauaccaugcaagccguccacagaagaaagaggccaccucuccuugcaccaagcacagugguccuguacuucugguggaggguugggggagaagcagcccaagagccgcaggggcugcugagccuggcaagggugugugcaucuagggagccuaaaacgccuuuccacuguggugggaaugucccagggcacaucuuacacccugucaucugaacugcuagaggcccucauaggguucauuuugugcuacuuugugaugugacaaccccugagucccaggcuaggccaaagaacaagacaauaaacucaucuuuggccucauaacaaaaguaguggcuaccaguguaagguaugaagggaaagguaggugaggggccuuuacucuacaccuucucacagccccucucuuagaacaggagaccacuccugucaggagaaaacugccuuccucugccuucucuucccuccacgcucuuccugagaagagugagugauacaugucugugccaggugacagcaauaggcacagaaacauaagugccgagugcccucauuggguccggagccucacccaguggagaucagauccaagcuagcugagggccugaggauuagggcucaguucucacugcacagaccacgcagcaagcagagaccccggguaguuugugucacugaaggggaaagcuugcccuucugagcugugggcugagaccacuggccuucccacucauacagcggagacuagcuauaccaaaggcuggacuaaguaaccagaggcuuuggcuaucuucccuggacaagugagcccacacaggcuuagaagaaaagaaagcaccuaccuggccaaagagaccuagucaggagcaguggagcagggucuugaaccuaagucuuucaaguuccaaagcuccccuuuuuauuauaugauggucucuaaugcccuuuaaagggccugcaugaucuccaaaugagauaauccucccgagagagugcacggucaacacuucuauauuuggcaaguguuagggaugggcugcuaaugauuuccaugugaguuucagcucccuaauuaacaggugaggcagggcagggacacagcgcaacuugagguacucagcaagucuugaacacugguugggcugaauugguccgaggugccagagacugccagcugccccccaagcugcucugugggguccugaccaaaauagagaagcaaaaccgaggcucagggcagccugggugacucacccgacauugaggaccuugggucucuguaauccagaaccuucgagccggaagacgacguuggugagggugacaggcaggggguucuugaacacgaucuguacuccacauuccugaccaacaacugcugcucccaguaacugagugagagagaaauccaccccucaucagagacccuggccagcccacaguuuguacccaagggagaaauguguuugguucaaaaucucgccaaguuccacauuucaguccuucagagaagcuaccucaaaaauugaggaggcaacucauauucauucugcaaucugaauaugaaacagaauuggaccugagaacccauuuuauugaugaggaaacuaaggccagaucuggacuuuaaccuucuccgaaaaggcucaucaggguaacuugucucaggcuuagcgugcuccccuugcccacaguuuuccuuagccucaagcucugggucucuauuuacccccaugagucccagaaagcugcacucaccguaagagaaaggucuggggugcgcaaacggaagguguguugcuuggcuaguaccugcccacucuccuugacauggccugagacauugagcaacauugcccccugguccacaagguggggcuuguauuccuuguaggccacaggcauggucacagaguccgcugggaagaaaaugcaugguaaucacaggccuucuuccccagaaaguuuccccagaacugcugccuguugcuguagggccuccaugugaaagccauaguacuuggauacccagaggcagggcaggagagggaguaccaucuaggggcagagcugggaagggaguaccaucuaggggcagggcuggggugggagcaccaucuaggggcagagcugggguggaagcaccaucuagggacagugcuggggugggagcaccaucuaggggcagggcugggauaggagcaccaucuaggggcagggcuggggugggagcaccaucuagggacagugcuggggugggagcaccauuuaggggcagggcuggggugggagcaccauuuaggggcagggcugggagggagcaccaucuaggggcagggcugggaagggagcaccaucuagguagagggaauaccaucuagggacaggauugaggaaggaccacuuacaggcuccuggggcuaaugucacuuccuuuuuggccuccuugaagguaggcccagagacaccaguguaguaggugacacaaagguagaggugcaacuucacagugcgucggcuacuaccacgauuggucagcaccacagagacagccagauccugccccaucacagcguccugcgccuccaccugcauugccacauccucagcggagucccggguggcauacacauuagguuugcugccaugggcugccgccuucuccacagcccuccgcucugcuucugagccuggggguugaggucaaaggugcguuugagcucuggcugggguaggcacaggcucugcggggacccucagccaggagcgggcugggcugggagcauguuaccuucugggugcuuauagaugugggugauguccucucgauuguuggaguggaucgccuuugugacaaugagugugccaauggcuuucucuuccacguacacuaucuuaaagcugccaucauccugccgcugccaguauaccuuaucgcuauuuaccuguggugagcaaaggucagcaggacugaagggccaggaagacaggcgagcgagaccccgguaccuucccucaacucuagggacugcaggcagggccaaccugccaugcucugaaagcaggggaagaagcuugccuaggaggcuccuuguagcccauuuuggcauuaauaacaguaauuccuugugcguauucgcuugcuuuauaacuaaugaagcagccccauauccauuaucucuuuugauccugaggacaggaagcgaggcagccauuauuaucuccuuuuuacaguugaggaaaccaugacucuagaaugagugacuugcccgagguuacacagcuagucagucagcggggaagucaagaccagaguguucaggacugaagccaaggcucuggucacuucagacuguuugcuagaggaggcaccuagagcccagcccucaccucagcaaaaaugaaaggugugucauacuucauguagacuaagccauucuugacggacuccacagaacaggggccacagcagaagaugccuaggaaaugaagcaggcgaugggucuaagaaggccaagggguccucuuguggucuggucuagaggccacacgaggcuccaacagcagggugggagugggaggggccugcggacagcccaacuugauaaccagguuguuagcacauucucugagcuggcaggcugcacuguccaugaaucucagagugcaggacacccucccccagucuuucaucacaaucaauccaggaccuauaaugguucugguuggcugagagcagugguagcaccaucgagcaccccuucagaaacaccucagcuuugcagcacucucugauuuccugauugggaaaugagaaggguggugggcaagaagggacuguccuuauacucaggaggguucccuaccgaggaccauggcgagcuggcugaaaugggcaggcugggacagaaagugaaaacaggaggugagggcuauccaauaggaaagaaccuuaacaccuaaugcucuggccuccuucggcagauggggaaacaggccuagccagugugacggaugccaagaccuuauaagacagcugggaaagcuucuaccgacuuagcagcuguaauguugucagcaugcuacaugcuacaugguguccauuuaauccucccaaccacaccauauggucucuaguacacacacacacacacacacacacagaauacaaaacacaaagguguaagguacuuccuugccaauaucacucaucuaagaaguaaucgugguagaccgaagcccuggccauccugugagggccccugccugacaccuaccccauuacuucuuagagcuggaccagagaucaagucuccaaguccacggugagcauugcuagguuaugcaacccaggacaccuuuuuacauagaugauugacagggaggguucugggaaaugggcagaagaauguaagucaggccaaggcugucugacucuaggaagguggaggagagaaggaaguagcuggugggacaggcugaguaaccuggagggagcauugcagccagagggagaggaggucacgagggcagagccaagaacagggcuacugcuauggagacagcauuugcggaugcagagaagagauaagcgacugacaggucgugucgcccaggucagaucugacaguuacagagcuguuuucugccugagcccugauuucucuauacugcacaugaaugcagugaacaggggaacaaaaagaagggaaacuaggccucauucugcuggagacccagacaaagccauucugccucccagagccgcauuuaccauguguuccauuggcauggagguuuguuccaaacauggguguccauaagaauuaccaggaacuuuugaaauagagaaugaaaaauggaugcugagcaugcucaaagccccagguucaaaaccaggacugggaagaaauagauacauacuacuagauccuauugcuggaaaucugauggaccaagacugaugaaaagauuuugggugggacuccugggacucccccccauagaaauuuacuuuaaagacaucuaagggaaaauaagaaacuguuauauuuuaucuuauucaauucaauaccguuuuguccuuccauucacacauuuauuacucauaacuuuucucucuguaugcgugucuuuuaauuaauuguaucugggauauauaaauuaaaaagcaaguaagaacugggcaguguggugugaccuuuaaucccaguacucugaauuagaggccagccuagucuauagagagaguuccaggacagccagggcuacacagagaaacccugucucgaaaaaagcgaagcaaagcaaacaaacaaaaaaaagcaaguaagaauaaugagcuuaucaggaaagggaaaccucuuacugaauauucuugaaucucuuuugacuuuugaaccaucucaguauauuaaccauuauaaauuauaaaauaaaauuaagucaaguagcuaaagagaggaaaauaaacuaauggcuugguggugguucaguugauaaauccauacaaagaacuauagauuuggcugucuagccaagaccggggcuaacauacaggagcuggagauguucuggauagggucugggcaaggccugccuuaccacugcuggucuccugggguguggcauccacaaccugccacccaucaaagccugagggcagaucuggccucuucauccagcagucguuccacacguggaaguuccuagaggggcaaggagggggcucugggccugagguucccauucagguccucccagccccgauccauacucaagccucaggucaucuucagggcacaugacaggccaccccucacccugugcucaccaaacagaaucaugguucagauguucaaguggcuucauguucucaucaaaguagauguccauagugagggaggugucugugucgugugcagaguugaaguuggugacgguacggguagcgaagcccagacaucggagcacuguggaagagccagggguaagggcuggggcagagguuggcugugugugcggcauccgcaggaagaaaagggugcugaacuugccaagcuuggagggaccaucacaguuaggggucagaagacccagguguccuuugggcugcaaagcaguguggguuacaaagccaccugcuugacacagacccggacuauugccucuucuuucucucccuuaggccucucaguugcagacacuaauuaaugauaauuaaggucaugcuaucauccacccuuaguggcacccuauccuguagccauaguugggcugggcagaaauagaacccuucccuccucauagagcccaggcuauuccuggcccauucccuguacuaccugugguggucacaccggcaaagacccagcauuggccguaggggacggaauagccggugcguagguagcugagcaggaucuccacacugcccacccacgcugagggguuggugccucgagaguagucaccgguccaguucccaaucagaacuccauugucauccagggaguucaccugcccaggaaaagauagggugcggcuggauuuggggaggugcuuaggaccuucuggauuccccaaccccuaacacugcaaccucuugagaggucaacuuaaaccugcccaucccucccccaacccaucugcuguaacacuggaaugugaacacugggugugccaaguuugggguuuggcgccuuacauuccaaaggagccaggacagaaacaaugaaaggugaggugggauagaggggguuggggaggggagggagaaggggugaaaaaucucuucagggacagggauggaaaauccauaaagggcagggcaggaaggcacagauagggcuuagagauacagaggugcucaccauggcagagacaacccgagagacacugacuggguccccacgaccuccauauggcaucccccuccgauccaggauguacaggcaggcauccagcaccccauggucaaacuagaaggcaggagggcagaggucaugacagcuccucaagugaugcucaaaccaaaggcuagugucggcccaccaugucccucacuucuaucucccuuuaaugagugugcaagaccagugguggcaugugccuuuaaccccagugcucaggagccaaagguggguagaucucuguaaguucaaggccagucugguccacagagugaguuccaggacagccaacacuacacagagaaauccugucucaaaaaaaaaaaacccaaaacaaacaaacaaacaaaaaaacaaaacaaaagagagagaaaggaagaaaaaaagaaggaaaguaagagagagagagagagagagagagagagagagagaaagaaagaaagaaagaaagaaagaaagaaagaaagaaagaaagaaagaaagaaagggaugcgagcccagccauaccugaccauaguuccagguucguucgccaaucugugcuucuguuccauaguagauucuuccagacucauuaagcacauauucuugccgccaguccucaugguccacauacacuauguccucuguauccccagaaaauaaauugcaaauccuaucuauuuucuucaagggcccugccuuccccucugccgggucugcaggacucaucccuauggggugggggugggggugggauugggggugcuucuagccuaaucggacugcucuaaggaaggauggugagaaagauuggcuguggccaggacccuuuaucagaagugaggugggacucuuuucuauacugggccucagucuccucuccuggacaaugggagggugucuuuuccuaugaccagauguccagacacccaccuggaucucaggaaaggaaguccugacccaccugcccucugcucuugaccccagcuggcuuaccugggcaccagggauugaagaggauguagaucucauugcgggggucaaagggcaacuggaacucuccagcuucagagcgggugcggacagugaacugaaacuugccaaugauggcauugggggagguguggacgcguagguuuagguuguguccguuguucuuagucacuugggccuuccagccaccacugccucccuuacccacugggaugaucacgugggugcccuugcccaccuccggauugcuuccuagaguaacaagaccagcaacuaggcagugagcgagucgcucuggaaguggggagagacuaggaauucauucaaccccacccagugucuaugagccaauuuaugugucccuaaguaguuaccacaccagccugugacaaucuuccuuagggcagcuugguggccgccccgugcucucccgcaugucagggcagaaccccaguccaacaucccaaaccuguuuccccgacaaugaacucaaguggggaggggacacuggggccauugucacuacuguccuacaggacuaaaaggagagaauugaauccaauccauuugccccauaggaaagaauacuccagauacuaaagggcagaguggcucucuggggucacugcuucuagagcccagagcauuucuggaggugguagggguaccugggaaauuagagacuggggugugcauggcugggcuguaaucaaaggguuagaagagucacccgcccgcccccaguagcuguauaaucaccagccugagcagucaacggucaccaggcaacauggugagggaggcaccugccuugggccuugugauaaaaaggcagagagauugauagaugggggcuagggggaugacccagcaagacccagaaagaggggcacauggagacauggagucaaccgugcugaaggagacacaggggccagcacugugagaaagacaguugccucuggaggcuuguggaaagccagcuugaggaaacugcaggaccacaucuuuucugagagcaccacuaggggagcacuaugaauccggcaccagccucuuuuggcagaggugaggagugccggggaggagccuaaagaccucucuaaccuaacaccagcccuucaagucuaggggcuuuacccuucccauuccaggucccacucaccaaugaggagcucaagggcaaugcgaucagaggacucauauucccgguucaagaaaaggaucauguggaagggcugcccacggcgcacaaucagcucaucauauucaaacucauccguguggugcucucggcgguucuggucugaucgugagcacagcagauccacaccagucacaaccagca

SEQ ID NO: 7479 - RNA, 13920 nt, Mus musculus
acagacaggacuacuaaacagcaucuuuauuaaaaaaaaaaaaccaguuuauuaucagcacaaaugaagagcgacugccuccccaggugccccagucuuccugucugagccuggggagcuacucugugguggggccccaucuuggggcaauguccuuguucaucugauuccagucccauugcuccuggcccaggguuaagcuccaccucgauaugccauagguauguucuccccagagcgacugucaccuccagcaucugagaaaccgcugccuccagaggcuggggccacauccacuugaauaacaccgugcacuugggaaagcuguggacuguccaggcuggcaaugagcuggcgggggccuggucgcacgggaacaaacgucuggcgcagugugacugucucauuacccccgaugucccuguagacagagacagugucaugaaccuuggcuacggguagagucaagcaaggacugacccaguguggccaggaaggaaaaagcaagagguggagcuuaacacacagguauuucuggguuccccuggaaucuacacccacaacccggacagagccuccgccccggggggccgccuccacccuuggccaccuccacacagcuugauggcaccuacacacccagcuacuugcacuaaagccuccccggcaccucaccuccucccucccucucccaccuggauggagacugcugaugcucuccacaguagccuggacugcucuucucuccacugcugcccuaucucaagcaccccaccucaccagggugucaaggccaagggcacuuuagagcaagaccuggaggcccaacagggaucccaaaugcuuucaguuuugccagaaaucugcccaguuguccucacaaagaaggaacaacuuuauguacugaaggcuguuuguuagccaggaaaaaggacauuuggcauuucuaaaaugacaugcguucucauaucucugugugugcaugugugugacaccaaagugugacaccaacaccuuugccuuuuccucagggagcucugaaaauauauacccgaacacccguggcagucacggguucuccagacuccucucggcuuuucccuagccugcugcugcuaaucacugggaagggagcuaaaucccucaagggcugggcauccuuggcgcucacugaaagagaagucaacucccuaaccugacguacaggcucacucugacucagcccccacccuggcgcagcugcaucacccccaccauucuucccguggaccugccccaccgaguaucuucuccucacacaaacucaccuccaccucguucugcaugguuggccggccgugccugcccugcccugagcuccuagcucugccacuuccauccuuauucuccagguccuagcucacaccccaccccagcaccuccuguccccaagagaaucaaucuuuucuuuuucugggcauuuccuucaaccuacguacuuuauucuuugaccuauuggguuuuuuuagaggggaucucaagaagcuuagacuagucucaaauucccuacguggcugaggcuagccuugaacuuuccacccucucaaguacuacaguugcaggcauuuaccaucccaccugacacucugcauuuuaaguaugaacaugguugcauuuauauggagucuauucauggcuuuuagaaaaucucccaauucuuccuaaaccugcacuuccuauugccaauucaacccacgcuugccuuaggguuccuuuuuggcccuagaccccaugaagugggcugccuagggaacaagcuggcaccucuaauuuugaagaugagcauuccuuggggcaaaacacucagcuuggcggcugcuucugaggagucccuggaccugacuaguaguccacuaguuaacuguguggcuuuagacaagcuacuucuuuggcccucgcuugcugguucauaacacagacaugcaucaaagugagaugagguggucagaugguuucugaaguguuccgacaggaagcaaaauuaagccuauaauuuaacagguuaugcuuugacuggccacaccuuuguguccuuaguuuucccccauuucucuauagauggacaguuaaagguugcuuagccuuacaggagccuucaaacgucuacuauaaaugaguuguuguauuucagaagcugaucuuuauauuacaaccacuaauauuauuucugcccucaccccccccucccaaaaaaaacugcugucuacuuucaaaguaggaaugucaaaaucuuccccagacucauucugauagcucagaugagacccuugccgcaucgcuucuuguuguuggugguugguuuuuguuuuuuuuccgagacaggauuucuuuguguaacagagccuuugcuguccugaacucacuuucuagaccaggcuggccuccagcucacaaagaucugucuuccucuuccucugaaggggugguacuaagagcgugugccaccaggccuggcuuccaccccugcuuuugaguuuaagcugagagcaagucagcagcuaaagcugggcugauccuuaacugcuggcgaugaaacuguccuuggcaacugauacuccagcucucuggcuccuccucccucuccaucccucacaggcagguacaggcacccaugucuccuuuguguuaugcguaauuucuaaaugauacagacauuaauaucuccuugcuuguuuuccuugguaauuaaucuuuaaauggcuuuggccuugucuccaaagucaagcccaccuuucgagaagggauuuaggccauuaaagauuuugagagagugugauucugcuucugggggaaauucccaagaacuuccagccucuccggugacacagucaacuggaggagugaguccuggaauguuuauuuaguggccagucaccaggcuggggugucacaccuggugguauaauugagcuccauaccacagccuuugauguguaaaugagaggcauaguaacacccaucuuggaauccggagcccucagaggagaggaugaggguacgguagauaccaugcaagccguccacagaagaaagaggccaccucuccuugcaccaagcacagugguccuguacuucugguggaggguugggggagaagcagcccaagagccgcaggggcugcugagccuggcaagggugugugcaucuagggagccuaaaacgccuuuccacuguggugggaaugucccagggcacaucuuacacccugucaucugaacugcuagaggcccucauaggguucauuuugugcuacuuugugaugugacaaccccugagucccaggcuaggccaaagaacaagacaauaaacucaucuuuggccucauaacaaaaguaguggcuaccaguguaagguaugaagggaaagguaggugaggggccuuuacucuacaccuucucacagccccucucuuagaacaggagaccacuccugucaggagaaaacugccuuccucugccuucucuucccuccacgcucuuccugagaagagugagugauacaugucugugccaggugacagcaauaggcacagaaacauaagugccgagugcccucauuggguccggagccucacccaguggagaucagauccaagcuagcugagggccugaggauuagggcucaguucucacugcacagaccacgcagcaagcagagaccccggguaguuugugucacugaaggggaaagcuugcccuucugagcugugggcugagaccacuggccuucccacucauacagcggagacuagcuauaccaaaggcuggacuaaguaaccagaggcuuuggcuaucuucccuggacaagugagcccacacaggcuuagaagaaaagaaagcaccuaccuggccaaagagaccuagucaggagcaguggagcagggucuugaaccuaagucuuucaaguuccaaagcuccccuuuuuauuauaugauggucucuaaugcccuuuaaagggccugcaugaucuccaaaugagauaauccucccgagagagugcacggucaacacuucuauauuuggcaaguguuagggaugggcugcuaaugauuuccaugugaguuucagcucccuaauuaacaggugaggcagggcagggacacagcgcaacuugagguacucagcaagucuugaacacugguugggcugaauugguccgaggugccagagacugccagcugccccccaagcugcucugugggguccugaccaaaauagagaagcaaaaccgaggcucagggcagccugggugacucacccgacauugaggaccuugggucucuguaauccagaaccuucgagccggaagacgacguuggugagggugacaggcaggggguucuugaacacgaucuguacuccacauuccugaccaacaacugcugcucccaguaacugagugagagagaaauccaccccucaucagagacccuggccagcccacaguuuguacccaagggagaaauguguuugguucaaaaucucgccaaguuccacauuucaguccuucagagaagcuaccucaaaaauugaggaggcaacucauauucauucugcaaucugaauaugaaacagaauuggaccugagaacccauuuuauugaugaggaaacuaaggccagaucuggacuuuaaccuucuccgaaaaggcucaucaggguaacuugucucaggcuuagcgugcuccccuugcccacaguuuuccuuagccucaagcucugggucucuauuuacccccaugagucccagaaagcugcacucaccguaagagaaaggucuggggugcgcaaacggaagguguguugcuuggcuaguaccugcccacucuccuugacauggccugagacauugagcaacauugcccccugguccacaagguggggcuuguauuccuuguaggccacaggcauggucacagaguccgcugggaagaaaaugcaugguaaucacaggccuucuuccccagaaaguuuccccagaacugcugccuguugcuguagggccuccaugugaaagccauaguacuuggauacccagaggcagggcaggagagggaguaccaucuaggggcagagcugggaagggaguaccaucuaggggcagggcuggggugggagcaccaucuaggggcagagcugggguggaagcaccaucuagggacagugcuggggugggagcaccaucuaggggcagggcugggauaggagcaccaucuaggggcagggcuggggugggagcaccaucuagggacagugcuggggugggagcaccauuuaggggcagggcuggggugggagcaccauuuaggggcagggcugggagggagcaccaucuaggggcagggcugggaagggagcaccaucuagguagagggaauaccaucuagggacaggauugaggaaggaccacuuacaggcuccuggggcuaaugucacuuccuuuuuggccuccuugaagguaggcccagagacaccaguguaguaggugacacaaagguagaggugcaacuucacagugcgucggcuacuaccacgauuggucagcaccacagagacagccagauccugccccaucacagcguccugcgccuccaccugcauugccacauccucagcggagucccggguggcauacacauuagguuugcugccaugggcugccgccuucuccacagcccuccgcucugcuucugagccuggggguugaggucaaaggugcguuugagcucuggcugggguaggcacaggcucugcggggacccucagccaggagcgggcugggcugggagcauguuaccuucugggugcuuauagaugugggugauguccucucgauuguuggaguggaucgccuuugugacaaugagugugccaauggcuuucucuuccacguacacuaucuuaaagcugccaucauccugccgcugccaguauaccuuaucgcuauuuaccuguggugagcaaaggucagcaggacugaagggccaggaagacaggcgagcgagaccccgguaccuucccucaacucuagggacugcaggcagggccaaccugccaugcucugaaagcaggggaagaagcuugccuaggaggcuccuuguagcccauuuuggcauuaauaacaguaauuccuugugcguauucgcuugcuuuauaacuaaugaagcagccccauauccauuaucucuuuugauccugaggacaggaagcgaggcagccauuauuaucuccuuuuuacaguugaggaaaccaugacucuagaaugagugacuugcccgagguuacacagcuagucagucagcggggaagucaagaccagaguguucaggacugaagccaaggcucuggucacuucagacuguuugcuagaggaggcaccuagagcccagcccucaccucagcaaaaaugaaaggugugucauacuucauguagacuaagccauucuugacggacuccacagaacaggggccacagcagaagaugccuaggaaaugaagcaggcgaugggucuaagaaggccaagggguccucuuguggucuggucuagaggccacacgaggcuccaacagcagggugggagugggaggggccugcggacagcccaacuugauaaccagguuguuagcacauucucugagcuggcaggcugcacuguccaugaaucucagagugcaggacacccucccccagucuuucaucacaaucaauccaggaccuauaaugguucugguuggcugagagcagugguagcaccaucgagcaccccuucagaaacaccucagcuuugcagcacucucugauuuccugauugggaaaugagaaggguggugggcaagaagggacuguccuuauacucaggaggguucccuaccgaggaccauggcgagcuggcugaaaugggcaggcugggacagaaagugaaaacaggaggugagggcuauccaauaggaaagaaccuuaacaccuaaugcucuggccuccuucggcagauggggaaacaggccuagccagugugacggaugccaagaccuuauaagacagcugggaaagcuucuaccgacuuagcagcuguaauguugucagcaugcuacaugcuacaugguguccauuuaauccucccaaccacaccauauggucucuaguacacacacacacacacacacacacagaauacaaaacacaaagguguaagguacuuccuugccaauaucacucaucuaagaaguaaucgugguagaccgaagcccuggccauccugugagggccccugccugacaccuaccccauuacuucuuagagcuggaccagagaucaagucuccaaguccacggugagcauugcuagguuaugcaacccaggacaccuuuuuacauagaugauugacagggaggguucugggaaaugggcagaagaauguaagucaggccaaggcugucugacucuaggaagguggaggagagaaggaaguagcuggugggacaggcugaguaaccuggagggagcauugcagccagagggagaggaggucacgagggcagagccaagaacagggcuacugcuauggagacagcauuugcggaugcagagaagagauaagcgacugacaggucgugucgcccaggucagaucugacaguuacagagcuguuuucugccugagcccugauuucucuauacugcacaugaaugcagugaacaggggaacaaaaagaagggaaacuaggccucauucugcuggagacccagacaaagccauucugccucccagagccgcauuuaccauguguuccauuggcauggagguuuguuccaaacauggguguccauaagaauuaccaggaacuuuugaaauagagaaugaaaaauggaugcugagcaugcucaaagccccagguucaaaaccaggacugggaagaaauagauacauacuacuagauccuauugcuggaaaucugauggaccaagacugaugaaaagauuuugggugggacuccugggacucccccccauagaaauuuacuuuaaagacaucuaagggaaaauaagaaacuguuauauuuuaucuuauucaauucaauaccguuuuguccuuccauucacacauuuauuacucauaacuuuucucucuguaugcgugucuuuuaauuaauuguaucugggauauauaaauuaaaaagcaaguaagaacugggcaguguggugugaccuuuaaucccaguacucugaauuagaggccagccuagucuauagagagaguuccaggacagccagggcuacacagagaaacccugucucgaaaaaagcgaagcaaagcaaacaaacaaaaaaaagcaaguaagaauaaugagcuuaucaggaaagggaaaccucuuacugaauauucuugaaucucuuuugacuuuugaaccaucucaguauauuaaccauuauaaauuauaaaauaaaauuaagucaaguagcuaaagagaggaaaauaaacuaauggcuugguggugguucaguugauaaauccauacaaagaacuauagauuuggcugucuagccaagaccggggcuaacauacaggagcuggagauguucuggauagggucugggcaaggccugccuuaccacugcuggucuccugggguguggcauccacaaccugccacccaucaaagccugagggcagaucuggccucuucauccagcagucguuccacacguggaaguuccuagaggggcaaggagggggcucugggccugagguucccauucagguccucccagccccgauccauacucaagccucaggucaucuucagggcacaugacaggccaccccucacccugugcucaccaaacagaaucaugguucagauguucaaguggcuucauguucucaucaaaguagauguccauagugagggaggugucugugucgugugcagaguugaaguuggugacgguacggguagcgaagcccagacaucggagcacuguggaagagccagggguaagggcuggggcagagguuggcugugugugcggcauccgcaggaagaaaagggugcugaacuugccaagcuuggagggaccaucacaguuaggggucagaagacccagguguccuuugggcugcaaagcaguguggguuacaaagccaccugcuugacacagacccggacuauugccucuucuuucucucccuuaggccucucaguugcagacacuaauuaaugauaauuaaggucaugcuaucauccacccuuaguggcacccuauccuguagccauaguugggcugggcagaaauagaacccuucccuccucauagagcccaggcuauuccuggcccauucccuguacuaccugugguggucacaccggcaaagacccagcauuggccguaggggacggaauagccggugcguagguagcugagcaggaucuccacacugcccacccacgcugagggguuggugccucgagaguagucaccgguccaguucccaaucagaacuccauugucauccagggaguucaccugcccaggaaaagauagggugcggcuggauuuggggaggugcuuaggaccuucuggauuccccaaccccuaacacugcaaccucuugagaggucaacuuaaaccugcccaucccucccccaacccaucugcuguaacacuggaaugugaacacugggugugccaaguuugggguuuggcgccuuacauuccaaaggagccaggacagaaacaaugaaaggugaggugggauagaggggguuggggaggggagggagaaggggugaaaaaucucuucagggacagggauggaaaauccauaaagggcagggcaggaaggcacagauagggcuuagagauacagaggugcucaccauggcagagacaacccgagagacacugacuggguccccacgaccuccauauggcaucccccuccgauccaggauguacaggcaggcauccagcaccccauggucaaacuagaaggcaggagggcagaggucaugacagcuccucaagugaugcucaaaccaaaggcuagugucggcccaccaugucccucacuucuaucucccuuuaaugagugugcaagaccagugguggcaugugccuuuaaccccagugcucaggagccaaagguggguagaucucuguaaguucaaggccagucugguccacagagugaguuccaggacagccaacacuacacagagaaauccugucucaaaaaaaaaaaacccaaaacaaacaaacaaacaaaaaaacaaaacaaaagagagagaaaggaagaaaaaaagaaggaaaguaagagagagagagagagagagagagagagagagagaaagaaagaaagaaagaaagaaagaaagaaagaaagaaagaaagaaagaaagaaagggaugcgagcccagccauaccugaccauaguuccagguucguucgccaaucugugcuucuguuccauaguagauucuuccagacucauuaagcacauauucuugccgccaguccucaugguccacauacacuauguccucuguauccccagaaaauaaauugcaaauccuaucuauuuucuucaagggcccugccuuccccucugccgggucugcaggacucaucccuauggggugggggugggggugggauugggggugcuucuagccuaaucggacugcucuaaggaaggauggugagaaagauuggcuguggccaggacccuuuaucagaagugaggugggacucuuuucuauacugggccucagucuccucuccuggacaaugggagggugucuuuuccuaugaccagauguccagacacccaccuggaucucaggaaaggaaguccugacccaccugcccucugcucuugaccccagcuggcuuaccugggcaccagggauugaagaggauguagaucucauugcgggggucaaagggcaacuggaacucuccagcuucagagcgggugcggacagugaacugaaacuugccaaugauggcauugggggagguguggacgcguagguuuagguuguguccguuguucuuagucacuugggccuuccagccaccacugccucccuuacccacugggaugaucacgugggugcccuugcccaccuccggauugcuuccuagaguaacaagaccagcaacuaggcagugagcgagucgcucuggaaguggggagagacuaggaauucauucaaccccacccagugucuaugagccaauuuaugugucccuaaguaguuaccacaccagccugugacaaucuuccuuagggcagcuugguggccgccccgugcucucccgcaugucagggcagaaccccaguccaacaucccaaaccuguuuccccgacaaugaacucaaguggggaggggacacuggggccauugucacuacuguccuacaggacuaaaaggagagaauugaauccaauccauuugccccauaggaaagaauacuccagauacuaaagggcagaguggcucucuggggucacugcuucuagagcccagagcauuucuggaggugguagggguaccugggaaauuagagacuggggugugcauggcugggcuguaaucaaaggguuagaagagucacccgcccgcccccaguagcuguauaaucaccagccugagcagucaacggucaccaggcaacauggugagggaggcaccugccuugggccuugugauaaaaaggcagagagauugauagaugggggcuagggggaugacccagcaagacccagaaagaggggcacauggagacauggagucaaccgugcugaaggagacacaggggccagcacugugagaaagacaguugccucuggaggcuuguggaaagccagcuugaggaaacugcaggaccacaucuuuucugagagcaccacuaggggagcacuaugaauccggcaccagccucuuuuggcagaggugaggagugccggggaggagccuaaagaccucucuaaccuaacaccagcccuucaagucuaggggcuuuacccuucccauuccaggucccacucaccaaugaggagcucaagggcaaugcgaucagaggacucauauucccgguucaagaaaaggaucauguggaagggcugcccacggcgcacaaucagcucaucauauucaaacucauccguguggugcucucggcgguucuggucugaucgugagcacagcagauccacaccagucacaaccagcauucccucugugaaaccacauccaugggucagugaagaguucacgaagagcccagucccuccucagaagucucagaagcccccuuagagaugccaggauaaaccuuagguuccauaaaggcucagcucuagguuaagguguguaaucucaccucggauggugccaucuccagcugcauuuacaccacugccccgagacucgggucuucggccaccccgagagucccuaccccgggagcuggucccucugcuucuggagccagaagguucagguccccagucaucguccccucuguucccacaugagcagcagccacaacaacgagcccagaaggagcggccuccuccucggcgggagcgcgagcgucugucuggcuccggcaccggcucuggcuccggugacgguguuguagggggcugccaggggcuccugccccagcggcccacgucugagcgaggaccuuccauugugccuguguagaagagacagagggugcucauucacucagaucuccugugccugggauguccaucccacccacccagaaacucuauccagagaaauugguucaguaccagcuaggugacugggauaaucacauucucacccugagaugccccaaagacccuauucagucacccagaagaagcaccuuauauugcagagaaaaaccuccucuccaccuugcuauagacacucucaaaucauacuaaaaaacagauguccaguggagaaaccauugaagauccaucugaggaaaugcacaguugccuaagagaacaccuccaaacccuguauauaucggucucuccacccgcuggcuucucaguuuagagguccagccucuaggacuauuuaacagcagguaggaggcauaggggucagagucccccgacaugccucacgucuggacaaacuucaggcagggcugcggagauggcacagcaggcguaagcagaguuuggccccaggaaaauugggucucagcccacagcagguacgcacuggagaucgguccuuucugggcuugggcugugugucccuugacagcgaaggcccgcuguggcucagcacugagguaagguguaagcuggagccucucaccuggcagcgguguuggugauggcaccaccgggucccgggcccggguggagcaggucagggcguuugggacgggaccaacaggcuggacguagccacgcgaguggaagguguagggcgggccggguaagcaguuuaugaggggaggggaggcggggccgaguuucugggaaaaggggaagaggguugcuucaucccuccugucaagaggccagucucugggggcuguccucugguaggggcgggaaagacuggcuccacccacuuucuccuuucuaggaacugaggucaugcuaaggaggggguccggaucaaaguucugucagaccugaggcugaagugaaaaggaaaggcguuuggugacggaucccacaccaacuugauucuuaccacacuagguguucagagagcaaagagaagggcucuuccacucaggccugcagggcagaucuguucccuagcuggagaugccuccuuuugcucucagagggcccugcugcuaagcucucuuguagcacccaccgggcuuggcccugugaaacug

SEQ ID NO: 7480 - RNA, 2535 nt, Mus musculus
uacuuccucucuggcugacuuagcugacagaccuagaagugggaccaggacccuggcacuaagacagauucaaggauuguauauccaacaacuagacaagacauuaccuucugaucagcaucagggaaacccuguaaguauccuaggaaugauaugguguguguguguguguguauuugaauauguuuauguguaugugugugaguaugucaguaugguguguguguuuauguaugcgucaguguguugugugugagagagucaguauggugucugugugugugugugugugugugugugugugugugguguguguguaugugugugugaguguguuuaugugugugugugaauguaugucaguauguuguguguguuuaugaaugugagugucaguguguuaugggugaguauguaugugagugugugugugugugugagugugugugugugugugugaguaugguguguguguuugaguguguaugugaaugucaguguguugugggugagugugugugugugucaguauggugugugugucaauuauaacuugaagagauggugagacagaauccccaaagaaagcccgaccucuguaaagggaugguucuuguccauuaacucuucccugcccugcucuuccuggugccccauggucagcucuagagaguguggguaggugacuggagaaaguggacaguggccucuugggagauagaggaguuagccuuucaaggcgugcacagugcugaggaaagucucccagccuggugcuggguuccaggcucucuuaaggaaacgagugugaaggguuuuggaaauacugcuguugcuguacauuuugcaacugggucugaagcaaagaaggggccccacagccugguuaggaaauuagucuuucuauucaaccaggcgccuuuaagacaaugagguuggcagggcgugguggugcacgccuuuaaucccagcacuugggaggcagaggcaggcaaauuucugaguucgaggccagccuggucuacagagugaguuccaggacagccaggacuacacagagaaacccugucucaaaaaaccaaaaaaaaaaaaaaaaaaaaaaaaaaaaaaaaaaagagcaaugagguugacagugauggggugacauauuuugaaggugccucugaaacuucugauuuuggagaccagaguacuccaugcuaguuugauguggcugggggucaagaauccuuuggcuuuccccucauggguguguccacuuucacucucuagguccuuuugauggcugcaaacacuacaucuccugcagcaccuucuucuccugguggcaugucccugucucuguugcccauuguucuacugucuguggcccuggcuguggggcuuccuggcaauagcuuuguaguguggagcauccugaaaaggaugcagaaacgcacggucaccgcccugcuggugcugaacuuggcccuggccgacuuggcuguguugcucacugcucccuuuuuccuccacuuucuggcucgaggcaccuggaguuuuagagagauggguugccgccugugccacuaugucuguggaauaagcauguaugccaguguccugcuuauaaccaucaugagucuggaccgaucacuggcaguggcccgccccuuuaugucccaaaagguucguacuaaggccuuugcccgaugggugcuggcaggcaucuggguggugucuuuucugcuggccauaccgguccuuguguaccguacaguaaaauggaacaacaggacucugaucugcgcuccgaacuaucccaacaaagagcauaaagucuuccaucugcucuucgaagccaucacgggcuuccugcugcccuuccuagcggugguggccagcuacucugacaucgggcgcaggcugcaggcucggcgcuuccgccguagucgccgcaccggccgccugguggugcucauuauccuggccuucgccgccuucuggcugccuuaccaccuggugaaccugguggaagccggccgcacaguggccggcugggacaagaacagcccugcggggcagcgucugaggcuggcccgcuaugugcucaucgcgcuggccuuccugagcagcagcgugaacccggugcuguacgcgugcgcgggcggcggccugcugcguucggcgggcgugggcuucguggucaagcuacuggagggcacuggcucggagguguccagcacccgccgcgggggcacucugguccagaccccgaaggacacaccugccuguccugagccuggccccaccgacagcuucaugacuuccuccaccauuccugagucuucgaagugaacugcaguaggcuggguuaugacacaacucauaacucuggccugacccacuucuguaccuggaggagaacauguuggggacugggcuuaagcggaagagagggagggguggggcaagucagggcagagagacaggaugcucuggccuggcuucugcaggcagcuucacgauuaaaacuaaagucugaaaucggcuaag

SEQ ID NO: 7481 - RNA, 3873 nt, Mus musculus
cucacaguuaacaugcuauguuuauugacuuuaaggagaugggucaagagucaguuuggguguagguccaacuguccucacagaauguugugagcuucaggaaguggcaaggacugucuuagccaguccagguugcuuaaaacgugcuuuuuauugccacgcugaauggcacacuucaggcucuugcagugauucucugaagucuacuuguggaagggcugccagccccuaccccugccgaacugugcuuggucauacuuggccgaacuugaggcaguaguucuugguggugcuaccaaggaguuguaguucccaaucugcacuucagaacaguuguugaagacgagagccgguggcccuuuaagaggaaaggaggaggugauggugagaggguucagagguuagaaagaugaaguugacaagcacuuuggggaaaggggcagcgacaccuugugaucucccuggggaaugcaaaugcagggucuucaccugcuagcuacugcgucccaguaugagcugugccucuucagaauuagucuuguagaagcucaaagaguagugccugcuguuugggugucuuugaugggagaccuucuggacuugcuuaucaauaaaggaacugugggggcucacagacucugugcugggaaaagucagccaaucccgacuuucuuucguugugugaccucagugggauccucuccuaguggaugucauguuccucgucuuaaacgaggcagaucggguuagaugaucucuagucauuccuucccaccuccagaguaacucaugucuauagauaagugcugaggaggaaggugaugggagagcugagcggggagagcaagagagaaugaagaauggguaccugucauuggauucggugggguccagggauaccaaggagugccgugucuuccaucucccugcaaacaacacagagcucucaggcuuucuauucaagagccuaaucucaucaccgugcaguucuccuggguaagagggugugcucuagucuugccagugucucaccugauuccuuugggggugaggaccgggagucucaguaaagacuggcccagguguugugccucugaaggguaaaguauguggaaucugaggagugccagccacggggucagaagauguccuugcugguguggcaggcccaacugauguguccugugcuugccucucaggacauuuuccaggaacugguccggaggguuccuccaaaugcaggcgguccagcauuuuagaaaccaugguuucccucgggcaauccauuucugugccucuuuggcuuggcucucuggcagacaaguuucugccgcugcuucugugcugagacagauaaugcuuuaccugugcagacagggggaccuuguugucaggagcuggggcagccaaaguaaaccccagugaaaauuuucuuggucucuggagacuaaggaguagguucuggugaaugggaaugacaaccaaggauuaaauaaugguggccagugaagauaaacugaaugguuaagggagccacuugugccaucucccaacaguuccuggaugggaaggcagugcuagaaacucaccucggagacagcagcaucuaccuuguccuuuaccagauuguaaacuucauugguuuuugguucgcagucugaaagacaacagcgaguuguauaugagucggauuucuuuccuuggaggagcucccugcugaagacccaagccuacccuaguugccagagauacggccaacucacccuggaaggauggccuguuuucggacugggaaccccagcaaugaaucauuaacuccuucaguuuuuccaagccgggagucucagggcuaccuggaggcagcucugucaguggaggacgacucugccugucacacacuguuucccggauuagugaagucuugucuaccacuggaguugggggauaacauaaggaauucaugaaaugaggggacagcccauucuaucgcggacaggagcagggagagucauccaagugagaggugaggugggaagagggcaguguguuagugggucaggguaaaagggagggcuccagggggguuuaggugcuuucggguacuccauuuggagucuuacacucagcuucucugccagccagcacugcccacacgaggaucccaaagcuguacagacacaaauggaggcuuagauggccucuggcgagacuucuuuccuguaucauucccuuuagaagggcccaaauugguauagagauuuggaguguguuugggguggaugguuuaccuguagacaucacucgcuuuagaagccuucagguugacaucaaauaacagcucuggguccaaguacgcuagggugcccccagagucccuggauccugauccugauccugacccugacugggacccucccugaaacguggacaggccaaaaucugcuagcuguaaaggaaaggaaagggaagguauuagaugaaggggggggucagagauuuuucccucucuugcuccccagaagaugcagcagccucagcuuuuuggaagguguuauggaggaccagagggaagguaaagucauugagaacuuagcaggagaucugaguugcugaugggcaggccugagauaagucagccuggguccgugagggugcauuaggccuguggaacugagccaggggguuaagaagggcgucugguaaggagggucaccugguaugacuagaaauaaaacuccuaguugggucuugucauguguguagucuuguauucagagggacagguacucaacauggucccaagucuacacuagguuguagauggacuaaccuuggcguggagcucuggauccagcagaauguuagagggcuugaggucccggugcaggagcggaggguucaagcuguguagguagcacauccccagcaccacuuccugcagcaggcgacagaggaguggccagggccgagggcacucggguugcagcagcccugcgagggagccauucuccaugaaucuugucaccagagccugcccggacacgaagucccacuggagguccucagugacccccagcaggagcagaacguucucauuacgaagauuaaccauagccuucaccucccaggauaucuucuuccuacacgccgaaagggggccaaaauuggauugcgcucuggaagaccccacccuugccccacucaggcucgugaccacacucugacuacagcuggggucacucacgaguucacgaucuugacugcuacaucaugguuccauguucuguggugugcccggaacacgacuccgaacccuccuuuacccacaaacuccagcuucuucaguucuucacggcucaccagaggaaccgcugacgcaccaguaggccugagaaagguucuuguccgguagggggcccaucccccagccuagcgcauccucugucucccaagcuccgggauuccgugacugcgcgugggcagcguaggcagcgagucuagccuccccacugcugcccgccucacccccagcuuuguccccugccucagaaaaggcguccuuugaguguguccccgggccaccugugugggugugccggagacacagcucacuccccacucaccauaacuugacagaagacaucgucgggagcuagcggcuuccuggaguuaugugugcacagacggagcuggaaacccgacgucuacggcucggaguguggacugagaggaaggcagggucugcaaagggaacaaucaguaggucaaggcacggagguucaggccccgaauuccgcuucccaggucgcucccccggacuuugaaugagcgacuucacaacuucccuuucaaauaagaggcuccuucuaucuc

SEQ ID NO: 7482 - RNA, 3873 nt, Mus musculus
gagauagaaggagccucuuauuugaaagggaaguugugaagucgcucauucaaaguccgggggagcgaccugggaagcggaauucggggccugaaccuccgugccuugaccuacugauuguucccuuugcagacccugccuuccucucaguccacacuccgagccguagacgucggguuuccagcuccgucugugcacacauaacuccaggaagccgcuagcucccgacgaugucuucugucaaguuauggugaguggggagugagcugugucuccggcacacccacacagguggcccggggacacacucaaaggacgccuuuucugaggcaggggacaaagcugggggugaggcgggcagcaguggggaggcuagacucgcugccuacgcugcccacgcgcagucacggaaucccggagcuugggagacagaggaugcgcuaggcugggggaugggcccccuaccggacaagaaccuuucucaggccuacuggugcgucagcgguuccucuggugagccgugaagaacugaagaagcuggaguuuguggguaaaggaggguucggagucguguuccgggcacaccacagaacauggaaccaugauguagcagucaagaucgugaacucgugagugaccccagcuguagucagaguguggucacgagccugaguggggcaaggguggggucuuccagagcgcaauccaauuuuggcccccuuucggcguguaggaagaagauauccugggaggugaaggcuaugguuaaucuucguaaugagaacguucugcuccugcugggggucacugaggaccuccagugggacuucguguccgggcaggcucuggugacaagauucauggagaauggcucccucgcagggcugcugcaacccgagugcccucggcccuggccacuccucugucgccugcugcaggaaguggugcuggggaugugcuaccuacacagcuugaacccuccgcuccugcaccgggaccucaagcccucuaacauucugcuggauccagagcuccacgccaagguuaguccaucuacaaccuaguguagacuugggaccauguugaguaccugucccucugaauacaagacuacacacaugacaagacccaacuaggaguuuuauuucuagucauaccaggugacccuccuuaccagacgcccuucuuaacccccuggcucaguuccacaggccuaaugcacccucacggacccaggcugacuuaucucaggccugcccaucagcaacucagaucuccugcuaaguucucaaugacuuuaccuucccucugguccuccauaacaccuuccaaaaagcugaggcugcugcaucuucuggggagcaagagagggaaaaaucucugaccccccccuucaucuaauaccuucccuuuccuuuccuuuacagcuagcagauuuuggccuguccacguuucagggagggucccagucagggucaggaucaggaucaggauccagggacucugggggcacccuagcguacuuggacccagagcuguuauuugaugucaaccugaaggcuucuaaagcgagugaugucuacagguaaaccauccaccccaaacacacuccaaaucucuauaccaauuugggcccuucuaaagggaaugauacaggaaagaagucucgccagaggccaucuaagccuccauuugugucuguacagcuuugggauccucgugugggcagugcuggcuggcagagaagcugaguguaagacuccaaauggaguacccgaaagcaccuaaaccccccuggagcccucccuuuuacccugacccacuaacacacugcccucuucccaccucaccucucacuuggaugacucucccugcuccuguccgcgauagaaugggcuguccccucauuucaugaauuccuuauguuaucccccaacuccagugguagacaagacuucacuaauccgggaaacagugugugacaggcagagucguccuccacugacagagcugccuccagguagcccugagacucccggcuuggaaaaacugaaggaguuaaugauucauugcugggguucccaguccgaaaacaggccauccuuccagggugaguuggccguaucucuggcaacuaggguaggcuugggucuucagcagggagcuccuccaaggaaagaaauccgacucauauacaacucgcuguugucuuucagacugcgaaccaaaaaccaaugaaguuuacaaucugguaaaggacaagguagaugcugcugucuccgaggugaguuucuagcacugccuucccauccaggaacuguugggagauggcacaaguggcucccuuaaccauucaguuuaucuucacuggccaccauuauuuaauccuugguugucauucccauucaccagaaccuacuccuuagucuccagagaccaagaaaauuuucacugggguuuacuuuggcugccccagcuccugacaacaaggucccccugucugcacagguaaagcauuaucugucucagcacagaagcagcggcagaaacuugucugccagagagccaagccaaagaggcacagaaauggauugcccgagggaaaccaugguuucuaaaaugcuggaccgccugcauuuggaggaacccuccggaccaguuccuggaaaauguccugagaggcaagcacaggacacaucaguugggccugccacaccagcaaggacaucuucugaccccguggcuggcacuccucagauuccacauacuuuacccuucagaggcacaacaccugggccagucuuuacugagacucccgguccucacccccaaaggaaucaggugagacacuggcaagacuagagcacacccucuuacccaggagaacugcacggugaugagauuaggcucuugaauagaaagccugagagcucuguguuguuugcagggagauggaagacacggcacuccuugguaucccuggaccccaccgaauccaaugacagguacccauucuucauucucucuugcucuccccgcucagcucucccaucaccuuccuccucagcacuuaucuauagacaugaguuacucuggaggugggaaggaaugacuagagaucaucuaacccgaucugccucguuuaagacgaggaacaugacauccacuaggagaggaucccacugaggucacacaacgaaagaaagucgggauuggcugacuuuucccagcacagagucugugagcccccacaguuccuuuauugauaagcaaguccagaaggucucccaucaaagacacccaaacagcaggcacuacucuuugagcuucuacaagacuaauucugaagaggcacagcucauacugggacgcaguagcuagcaggugaagacccugcauuugcauuccccagggagaucacaaggugucgcugccccuuuccccaaagugcuugucaacuucaucuuucuaaccucugaacccucucaccaucaccuccuccuuuccucuuaaagggccaccggcucucgucuucaacaacuguucugaagugcagauugggaacuacaacuccuugguagcaccaccaagaacuacugccucaaguucggccaaguaugaccaagcacaguucggcagggguaggggcuggcagcccuuccacaaguagacuucagagaaucacugcaagagccugaagugugccauucagcguggcaauaaaaagcacguuuuaagcaaccuggacuggcuaagacaguccuugccacuuccugaagcucacaacauucugugaggacaguuggaccuacacccaaacugacucuugacccaucuccuuaaagucaauaaacauagcauguuaacugugag

SEQ ID NO: 7483 - RNA, 5551 nt, Mus musculus
cauauccucucuccauuccucuucucccucccagggcccaacugcugucacuccaugcucugccaaggaggagggauccgcagagacagcaguaguaaggccaggcagagcugugggacacaaaaagauacagggaggggagugcccgggcuaggugccagacucacagaggacagcagagcagggcaggaguacugaagccuugaagcagaggggggagagccaaggggacagaagacaggaaaaucugugaguuacagaggcaccuagcaaggauggggacggaauggcacaaacccaagcuguccuuggcccuggugcuucugacccuggaggcugggugggcucaagaagggucagagccuguccuacuggagggggagugccugguggucugugagccaggccgaccuacugcaggaggaccugggggugcagcccugggagaggcacccccaggacgaguggcguuugcugcaguccgaagccaucaccaugaaccagcaggagaaaccggcaacgguaccaguggugccaucuacuucgaccagguaaucccucugccucuguccggaagacaugcaaggaccuggacucuacuguccaagccccuuugcaucccucggacuccaaggaaaccauuaccugcaucucuugcaccaccuuccucuaagauggccacugaccguugguuggccuucuuucauucauacacacagcaccguagcccuuccucauaguuuuugacucuacacauuccugucacacccguuugccaccccuucucuccucacccacugcacaaaugccaacccagugaugcuccugagcucccggcacccagaaucccucucaacacaaucugcuuccccacagguacuggucaaugagggcgagggcuuugaucggaccucgggcugcuucguggccccuguccguggagucuacagcuuccgauuccacguggucaagguguacaaccgccaaacuguccaggugaccuaagugccaguccaccuccggggggaagggagggucauaguggaccgcagcacaucccuggauagcccuucuguuggaccuguaucccagggaccaggagcaagggaggaaaggcuagcaggguauggcagauguacagaacccaacacuggccaccccucagugcucacuggagagcccacugacccucaaguucccaaaagaaaacucuugggaggauggggggcgggguguccugagcuaaggacuaggacauagaugcuaacugggcuccccuccccaggugagucugaugcugaacacauggccggucaucucagccuuugcaaaugacccugaugugacccgagaggcagccacaagcucugugcugcuuccccuggacccgggggaccgugugucccugcgccugcgucgggggaaucuucuggguggcuggaaguauucgagcuucucaggcuuccucaucuucccacucugaggacccaagccuuuaaacggagaugucuagcaucuuucugcccuucccugccccagaaacaaaguaucuuuggagcaagagaaaggcccccuccaggcugccuacggcccaccuccuugcaugagaucauaguuaaacacccaaggcuaggagcagagcagagcuacggaaccucuagacaaaacgccucacucaggucgcccucccagucuccugcugccccuccugccccuccgcagcuccaguuuaaggcaggguuugcuaagagggaagcuugcacuucuucacagacuccacuccuccuguucuccaccccagcuuccugcucagcgcuauuuggugacagguggcgcagguaagcuugacaggcucccacaggggcccagauggaccagccucauaguaccugcgggcuccauccugugaggaaugccagcaaugagagcucucggccagcacccugugaacagggcugacagcucaaccacaaaaaagcaguguggggaaggccacagagcauccguagcuggagagacaggauggggccaugugccuacccugaacauguaaacauucugcagguaaacugggacagucagaaggcaggaauccugccguccaucugugccaggucccaauggacucuggcccucauugccugaccagaggcuuggguguguguguguguguguuugcucuggcuaauaggggaaacuagagcagguauacagaccuggaggcagagucaaaggucacgaaugagucaucaguaaccacauguccucucccucagccaccuccuagaacugccccaccuuggaaaucugaauuucagucacucccuacucuugaucgacauguaguuccuccagcugucucccagcuaauuucccuguagucugcucccccccccaaacgcaucguucuuccucuacuucuacuacugucuuacucuucuuuuaaggucuccuguuaccugggaguccaugacucaucucccccaacuaguaucccaccaacaucagaaacucuuuuuacccaguugucccaaugguccagcaugaacggaccuaccuagaacaacuggggagcugcggcuguuaaaacagugacuuguccuguucgugagggugugaaacagggacugcaggacuacagcaugcugaagagaaauaaauucaaagcugggcauagcagucaacguuuuuaaagugcuauaauauaaaguacucgugcuaaauaaauaccagggcaaguuugugguuuuuuguuuugguuugguuuuugguuuuuugagacaggguuucucuguauagcccuggcuguccuggaacucacuuuguagaccaagcuggccucgaacucagaaauccgccugccucugccuccugagugcugggauuaaaggcgugugccaccacacccggcaaguuuaugguuuuaaaauaaaaaucuagguguucauucaggagacagaggcagguggaucucugugaguuucaggcaagccauaguaaaaccuguccaaaagaaagacagagagacagagacagaacaaagaaagaaauaaggauggaggugucacucagaggcagacgcuaauacgcaugaagcacuggguuugaaccccagcacugggguaggcggguagggaguagacaagagggggaggggcagcacuuuccuucagcauuuguccuuacuuuguggccaggaagaauaguuuaaacaagauaagauaauauuucugucucacauggaagagucugcagcuggggaguucaggauaaacagcugcuuagaaccacagagcccagucuucccuuuugggaugccucucuggcaugccgccucauggcccaagauggcuucgugcaggucagcauuacaucccagcagcgcuggaaaaagggagagaagaaagaacacagcuccuuccuugaaagguuuuccgaccgcugacagcugccuacacacauuucugauugcaucucaucgccagaauggagucacacuuggccacaccaagccaggacaggcaaggaaacaaucucacaaucuuaccuuuuugucauauuuuccaugugcaugcaccugggacgugugugugugugugugugugugagagagagagagagagagagagagaggggggacaacuuuggguguuggaccccaccucccacuauguuugagacagggacucuaauuuuucauugcguacaccaggcuagcuggaaccuucuggaauucugccuucuccuuaaaguacaggauuacaaaugcauggacuauggcuggcuggaauaugaacucaggccaacaggugugcacagcaaguguucuaaccacuggaccaccuccaaagcccguagacuuuauuccaggccaucacauccaaaaucaggaucuuauaguaaggaagaagaguaauuggacauuggaaguuuuucagaauacaauaaacuagaucagcccguuaacaccgggagguacacgaugcucuuuauuuauuuauugcaccuucuauaugucaacagucuggaaaagcgugacuauucucugauaaaguuucacaacgcugaaaauaagguggcaggugguacccuuccuucccagaaggaaagagagaagaagacacuuccaaauucauuuagugcucaaucccuuagagcuguagugcugauauccucaggagcuucuguuuuccagcuaaaacacacacagcacagccccgcccucugacuggcuccagccuaaaccugccacaucuuucugauguccauaggaaaaguuccuguagguugaaaauucgaugcuuagacuggacccaccgagaauauacagagcaaucuuucuauuuuaagguccccaccagcaguguauuugcaaaguccccaugccauguaaacgcauauugagauaucuuggugauuagaguauagacucugagauaucugcauagcacagacuuaaaaucucaagaugauguuuugagaaaacacuuggcacaauucacccacugagauacucaagacaaagaagaucaacauaggcuuugguuuugguuuguuuuacuuuuuaguuuauuuuuauuuuauaguguuuugccugugcaccacauacaugcaguucccuuggaggccagagggggugccucagaucccuugagacugaacugcaguggcagugagccaccuuauggaugcugagaguguaagcuggauccucuacaagagcagccagagcucuuauccauuacuccaucucuccagcucgcuccuccacucacacacacucugguuuuaaucauuuuagaagguaaaucaguuccuacccaaacaagaauucauugguugauaguccaagacuuccuugccaugaagaaaaugccccucuuuucuuuugacccagaaacagaugucuugucuuuaggccacauagccguguggcccucuuuuuuacauuugaagaccaaauccaaacuuggucugagugagauaguauccacuucauaacuacaaauucauuuguaugauagugagaguggagguuuaaaauuggacaauggaugucccauaccuuuaaucccagcccucgggagacagaggcaggugguuaucugugaguucaaggcuagccugcucuguagagugaguuccaggauagccagggcuugucuugacacaaaauaaaacugagcaauccagccuagugugaugguacacaccuguaaacuuggcacuuaaaagacagaagcaggaagaucuggaguugaaggcuagccugggcuacauaaacucugucacacauacacacacaaaacuuguauaaugcuguagugauguguuugcuuuaucaaaaugcucaaagcuuuuaaaagugcugaccuauuagacuugcaauuccauuuaaauguucaggagaauuuaauugaauuuguaaucgguguuuaagugauuugacuuguaaaauuuguuguaaaaauuguugauuuguuggcuaugugcuuuuguguuccauuuugcuuaaguagguuucuauuaaauacugaagaaagccucgaag

SEQ ID NO: 7484 - RNA, 14071 nt, Mus musculus
uccgccccgggccggaaagugacuccaaagccacaacgcguuguugacgagagaagucuagguugggugaaggauccgagaaggcccucccagauucgggcucccagccccaggccccuggggcgcgggagaaacgcgggccccuccucccccgccgcgggcaccuagaggagcgggcggaacucgcggcuuuggcgguaggcgucccccuuccgggcgaucgggagcugaaggccguggcgggaggguggucgggcugggggcggccgccgcaggcugugggagggcgggcuaugccccugggccccgggugggaugcuugacaguggacaaacgaggagggggggcgggggcggggaggugggagugguuagugaaggaauaaggcggauaggggaaacccccaccccaggacuacacuguuagagccucuggcgcguauucauuucccaagaggcccuccucuacucaaaaaauccgagaccucucagcucugggacucuuuccucaaaccacccacuucuugugacccucaaaaugagcuggaggcccucucaacucgucccuucucagggcgguggucaucaguuuucucuggccagucgcccaccccagcuagcccuguuuaagaagggcuuacucucagggagaggccuguguauagaugauuuucuauauucuccacccgcgagguggacuugcuaucuccugggguuguuuaccaguucugucacuaggugcgaccuguugauuguuggauguaugccaugugauuaggauuuggguugaagggagacagagacuuugagauugccucugcccuuccaggacuccagguagaagccaugucuacuuggggguuugccuccccgacucccgaccgcuuugcggugucugcggaggccgaggacaagguucgggagcagcagacucgcuuggagcguaucuucaacgugggaaugagcguccucuccaaagacugcccagagaauccucauaucugguugcagcuugagggccccaaggagaacgucugcagagccaaggugaaguccucuuccuuuuagggcugcuacaaagccuuuuaggacgcugccccucccgaggccgagucggaggagggacugggaaaugccucuuggcaaucuuauuggcugccucucucuugagcuuugaggaacucagcaaaccuuuuuauuuagaauuuugguuucacuucugcugugcugccuagguucuucaggcuuuagaaccaaaucacuucaugcucuuggagauaguaagguaauccccucuguacaggugggccuugccagggaauucccugggguugagagggggccggccacuuuuuccccccuuugcacccaaggccaauaggcuccaucacuugacagcccucuggucuguucuuacauuuccauaggucuacagugugaauagaaacaguaucuacuuagaugauguaauagcuugaagcucagggagagcagugaaucugaaagggauggcuucuagaaguuuccucucugaccucccuaucuaggaauaccugaaggggcucugcagcccagaacuacagagugagauccacuacccacccagacugcacugcaucuuucugggagcccacgguuucuuccuugacugccuggccuggagcacaucugcccaccuggugccucugcuuccuggcucucugaugaucaguggccuaaccgaggcguuugugauggcccagagccggguggaggaguuagugcaacggcugagcugggaccuucagcuacagucuugucccggagccccugacaauggcggagugcugagagacuucucugcccugcugcagacuagggaggaugccuacacagaggcccugcugcggcugccccuggccgugcaggaggagcuccuaagccuggugcaggaggcaucuagagggcaggguccaucucgugagguggggagcucaggccuguugaguccucaguuccagggagucagggcucccuugaaugaaggcagggaauucguaggcaccagaguggcagggucgggaaagucgccagcaguaagaggacaaagucauacuguggagaaggaggaaaggaaacaggaugcugucagggacauggguucagggcggaaggagcugucuggggaagaggucugggagccuggaguggcuuacaggucacagcuagcagguggaggagcagaggagguggcacccuugaagggaaaggccucggggaaacaggagguuccucagcaaagaggaggguucagugugcagggugaaccuucaggugcgcaugugcccugucagagggcagcuccaauccggggagccucucuccuccagcggcuccacaaugggagcgccucaccuccgagagugccuagcccuccgcccgcgccggaacccccauggcccuguggagaccgagaccgagaucgagaucggggagacaggggagacaagcagcaggcuggagcucgaggccgagggucuccguggaagcgaggcacucgugggggcaacuuggugacuggcacgcagcguuuccaggaagccuuacaggauccuuucacccugugccuugccaaugugccuggccagccagaucuccgucacauugucauugauggcagcaacguggccaugguguaaguagcuggugggacugaguucuggagacagccucugaggggcuugugccgcagccuucucuggguccugacgucgacgcucuccguaacaggcacggacuccagcauuacuuuuccagucgggguauugcucucgcuguacaguacuucugggaccguggccaccgugacauaaccgucuuugugccucaguggcgcuucaguaaagauuccaaggucagagguaaguugggucuggucaucuguguccuggugaggcuggguccaccuugagaacccuguugcacuuuguucuacagagagucacuuccugcagaaguuguauucccugagucugcuuucccugacacccucacgagucauggauggcaagaggauuucuucuuaugaugacagguaauuguuccucuccuggccccgaguuugcuaucuaaggaaucuagugggauuuggaguaggacagagaugcucccgaccucugucuucuagccucaguaguagagcuaguuucagugggacaaaugauggguagcucagcucugcaggugagaggagacgggcuguagacagugaugguuugccugcucgcuauucaccucguauuuauauagagugcuuuauugucuaggaaauacugugcaauugagaucugcaaaagcugguggcauauagagcugacagaauucccaaauguagagaaauuguuugaacauucugggaaaaggagagcaaaccuuuaaaguaaacagaaggcagaaacacagucuuugaaugcuaggagugucuggaacaggauauggcuagaggccacaagacucaggauggaagggaaugucggagucagagccccagguuuucuuagggaucugcuuucucuauggccuuagccccaccucucagugaaucaaaucaaccucuuuaucucaggauccaucuccauucauuuacccuccuugugaauuccaaaagaagcuaagguaugugcuugccucauuccuggugcuaagcuggagggaagucuagugauguucccucuuaacagugcaugggcccaguuaaguauugcaugaagcugggugugguagucgcuccuguucucccagcacaugagagacugaagcaggauagucuccauuaauuugaggccagcaugagcuacaaaguguguuccaggcuagccuggacaauaaggugagacccuguuuuaauaaacuaaaaagaaaaaauaaaggcaaaaagugauaaauaaaauaacaucucuauuuacagagagagacagaagcuaagugguuaacucccuuggcaauaaaaaauuagaauuuaagguuaccuuguaggcaaaacagaaaacauagggcuuauuccugcauaguugugcacacaugguauggauauauaugcaguuuaaagcuaauuagcuacuuuuaaaucguuguaaacauuacaucuuauuuuauggguaguaguguuuugccugcaugcaugggugugcacugugugcaugccuggugcccacagaguccuaaaaaggguguuggaucuucuggagcuggaguuacagggcauugugaguuuccugcuguggcugcugggaaccaggucuuuugcaugcacagcaagugcucuuaacuuuugaaccaucucuccggcccuauuuacagucuuucaacagcuaucaauacuuauuccuuaggauguucauucaguuuuuaacaauuaguuuccaaguuaccgugauuaucuuaguuuauuuuccuauacuggcgauaaaauacuccgaaagaagcaacugaagggcuggagcaauggcucagggguuacaagugcuccuugcuccuucagguuuguuuccuggcacucacaccauuguagcacacacagcuccaaugagucuaacacccuaaucugggcuuugugagccugcgaugugugucaagacacaugcaacccgaguuggguagaacaacucaaaggguagaaggaguaagcugacuucugcaaguuguucucugaucuccacauucucauugugucacauguguguaugcgcgcacacacacaaacacaaauuagaaagguaacuuaaagggcuggagagauggcuccgugguuaagagcauugauuguucuuccagagcuucucaguuuaauucccagcaaccacauguuggcucgcaaccaucuguaaugagaucugaugcccucuucugaugugucugaagacagcuacaguguauucauaugcauaaaaugaauaacucuuuaaaaaaaaaagcaccuuuaagaaggauaauuuuagcuccuaguuucagguuacuguccgguucagguuacaguccaucagagcugggaaaucacaguaacaggaacuuaagggaaccggucacaucacauccauaaucaggaacagagagcaaugaaugcauacaugguagugcucagcucacuuccucauaggauccgggaucugcugccuagggaauggugccacucacaguggauggaucuuuccauuuuaauuagcgacauucuuacagaucacuugcucuagacaguccuucauugugaaugcuucucuggugauuccagauuguauuagguugacaauuaaaagcuaagcagcagagugauuauauguuuuaucuuucuauauauuuaguuuuuacuucugagaaguaacuaguauuuuacaaaagguccuucacuuucuuugugucuuaguuagguuucuguugcugugauacaugccgugauccuaagaaguguggggaggaaggguuuuauuucaucauaagcuuucaggcaauagucaccucugaugggaggucagggcagaaaccuggaggcagggauuggugcagggacugcagaggagugcuacuuacugacuugcucagcuggcuuucuuuuccuuuucuucuucuuuuuuuuuuuuuuuaaagaguuguuuauaugaguacagugucacugucuucagacacacaagaaguggguaucggaucccauuacacaugguugugagccaccuugugguugcugggaauugaacucaggaacucuggaagagcagucagugcuguuagcugcugagccaucucuccagcccaucagcuggcuuuuuuauaccacccagggccacuugccuagagguggcacugcccaccaugggcugguccuuucuuuaucaauuaacaaucaagaaaaugucccauacacuugccuacaggcaauuugaugagucauuuuucucaacugaggguccucuugcuagauaacuauauugugucaaguugaaacaaaaacaaaaacuuccccccaaaaccgaaaagccaaccagaacacugcugcugcgacugggucuucuuuggaucucacuaugaaucucugagccagacuaauaccucauccguauaggccagguugacuuugaguuugugccgcuucuccugcuucugccuccuaagugcugcuguuuuuuuuuuaggccuagguuucaauauaucuuagacaguaacuuguugaccauaucagcauuguaacagaauugauacuggagacugaguuuuaaugcauaguuccauagaaccugguggguacaugaucuucuaaccuuggaauuuuucuucacuauggaaaaaucaucacaguagagcacagcagggccuggcgaaugacugcugcagagcagggcgucuccucacaggagagcaguaaacugcuuaacuagaaagcgucucuguaugucacagagcauagcauccccuuagcuugcuucccaacuaccugcucucuguacaacagugccuuucggauacugaccacccacuucuaacuagaugccugacuuggagaaagaacucuggggugagaguugguccaggauccucugugaaucaagcacuucagggccugggggaagggagcccuauugugacugcauuuuacaggaaggaaggguuguucauugagaaggaugugggaugggcuggaucucuuugauuuuaaaagucuaaagucuaccuaccaccuugugaauguuacuguggaugcagaguuauuaaaaugggaccugggcaugguggcaaauaaucuuuaauaccaguacuugggacguggaggcaggggcaggggcaggggcagaggcagagguaggggcagggagaugaguaguuugagguaguuuuagcuauuuggugaguuggaggcaagccuagacuaugugacguccuaucuugaaauaaaacaaaaagagaacaaaacaagaggacuacuaaagugggccucaggugucuuuaaaaaauuuuaaauuuuggguuggagagaugguucagagguuaggugcacuggcugaucuucuagaaguucugaguucauuuccuagcacucacaugacaguucacaaucuuaugcccuccucuggucuguagucauacauucagacagacagagcaccaguauacauaaaaaacaaaccaaaaaccaaccaaccaaccaaccaaacaaacaaacaaaaaacccaaaaccaucaaaaaucaaaaccaaaagcacaaacccuuagaaacaauaacaaaaaacuuugaaguuuuauuuuucuauuuauuuuuugagauacgguuucccauagccuaggcuggccccaggcucagugaguaacugagaaugaccuugaacggauuccauugucuccugaaugcugcaguugccgguguauguugccacgcucgguuuauguggugcuggagacugaaccuagggccucgugcaugcaggcugggcacucuaccaagcaagccauauugccagaaaggaaucuccuuagguggcuuucacuguaagggcuuaggaugcauucagagacggagggaauaguuuaaggaauugaagucagauagcagagcauguguugagagaguaaucugauuguugaucuuagcuggaguggagggcacuugagggaauucugagagaagacuggaagggugacauggaggcucuuaguugccaggccuggacaugcggccuuuagucaaagucuuucacuugggcuggguugggcugaagggcagcuguggaagaguucuguguaaggggagagcaggugagacuggaggacggugggcaguuagguaaggcaaaugaauugguagaaggcugggcaguagucauaguuuuaaugucugaauuauuaaggugauugcggccuugggaaggaaggcagugugagaaguucuucauugggaacuuuucagaggauaaauguagguuugugagugacggguggggugggagagaguuagagcuagcucuuacugguucuuaguguugagugaaggcuguagugaauggugauguuggaagacugccucggguccuucacuguuucuucucuaaucucugugucuagucagucacguguagcugggugaugcugaggugugaagcuaacuauggaggcacaggcugugaucucagccacuugggagaccgaagcaggacgacugagaguucaaagccuacuugggcuacagagcaaauucaaggcuagaccaaguaacuuagcaagauccugucuuugauuuuuuuguuuguuuuugggacaguuucucucuauguagcccuggcugucuggaacuauguaggccaggcuggcuuagaacucacagagauucacuugucucugccuucugagugcugggauuaaagguguaugccaccauauccugccugucgcccugcucugccccaacuuguuggucucuaucucugucugucucucuaucaucuauguaucuuaucaucugucugucugucuaucuauaucuaaccuauauucaugugccuauuaucugucugucaucuaucuaucaucuaucugucggucugccuauuaucuaucaucuauguauauguuucugucaaucaucuauuuaucuaucuaucauccaucauguaucuaugaucugucuauuaucuauuugucuguuggucaucuacagacaucuaucaucuauuaucaaucuuuguaucuaucaucugugucaucuauguaucuaugcaucuauuuaccuaucuaucaucuaucuauauguauguauguauguauguauguauguauguauguaucaucuacauacauacauacauacauacauacauacauacauacauacuaucucagugguaaagcauuugcuuaggaugcaugagggucugggcucaauucccaagaagucuuccucacccuucuucaguuaagugaaugaguuuggagacugaccuccaucaccagaagugggucacaggugcugauaucuuacuguggggucagcuccuuggagagucccagaauggugucuguguuuugagacagguucauggugaagcuggcugaagaaacggaugggaucauugucuccaaugaccaguuccgggaucuggcugaggagucugacaaguggauggcgaucaucagagagcggugagagaauagggcaccggcucacaccuuucucuaaaccagcucuucucuggccacugggugagaauccuggggaagggcuugaagaugccucaaaggauaauagccaguagcuccugguggugcuggucccagacgccugggagguagccaggucaucucugugacguccucuuuccuccuuuagccugcugcccuucaccuuuguggggaaccucuucauggucccagaugacccacugggacgaaauggccccacccuggaugaguuccugaagaagccagucagguaaugccccugcuucuguaggcagccuguaggccugcucuucucugaaggauuggaggcuuggauggagugucacagcuugggccggcuuaauucugcgguagucuugaguuugcuggccuggccuuuaaaaccuccccagggaguccugauacagaccuucauacuagguggaggaacuuuuauuuucucuucuggucaguguguuugauggagcuauuugggaggugguugcauguagugauaaccguuugugcccacaccguccuuuggcccauuaacaaaugauuaaauaaggacaucucuuuaggggacugucuuccaaggcaguugauacugccauucaguggccugcuuaggaaacuucacaaauucauuuccgacagcuagaaauagguccgcuuggcugagguuccuggaggcccagcuuuuccuccagagugcuuauucguucuuauucugcuuuuucuccaggaagcaggguucuucuaagacucagcagcccucuaaaggcuccacagagcaggcuaaucagcagcaggggaaggacgcggacaggagcaaugguggcauucggaagacccgggagacagagcggcugcggcgccagcugcucgaaguguuuuggggucaggaccacaagguggacuucauccugcagcgggaaccguacugccgggauauuaaccagcuuucugaggcccugcugagucucaacuucugagccuuucugcccugcauagcugcugcccuauuagagucagccucccccagccccgccccuucucuuacagucccucugccgcucagaccaugaccuagacccacucuaagauggugcuuuggccagaggaagcaccagagaagagaauuugagugugggaauacucuuugccugggguaguuugaggucagguccuuaaaaugacucaaccugaggaaggaccacgaagccagcucuuaggagguuuugaucagacucagcgccucaacucugucuuuagagagggcuucuguaagauguagaagcuguuccaggagacugcgccuguggcuuuacuaccaaguuccuuaguuggaggauaggguaggcuggaggcgacaaaaaggcuaagcugagaaagaaagcacccucuggcugcuccucugagugguaggauaggcugagcucuacccuggcguguccggaggaauacugacucccagaggggucauagcgcuacgugggcuguugcagugggcuaguugagaaccagaaggcagaggugggcaggcuuccagucucagcugugccugccugugaccuugacagaguugcuuggccuuuacuuaugucuacacaucaggcauaaagauaaccguugagggaaaugagaacagagaaggcucccaugaggaccuguacuugggucauggcucaggcgugucugccuguggcuggcuguucaggcucccuagccagaacuucacauucagagauguccacuguccacucccucgauguuaacgcugggcuuucaguagaacaugcccuguaaauggcugcaucccuuuucagcaaccuucgaaacucacguuaucaaaauaggcaaguuaggguggauggcugcauuacuuaaauacucucagggcuccuauaaauggcagcugcucaguugcauuucaaguguuuguuuacagauugacaaggcccugguuaaauuuucuuucugguguugagccuauucaccaaacucacgaugucauguuuggcagugacaguguuagugggaucuaucuaauauuuccuuuauggaagacagguuucuuucggcaagacacacugcuaccuucuguguaugggaagcggaagcugaagcaucaggaucgagauaccugauugguuacagacggacuccauugaccugucaugacaagcuguuuacauucuaacucccacaagucauugcucuguaucuguuugaacucugucugugccggggaauguacugucugcaagguggcacacuccuuacuugauuguguuaagcaguuuuuccucuaguguagucuaaccugcuucucugugacuuucacuuuccccaggaguaauuuagggcuagucaacuucuuagaggccagagucggguagagguauaaaaagguaaggcaggugccacuggguucauguagcaagucccugaauuagaugccuuucuagcucugacuuaguccaagugacauggaguuaacuauguggcucucugggucccagugucuuugucuguuuccuugggugauuuucauuucacaccagauugauuagguguuggggacaaguugauuaggggaaugacaagggagaagaagagaauggucuggacugggggcugguagagcugccuuuuaagcuuaggauuggugucuucucuuuucucuugccaugaugguggguaugcagaaggcugggguuaucuucccuucccugagugcccuggaaggcugaguguuccugagaagaugagagaccaagcuuauagagggacacugacaucuuacugcaguaugacgagccgggaccuguacacguuuacuauauuaacucauggcuguuugguaaaugcugaaggcuagcccacagggcccuuuucccacuuuugcuggcauccucugaacaggugucagggugacaccagagcucacuggagacagaucuuuauauguaucgccuuuaaucugucauaaccucaugucucaccagcucauuuggaaagagagacugagaaaggaaaagaugaggagagauugcauguuaaaacguuaagaacccagcuuaggagaagagccauguaggguaauaguucuucagauaauucuaggggaauauaagccaaagagacagcggaagccagugaucuagcgauguaaucuaucuuuauugccauaacuguagaacauugucuacacagcauauaugagaaccagggcaacaauguaacacagaagccacagaagaaguugaagaggugaagguuagaaugagauuauauucuugaggcuggaguuucucagauagggguggaucaacgaacaugggaagagaguggggugagggggggcagagucuaagacccugauggauucugaucucaaucaagugcagggaucaucaccugacccacuucucagagugcgggagcaggccccagcuucugccuuggggcuccuucucugcucaggcuacaacauccuucaaggcagcccucagcucugggaaggaguacugguagccaguagccaguguccgccgagggaccacuuuuugcccuuccaacagcaugauggcacguucuccaaagaccgcucguaccacagugcuggggacagguaugaaggcugggcggcccagggcagcacccaaggccugggcaaacucagcauugguaguuguagaugcuggagccacuccauucaggacuccuuggacgugguuugcuucaagggcauaguucagaauuccugccaggucaccaauguguauccaggggaagaauuggcgaccugaaccgauggggccuccuaggcccaggcggaagggcagaagcaugugacugauggcgccaccuccacggcccagcacaaccccuaaaguagagaggugguacauggaggcugcuuagccuugaaaauuugcacuacucugcuuucccuucucccuuauggucuucccgugugcacguggagugggcagcguugagggcugugggucuuuuggggauuuuucccucugcuagcuaaaguaauaguguccucucccugcaagcucagcccaggaaucguccauguugccugauucccaggcccuugguccucaccugaacguaccacgaccuggcguguagacucuccaggaagccuggcugcugcuucccauuugguuaccagguuggagaaaaagucaaaauucccuccugggcugucuucaucauacuccuuagucaggcuuggcugguaguaagcugucauggaagagcguuuguuugcucuggcggucccuggccugcugggcccuuuguagugcaaggcuccuuagccucagucuccucugcccuuuggguuuccacaggagaagaaagaaccauaacuguuucccccuugagcuucucuguguguccaugccugaacaucuagcuuuuggcugucaggcuguguccagaggccgcuagcuuguaguggguagggacagaaacguaggugcuaagcugcuugaacuggaccauucuugacaucugugacuuuuuuuuuuuuuggcaaguuacuucuccguaugaaaaaaaucugcauccucaguaugggaguaacuguaccuaccucauaaaguuguaaggauuaaauaauauguauauaauaguaugguggcuacuacucauuuuaauuguuugcaauuguguggucucaaaggagacacaacaaagggagcucuucauaaagaacugcagugcaaaaaagcaaggggugugggaguggggagaugccuucugugcgcacuaggacccguaccacaccucuuucucugagggcucccaauaaaggcucucuagccaaguaccccacacccccauucugccuuuccacacccauaaagacca

SEQ ID NO: 7485 - RNA, 2976 nt, Mus musculus
cuagcgauguaaucuaucuuuauugccauaacuguagaacauugucuacacagcauauaugagaaccagggcaacaauguaacacagaagccacagaagaaguugaagaggugaagguuagaaugagauuauauucuugaggcuggaguuucucagauagggguggaucaacgaacaugggaagagaguggggugagggggggcagagucuaagacccugauggauucugaucucaaucaagugcagggaucaucaccugacccacuucucagagugcgggagcaggccccagcuucugccuuggggcuccuucucugcucaggcuacaacauccuucaaggcagcccucagcucugggaaggaguacugguagccaguagccaguguccgccgagggaccacuuuuugcccuuccaacagcaugauggcacguucuccaaagaccgcucguaccacagugcuggggacagguaugaaggcugggcggcccagggcagcacccaaggccugggcaaacucagcauugguaguuguagaugcuggagccacuccauucaggacuccuuggacgugguuugcuucaagggcauaguucagaauuccugccaggucaccaauguguauccaggggaagaauuggcgaccugaaccgauggggccuccuaggcccaggcggaagggcagaagcaugugacugauggcgccaccuccacggcccagcacaaccccuaaaguagagaggugguacauggaggcugcuuagccuugaaaauuugcacuacucugcuuucccuucucccuuauggucuucccgugugcacguggagugggcagcguugagggcugugggucuuuuggggauuuuucccucugcuagcuaaaguaauaguguccucucccugcaagcucagcccaggaaucguccauguugccugauucccaggcccuugguccucaccugaacguaccacgaccuggcguguagacucuccaggaagccuggcugcugcuucccauuugguuaccagguuggagaaaaagucaaaauucccuccugggcugucuucaucauacuccuuagucaggcuuggcugguaguaagcugucauggaagagcguuuguuugcucuggcggucccuggccugcugggcccuuuguagugcaaggcuccuuagccucagucuccucugcccuuuggguuuccacaggagaagaaagaaccauaacuguuucccccuugagcuucucuguguguccaugccugaacaucuagcuuuuggcugucaggcuguguccagaggccgcuagcuuguaguggguagggacagaaacguaggugcuaagcugcuugaacuggaccauucuugacaucugugacuuuuuuuuuuuuuggcaaguuacuucuccguaugaaaaaaaucugcauccucaguaugggaguaacuguaccuaccucauaaaguuguaaggauuaaauaauauguauauaauaguaugguggcuacuacucauuuuaauuguuugcaauuguguggucucaaaggagacacaacaaagggagcucuucauaaagaacugcagugcaaaaaagcaaggggugugggaguggggagaugccuucugugcgcacuaggacccguaccacaccucuuucucugagggcucccaauaaaggcucucuagccaaguaccccacacccccauucugccuuuccacacccauaaagaccagacugugacaguacagaucugggucaggaagaaccugcaaggcuggaggccuaggcagugacccugggaaggaccugugauucgggugcaagccccaagugccucaacugcuugcucuguucucccuggcuccguuaauguaagaggcuggugauuugggagcguaccuacaccugugacuagaauccaagccugaggugggugcgcaguuucggugauggcuuuggcuagcaaguggguaguauccaagcggcucguaagaaccucuuuuuggaagguuucauuccaucugcagagaaaaugaaagaaaaggucaaaagugcagacaugcaccuagaccauauccuccccacucauccggcuccccucccaguaagucuguuguccuaagccugucuuaaugcauagcucgggguggcuaagaagauaggacucucucccccggcccccaauaggcaugggcuauaucucuuuauccacaacacugggcuuuaguagacgcugauauauaacaggcuccaaaggcuuaaggggacacuugcacaaguuuaugucuaccaugcacgggucacaggcaucgacccucucuccccccuguacaggugauaacugcuuuauggcccuguugaccuucgcagaggguugaggauauucucuccagccagguugaugacaacaucgcagaggggcagccccgacucacugaguucacucugugggagaaaguacagugccggcugguacuguccuucccgcgcaaauugcccucccacccaccuuccagaagcucgaccuacccacgugauucgacccgggccaggcugucuggagaccaauuuaacuucguggccccugccucucagcagcuggguuacggcugucccaaugaaucccgucccgccaccugaugggggagcacaaacuguuuacucagcgggguggcgguaggucaucugcuggcggccccuuugggugcgguccccaucugacaucaggccucuccaacccaccccgcgaugcagaggugacaaaagucacagggucgcacagauucagcuuuuggggcugggaaaccaaggcuagguugccugcuuaggagacugcacccugugggccuguuuucucagcucucggcuacagccuaagccggcccgccacucugcccucccucaccuacaagcacccgcauagcgacagggagcuagcacgccugcgcgagauuuaaacaccggacgcgacuacg

SEQ ID NO: 7486 - RNA, 4943 nt, Mus musculus
ugacgucacacucuauuuaauugagauaucauaauuaacugacaacucauuuauagauggguaaauugccuaauguuucucauaaaguuaugauucacacuuuaacgugugagcacaguucuaacuucuuucuuuguucauaaagagagaaaggcucucucuccaagagaguaaacaaugugucgugcugugccaugccauugcggcuaacgcugggaaccgguucucagcaagaacggccuucucaucaccugaugaugauggucacugaugcugucugaccuuucagcagcggagguaagaggaauccucgaaugacacuguuggugggugagggguccugguggcagauggcuuauauuagacuccuuucaucucauuuuuaacuugacaaauaaaaacuguauguaauuaugccacaccacaugauuucucuguuacaugugagcaggagcaaugacuaaaucaagcuaauuaauauauuaauuaucuuagauacuuuccaaaucuaaaaucucucagugaguucuaguuauaaaauagaguguuauuaagugggaugcggugguacacuccuguaauuccaggacuuuggaggcugaggcaagaggaccagagauucaagaucauccuugccugcauagugaguucaagacuagccugggcuacaugagauccuaucucaaaaagaagacaaaaacuaacuaaacaaaacccucaaaccauuauuauuaauuauacucgccauggucuccaacagagcucuaaagcagaucucuggcuguguuaauucuccaugcuuaguuauguuuuacuuuaauuauguuuuacuuaggaaacaguuuaccucuaauguuaaaaaccuauaagggaaaaucauacaguaaauauucuauucuuagaaacuccucgugauaccagugaauaacacgcacauggcuugagcagcaagugguuugaccuucugagacaucuugcuaaucccuauuuucaguuuucaaaaacaauuuaucauauaacuguggcucuccuuguccucggggaucgucggcugauaugauccacaaguguaacagagagcagagagugugaacaggggaagggugaguggagggaagggggucaggguacgagugggugguuccggagcucugugaauaugaaugaucacuccuggaccagcugcggggagucauaccaacuuuauguagggugguucaaggcuuauauaauuuagggggcugaggguaggaacauccaggaugggcaaagguuauuggcugagagcauagggacucaaaugccucauuagcaugggaagcauuucaggaagcucagguucuagcuaguucuuaucaggagaaaagaaucugcaaucuaacuaaggcuacgugacauuccgaagguagaagguuuugaauuccccagacaaggucugagaagaagcccugcauaugaagggagcccuccauauggcacugagcucagaggcugucuagccaagggugaacuuuaaccuuaauuaguggaguuuccccacaucucccccugauuuauuuuuuaaugagaaacaucacaaaguauugaacuucuguauugggacagcuugguacugaaccagaaccuguuuagccaugguuuucccaaugcuauuaucugcuguuuuaaaacuggaggaggcagggauaaaacacaacauaaaccagaaggggcagagaggggugggagccaacaauauaauugaaauuauugaaacaauauaaucgcucaguggacugaaaccucuagagcaagucuguacagaguuuucugaggauaucacauuggucuuaaacagcauuggauucauuuacauugauauaacauucuuccucacuacuaugaaaaaugccccuaaguuuagcagucauuaggccccagcaagagaguucaccugccgcuggagggacccaaagcugucaucaucuguagauaccacugccugcuugucucaaaagucuauagucagauggugggccuggauaaaggcaacuuugugacaccacaaagguccaagggagauggugggucagucuccaucuugccugcagcagcaguguugccuucauuuccucacagacacaaaccuguggaauaaucauaacagaagugcagaacccuggcagggcggugucuguucucucucucucucucucucucucucucucucucuauauauauauauauauauauauauauauauauauauauauauauauguacuggcuaguuuugugucaacuugacacagcuggaguuaucagagaaaggagcuucaguugaggaaaugccuccaugagaugcaauuguaaggcauuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcucccugaccugcuugaguuccaguccugacuuccuuuggugaugaacagcagcauggaaguguaagccgaauaaacccuuuccuccccaacuugccucuuggucaugauguuugugcaggaauagaaacccugacuaagacaaauauauauauauauauaauuuuuuacaccaaaagaagagaguggguagagcacaugcuaagccuguaagaguuugauugacaucacacuagugcuucauugcuauaggccuaggagaaaggcaaggguguugaggaaucuuaauccuggaagugggaaaucaccuaguugcuuuaaggaaagcagaggggagaguugggaauuauuuaucucauuugcuuaagguagccaagcaaagaaaauaccauguuaauaauauauccagaaugggcaauagccauuugucuguaaaaaaauaaacugccuucaguagaugaucucccuuuuuucaaauugaagauuaaauaauaguuguuaaugcaauccgugugaccugugggagguagacaaagaagcuugacuaccuaagacuccuggccuggccgugggggauacagagccugaaccaguuaucuccugaaaccaggcagacuuccaguggagagauuugaacauccccccagccacaacaccuuugaauuuguccugcuuacaagaucugcggggguaaagauggcacagaaaucgugcaaguggccaaccaauaacugguccagcuugagauccaugccccaugccaugagauggagcgcccccccccccccccccagugccuggagggucaggauccagaggcuagauagucagagacccaugauagaaucaaacacgauuggaaaaaaaaaaggcaaugaaacuacucuuaaugcuacucugcuguacucauagacugaugccuaacucaauugucaucagagaguucaucuagcaacugauggaaacagaugcagggacccaaggccaaacauuagguagagcuugggaauucuguggaggauggggaggaaggauuuuaagagcuggugaggucaaggacacaaaaaaacacacagaaucaacuagccugggcucacaggggaucauagagacugaacccacaaccagggagccugcauagaucugaccuaggcccucggcacauauggcauaguuguguagcuuggucuucuugugggaugccuaacagugggagcagggacugccucugacucuguugccugccuuugagacccucuccucuuaugggguuuccucaucuagccuuuauaggagaggaagugccugcuuuacugcaacuuaauaagccauguuugcuugauacccaugggagacugcccucuucugaaggaauauggaggaggagugguuggagagggggagagaacagaugggggaggguuuaggaagagagaagggagaggaaauugaggucaggagauagaaaugaauuaaaaggaaagagaaaagucuaucauuucuguuccuuggcccaggggaccucaggaagguucagcuucucuaguuuucaggauggcucagcugugugagccguaagcacaggaugcccauggagcagugcuggaccagugggggacuggagacgaguguaugcacuuuccuggugcagagucuauggucaggacacacagguguaucaacaaagcacaaacugcuguuaguccuguccucuagagacuauuuccaacauuauuuugauauagccacuuccagcaguuuuuaggauggcuacacaccauauauaauuaaaacugagacgcuaccauggaaagauuuucaaauugcuuuuaaaaaagcauuguacugaaauuucugcauuauuaaauaugucugagaacaaauuauuaacuaucaaaacacucagcccuguaaaucuaccauuuaaauucuguuccauggaugguauuccagugugcuuuaaaauuaaguauguugagauucaaaucuuuauacaacagucuucacacaugucccuuucacuucuuaaggaauccccggaaauaacuugaucaaagggauccacccugcccucagaagccauggcuguugccagccuuagccucugauugguguccucaugcuaccacaggcucuccuccagccacuucuuuaugggcagaugguguccuuauccugcugugugcuuucugacaaccauugcucuugcggacaaaugucuguacugagcaauuuguggauggguggauguugcucaagcuggccuugugaucauuucucaucuuguuguuccuggccaucuguucuauggcagcgucugaggggcaauccccucugccuccccuuagagcucuacagaugggagaucgcuuuuccagaugagcuccgagaagacuguuugauccuagcuguccuaccuguaccgacuguguacauc

SEQ ID NO: 7487 - RNA, 3115 nt, Mus musculus
cucugggccucuuuccucaccugaugguuuaaaaguugugagaaguaacaaaguggccaacugagaccuggucagacccugaagaggauguuccugcuccugguccuccugguggcugcccugccagucaacgcugaaggagguaagcaaccauccucaucccuagagguguggcauguggcuuccagcacugauaacugcaugguacccagucagacuguauguaagaucuccuccugacuugguucaucugagauguuagcuaagccccagcucuagcaccagauaaauaggacaccaaagucacaaugaccuacuggcaguggcaccugaugagugagaccucaucaccuaaaaguaaugaauuauaaaaauaucauaggacccuacuaguugaaagaaaggccuggaaguuccaacugcacaaaccuaagagcaagcggcuuccuccaggggcugccaccuggauuaagacuagaagaauucuucuauucagguuuccaggugucaccuugaucucgucucuguucuuuggaaccauacaggucugccaugagaguuggccacaaucuaacagagccaggaaagugugcccucaucucugcuucacagauugauggaaacaggcagacguaggauccucgaacccauuuucuccccccucuaugaucccugugaguccuguguccuuccuucuucauccugaaggcuaguucaaugccugaggaagauaaaucuaugcugaagcuuagacuacauuaggagcucuugucccagcuacucgcuuagcacauuugagagcuuaucaguguuuacacaacaauccuaucucuaaguggaguacuuacucugccucaugaaucagaauagaggagaagcagaguuuucuacucaguagugcaccaugcuuacuacaggcagagcccagugcuuaagugagcaggacaccaggugaaucaugagacacaggaacacccguaguuguuuggaguguguucuagauggucuggacagugugugcugaauucuuccuuaauguguccaugagauuuaauuugauucaaggaaaagucuuggcaccaucaugacuacaagaagaaauugaaaacuagaggaaagugaugccaggcagcaggcuuugugugaucucucgcagcacccagacacccuuucuuguugcgugacagccccuacaaaagaaucuguucucuuuacacaucagguccacagacucuccaagcaugaagugucccuuaccagccuccagauaacuguugcacaguuuccaugagcacaaagauucagaauaaucucucuuuuucaggggaaaucauaugggguacagaguccaaaccccacucccggcccuauauggcauacauaagguuuaaugacagcaaaucagucuaucgcuguggugguuuccugguggcaagagacaucguaaugacagcagcucacuguaauggaaaguaaggagaagcaacugggucuuugaugccugggacuaaccaaauaacaacagauccuggcugucccuaaacguguagagccaaaggugaagaucaaccugacuauauccuauuugaccuaaagugguugugaaacucaggaccagauagugucagugaagggucugaauggcugggugguuauugaagaccuaaggaacaacucccucauaaaucucuugcuauuugacucagucaagcucuacccucaacuugccuuucagggacugcuuucauugcuccuguuguuguacuuaacucaucuucuuuucacagaguuauaaauguaaccuuaggaauucacaaucucaagaaaaagaaaaacacccagcucauuccugucagugaagccauaccucacgagagcuuugacaaugaaacacuggucaaugacaucaugcuccugaagguaccauuuuacugaucacugguuuucgcccauagaucacugguguaucagucccaucuucucuucuagguggcugaccuauuggucccagggcaauagaaugaggcuagagugggaccaggggugggggacagggguagagauacaggcagccucaucccugguuuaagcuugcugagagugccaggccugaacucguauucuucaucuuucugaccagcuggaacgcaaagcucaacucaacagugcuguggauacuauugcccuuccaaagagcaaggauugggugaaaccugggcaggugugcacaguggcagguuggggaaaguuggccaauugcacuuugucugacacacuucaagaagugaaucuagaaguucaaaagggccagaagugucgcagcaugucccaaaccuacaacgacuccauccagcucugugugggaaaucccagugagaauaaggcuacugguaagguaaggacauaaccaucuuuuaauguuuucccagggacagagcaauacugcagacacacaggcagccuaucuccagcuguacaaccauggcuagucuagaggacauagagggaacaaaauauggggaccuggcauucacccucagccaaacuuuuguccuuucaccaugggaaaauaggagagcuacgucuaguuaaccugaaggagggucacaaccaggcagagacacucaagucagugagucaggcucucuauucagucauauucagaaucgaggucaauggaggcacuaauauuucccauaugaaaacccaggccguagugggaacaacaacaacaaaaauaaaauaaaauaaaauaaaauaaaauaaaauaaaauaaaauaaaauaaaauaaaaaaaauaaaaaacagggagaaagugggucuagaaagaggugaaaagaguauuuacuaaaacuuccccuuuuucuauccacagggugacucuggcggacccuuuguguguaauggggugguccagggcauugucaguugucgcuuguguacugggacacuuccucggguauucaccagaauuuccagcuuuaugccuuggauucggaaaacaaugaaacuccugcaacaacccuagaacacaaaaccugugucugggccaguguccagcauccugggguaugguugucugagccuuaauaaagaaaucugucugcaggaaacag

SEQ ID NO: 7488 - RNA, 2696 nt, Mus musculus
gaugaaaccuuucacacgagcaggaaaauagaucugugaccucucagaaccacccuuccuuccucucucuccaggggaggauaaaagucuggcagagaaaagccccggcagcaacugacuaagcaacgguucuggaaagaugcagccucuccugcuccuguugaccuuuauucuacuccaaggagaugaggcaggugaguggccaaccacaccucagagaucagguccuguccuauacacuugaauagacaaguuguagcaauccuaacucugcauuguugaguaaauuucuugaacucacaucuccucaguuuccuuaccuauaaaaugcaaauggcauuaauacuguggccuaagguugcuaugacaauuacauugguuaauaaacaagagagucuuguuauuggcccugacauauagaaaguacgauauaaauguuuccuacauaaauuuauucagucacccauaucuagugccaugauuugagaagguagacucugggccauggggugcucucugaggaaggaaguaccagggaaccgagaaagcgcagacuuugggaaagcgucucaauagccagaaucagccucauguggaacaaacauccuucuccauuuggaggagcacacaaaggucugggaaggagacgagucucccuucaaacuaggaguaacuccugugaagucuuagcaucuucuccaugugccuggaggccugcaaagcuccucuguaucaccucccucccccacuugcagccuuucuaaagcugcccaccuggcacugccggcaagcucccagguacacggguaagugccagaucuuucuuugcagggaagaucauuggaggccgagaagccaggccccauuccuaccccuacauggcauuucuucugauccagaguccagaagggcugagugcuuguggaggguuucuggugcgagaagacuucguccuaacagcagcucauugcuugggaaggugaggaacucagacgcuucucaggaagucaguguccccagacucccuccacagagccugaacguaugcuauuacaauuaaguauaaugauaaugaaauucuggagacaagaugagaccaggaggagggcaguaagaagcaagugucuguacacagaaaaggaggcuaugauccaaaagccaaccaaccaaacagaagaaaguggaaagcacaggcugggcgcuagcuaacuaagaacucaaacuguuucuguuuaaucugcuuuccccaguucaggguuugugggaaacagcaagaaggggucaggcccaaggcccuccuaucccccucccccccacacacaccccacccccaucccgcucucuccagcuuguuuuucugcucuugagccauucaugcacccugcggaacuguuggauguaugauccauguaugauguaugauguaugauccugguuauaguaucuacccaaccuuucuuucgcagcuccauaaauguuacucuaggggcccacaacauccaaaugcgagaaaggacccagcaacucaucacagugcucagagccauccgccauccugauuacaauccgcagaacauccggaaugacaucaugcuucugcaggugcuccccuuucccuucugaccucugcuucuccaggcuugcuggcgaccucuuggucuguggcauuugaggaggaagucggggcaggguuccaggguggugagggagacgcgaaaucccuaagugcugaugggaaagagcagugagcugaaaugccuacauccauauccugacagcugaggcgcagagcccggaggaguggaucggugaagccuguggcucugccucaggccagcaaaaaacugcagccaggggauuugugcacaguggcuggcuggggccggguaagccagagcaggggaacaaauguacuccaggaggugcagcuaagagugcagauggaccaaaugugcgccaaucgcuuccaguucuacaacagccagacucagaucugugugggaaacccgagagaaaggaagucugccuucaggguaagaaugugaacacccacuaguguuucuugggacaaaguauaacagaggacagcagggcaggucuccaucccuucaauccuggguacuagaccagaguagaaaggguuuuuccucuucgagagugacaggaagacacacaauuuaucuuacuggggaagguggagguaccuggauggagugagcuggaggcaauaacuuuagcaggaucugaagccuagcagcggaaaagcccaggaacuugauuccugcaauccuauaaaaaagcucaucacccacacacaggcaacugaaggaagcccccagcccauaccuuucucugagagccuguaucaugggacagcaaggggcagaaggccuagcuuuguguccuuuuccuccucugcccacagggugauucugguggcccccugguauguagcaauguggcccagggcaucgucuccuauggaagcaacaaugguaacccuccagcuguauucaccaaaauccagagcuucaugcccuggaucaaaagaacaaugagacgcuuugcaccaagauaucagagaccugcuaacucccugucucaggcacagaccuagggacuuccauagcccuuauuaaugccuucuggggaguguacauuuucauuuauuaaauauuauauagugcugucuuaau

SEQ ID NO: 7489 - RNA, 3027 nt, Mus musculus
ugcagucuggagguuauuuauugugaauuuucauucuuugcugcccacuccacgugguucuugccugaggucggacaggcuggucaggcacgggugguuuaacaccuguuagagcagcuucauguuccugcuuauccacggcaggaagugcacaaucuuagugaagacuccugaagagauuguccuguuuuuugcauaggcuaaaaguccauaagcuuuguugucacacacgaggggucccccagagucacccugugggcagagaaaggaagaacuuagccuggcucccucuggcucugcuggccccaccuccuccuggcaaggcuaacuuuagaucagggcaggacagguuuuccagcuucccucagucccagagcuccagggaggcccaacuuuuccuucuaucccaggccuaggcuuucccugaaguccucagggauacugagauaauuuauccuguuugggaugacagagguuuuccugcugacacucuugcuauacccacucaagaccccaaagcuggauuuuugggcuuucucuuaucugaaaugaggcuugaggguuuugccauucucacaccauggccucuuccagauucuucucauuuuguuuguuaaaugcuugaacucucaccuugaaaggagucuuuauuuucuucaagucuccagcacaaaucucuguggucucaguguagugucggaaacguuuuuugcauuccucauccuccuggaugaccaguugagccucucgcaggcgggcagaugcuuuagugucauugauggaccuugacccccagccagccacacugcacacauccccuggcuucacccgggcauugggucugggcaacuugaggggucucacagcuuuaguucucuuggccuuacucuccagcugauagggaagagggaggagagaacagcucagcuaggagccugcuagccugagacucuuugaaagucaagauggaagagagaaaagaagaaccuguaucagaaaaggagggggagguucacccugcaccaagaagaacacagccaggaggcagggguuugugguugggagggugacaggucucaccuuuaacagcaugaugucacugaagaaggcaguggcauuauaaucuggauggggaauggcuuuugccacagggaugaucugcugugucuccuccuuagccuugauguugugggcccccagugugacugucauuguccuguggaaagagcaaaguggagagcagagauguggagucagucagagaggaugcaguccggagcugugaaaggcaggguagucaggguugggcucuagcugagaggacuugaggaccaaggagggucucagagucagaccuacugcucucugacucuuaagaacaugggacucccgggggaucccucuuguaucuaggcaauauuccauagcuugcauuguguuuuagugugaacuuucaaccucaaaaaccgcuuuaguuuggccaguguccugcuggcucugaccucuugcaauuggaccuaaaauuuaccucucaucagauucccauuuuacauuccuuccuucaagagagcucccaugggaucacccacaauaaacgacaggagaugugugugugugugugugugugugugugugugugugugugugugugugccugauaaaaggugggcuacuccucaccuguuccugcagugagcagcagucagcacaaagucaucuugaaccaagaagccuccacaguaucuccuauuaccuucaauauccacagacuuaacaaacgccauguaggggcgggaguguggcuucaccacauggccgccgaugaucuccucugaaaaaagggguagaauaaguauagaagcaguagauaggguaagcaggggagaucuagggggugacugggcgucggaucugcauuccccaaagccuauugcagacaggauuccuuguucauggaauaaacuuugcugacacuuaagccuuagaacccugcucuaggaagguguggguagcacuuaacuuacaccuccuucuuuacaaauacacagaaagauaaucucugucuucaucauguagaaguugagggaauccugcaaauauccacguugguauuugguuguuggugucaucuucucacauuuuacccacacaggccauauagagguggauuuucuaacauuauuguaccuaacacauuguggguucucaguaaaugcuuuuugcugcaugaaagaguggcuuguaguuaacuggggggcuggugggucagugcuggugggauucugagccagggccauauuggaacaguaugcugucccagcuagaauagcuggcgaccugcagaagaaguggagaugccaacuaaaacuagccugcaaagcugguggagcaugcagugcagguucuugucagucugggucucuuucuucugcaggguuggggguggacuuaauaaauaaugcugagauucuugagcugggguccucaccccuuuguuugcuugucauuaaggcuuccuugucccuuggcuaacgucaagaugcacauuuuugaucuuugcauucugugccacaucucuuucuaaggaugauccaguuuccagguaaugaaaaaacaaaaaaacaaaaaaccaaaaccaaaccaaaacaacaacaacaccaaaaacaacugugagaagcuaguagcuacuaaauuucugagaacaacucccuuucucacaccuuguugagaaucuagccagugucagauuuccaagucuggguuugguaccugagguucagaaacauccuggguccagugccaggacaauuccugacuacugcugggcagaaagucaccagaggugucaugggauggcaucauugguacagggguguucacucaccugcuccagcuccaagaggcagaaguagggucaggagaaucaggacugguggcaucuucccaggaaggcugcucaguugaaggagagcaaaggagacaaagcccuuggaaggggaggaaggaggugugggcucagggaccuca

SEQ ID NO: 7490 - RNA, 3027 nt, Mus musculus
ugaggucccugagcccacaccuccuuccuccccuuccaagggcuuugucuccuuugcucuccuucaacugagcagccuuccugggaagaugccaccaguccugauucuccugacccuacuucugccucuuggagcuggagcaggugagugaacaccccuguaccaaugaugccaucccaugacaccucuggugacuuucugcccagcaguagucaggaauuguccuggcacuggacccaggauguuucugaaccucagguaccaaacccagacuuggaaaucugacacuggcuagauucucaacaaggugugagaaagggaguuguucucagaaauuuaguagcuacuagcuucucacaguuguuuuugguguuguuguuguuuugguuugguuuugguuuuuuguuuuuuuguuuuuucauuaccuggaaacuggaucauccuuagaaagagauguggcacagaaugcaaagaucaaaaaugugcaucuugacguuagccaagggacaaggaagccuuaaugacaagcaaacaaaggggugaggaccccagcucaagaaucucagcauuauuuauuaaguccacccccaacccugcagaagaaagagacccagacugacaagaaccugcacugcaugcuccaccagcuuugcaggcuaguuuuaguuggcaucuccacuucuucugcaggucgccagcuauucuagcugggacagcauacuguuccaauauggcccuggcucagaaucccaccagcacugacccaccagccccccaguuaacuacaagccacucuuucaugcagcaaaaagcauuuacugagaacccacaauguguuagguacaauaauguuagaaaauccaccucuauauggccuguguggguaaaaugugagaagaugacaccaacaaccaaauaccaacguggauauuugcaggauucccucaacuucuacaugaugaagacagagauuaucuuucuguguauuuguaaagaaggagguguaaguuaagugcuacccacaccuuccuagagcaggguucuaaggcuuaagugucagcaaaguuuauuccaugaacaaggaauccugucugcaauaggcuuuggggaaugcagauccgacgcccagucacccccuagaucuccccugcuuacccuaucuacugcuucuauacuuauucuaccccuuuuuucagaggagaucaucggcggccauguggugaagccacacucccgccccuacauggcguuuguuaagucuguggauauugaagguaauaggagauacuguggaggcuucuugguucaagaugacuuugugcugacugcugcucacugcaggaacaggugaggaguagcccaccuuuuaucaggcacacacacacacacacacacacacacacacacacacacacacacacaucuccugucguuuauugugggugaucccaugggagcucucuugaaggaaggaauguaaaaugggaaucugaugagagguaaauuuuagguccaauugcaagaggucagagccagcaggacacuggccaaacuaaagcgguuuuugagguugaaaguucacacuaaaacacaaugcaagcuauggaauauugccuagauacaagagggaucccccgggagucccauguucuuaagagucagagagcaguaggucugacucugagacccuccuugguccucaaguccucucagcuagagcccaacccugacuacccugccuuucacagcuccggacugcauccucucugacugacuccacaucucugcucuccacuuugcucuuuccacaggacaaugacagucacacugggggcccacaacaucaaggcuaaggaggagacacagcagaucaucccuguggcaaaagccauuccccauccagauuauaaugccacugccuucuucagugacaucaugcuguuaaaggugagaccugucacccucccaaccacaaaccccugccuccuggcuguguucuucuuggugcagggugaaccucccccuccuuuucugauacagguucuucuuuucucucuuccaucuugacuuucaaagagucucaggcuagcaggcuccuagcugagcuguucucuccucccucuucccuaucagcuggagaguaaggccaagagaacuaaagcugugagaccccucaaguugcccagacccaaugcccgggugaagccaggggaugugugcaguguggcuggcugggggucaagguccaucaaugacacuaaagcaucugcccgccugcgagaggcucaacuggucauccaggaggaugaggaaugcaaaaaacguuuccgacacuacacugagaccacagagauuugugcuggagacuugaagaaaauaaagacuccuuucaaggugagaguucaagcauuuaacaaacaaaaugagaagaaucuggaagaggccauggugugagaauggcaaaacccucaagccucauuucagauaagagaaagcccaaaaauccagcuuuggggucuugaguggguauagcaagagugucagcaggaaaaccucugucaucccaaacaggauaaauuaucucaguaucccugaggacuucagggaaagccuaggccugggauagaaggaaaaguugggccucccuggagcucugggacugagggaagcuggaaaaccuguccugcccugaucuaaaguuagccuugccaggaggagguggggccagcagagccagagggagccaggcuaaguucuuccuuucucugcccacagggugacucugggggaccccucgugugugacaacaaagcuuauggacuuuuagccuaugcaaaaaacaggacaaucucuucaggagucuucacuaagauugugcacuuccugccguggauaagcaggaacaugaagcugcucuaacagguguuaaaccacccgugccugaccagccuguccgaccucaggcaagaaccacguggagugggcagcaaagaaugaaaauucacaauaaauaaccuccagacugca

SEQ ID NO: 7491 - RNA, 1272 nt, Mus musculus
aacagccauugcaguacauugagcuccaucgagacagcgccagggcaagcacgagccgguugggcacugggcgacucugugccucgcggaggaaaaucagcuaaacaugggcaaaggagauccuaagaagccaagaggcaaaauguccucauaugcauucuuugugcaaaccgccgggaggagcacaagaagaagcacccggaugcuucugucaacuucucagaauucuccaagaagugcucagagagguggaagaccuugucugcuaaagaaagggggaaguuugaagcuauggcaaaggccaacauggcucguuaugaaagagaaaugaaaaccuacauccccccgaaaagggagaccaaaaaagaaguucaaggacuccaaugcacccaagaggccuccuucggccuucuuguucuguucugaguaccgcaccaaaaucaaaggcgagcauccuggcuucuccuuuggugguauugcaaagaaacuaggagagagguggaacaacacugcagcggaugacaagcagccccgugagaagaaggcugcacuauguaccuacuggggguggggggguggggggguggggguggggguaaucugaccucaagugugcucugagcccagguuuucucauguggugucuuuuaccacgaaauuaugacacauugcaaauccugguauugugaucuuauucucuguacaaagaaagaagcucuaugccgugagcugugguuaaauggucacagaaugucagcacugcuaucauucagcacguguaacauuuuuaaauuuauaaauauuaaaauuuuaaacuuacacuaagacuuuuaaguuuuuuuuguuaaaagagacccagggaguguauacuguuuaaauauuuaccucuauuaauauaacuaaugaaggcauuuaauuuuucaaaagauaacugcaguaugauuuuagggaauaaaccaaggcuguguguagagccaguuauaaccugaauaucaaaaugauaaaacguuauuuguauuuuuuaauccaucuaugggcguuaaaauguuuucacuaaauauuuuuauuacaaaaaaaaagaagaaggcugccaagcugaaggagaaguacgagaaggauauugcugucuacagagcuaaaggaaaaccugaugcagugaaaaaggggguggucaaggcugaaaagagcaagaaaaagaaggaagaggaagaugaggagaagaggaugaagaagaggaggaagacgaagaugaagaagaugauggugaauaag

SEQ ID NO: 7492 - RNA, 29727 nt, Mus musculus
cgagucacgccgcuggagcggauuagggcggagcggcaggcgcgcggugcugucccgcugugggucgccggcgguuuuucgcguugguuuugcacugcgucugugauggcggcggcggcugaggagggcaugagugcggccgcucuaguuaugucaguucccgacagcauuggccguucucccgaguccgaaggaguuggagcaggggacgaagagaaggacgcagccaccaaaggaacgguggccguuggggacagcgaggaggauggggaggacguuuucgagguggagaggauccuggacaugaagugcgagggaguaugugggggcugagcggccggacagggagucuccggggcggggacggcggguugggagaauccgagugggacgccgaacagccuggaacagcuugggaggacgguggcgguccguaggcgcagacugacauccuggagaggacccuggccgcagucgguggaggauggaugcuuagggaaguucuaaguguuguuuuggcagaagagacgaagcggugacauggaauguugagaaucguaggaugcaaggcagcuggugggagacuucuguggccuucagcauucggguauacgguuagggccauggcuuuccguuaggaaagacuggaggauucucuacaccguugucccaauguuuucuaaaaguagaaaaugcuccuuggcuuaaauucaggaaaucccauucacaccgagugcccgggacaguaaagguuucccaacccaaagugucccuuuucugcgcguuuuaugaguguaacucaagagauuuagaguaagcuugaaaggacaaucuucgcacaucgugcuugaacacuuaacauccuccuugcugcgaaugucguccccgggagaaauucuuagucuguauuuccaaggcuugggauccaucuguuugugauaccuuuucuccccucucuucccuuacccgagcucugcagaaaaaggugcuuucucaguucuguccuuacucucuuaccucuauuuaagucauugucuuuuaucucuguauuugucuuuucugcucuagauugugggcuccuuuaaucaggggaugugguuuauaauaaugcuugaaucacggacacuuaguccaguaacagcaaaggcugauuuuguuguugccguuaucugauaccguguacuggacccaggguuucaugaaugcaaggcaagagcuuuaccacagagaucuaucucacggcugugggauuauugaaugaguaaacgaaaugggaauuuggagaaaggagaagauaagggcuguagauaggaaucgugccuauacgaugguuuuguuucuguuguauuuucugucauuuguuaucugccauaugccaacuuucaucuuaauuuuuaauccauugacaaacuuuuuuuuuuaauggacugcuguuuacccugugccauguuggcuugaugguagacauuucuuuaaaguggugcuuuucucugagaacuccuguuuuguuuuguuuuguuuuugagacaagauuucucuguuuagaccaggcuggccuuaaaacucaaaaaugugccugcaucugccuccuggaugcugggauuaaagaccaccacugccuggccugaugguagagauuuuuuuuuucuuuuuaaagacgaaauucuagccuauauuguuauuuuuauguauaugguuguucagccuuaugucugucugugccacauuugugagccgagaagagagcauuuguucuccuggaacugaaauugcaaauaguugugagcugccacauggguacugggaauggauccuaaauuacucuuagccacagagacaauggcuccaggcucccucugcaucugcauaccccacuuggucacucccugcuuuuugagguagggucucagaaguccaggcugacuuagagccugagaccuuccugcaguuacugacacuggaaaauuuucaagggagaguuaaauaauugaaauucacugucauuauuauggagcuagagagguagggccagaauucaaauccccagaguccauguaaaguuggcugccagucugugaaccugguguuccuguuggggggugagacaggagaauuaccugcuauauuaucuuacugugcuguguuaaacaaccacagacccugucucaaggugaaagacaaguucaagacugaguuuauccucuaaggucuaccagcagcaguggcacaccuauauccacacaagccugcacuugugaauggcuagcaguggauucugagaaucuuagggucuucucuaagagcaguaagcagcuuuucucccuccaagcccuccuguauaccccuccuugcugucuuucaaauucaugaccuccauaucuuaaagaaaaauaauaaauaaauuuuuaaaaaagucaagcuugguggaguggcauacuccuuuaauaccagcacacucuccugugaauaggucucuccugugaguuucagcugagcuuuuuuuuuuuuuuuuuuuuuuuuuuaauuaauuuauuuauuuaauguaaguacacuguagcugucuucagauacaccggaagagggcaucaggaucucgggugguugugagccaccaugugguugcugggauuugaacuucggaccuucggaagagcagucgggugcucuuacccacugagccaucucaccagccccucagcugagcuuuuugacuaauuauucuaucuacaguuuucagauuaaacuagaauaaguaauaguaucuacuccauaggcuauuguaaagauuaacuaagcuauugaaaguagauauucagauaacauauggcauuuuguaaagcauuucaugaaccauucaugaagcauuguuugaaccgugugccuacuuuauauaugcauguguauuuuuuuccuuuagauuuuuauuuuauguacauguaugugcaccacaugugugccuuagacuuaggucagguccccuaggacuggaagugcagguauugugagccuccauguaaguacugggaaucaaacccagguccagguccucuucaagagcaguaaguacauguauuuaggguuggugguggugguggugguggugguuguuuugagacaguucucacaguguagcucaggauugccuauaaagcauaggcuugccucagauuccacagcugucuucucugcuuuuucucaaaggacuguagcuguguaacaccauacccagcagcacacuugauuuuauuuuuaaagauuuauuuguauguguuuguggcuuuagagaccagaagagguggaucuccucugaugcugcaccugguagugagcugccucauggugcuggcauucaaaagggcucuuaacuguuaagcuauguaugucuccuguccccagcugccauuuugucaguccugucuuucaguguguuaucuggggcucuuaccucucaguuaucagguuuaugccugaagccccuuucccuguuaagcauugugcugcucuccagcccccuuuaaauuccaccucugcuugagaauaacauugucagagaaguacaaguguaccucugcuuuacuuuuuuaaaaaaaaucuaaacaagcuagcuagguguugcucacuuuuaaucccagcacucaggcauguugcugcacagacaaaaacccugucucaaaaaaaacuaaaaaaaaaaaaaaaaaaaaaaaguaaagaaaaaaaucuaaacaguguugcuuauaugauagaauaaucuccauuuacuaaauaucauccagugccuugccaguuuuucguugcuauuuuaagaguacacauugcuuuauaaucagaaaaacacaucagucuuguuuuuuuguggagcaguuuguuuguuuguuuuuuagacaagguuucucuuuguagcccugguuauccuuagagagucaccuacuucuacccugcuuucccuucaagugcugagauuaaaguuuugggccccaggugccugacaauuuuuuccuguguagugcugguugucuuggaacuaacucagugaccaggcauacuccaguuugauguuaauuuucauuuugaugcaguuuucaaguucucuugcuccccacagcugaauggguuugaaauuuuaaucaguaaugugucuguuuuuaaucuaugcuauaggguaagaaucuuuauaaaguucgauggaaaggauauacaucugaagaugauaccugggagccugagguucaucuggaggacuguaaggaaguucuucuugaauucaggaagaaacuugcugagaacaaagcuaaagcagucaggaaagauauucagguaucaaguuuuaucucauucuuuuuuuuuuuuugguuuaauauuuauaaucuuauguauauagaguauguguaguaaacaauuuaugaaaaauacacuguccagcauuucuuuuaggaauuccauuuugcucacagacugcuucuggugauuuuguucaacucuuguuuuccaaccuaugguccuauuugagagacaaguauaguuuguauguuguuagucagcuuauacuguaaugaaauaccuagcauaauuuaaagauaaguuuuaauuuugucuuacaguucuaaggugucagucuaccucuggaugccucugacgggaagcaccagggugcuaaaagcuccucguuuucacaagccaggaagcaccaaagaaaccaggguccccaguccucuuggagguuuucacaaaugaacuaagaauuucuuauuaagcuucaccucccuaagauccaccaagcugaggugggaggcagaaacaggcagaucucucugaguuugaggccagcuggguuuacagagcuaguucuaggauggcuaaggguagguaacaaagaaaccuugucuuagauagaaaaaaaaagauuucuccuccuauuuguuagugcuacccuagggaccaauccuuuaacacauggaccuuuggaggacacucagcauucacauuucagcagauaggaauguuggcuaauaaguugggguauguucauaaucccaguaaucagaacaguuaggcagaaggauuacugagaaagaaggucugccagggcugcauaaugggacccuaauacaaaucagccagauagguaagauuucuauguuguuagugugcuuguuccguauaacuuauauagaacaaguuuaagaacauucuagaaaggccgaguuugcuguuuguuauaccugaugaccuggguuuaauucucagacauuaucacuuggugaaaggaacaaaagucaguugauccucugaccccugcauucacgcuuacccauaaaaauaaauaauuaaaaaauucaguuacagauacauuaugcauuagacuguugauacauuagacuguuaacuucuuaacucaguuugaugauucuguuugauaccacuggaaacacugacauuuuucuucuuuaugucuccuucuuaaauugacauuccucaccucugaguuuuauuugcuaggucagaaauauaaguaauacacauguuaaauuuaggcaauuuuuaaaaagucaauuuugcuacaaauuuuuacauuagauuuuauuaguacugccucuuaaaacucuugaacuuauguuaguguuuuaaccuuuucuguuuuuuauagagacuaucuuuaaacaaugacauauuugaggcagacagugauagcgaccagcaaagugacacaaaagaagauauuucaccaaggaagaaaaagaaaaaaauaaagugcaaagaagagacaaguccagaagaucugaggaaaaaaaggacaaaaaugggaaaacuaaaagacaaguucaagacagagcuggagagcaccucugaaauaaucgguuucgauguaaagacgaagaaaagaauuugggaagucaaggaagaauuaaaggacuccaaaaagcccaaaaaggaugaaauaaaggaaaccaaggaauuaaagaaagcuaauaaaagggcugaaguaagagauuuaaagauuaaaauaagagaagaugucaaagagaaccgaaaaacaaaaaaagagagauauauagaaucuccgcuggagucugaaucgccuaaugauucccucauucuagaggaugacagugaagacuuuauuucugacaacagagaagagaaucagaaugugagaaguguaagagauaagacagcacaggagacagugcaagaggguauuuuugagaaacaucuggaugaccuuauaaguauugaagaggaugcugguacccgaguuagaaggaagaagacgaagccaagaaaguuugaggaaccaaaagagaucaagaagcuugaaagcacgaaugccuuuuuagaaaggagagcaauacccaaaaagcaaagaaaccaagacaagggcauaaguaaccuagaguuaaauaagcuaccaucaccuguguuugcccaaacccugaaaaguuccagacugaguggggaagagaagagccuaaaguccccugacuuggcagaagagguaaaguugguggagaacuugaagaguacagauaugguugguacagauuauuacuugcuguuguaugguuaggaacuuucacaaggaaugacaaaggaaacagucaaacuagaauaaaguguaacucagguaguuauuaaauaugguggcacugaaguugccugugugugcucaacuauuaagcaccggaaccccaaguuuaccuuucaguuugugccuuguuuuuuuuuuuuuuaauauuuuuuauuacguauuuuccucaauuacauuugugccuuguuuuuuguuuguuuguuuuaccaaacaagacaaaccccugagaguuaauuugcuaccaaagucagaauuuuuguagauuugugcagcauuuuauagucaggccuaucagcuucaucaucuuacuaauuucauuugggguauguauguucucuauuuuaaaaauacugaaguuugauacagugcacuuugaucuuauuccccucuacucuuucccugacuuccuccagauccacuuuuaccucuccuuucacccagcuugugggguuugguuugguuugguuugguuuuagcuuuaucaugucuaguuuguauuguccauauacugaauguggggccaucuucagguacaugguagauuuacuaguagccacacacacccuuaaagaaaaccuagaaacuacccaauagucagcuccauagcucuccucauuuaggaguggaacuuaguggcuccuuuccuguuucauguuaaaauguugacgagcuugaucuugugucuaucauacuuccucccugccccucucuaacaaaaugucuuacacuauagcccaggcuagccuugagcugguccucuggcuccuccuuccugggugggaguugaaguuacguuuggcuuucacuuuauuugggggagggcggugauacgauuuauuuguauggcuuggcaguaguaguaccuggugguaguacccaccuuuaauccagugcucaggaggcagaggcagguggaucucugaguucaaagcuagccuggucuacagagugaguuccaggacagccagggcuucacuagagaaaccugucuuaaaaaacaaacaaaugcacaaaaacaauaaaagauuucuagauuuauugguaugaauguuuuauuugcauauagguacacguaucacgugugccuggugcccagagaguccagaaaaaggcaucauauagucauugagugcugggaacugaacccagguucuuuaugagagcaccaaguacucuuaacaucugugccaucacaucacugcagccccaagauuguuuuuauagaguuuaauuuuguagcaauuuaguuuuuauuauacaaaagaagggcuuucacggugacauuuucauaccuguauauaaugaauugcaagguuuuuuuuguuguuguuguuguuuuauuugaaauaaggucucacuccaugacugagcuggccuugaauuuauguagaucugucccugccauccuagugcuaagauuaaagguuuacacuaucauguaaauguauauucaaacauuuuaaguaauagauucuuaaaagaaaauggagaaacaaaguauuggguuuuggguuucauuucauauggcuuagcgugucugcagaauagucuugguggcgggagggagcagugggagaaacauuaaauaaucagcugugugcucaggcguguguagaauauuugguuugcaaauauuacaguaucaacucuuuaucuuuuauuuuuuguuuugcauucauuauucuuuaggagaaagagaaaaaaaaugaacccaaaggaaaauaccagaaaagguaugauuuggacaaagaagaaaaagccagaaaagagccaaagguauuaaaauguaaguacaaaaauuaaaauaguuccauguucauugccauuguuaaaaaaauuauuaauggauuuuauguguauuauguguacaccaggguauauauaugugcauauguauaucugauauguuguaaagguuggaugucucuuuucugaaauauuugggaccaaaaauguuucugauuccucuuccugguucaaugaaauuuauauguacauauaaugagauuucuuaagaauaggcccaaguuuaaauccaaauuuuguuuuauauguacauuauaugcacuccuuuguaauacuaugauguuuuuaguguuccaguguuuuugagucuugcauuaagaguaaaauuuucuucuuaauaccuucauacuggcuuaaguuuaauuuuggggcauuucagaguucucucguguuucagugcauaugugugguauaugcagauguguaugugcauuugcccagugcacucagaaggccggaggaggacaugggauucccugcucaguuacucuucacuuagccacugcaucugaagguaugcugacaguuagcaagcccaagcaauccacuuguccacaccccacauaguucuagaguuucagauacuuaacauuucuagcuuuuuauauuugggguaucugaacucaggucucaugauugcacaaggcuucuuacacguuaugccauuucuucagcuuuccugacuuuagguauuuuguuguuuuguuuuuucaaggcuggccuuaaacuuccagagccccaccugccugccuuugcaucugagauuaaugaggugcacuaucauaccuggccagccaugcacauuuuuuuaauacuuuuuuccucaccauguuagagguggaacucagggucuuuuuuaugcuaagugaaugcuuagcugcaucuaaaguuguaaaaguagauuuuguuuuaggucuagacuuggacauggcaguaguaaugccuaucucaguggcucauacauaaagugcuauaagaacugcaucuauuugaacaguacagaaagcacuuauuacauuucagagauuuguuagagaucuaaaauacugucaaauuaauaucugggcaagauguucagggugaacacugcuguuacugaacuacugugguugugacaaaggacuacuaaaagagggacucacucucagugauccuugucacaccuuaccuuagaaagacacacuagagcuugugcagaaguuguuucugaugcugaauggggaaaagagcaugguguaagagcacugcccaugucccugauaaagcuacaaaauucccccagcuuuuaacuacgaauggaaugcaagaaaaacuagguauauagauuaauaauaacaugugugcuuaccauacaagggccuaccuagguucuaucuugagcaccaaaaagcuagagugaggaaguaggaaaaauauguaauaaguuuuagagaauuuggaagaacuuuuguuaagugcugguuacauaggugcuuacuagcagggaaauuggaaaccagugcuccucaugcaugaaauaaauaguaguuccauugaaauaaaaacacguacuugagauuggcauacacgaugagggaucuggucugguagaguguccagcauacacaggggaaucaauugccccauccccaaaaggacagggaaggaaggaaggaagggagggaggaaggaaggaagaaguuacucaaguagauaugaauacuacuuugucacagcucucuggauacugaacagccaaaaggacuaguuaaaaugaauuugugacuuugauaguaagucuuaaauugauucauagcuaagguaaguauuauuaaaacuacaaaaaccauacuuacucaauaugaauaagauuuucuuuugauugcaacauaaauuugcaacuuaguuaacauaaaugguuaacuaaccauugauuuauuuuuuagcauuuaaggaaaucagaaaugcauuugauuuauuuaaaaaaacaacagaagaaaaaaaugauguucuugagaauaauucaaaaagagaagaaauaucacuggauucuaaaauuaugaaugauaacaaaaccaaggacaaguguucacuuaaagaaaaaagaaauacucgagaugagacugacacuugggcauacauugcugcagaaggggaucaggaaguuucagacaguguaugccaaacagaugagacgucugguaaguuugcuuggcauuguucacauagagugauuucagaaugcgccccacauuaucuacuuuucucucagaauauaauaauuuuauuuggaucugcugaguaacuucauauugaagacucaagucauucuuugacaucuaaaugcucuaaauuuuaauacacuuauaaagauuucuguuuuccagcuuaacuuguuuguuuguuugcuugcuugcuugcuuuuucaagacaaggcuuucucuguagccuugacuguccuggaacucauucuauagacuaggccagcuuugaucucauagagaucucugcaucaugagugcugggauuaaagacagaucccaccaccacccagcucaguucaaucuuuuaucuugagcuuucauuccaaaaugaucauauaaaaacugugcauggugagugauaccagcccucaguagauaguggcaagaagacagagacuucaaggucauccuuagccacauagggaguucaggauccuccuagcucuacauccuaaguguuggaacaguagauguguaccaucacucccugcuagguuuguuuuuguuuuguuuuggguuugguuuugguuuuuccagacaggguuucucuguguagcccuggcuguccuggaacucacucuguagaccaggcuggccucgaacucagaaaucugccugccucugccucccaagugcugggauuaaaggagugcgccaccacugcccagguuggacuuuuuuuuuuuggacugcuauuuauuuuaaacuuuacagaaaauagcuauaaaugagacuauauuguaaauguuacccugggaacauuucaagaagggaaggaucuuguguaaaauacaaaauacaaaagguauauacgggaagaaggaguuuaaagguguaccuguagauaaguacaaaugaaauagcuugaucuuauaugaaauuaucuaaucugugaaucucaagaaauaguuuaaaauauuuuucuauaaguacauauuuuuuuauuuuguugagauagggucucaacuacauagcccuuguuggucuggaaauacuguguugaugagacuggaugagcuuacagaaauccuccugucucugacucccaaguugauuuauuuguaagcauguuauacuucacaccccuccccuuguguguuugugugugugcacgugcacacguuggaugacugaugcucaagaaggucagaagagggcacuggugcugaaaacugaaccugauccuauacccuuuuuaagagcagcaaguacucuuaaucauugagccaucucuccagccccauagugauuguaaaaaguaauucagaauauauaacacacuagauuuuucuaaaaaaaaaacccuccucaucuccagauccaguuuugcauaauagacuuuugugaaaggauuguuuuuguauugagauggggucuuguauaacccagacuuccuucagagauuccuaagccuaccagagcaauuguaucaccaguccaguaacuuccaagcagcauguaauacuuauauguauacaauauguaaaaagauugcuaaaaaaauuuuaagacauaggauauguauggauaaaauuguaaaacauuugaugccuagcuucugugaagaccuggguuugauacucagcacugaaaaaaacguauuaaaaucuuugauugcuauuucuauuaauagaaaaaauguuuuacacauuugucauuuacuucaaacugcauccaauuagaauaaaaccaccuagcauuggcuagagaucuagcucagugguauagugcagaacccuaguuuccuucuucaacauuauaaaaacaaaauaaauuuccauagaauuuacaaauacuaacucuaagauuuuucuuaaagauuuauuuauuuauuauauguaaguacauuguagcugucuucagacagggcgccagaucucuuuauggaugguugugaaccaccaugugguugcugggaauugaacucaggaccuucggaagagcagucagugcucuuacccacuaagccaucucuccagcccuaacucuuaagauuuauaugaauauuucagacgcuaaauccaauuuaucaguaguaaucaaagucuacuauauaaacuguagcaguuggguuggaaagauggcugccccugcagaggagccaagguccaguauccacuuggcuucucauagccaucaauaacuccaguucuguggguucuuagaccuggccuccacggguaaugccuucauucgauauagacauauaugcaagcaaaacacacauacaugugucuuuuuuuuuuaauuaaagaaaccuguauauacuuggcauuaggaagauuaucguauugcauuauauuauuauuauaauuaguacaacagucgucugucagacccaugcauagcugugagauggagaaaaguggcagaugucacagacuuaagcaguuacaacaaacaagcucuugguuacuauuucaggauaguagaucauccacacacaaaacucuguacauggaaaauagauccuuaauagaauagggagauuuaggugcuaguagucaugagacugaaguuucugaccuuggcauaaaagauuauaaauguaugagcacacccagucauguuccacugcacauguaugcaagccaggggacaucuuguggugcuucucuuuccaccaugagauuggggucaggcuugccaagcaaaguaccucacccacugagccaucuuacuaccucaaaagauuuguuuuuaaaguauuuuauguauauggguguuuugucuuguuguaugucugcaucaugugugugacuagaguuucuggcagguauaagcugccuugugaacccaugauucucugaagaauagccagugcuuuuaacugauaagccaccucuauaguucccaccaguuuuuuaauacaaaaguaaaagagaugccaacacaaugacuuagcaaguaaaauugcuugucaccaagccugaugaccugaguuggugcccagagccuacauuauaaagaacacaggcuaucugcugacuucuacauugugcuuugccauguguccaccacucaccccucuccacucccaaaaguaugaaaacaguuacaagaguaauguuugagucuacuaaagucaucacagcuguuauuuaauaggguggaaacucagaaacaggcaaaacuucaguuuuaaggguagauugucaccaacuaauuuuacauagggugucauuuauccagacucaugauguaguuaacaccauagagagcagccagggauggucaaaagcacauaguaacauuuggaaucagugugcauccauuguucuuuaguauauacuuuaguuuuuucuuuuuuauuaaaaauaaagugaaaucugucauuagggcuagaggucucauugaguaugugguagaaaugaacaguguugggaugaacugagccacaguggaagccaagcucucauaacuguaguaguguuaagcucugcuaagauggaccuucuucuauccugucugguuucucuccgugcagugaccgacauuccuuccucuguggccagggucgagaauaagggauuccauugugaacugagaccugguuauguacaaagauuagggcucucucugacuuuguuugauaauucucagagcuacuuuaaguguguccuaccuagggcuuauucuuuuacagguuagugugugucaaguaaauuaauuauaugaauacauuauaaagguuagcuucauaaauauuagcugcuuggauuauaaccacugcuguauauucauaaucauauggccugcucagagcuacauagcugggauacagaaccaggguguguagcaccaaagcugugcaauuucugugauaacauacucuugggauuagcaaagagucaguuuuaaucuagaggacuucagaaaaaaauuacuuauuugcacaguuuuccagauuuccuuuuuucugguagguuaucuuccuaacauguauguaguuuaaaaauugauuuuuagccgggcagugguggcgcaugccuuuaaucccagcacuugggaggcagagacaggcaaauuucuaaauucaaagccaaccuggucuacagacugaguucuagacagccagggcugcacagagaaacccugucuggaaaaaccaaaaagaauaaagaaagaaagaaaaagaaauugauuuuuuaaaaaaaauauucuauucuuaccaucaaguauuucugguggguuuuuuuacuguuuguuuuauuuugcuuuuuccuuguuuguuuucuuaaauacagggacuugcuauguuacucugauuugcuuggaacacauuguguacacuagguuaacuucaagucugugcccauccuccuggcuagcuguuuguuguuguuuguuuauugaggcugucucacacugagcccagguuaaucuugccauagauaaaucuauugcaucagccucugaaguguuggaauucuagguaugggccaccagucccugcucugguuucauuuuauuuuauuaaaguaauaugcagacuauuuagacuacccuaacugagcaugcagcucaaguauguguuucaguauaagaaagaaacucugcauacugguguucagggaccugagggccauuagcuguaggaguagaaugccaguagacgugagauggggcuuuguugcccuguuggagcauuuggcuucuaacagaaagggaagcaucauaaacaauggcuuguauuugcauacagccuaguuuacacaaaaugacuucauguaaaugguuauaagcaauguguauuuaaaaagaauaagacagaaagacuuacuagagucuuggaacauagcucaaguugguagagugcuugcuuagcaugcucugaguccugaauuccaguucccugugcuauacaacugaauauggaggcacauaugugaaauuccagcacuuaggagauagaagcaggccuaucuucuaucuuaggccgaaggucaaagucauccuaauauaaaacacugcucccacccaaauuuauauuuuauaauuauaguuuaccuuuaauguguggauauuuaucauuugcccaagcaauuuaaaauuuuagcacugaaagaaaagauucaguuacauacugaccuguguuaaaaguauacuuaucgaucuggagaguucuuugaaaaagacaaaaacaaaccaaagugggcguauuauacccaaagaacuuucuaucuuacuacagagauauuugcacuucuuuguucaucgccucucagcucauaacagcuaggaaauggaaucaaccuggaugcccauuagcugaugaaggaaaugaaaaugugguacauggacacaacagaauacuacucagcuguagaggaaaaugaaauuuucauguaaauaaacuagaaaggucacacaggcacacacucuuaugaaaauaaguucuagcuucagaucuugugggaguuuaucacagggcacaugcagaagccagaauagaaacaagcccuuuguugggggcugcauugagggagguuaguagacuauaggugaagugaaagaaagaguggaaaacugaaggcagguuggagcagauaccugaggaaccaggggaaggcucaaaggagcuguuugggagccuguggcucuacaauucaaauagaaaauacaagaggguguuguccagugugugugcuaugaaagagcaggguagggaguacugugagcuaagguauaagcugagaugggggugagggagaagggauugggguggguuagccaaaucaaggaaugugacucuacuaguuuguaaucugauuuaaaaaagaaaauugaagcuaggcaguggugcauauaccuuuacgcccagaagcugagaagcagaggcaggcagaucucuagaguuugaggccagccuggucuacaucaagaccaggacagccagggcuacacaaagaaacugacucacccucaccccucaaguaagauuuaaaugcaguauacauaaaaguuuguuaaaaaugugacaaguuuaauaauguuaugauuuugugggguuuguuuguuuguuuuuauaguacuccauaagaguguauauuaaugaugccuuuguaugucccagauggcaggcaaccaguuuugaguuuggguauggaccugcagcuggaguggaugaaauuagaagauuuucagaagcaucuggauggggaagaugagcccuuuaucacaacaaacaggauuccaaauaguaagugaucugcagauuguuugccuuuuccaccagucuagauuuauaaaaucuaauguaacuuucuuuucauuauagauuuguugagggaugcugugaaaaauggagauuauauugcugugaagguugcacugaacucaaaugaagaauacaacuuggaucaagagguacuguuuuuuguuguugguuuuguuuuguuuuugguuuuguuuuuuuguuuuuuuuucuuuuuaggaaaaaaaaaaaucucacaaagcagcauggaaacuagugugacacacuaugguaauucagucauuuuccuaggaaagcaauacauguuaagucauuuuaagugugcauuagaggucuuagaaucccagcccuccaaaaugacugguuuaguauuauuuacuuuucuguugcucuaauaaaaugcucugaccagaagcaacuugaagggagaguguauuugggcaaucaguucuagcaggauaagaguccauccaucauggcagggagucuugucagcaccaggcaugaugucaggagcaggaagugagacucacauccucagacacaaaggacaaagcagagacagcaagacucugucucaaagcuuauccccaguggcauacuugcuccagcaaggcugcaccaauaaaucuuccuagacagugccacuaacuggaaaacgaguauuuaaaaacuuaaguauaugggagacauuucucacucaaacccugccuggggauuuaucuuaaguugcagugguaaguaguauaaaagaaccuguguuauauguggcuauuuuuuuauuuuuuaaauguauuuuaauuuuuauuuuauguguauugguguuuugccuggacuuaugucugugugagaguuucaaauuuuggaguuaaagauaguugcgagcugccaugugauuucugggaauugaacccagguccucuggaagagcagccaauguucuuaaccacugagcaucucugcagaccaauguauauuuugauuguagcucacauauacaauugcccagcuuuuuauuuucacucaggauuuuucauaccaaugugugugagauuuuuguuuuuacaugggaguguauuagaguccuuuuccucuaguuuuuagguaaaacaaugaauuuuugggagaaaauuuucuuuugauauagagucucauuauauaacccaggcuagccuugaauuauuggugauuuuauuaccuacauuucucaaauagaccuggcucuaguaauuuuugcauuuacauagguaucucuguugauguguuuuaugacuuugaagugucucaucuuuacacuaggugguugguuuucuuucuuuuuuguuuuuuuuguuuuuuugcuuuaaugauauguuuauaguguaaaaucuuguuuuaaucuuuauuuguuggugggggaaguguacgugugaguugccuucugcaacuuaaagaauugguuuuuuucugagccaggcuccuguagacaggcuuuguaaccaaggaugacggaccccuaacuccugaguguugggauuaugagugugagucuccacacucaacuaaugaaguucuuacucugaucauuuuaaauagugccuuagguuugccauucauuuuauaccaagaaaacuugaucuagaauuuauuacacggaaacuacuuaauuuuugaaagauuuaucauuguaugcauuuuauguauauggguguuuugucugcauguaugucuagaagagagcaccagaucccaugggacuacaguuauagaaggcuguggagugcuauucggguguugggaauugaacuuaaaaccucuggaagcagaugguacauuuaucucugaaccaucucuucagccccuuuaaauuuuuuauuucagauauuuaacuuuaaugugcaugagugucugccuaaguguauauagaugcacaugcgcaugucagagccugccgagauuagaagaggaguuagaugcucuggaauuggaguuacaccugugaucugucaucugagugcugggaacugaacuggguccuuuggaagagaaacaagugcuccgaaccacugagccaaccccagcccaggccuaaaauucaauguuuauguaggucguauuggacacaaaauugcagaaaucuuucugccccugccuuccaagagcaugagccaucauacuugcuugcuuauacauggacguuguaaaauuuaauagcaauacuuauuuuuuugaaacaggaucucacuauguauuccucacaggcuuggaaggcagagagguccacuugccucugccuugaguguuggcauuaaagauguucaucaccgugcucgacagcaaccuuuacauuuuuaaaauucuaggagcuaggcagauggcuuaguguauaaaaggcuugccaugaaauaugaggaccugacuuugaauccacauaagacaagcacaguagcuagcaucugaucccagugcuacuaaaacaaaauaggaaguagaaacaggaaagauccuggagacuuguaggcuggcuagccugcuguaugcaguagugcaagagaagcgaccuuguguuuaacaagguuuguccucugauccccaccuaugcccacuuguuguguuguaugcuucacauacagauuuuuaaaaugcuagggcuagggauauggcucagucagagaaaagugcuugccacgcaagcaugaaggaccugaauuuggauuccugucacauauauaaagaaaaaacagggucaauagcacauaucuaggaggcagacuaugccuugggcaugcaggccagccagcuuaguugaauuugaugagaaaccuuguuucaaaaaaaaauaaaguggagugaugcugaagcgaugguugagugguugccuugcagaggacugcaguucaguccccagcacacagagagcucacaagagucuaugaacuagaguuccaggggauuaguugucuucuggacuuauaugcccaugcccccacaaagauacgcagacauaauacaaauugaaaaauaauaaaagugaaucuuaagaaauagggcagugaaccuauuucuggccucuauaugcaugcgccccccccccccaugaauacauacacacaaaauccuaaagauauuuuuucugauuacuuacaagaauauuauaguaagcaaccuaaccuaaguggauccuuaagucauuguucuuuagugauuucuucuugaaauagcaugacugaagagucuugcuucuaaaauguuucugauuaaagacuaacaagguuucacuaacacaggauucuacugggaugacccuggugauguuggcugcagcaggcggucaggacgaccuccucagacuccuuaucaccaaaggugcaaaagugaaugggcgccagaaaaacgggacuacagcccucauucaugccgcugagaagguuugagacuugacuccaugaagggaaacugagaaucuuuuuuuguagugaaauauaauggucacaugucauguagccuuacuuuguacuuuuagugggucugugaugugaauuucugcuauuagcaguacuuuguaaucagauuuaaagugugacuugccuaaucggcaauuuguaguaagcacaacuucuagcuacacugccaauacuuauuucagucuuaaaugauuuagaggacucauagguagaguuucucacauggaagcuacaggguagacggcagguggcacuugcugacaaaucagugagggacuagacucaggagguggcuucuguggcccuccagugaaaaucagggagacaguguccagccaccugcauggaguugaaucugugagucuuuuuccuuguuacaaaacagcuagaaggaaggucuugucuuuuaaggaaaucuugggacuaaauuuguuuguuuuuuucuucuccauuaauuuacucacuuuuguuuccuguuuuuuaauagaacuuuuuaacaacuguagcuauucuuuuggaagcuggagcuuuugugaauguucagcaaagcaauggugagacugcgcucaugaaaguaagucaaguuucacaguggcuauguaugugggugcugcagacugggaaaggcagagagacaaagccaucucuggaagucaggaucucccauagaauagaagugggucaucaaagcaggagaguaugguagaucagugauguaugggacaugcucagucuaagggacccagcaagagucaugggagcuggggguuguaggugcugagucagcaggaguuggggagaugcaaggaacugcaaguguuucagugaaugauaacucuaugcuacaaguagaaggcacuggaaagaggcagacagauccaagauugcacaaugugcaguuuacagaugucuugggugguuucuagccacguggaugcuuauaucucaaagcagaaggaagaguuugucugcuaagcuagacagagagaggcuuuucuaguaucaauuaauacaucuagugccaguucagaaauuuauaucagagguccauacacauuaggugaaugccuuaaugacuuugucuagcaugagucaggucacgugcaaaagguguagugacaauacaaucaaggucacuguagucacaugaauagguuuagacacccgagaggaggagaggauuauaugcucucauuauuuuguauuuuguaacuccaucuccuguggaauuauguuuugaguugaagguuauugaguuugugcuguucccaaccacccuucuuguaucuuugaaugguagguugcaaguuccucacuagccucagccuagagugacucauuccucucucugcaggaguucuagguuucugcuucauagugcugcugugacucagcagauccaguuguccguagcuggcucugucuuauuucuucccugagguacagcuuugcauaagcugugaucugagcugggauuucucugcaaugccaaguucucuccugucaggugugagcagugcauuggauugcaguacagccccaggcuuguccugaaccuuguguucuauaaucugcaucuuucuccugggccuccuaucagacccuuaaggccuaagccuugaucauugcuuugugauuccucacuaugacugauuuggguuuguguaaauagucuuuuauucaggagucuaagcuuacguggucuuucugugugugugugugucugccuguuauuaucacguaaguacaccaagguggcacucaguaaugucuuacugagaaccugcuagacggcaggcacaccucaguagaagaaagagcacgggagcagagaggggcagggguaugcuagcguuuucuacaggaccauccaggguugggaguauucuaagggcacuuggagaaguucccagauuaaaggguggguuuguucuaaugcuccuuaguucacuacggagugcauuugggaaaagacaagcaguuuguagaccuggaaggagguuccugaaauaagugauauuaguaauauuagucugaaccuacauuuccagaguuagggagcucuggcacugggcaucagcugugagaaccauugaaaggugaaaggcaguuggaaccaugaaggccuaaagaaccuggagaggguguccuagcagguacccugggcacugagcuguuccucacagcagccucuaguuuacuacuucacaacugucuguugccagugcuugcuaaugccuguucccagguuucuucccuuucauuuaugaggcuuuguccucuuucaccaagagcugcugccagacccguguggagaaacuaaaguuacuaugguuuacaaugccacuccucuuuccugcccuaggcaugcaaaagaggaaauucggacauuguccgccuugugauugaauguggagcugacugcaacauuuugucaaagcaccaaaauagugcauuguacuuugcaaagcaguguaauaaugugcuuguauaugaacugcugaagagccacuuggagacguaagugucaggcgaacgaacguaccaugguuaagucagagugggaaaaauuuauugaacacaucauauuuggaaugguuuguguaggaaauguucagaaaagaugaucugcagggauucucucuucaguagauuaugaauuuaguaaguggcauauauauuacuuccauaugaguuaccaaaaucuuagaaaacccagggaaaucuuaaaauguuagucuaggacuggagauguagcucaguuggaaaagagcuuaccuagaauguacacaguccugggguagaccaaagccaagccuauaauagcaguacuuaggacauuagagcaaaaagaagaucuagaaauuaggguagaacuaggguagaucuagaacuuggauacauagcuaguugauggccagccuagacgagacuauguaaaacuguaauaaguuaacaucuccucuuaauuugguaaaacugugugucugugugcaugcccaccccugcaucaaccagagacugacuucucucccucuuuuauucucuauuuguauauuuuucaagugaauucugaagcauauuuuguuaggaauuuaugucuuuaucacugaagaauucuuuugaugggcuaggaugugauuuugugguagaguuuccaucccggggcccacguaauauuuuagcaacaccugccaaaaacacugcuagagaggaugaaguccuuauuuacccagguaacagccccagaccuuagcuuguaaacuagacaccagguauaggcagggggcacauauuguaaacaaaguaagauuuaggcaagggacuauguugcaucuugccuguugugccuacuggaaagccuguccuggacauuucccauaaagaauuccugaagccaguucugaggaucugcccgugcaguggccagccgucuuccuuugucaggacuuaggagcgcucauuccuaauuuuucauucaugcauuagacaagugcuaagggaauuuuuuugccggacacuguuucaaagguuaauauuaugaagacagaaaaggcugcccuugugcacccccuguuccagugagagaagagcaugagaaggaaauugaagggccacagacaggagaggaaagccaagagaggccagagucguacagguccuuuccacaaaggcagugcugaguugugaggucagacauaauugcagcuacucaggcacuuaaagcauacagacuguaaacucaagccguacuugggcuacagaaugaguuaaaggccagccuaggcaauguagugaaauccugcaucaacauagaaaaaugaagagagguuggagaggugguuaagagagaaccaggauuuagcacccaugugaacaguggggacauggucucauucacaucuguaaccacaauacagugagauacuugaaagaggaacuugcugaggggcgggggcuauucuaggugccauccuaacuggauagagaaucccagauccagggagacaacuaaagagugauaaagcacgacaccgugcuguucucuggccuccacgaagccacacagggcagguacaaggcaaaacuuggaaaagcaguuucuccacgguaacaucagggcuaaggaugagcucuaucagugggagagcgcuugucguagucgugugcaagggccuagguacugcaaaaaauagaaaguaacacugggcagcguggcacauucuucuaaccccagcacucaggaggcagagguaagccgggucuacagagugaguuccaggacagccuguuacagagagacccuguguucaaaaacaaauuaaaaugcagaaaaguugguaggcaggcuuuuauacagcauuauacaucuuuugcagagggguaaagggaaggcagagucucaugucuuccauucuaucuucaaacucacuguaucggaggcugaccuuggacuucucauguuccugucucccuccucaguaccaggauuauagaugcaugcuaucacaccugacucaugugcugcuagugaucaaacccugggcuucaugcacacuaggcaaccagacuacaccuccaaccagugagguguauauuugaaaugucaauuguacaguggaauacagaguccuaaugaugcaguacauacauaguaucuaauagucaaauugggguaacugaaaauuuuaaauuuguuaauuauaguuacucaugugguauaguguaauaauucaguacaucuucauaaaaguuuuaaagauggggucucacucuugccauccuggccucaaacucaugguaauccuccauuagcauucuuaagcucugaggcacgagucaccacaccagcauuaacaauauccuuguguucuguuacuagacuuuccagaguugcagaagaaacaaucagggauuacuuugaaucucgccuugcucuacuggaaccuguuuucccaauagcaugccaucggcucugugaggggccggauuucucaacagauuucaauuacaugcccccucagaacaugccugaagguaagcaagcaugugucccauucuaacuucaguguccguagccauaguauguaaggacgagcuugucccuaaguaaauccugcccuagcaggaggccuucccaucccacuaccugccacugugaguccucuuuaaaauauugguucucuauaauuaguuguuuauugaguuauuaaaagacggguucaugacucuuagucuagaauuauuuuuuuuucucccaauuuuuauuauacccacuaaguuccuccuuguuuggcuuguuuguguuuuguugcuuuuugagacaaccuuggcuguccuugaauuugcgcuguccaucaagcuagccuugaacucaggagauccaccugccuuacccuccuguguguuuagauuauaaaugugcucuacuaugccuuguuuguuuuaaggcuugacuagagucaagcucaacagggucuucuuuccccgcugauuccgccaagcccguucccuuggcugugguuucgcuggauaguagguaggaacagagggaaucucguucauccauucaugcgcgucacuaauuagaugaugaggcauuuggcuaccuuaagagagucauaguuacucccgccguuuacccuauacuccugucucagccuucugagagcuagaauuaaaggcauugaaccauugccugguuucacuuuuuacgaaaaccugggugggagcaccaggugcuguccucucccauuggacguaagugacagagcuauaagcacuaaugggugcugggcagggucauacuccucaagguggaacuaauaguaagugacuaacccagccgugcuccugcaagcaaccuuauaaccagugggccagcaaaacaaaagcaggagcgggaccuauugggaaguaguuuguguguggguugagggagugggauaagagugauggauacaauaugaucacaguaugaguaugcaaaguugcaaaagaaaaaauaaaaguagggcugacuuaaguucagucaccagaauccacaugguagaagaaagccuccuccuagggguugucugucgccugguguguaccaugcacauucaagggagggcagagaacauuaucucucccuuuaagugaaaaauaaggcugugacuauuuuguuaagauuuaguuauuuaugaauacacucguaucccauuacagaugguugugagccaccauguaguugcugggaauugaucucaggaaucuggaagagcagucagugcucuuaaccgcugagcccucucuccagcccuuugucaagcaucuuuaucuacaguguuaacauuauguauguaggacuggugagguaacucaguguaaaucuucugcuaccaagcauggugaccugagcuugauccaaacacucacaugguggagaaaaccaacuccuuaaaauagucuucuggcuuccauacaccaugugcugugugguugcaugcacacagaauaaauaagguuuguuucuuuguauacauugcuguaagcuacauuauaaugauaauguuugaguggauuuuugcuaugggcacgcauuugaagacuucuaggaacuaaacguaaauaaacuaggaugucuauuuguacauauaauaaaugccaaauauaaagacaaaacuguuuuaauauguauaagucaggugcugcugucuacaccugucacccuagcacuuagaacaucuucagauuacacauuuguaaaggacgauucagcuuucggcauccacauaacugcucauaacuccaguuucaggauucuucuugaacaccccuuaaaggucucugcaggcggcaggcacacauacacguauguaggcaaaacacucauacauaauaaagaguaaagccaccaguuaguuucaauacacacacaaggcugucuugugggguuauuuggacaagcucuccagagugaugguuugaaaacuguagagugaaauccagguguugugaguggggccuccuccgugucagaagaugaccccaacccccaaugcugugacagcaugaaucucucuucucucccuuaggcucugguguccuccucuuuauuuuccaugcaaacuuuuugggcaaagacguuauugcucggcuuuguggaccaugcaguguacaagcugugguuuuaaaugauaaauuucaacuuccuguuuuucugguaagauuuuuuuuggggggguaguucuuaauuauuaaaaauugugaucagagccaggugacauaauucauguuuuguuuggaguuuuugggaagaggcuuuuaagauaauaaucuguauguaggugcuuaaggcaaccugugguaguaacuugggucauaaugcagagcaacaagaggcuuuauccacacaacccaagacagggucuuguuacacagcuuaggcuacaggcccagaaccuacuucaauauuccagccucugccucuugaggucuagaacuauggacauucaguuccaaaccuggcauaauuuauaaaauugauaaagauccaugugaaugcugggcauacgugguggucaccuggcagcuguccugccuauaaaggaugauugcacauuuguacaacaugccauguacaccucacacaggugugcauaacaaaauguaaagaauguuuacagaaaaauguguauauuagugaacuucagacaauccccacucacuauaaaagaaaaugauccaaauuguuagaacauguuaauguuuauucacuuaaaucgugcuaccauauguccuacagaaaacaaugugagacuagaauagaauaguagcaugccacgcccucauucuaacacacucugcugcuggaacucuuccagaggcuaauaaaaugaacaccuuguauugaaugcagucauguguuguuuuuauuucagcccuagguagccuagaacucuuuagacaugguaagccuugaaggugagguuuuuggggggcugcacagagagauccuaucuuaaaauucaaaaacaaaaccccucaguucgcugaucggaguuccuggucucuauuguaaaugucacagcccugacuugagucugacuuuaucuucucucuuuccccucuaggacagucacuuuguuuauucauucaguccuguugcuggccccaauaaguuguuuauaagguugacggaagcacccuuugccaaggugaaaaucuuugcuucauauuuacacaguaacugcugacauaauaauagcaauacuaauaaauccucucacuagaaacgucaggagacaugguucagacaagcucuuuguacuagacggcuuauguugggcaaacuucggcucucugaggcagcuaugcauagcauauuuggcaagucugggggcaucccugcugagcucuccaaaucuugacuucaguacuaaaaugccacuacccucaccuaggacagaucccuccauaugaaaaaaggaagcuggacuacuuagaagaccauucuaauaaugguuaccuaauauauauuauagcaauaacuuggauguucuuacaagguggaauuuguguacugacauucauucucuucuuuagguuaaguugcuaauaggugcauacagaguacagcugcagugaccacaaaggauggagaaccggccucuuuucagcuggauuccaaggaccaucccuguagcaguuuggaauucuggugcagcucaaauguuccuaccuaguuguaaacuuaaaauuuaagccugcugccuguucagguuugucuacauauauuugugccauuggucgaaaacguucaauguucugcuuaguuuauuuccacaauguggaacaguacguguaagaaauauuuaaggaaauuaaaaaccuuuugaauugaaauuuucuacuagucguugugaguuuguauuugaaaaacaaaaaccagauucagggugggccccacuacugaguucaagaguagccaugucuacaacaacaugaaccuuuuacaaaucagguuuaaacauuuacuauacaacuaaguuugauauucuuaaagguggaaaagcaacuuaauuauaauuauaaaauguaacaaugcagcugcaggauuuuccucugagccucuuuguuuccagaauaaagacaucugagauugaauuauaagcuugggcuuguucugacucgcuuguaacuuaaccaacacguuuauucuauuccauggucagaggcaauucuguccccucacccgauuaucccagaguccucuucccuaccagaacuuccaccuauuuccuuccugccucagcuagcaggccaucagcuacuuauuuauggcaggugaugcuuccauacaguacacaacagauucucucuacaguagaaaugugucccguagcauacucuugacaugugcugugacugcucauaagcauaaaucac

SEQ ID NO: 7493 - RNA, 82075 nt, Mus musculus
cgucucuucuuccaacugcaguuugaagcagcgccauuuugagcguucggccaccgcgggcgugauugcggggaggcugggcuucccuccguuaccuggcuuuccuugcuucguuuccauagauacauguggagacguguguaccuugacgucuaggccucauccagcaucccaagcgaacuugcuaagaugauguuaagaggaaaccugaagcaaguacguauugagaaaaacccggcucgucuucgcgcccuggagucggcggccggagagagcgaaccgguggccgcggcggccauggcgcugacgcuggccggcgagcaggcgccgccacccgcaccuuccgaggagcacccggacgaggaauugggcuucaccaucgacaucaagaguuuccucaagccgggcgagaagacguacacgcagcgcugccgccucuucguggguaaccugcccacagacaucacggaggaggacuucaagcgccucuuugagcgcuacggagagcccagcgaggucuucaucaaccgcgaccgaggcuucggcuucauccgccuggugagucugcggcggggcgcgaggaaacaacaacaacaacaaaaaaaagcugcgggggcugcgguuuggcgugagggcgccgcagggcuucuguccugcuggucgccggucgcccggggcucacuucgggagcgcgcugcuaucgcagggggcggggucaaggaggaccagcggcgucuggguggacggucuugcgcgacaaauuuuguugucacggaggugaauuggggaugaacuugaggaauuucagcagcggauuuguucccucaccagaaugauccacagcuuccuuuugcuuucaaggggaugugucgagugguguagcucuguggcagaaccuggcccagcauuagcaugcucaaggcccgggguuucuucugcauccuagcaaguauucgccuucugucucugcauugcgugcugucuacgcuaagccauccaggucugcaaacuccugagaguaauuggggccaagggugggugcuaccguguauuugacuuauccuagcauuaaaauauuauccuauacccucuuaaauuuaaguaaagaaaaaaaauccaauuagguaaaaaaaaaaaaugccuaguuugucggcuugaagcacuauucauucauucauucauucauuuauuuuugguuuuuccagacaggguuucucuauauagcccuggcugucauggaacucucacucuguaaacuaggcuggccucagacucagaucugcuugucccagccgagcucugacauuaaaggcgcaccugcgcuaccaccaccaagcuuaugccugauauguuaauugcaagucgcauacuucuuuuuuuuuuuuuuuuuuuuuuuuugguuuuucaagacagaguuucucuguagcccuggcuguccuggaacucacuuuguagaccaggcuggccucgaacucagaaauccaccugccucugccuccugggugcugggauuaaaggggugcgccaccaccgcccggcagcagucggugcucuuaaccucugagccaucuccagcccaguggcacacacuuuuaauccuagcucugaggaggcagaggugggaugaucucuugugaguuccaggucaguuuggacugcauagcaaguuucaagacagccaggacuaaauagagagacucugucugaaaagcaggauggggguaugacggaagauguguuccucuaaaucuggcacccagaguuuuuuuguguaggaauaaaaagaccuguuaauuggaaacuaguuaacuuacagaaauuaaucuucuuaaguaauuuuacaguauaaucugaauucugugcauagcagguaaauuuauaaauucuaaguauugcuuaagucuauguuucaauuggaaauacauauaauuguauaguaugugugauuauaaauauugauauacagugacuuaauaaguagauaguagaauggcuuuaaaacugauaugaauuuugccugguuuguauuucuagagauuucccaacuccccuuuuuaagggagacagggugggugcauagccagccuucauaguguugagauuagaguuguaaccaguacuccucuagaagcacuuuuucuuuuaaagguuuauuuauuauauguaaguacacuguagcugucuucaggcaccccagaaaagggcggaagaucucauucaggaugguugcugggauuugaacucaggaccuuuggcagagcagucagugcucuuaacagcugaaccaucucuccagccccuagaaguacuuuuaaaaaauguauuaucuugccagguguuaguggugcacgcccuuaguccuagcacuugguccuagcagaggcagacagauuuccaugagcucguggccagcccaguuuacagagugaguuccaggacagccaggucuauacagaaaccaugucuugaaaaguugaaaaaaaauguauuaucaacuuuaaaauauauguguucauauuuugccugcauguauguguccacuauguguagugaguggauuuuugguuucuguaaaaaauacagaaauaucauaagaaugugcuuuuuaaaucccaggugugggguuauggggcugucuguagcagcugacuaugauuugccuccugcucuaggaaagcauaguuuugccagcugcagauaguuucuaggauugugugauauuuggaauucugggaucgucuccgaggguauauaaauacuagaacccuguaggcggggauuguagguguuggcuguucauggaaguugucugugguuuguuagugguuggaagaaaccaaagaagaaagaaauuagguuuaggaauuucucuuucuuccucucucuagucuuucuuuccuaucuagugauagggugugaaccccgggagauaaaggguggggaaaaagaagaacucacaaacuagcaaaagcuacaaccauuugugugccuggugcccauggaggacagaaggaaacauuggauucucuucagcuagaauuauagauuguggcaagccauuauguagguguuggaaccaaauccagacccccugaaagagcaacaagugcuucuaacugcugggcuaucuuuuuagccccuagaaauacuuuuuuccuuuacuuaugugugcaugugcaugacagcauauguguagaggucagauucagucugcaggagucaguucucuccucccacuguguggacccagggauagaguuuagguugccaggcuccacagcaaggcaucuuuuccugcugcucugucuccauaguucauagaaauuauuuuuauuugguaauauuuauuuuuggagacgaggucucauuauguaacccugucuagccuacaacauacagaaaucugccugccuuuuccucccaagaauauugggacuaaacaugucaugucuagccuuaauuugguaauuuuuaaaaagauauucauuuauuuuaugcauaugaauacaccaucauuguucucuucagacaguguucugaagagggcaucagaucccauuacagaugguugugagccaccaugugguugcugggaauugaacucaggaccucuggcagagcagucagugcucuuaaccgcugagccaucuuuucagcccuauuuuucuuuuuuuuacauucauguaaauguuuuggacaaacaaugguacaaguauggaggucagaagacaacuugugggaguugguucuggggauugaacccacgucaucaggcuugguggccucaccuuuaccuugugggccaucuugcuggcugauacuguuauuuuuuaaauucuuuuuagauuuauuauuuuaauuuauaugucugauguguuuuucugugugucugugcaccacuugaugccugaugaccaugaggcagaguguuggacuccuggaacuggaguuaaggauggccgugagccaccgugugugugggugcugggaacugaacccaagaucucuucaagaauagcaagugcucuuaaguguugagccagcuuuccagccuccuaauuuauuauuauuuauuauuauuauuguuauuauuaucaucgaggcagggucucaguauuaaccuugguuguucuggaacuaauuauguagaucagguuggccuggucacagaaacucacccgugcuggaauuaaagguauaugcuacuuuauaacucuuugaagugguuuuauucuguagccugggccaguuuggaauucccaauccuucugccuaugcuucccaaguuugccaucaugcacagauugaauaaagagguaguguacccucggggcaguuuucauggggcaagcccuuuuuuuuuuuuuuugguguggcucuggcuguccuggaacuuuuuuucccaaagaauuauuauuguauaugaguacaguguaacugucuucagacacaucagaagagggcauugcauccuauuacagauaguugugaaccaccaugugguugcugggaguugaacucaggaccucuggcagaguagucagucagugcugagcuaucucuccagcuguccuggaacuuguucuguaaacuagacuagcuuugaguuuggagguccuccugcuucugccuuuaaaccagugcugggauuaaaggugugugcuaccacugcucaauguauauaagcauaaagaagcucuucauaguucuuggagcacaauaaauaccauuucuacuaacuauaucaguuauuuauuauuauauauacuuaucuuguaccauagaugugaaaucucuucaguagaaaggaguuucucuuugaauuuuuguuagauuuauuuauuuguguguguggauauguuugcaugagugugcaugcacacaguaguacacauguggaggucuaagaacaccuuugggagucuguucucuuuuacauuuugugggguccuagggaaucaaacaucagucaucuuggugacaugugcccuuaccugcugagccaucuuacugacccacuguuuguuuguuuugggagauagggucucauugcaaaucaaauaacaaguaguuuguggacuguaacaguucucaucuuccugugaagaaguaaguguacauaggcaauuacaaacuagaaauacacucauuugugauaauagagaacuuucuagcugugcacaauagcaaaugccuaucaauugcagcauuugugagggaacuguucaguguugaauguaucacuugcuuuucaguacacuggagaaacugcaugcaguucaugacuuugaauuugacucccucccaugauagcaaaaaauacguagcccagguagguauuucaggaggagugauuaacaagaccuaaugguaguguuugcagauauguggauagguugacauuaauaauauguuuuguuguuaauaucauccaggcauaguagguagcacacacuugugucucggcacucacaaagcagaagcaggggugucugugggggugggguaggggaaggacaacguaaaggccagccuaugcugcauggggagauuguaucaauaaacagccuauaaauaaaugaaccaaccaaccagugucaaacauugagguauuugugaagaaauacuguuuucaugguaguucuagaaacugauacuuguucuuaaaauaauguuuuuuguuuuuuuuguuuugguuuauuucuuuuuuuuuuuuuuuuuuuuuaaagauuuauuuauuuauuauauguaaguacacugcagcugucuucagacacuccagaagaggacaucagaucuuguuacagaugguugugagccaccaugugguugcugggauuugaacucuggaccuucggaagagcagucgggugcucuuacccacugagccaucucaccagcccuuugguuuauuucuuaagacaggguuuucucuguguagccuggcugucuuggaacuuacucuguaggccaggcuggcauugaccuuagagaucuacuuaccucugcccugaaugcuuaaugacugagguuuguuuuguuuuguuuuguuuucaagacaggguuucucuguguaguccuggcuguccuggaacucucuucuguagacugggcuggccuugggccucgaacucagaaaucugccugccucugccucccaagugcugggauuaaaggugugcgccaccaggaaugcauaguaaaucaugugaugccaagguuaaagaugaaagggaccuuaguaucuguuucuuagugauacccagucuucuuagagccaaaccacuauuuuaauuuucuuguaauucaacuuuuaaaaaauugacuuuuccuccuaaaaaggaaucgagaacacuggcugaaauugcaaaagcagaguuggauggcaccauacugaagagcagaccucuccgaauucgcuuugcuacacauggagcagcccuaacggucaagaaccuuucuccgguuguuuccaaugagcuucuagagcaagcauuuucccaguuuggcccaguagagaaagcuguugugguuguggaugaucgugguagagccacaggaaaagguuuuguagaauuugcagcgaaaccuccugcacgaaaggcucuggagagauguggugauggggcguucuugcuaacaacguaaguuuuaacucucuuguccucuguccaguuaaauauggacuuguguuuguugggaauuguuuuuguguguguguuuauuuuuaauuuuuuuaaaaaagauuuauuuauuuauguauguauuuauuuauuauauggaaguacacuucagacacaccagaagagggcaucugauccccauuacagaugguuauaagccaccaugugguugcugggauuugaacucaggaccuuuggaagaacagucagugcucguaaccacuaagccaucucuccagcccuuguuuuuaauuuuauuaauuuuuuugagacaagaucucucauagcucuugauggcccugagcucacuauagagacaggcuggucucaaacucagagaaacuaccugccucuugcuagugagccacaggguuuaaaggugagcaugugcuauuaggccuggcuuuuuuauuuuaaagacaguuuuuuguuuuugaaauauaggcugcagauguugccuuugaacuugcagcagucuuucaccucagccuuuugagugcuggguuuacacuuaagugugugcaauuauguaugguuuguucuggaauaauauuuguccauguuugcauaggauaaguagauauugaauacucauuuucuuggugugcuuuucacuagaagucauauagagcaauccuaagaaauuguagcuuucuugggguauaauuuucuuacaucaaaauccaucuuguuuuaaauguagaacccaaugaauuuuuuugggggggguauugagucuuuauaguccaggcuggccuggaaucuucuugauguguagcaaaccuugagauauagucguccuuucuuagcuuucuaagcacuaaaaguguguggugccuagauggcucagugaaguguguuguuguuuugagacauagucuuacuauguagagcagguuugcuucaaacuucguaugcagcugaggaugacugaacucacucugauguguguguauuuguaucauugcagauaugugcuaucacacucagccuugggauagguugcugacuguuuaacuucaggaccugucagacuguuucacaaaguggcuaucacuucugagucccaccagcaaugaacggcaggcuuuaguuguuguuuuuucuucgagacaggguuucucuguguagccuuggcuguccuggaacucacucuguagaccaggcuggccucgaacucagaaaucugccuuccucugccuccuuagugcugggauuaaaggcuugcgccaccacagcccgacagcuuuaguuauucuauaguucuauuauaguccuaccaacuucuguuucuggacuuaaauauguggacaaauuucaucgcaugcuaaauuagauuuuuuuuugugaugacaaagguugaacauuuuuguauguguguacuuuuggccaguuauaucaaauacauacaaccaugaaguaucugaaaauuuucgcccaaauuuuuuuuuuuuuuaguuugccuucaugaauuauauaaucagaauugcaaauauuucuuuuguuuguggcuuguguuuuguuuucuuuugauguaggguuucacuauguagucucuguagacagguuagccuugaauucccagagauccacuccccucucugccuccuaaguagugggauuaaagauucaggccaccgcaccauguucagcuuguggcuugugcuuugaagagugugggcagugcauggcaugaaauccagggcauuguauuugguagacaagcucucuacuugagcuacaucagcccuguggcguacuuuauuuucuuuuuaaauuacuaauuuuuauuuauuuauuuauuuuaaauuaauuaauuaauuuauuauauguaagcacauuguagcugucuucagacgcacuagaagagggcaucagaucucauuaugggugguugugagccaccaugugguugcugggauuugaacuuuggaccuucggaagagcagucaggugcucuuacccacugagccaucucaccagcccuaguuuuuauuuuuuaauuauacauacauuuacauauacauaugcuuguauauguguacaugacuugaguuucucuuggaggcuagaguugucaggcauuagauaaauucuccucagccgguguuuuaggcaguugugaacugcaaauauggguacuagaagcugaacuugucucuucugcaaagccaggauauacucuuaaccacacuagaacaaugguucucaaccuguggguugauaccuauggggguguguaugucauauaucagauauuugcauuacaguucauaacaguaucaaaauuauuuaggaguaguaacaauaauuuuaugcuugggggucacaauaauaugaggaacugaauuaaaggaucguggcacuaggaagguugagagccucugcuuuagagcuacauuuuaauauuuuuuauuauuauuuuauguauaugaguacaccauugcucucuucagacacaccagaagaggauaucagaucccauuacagaugguugugagccaccaugugguugcugggaauugaacucaggaccucuggaagagcagucagugcucuuaaccgccauuucuccagcccacauuuuaauuuuuuuauagugauuuucaaagaacagcaguagcuggaguuacugguacuucugaacaccugaugugggugcugggacuugaacuaggguccucuggaagagcagcauugcacuuacugcugaguccucucuacccucagggaccuagaggcaucucacuuacuggucaacugcuacugacaggugaggugcauaaaagcacugcccacccuaacccccauucccuacuuguccugcucagucccuugccuguguucuccucuccuucucccucucuccccacuucccucaucucucuccucccuccuucacucccucccuccccuuccuuucugcccccuuccuuuuucucuccuucccuccuagccucccuccuugucuucuuuuucugccccucucucccaugcucauacuccaagauggccuuuugcuauccccuucuuccuuaaguaaaccuccugcacuagaucucucuguguggcuucauuucuuagcagcacaacuuggcacaggccugcaaagauaccuuacccuucgcugcuuuguccuaucgccugaugacuuauagaauaucucucaaguugcuaaacaauguauuaggugggaaaaugggauaggagacaucuuucaaaauugaaacuucagguuuuuuuuuuuuugucuuuguuuuuuguuugucuuagugugugucuauaugaauaucaucaagggccagagauaaauguugguuguugucuucuagaaugggucaccuuguauuugagacaaggucuuacuaagaccugagacccacugauaugauuagcuaugcuugcuggcuagugagcuccauguauaugucugucucugccuuuccaacucuggaauuacaguaccugcccuacuugccuuuuuaauggaugcuggggauugagcucaaauccucauguuuaaguuacaaaaauggacagaggaagcuuccacaggagugguaggcauugugagaccaaggguaagaugggagagccccuuaaguacauuauaccucagauuccucuucuuuuauuaugucaugugauaaaaauggcuugugacugacugaucuugacccuuuuuuuauuccugcaucuauucagggacaagacaauagggggaaauuggaaauuuuguauuugucaggaucuguuacaagaggcaguccuucccugccuccugauuaaagcauucucuaccacaccugacuagaaaucaguuuuggaagaaauaauguucaaucuuuuccuucuccucuccauucuuccuuuaaauuacuuaauuuuaauuuuauguauauguguauuugauugcauauauucuguaccacgugcauaccuacuguugauggagccagaaaaggggauuggaucucuggugugaacugccaugugggugucaggaauugaaccuggauccuuuggaagaacaccagugcucuuaaauccugaguccagccccacccucuacucuuuuuuuuuuuuuuuuuaauggguucuucugcggcccacuuggcauguaauuucagauggcuuguaguuuagguuucucaugcuucugcuuccuaaguucagagauuauaggcacugccauguucaguuuuacucaguuuugggguauaauauguauaauaggcaaguacuuauauuuaacucauuuugugguuuuccucuaguuaggguugcaaguuagcagcuugacuuguguuucuucaagcaccacucuucugaaagcauauuacuugcauugugaugagcagauagcagagaaaauuuuuuuguuuuuguuuuuguuuuguuuuuuuuuuuugauuuuugagacaggguuucucuguguagcccuggcuguccuggaacucacuuuguagaccaggcuggccucgaacucagaaauccaccugccucugccucccaagugcugggauuaaaggcgugagccaccaccccccggcugagaaaauuuuaauauuauaucaucuauucuucuuacuugacucuucucaugaacucucccuuccauucuuaagaccauaguaauguaagaaagguuucuaggcauaucuaucaguacccauucuuaauuucucagacccuaauuuguuccuugaguguccuguggcuucugucauccaccaccauaccugauuuaggucucauuguaggcuuucucguucauuuuguucgucuuauuugagacaagcacauggccuuuuguagcccuuguuggccuagaacacucucuguagcucaaggaccacaggacaugaacuccucauguucacuuccugcccccuggaccucacaggaauaaugccugcuuguaccaccaccacauucuccuugccucccaaaccuucccuucucccccuugcuccagcccacagguuuuuauuuguugagagccaccaugugguugcugagguuuaaacucaugaccuccagaagggcagucagugcucuuaacugcugagccaucucaccagccugcuuuuuuuuuuuuuuuuuuuuuuuuuugguuuuucgagacaggguuucucuguguagcucuggcuguccuggaacuauucuguagaccaggcuggccucgaacucagaaauccaccugccucugccuccugaaugcugggauuaaaggcgugggcugccacgcccaguagaauuuuuuuaaaaaauuagaaaaggggggcuggagagagagagcucaguguuuaagagcauuuuuuacucuuccagagguacugaguucaauucccagcaaccacaugaugucucacaaccaucuauacugagaucugauacccuccucuggcauguagacauacauguacauaggacauguacauuaaauaaguaaauaaaucuuuuaaaaaguuuaaaaaauauuauguggguguuuugugugcaugcauguguguauaucauguauauccagugccugaggacauagaagguauuggauacucuggaacuggaguucaugauuuugccauauuuggguucugggaauugagccuggguccuauggaguagccagugcucuuaaccacugagccaguucucuagauuuuguuggagaauuuuuaacgaaagaugauugaacaauauugcuagaucaaagaagacugagaaauaggcaaaucugaguguuugaaguuguaggacugagauaggaagccauauacauccaaucuggaucagauaaugccuuuguaugcuggggguugaacccauaaucuccugcccuguuacuugagacaagcucucacuuugcacacagaucaggaacuauacaucuauacauacuguguacuggaauggcagcuguaaguuauugcuugguuucaguugcuacagaaaaauaaacugaccaaaagcaacuuggagaaaagguuuauaguuguggccaauuauaaagagaagccaggauaggaaauugagacagaaacuaaagcagaggcuguggaggaguacugcuuacuugcuaucagaguuuguucaguguguuucuugauacaucccaggacaguacagagguuuugccacccacagugggguagccuuuucacaccagucaagaaaauaggcuugcccauagaccaguugaugauauuuucauaguugagauucuguaauaguuacuuuuuuuuucuuuuuuucuuuuuuuaaauauuuuuuauuagguauuuuccucauuuacauuuccaaugcuaucccaaaagucccccauaaccccccccccccccacuucccuacccacccacucccccuuuuuggcccuggcguuccccuguacuggggcauauaaaguuugcaaguccaaugggccucucuuuccagugauggccgacuaggccaucuucugauucauaugcagcuagagacacggucucugggguacugguuaguucauaauguugauccaccuauaggguugcagaucccuuuagcuccuuggguacuuucucuagcuucucuauugggggcccugugauccauccauuagcugacugugagcauccacuucuguguuugcuaggccccagcguaguuucacaagagacagcucuaucuggguccuuucagcaaaaucuugcuaguguaugcaaugaauaguuacuuuuuuuguuggugugauaaaacacuuaugaccaaggcgacuuaggaaagggugaauguauuuggccauacaguuccagagagagccaucaguuuuaugauggugcagugaggaagacaugguuguuugaacaagaagcuuagaucuugaauugcaagcacaaagaacagagcaaacugggaauugugggaguuguugaaacugaaagcucuccauaacguacuucuaaccuauacuuccuaagauuacuaaaacugugauacuugcuagggaccaaguaugcaaaugcccaaaacuguggggagcuuuucucauuuaaacuacuacauauucuuucuuagauggcucuagcuugucucaaguagacaaaaugaccaacauagcaaccaugccuaccuauuuuggcaaauuaacaauuaauuagcuaauuuugugucagggucucauugaauagcucuggcugucauagaacuugcucuguagagcaugcuggccucaaauucagauccuccugccucuuccucugcaauacuggauuauaggugugggccaccaugccuugcauaauuuuuaucugugaauaugcaugauacuuagacauuuuccuuaacuuuuuuugacauuuuuauuauaaaaacuuauaaagaauguuaauuguagucuugacauuaacuuuuauuaaugccuuuauacuuuuaucuagaacaccucguccagucauuguagaacccauggagcaguuugaugaugaagaugguuuaccagagaagcuaaugcagaaaacucaacaguaccauaaguaagacuugauuaauaaagacauucuagaucuauauuuucuuggguauauuauauuuuuuaugagguacuauuagaauacaaucugguuaaugagcgguuuggucuaaauagaauguuauuuuuauugaaagaacaauuuaauuuuauguauauaaauauguaaauauauauguauauauuuauauauaugaacuacaugugugcaggagcccacagaugucagaagaggcauugcaguucuuggaguuauauauaggugguugugaagugauuaaugagagccaaaccuagguccucuauaaggauaguaauuguucuuaacugcugagccaucuuuccagccacauuauuuccuuuuuuuacauaugaguaaagcaugcuaacuuuacuuagaaaagcuucuuuucuuugcuugcuuccuuuccuuuccuuuccuuuccuuuccuuuccuuuccuuuccuuuccuuuccuuuccuuuccuucuuccugcuccccccucccuuuucccuuucucuccuuucucucuuucugucuuucuuccuuuugucuuucuuuuuaaagagagucucauuguguaguucuggcuggccuggaauuugcaugugagcauguauaugaguacagguaccaguggaggugccagagauggaguggaagcuguugaugagcugcccaacauggguacuagcaacuaacuuuaguccucuggaagaacaucagugcuuuuaaaugcuuggacauuuuucuguguucauuucucucucucuuuucucugucucugucucucucuccuugcagugaugguuuuguuuuguuuuuuagucuggguuucacuguguagauggcuggaacuuacucuguagaccaaccaagcuagcuacaaacuuaucgacaucuacccaauucuguuucuggauugaauuuauguaccaccauaccuauuuuccuuccuuccuuccuuccuuccuuccuuccuuccuuccuuccuuccuuccuuuuugagauggggucuugaacucagagaucugccugcccuugcaccuggccccgucucuugcccucccaccuccauccacaaggaccaaauccugugccuuauugccuuauucuguauauuacugaccuaaauuccuggacccuaugugauucuguguucacuaccuguuuuugcccugugacuuucuguauuaguacuuggaauuuaaucauaucagcucaucuucccuuuaaccccaaguaaaaggaaaauuccagcuguaaaguuucuauaggugagaugagaauugugcugguauuaauacuuugaccagacacuccucuuaguugagaaugguugaaaacuucauuugagcuucaguuguguuuguagcucuuauuuguuuauugucuuuuuugauaugaacucacuagguagccccugguggccaggaacacacuguguagagcagcuuggccuugaauucauagauccuucuaccugggauuaaaggcaugccccacaaagcuugccaauuuuuauuuuuuauuuagucauuucuuuguucauuuguuauuuaaauuuugaaaagguauauauguauaguagugccauaaguuauaugucauaggaauuguauuacacauuugagauuaaauaguugacugguaaugccuguccuauaagggcaaaacuguuaaauauguaauuacaggaagagugagcugguuuguuaucuuuagcccauccacguagcuugguacauaacaaaacguuuuuauuacuaagaaaaucugauucuaagcuauuaacuuagggcuuacugggauuguauguuacagguuucaguauguguaguaguugaacgaaaaccagaaagucuuuaugagagcuaguaauaaaagcauagguuggaguauugcauuuuguaaguuugaaucauuauuucauuauuaauuuggcacuauuugaaaauuucauaaauuuguguuuauagaaucuauuucaugauccugucaugagacaauguauggugccuaacuguucaggccauaaauguccaauaagugauaguuacuauucucugugguuguuuaccucuuaaguauacacuuuuguauguuuuuaauguuaauacagggaaagagaacagccaccacgguuugcucaaccugggacauuugaauuugaauaugcgucucgauggaaggcucuugaugaaauggaaaagcagcagcgggaacaaguugauagaaacaucagagaagccaaagagaaacuggaggcagagauggaagcagcuagacaugaacaccaguuaaugcuaaugaggcaagguaaaggagaugugccagugagauguuaguccuuuauuauuaguugugguuguggagaacagggucuuucuauauauaccagacuagauuugaacuugcagaucugcuugucucugccuuuugagugcugugugcuaguauuaacuugccaauuagaguucagaaacaggaguuguaacucaguauacuaguucugagagaacuuuguuguuuuaaaaacagacucuucuuaccugguaacucaggcauuguuugaacaccuuauuaucuugaguacuggauuucagaauagagccacaacaacuggggagaacuuuuuuauuuguuuuuguugugguuguuguuguuuguuuguuuguuuguuuuaaaaucaaggcaggguuuguuucucuguauaucccuggcuguccuggaacuugccuuguagaccaggcuggcauguaacauggagaucugcccgccucugcuucuccagugcugggauuaaaggcgugcgccaccacugccuauugagaauuuuuucuuuuaaagucagaaauuuaguagggauugaguaucccugaucuaaaaagauugggaacagauuuguuacagauuuagaucucugggucgguaccaaauguagucugcaaguaugucuuuguaacaagugugcaugcugccccucauaagccagagagaguauuagagugcauagcuaacaguaagauagacugcuuaaauauuuccuagacgcuucugugucuuuguuacauucauuuuuugcucauauuuuccuuuucucuucuuuggagguguuuguuuauuuuagguuacuuuugaguuacuugucuuuauguauauuagcuguuugacuuaaugugagccaugugugugcagucuuuucagaggccaggagcugucaauccccuagggcuggaguuacaguugguuccaagcugucauuagggugcugggaauugaacccaagucuucuggaagagcagcccagacucuuaaaugcugauccaucuuucuagcccugucguguaacucaagcugacauugaacuucugugaggcuggggaugaccuuuaucuccuaauuccccuaccucuacuucccaagggcuagaauuaaguauauagcucuccagcccccguucugguauuuuagcuuuaaaaaccauucuaggguguuuauuuacuuauuuacuuacuuacauauuuuuugagaugggugagguucauguagcccaggcuuaccucuaacuuggcuaaauccuggaggauaaaccugagccccugauucuucccucagguauuggugugcacuacuguaccuggaauaguacacguuuauuacuaugcgguacccuaugcuugcacucccaacaucugacauagagucugaagaaucaucucaggguuagccuaggcuacauaaagugaguuuagaaaguagaaaacauugaugacucgucucugaauuuaccuuuugguaaauucucuuucugccaggauaaaauagagaucuuuuacuguguuucuaacagucucacuggacucugcaaauauuucuuuuagaacaaggcaguggugguacaugccuuuaauccuggcacucaggaggcagagguaggcagaccuuugggaguucaaggcuagccuggucuauacagguaguuccaagacaaccagggguacccugugucgggaauaaaagaauucuuuguuuauguauauggguguuuugccugaguguaugguauaucuguagcucagagaggccagaagaggacauuggguccccgcggguacgguuacagaguuuuuuguuuuguuuuguuuuuauguggauaccagaauggaucuguguggcucuguaagaacaauauguguuauacucuuuuauugagacaggguuucucuguauagcccuggcuggccucaaacucagaaauccauuugccucugccucccaagugcugggauuaaagaucugugccaccacugccuugcuauucuguacucuuuucuuccuuccuuccuuccuuccuuccuuccuuccuuccuuucuuucuuucuuucuuucuuucucuuuuuugguuuuucgagacaggguuucuuuguguagcccuggcuguccuggaacucacucuguagaccaggcuggccuagaacuaagaaaucugccugccucugccucccaagugcugggauuaaggccugugccaccaccgguacucuuacuuugagccauguuuccaucccaauuucuugguugcuaauguguauaaucuuggcacuuuugaagccgagaaagugggcuguggugaauuugaaacuaccuuggacuacauagugaguucuuguuugauucagagcagugguucucaaccuuccuaagugcuucaacccuauaacauaguuccucauguucuaguaauuuccuaccauaaaauuauucucauugcuacuucguaacuguaauuuuguuacuguuauggauugaaauguaaauaccugugcuuucugguggucuuaggugaccccuguaaaagggucauuugauccaccaaagggguugcaaucaauaaguugagaacaacuugucuaggguaugaucuuaucucaaaaaaacucacaaaaauuaaaagacugaaaagaaaaugugacuggagagcuguuucagcaguuaaaagcacuggcuacucuccuagaggacccagcuucaaucacuguaccuggaacucucuguaacucaguucuaggggaucuaauguccucuucucgcuuccuuggauaccagccaugauguuguacacacauauaugcaggcaaaauguucauauauacaaaauaaaaauaaauccuugagacaaaagcagaaaggaagcaguagaaacaauauuuccuuagcucuuuuuuugggggggggcaggagggguugagacaggguuucucuguauagcccuggcuguccuggaacucacuuuguagaccaggcuggccucgaacucagaaauccgccugccucuguccuuagcucuuauaugugccaguaauagagauuccacuuuuggaucugaaaacagaaggaagguuagauaauauuaauauguaguuaauauuuucuagaucuaaugagacgucaagaagaacucagacguuuggaagaacucagaaaucaagaacugcagaaacgaaagcaaauacaacugagguaaaagaacaucuaauauaaauguguguguuucagugagaaaauuuccauuuauuauaaacaagucguaaaaauaguagaaauacuaaagaaaacuuuuuuuccuuuuuggccacauggaaaauuacaauauaccauaacucuuuuuuggugguucuuguuaugauucuuuagcugguuaaggucacuuugacugaauugcaaugguaagaaugcucgugauuugccaguuuuuccagauauacauagauuuggauugcuauuugccuugguuuauuuugagucagagucucacuuuguagcaugggguuggcucaucacucuauuguauacuagguuggcuucaaagucuagaucuuccugccuuacuuuuucuaagugcuagaauuacaggcuugugccacuauguccaguuuauguagugcugacugggcucuugcaugguagaucgauaucuuaccaacugaguuacaucccuagcucaagguauguaaaguacuuagucuucaaauuuucagaaaucaaaguuaauguuuuugaauuuuugguuguuguuuguuuguuuguuuguuuuuaagagugcuguaucuuaauguacaccuacaugccagaagagggcagcagaucccauuauagaugguugugagccaccaugugguugcugggacuugaacucaggaccucuagaagagcagauuguucucuuaacugcugagccagcucuccagcccccaaaguuaaguguuuuaaacaaagcuaugcuagaugaaacaaacuugauauuuuuguuuuggaaaauuauuguuuucaaaguacgauauaaagaaucuggguucaauucccagcacccacaugacagcucacaacuguguuucaggggauuugacacccuuacacagacauacauguagauaaaacaccaaugcauacaaaauauuaauaaacaagggacuccccuccccaacauuguuuguuuauuauguagcuacagcugaccuuggaaaagaaugaacuugaauaagcugaaauuuuuagaugauagaauauuugacauugauguagaggaaugaacaauuaagucagaagacauagaaggaaccuuauaugccuauugcugaguaaaagauaacaaucuaaccuggucagguacuguacaacuuuuaguuauaguuuuauugcuaugaagagacaccaucaccaaagcaacuacaaaggacuacauuuaauagaggcuggcuuacuguuccagagauucaauccauaucauuucuggcaggaagcagacauugugcuggaggaggggcugagaauucuacaucuuaaucgaaagacagccaggacagccaggaggagacuuccuuccauagguagacaggaggagacucuccuauacugggcagagcuugaguacuaggagcccucagagcccaccuaaacaguaacacauuuccuccaacaauuccacaacuauuuccacaaggccacaccuccuaauagugcuacuucccaugggccaacaauauguaaagcaccacagacucuaauuacuauggaaacagcaagcuaaagagaugacgauugugauugucauaguuuagugaguagagaugaagaugagaaaauuguuuuaaaauuuuauuuuuauuuuguaaaaauuucguauuuuauaugaaagugccuguauguauacaguagaaaccaaaaguguguaucagauccucagaacugcaguuacaguuaguuauaagccuccauguggauucugggaaccuaggcucucuacaaaagcagcuccuaaucucugagcccucuuuaggaaaucagaguuuuagggcagaaagacuuguuuguauaauguuacauuuuguuuuugaacuuacagcauacacaucaaaacugaaaccuaacaggaccauugaacucuggaugguaaugauuugucguugggguucauggauuuuaucaaaugugccacucuagugcacauauugacaguagguuguuguggguuuaggaguggaggaaauauuugggaauacaauauaccacuauguuuucuucagagccauaacagcucucaaaaauaaaaaacaaacaagcacacucgcaggcacacacccacgcauuuacauacaguguggggggggcacaugaauguguacauucaauggcacaggauuaccugcagguuuucaagugcugagauuauagguaugcacucccauacccagcauuguauauucuuuguuaagugaacaguaacuguaguaugagacauauuucucacuauuggagcaaggucagagguuuucaguauauauagguagaagcuguacaguacaguucaauaaaaggccccgaaacaguuuugucucagccacaaugagcacauguauuuuccacauucuaguaagugccauucccuaauagcaaagacauucuaucaguaguaaggaagugcucaaaacaggguagguuguaucagaacaaccuggaagccaacaugacagcuucuaauggccaaacaguuucaucaaaaggagaaagauggagacacugagaaugagaucauuagcuuucaaaccauagaacaaaauuucuguaaauuuauagugcuaaaaguacugaauaauaaauacauaauggagaaaaaaacaacuguucacagcggaauuccauuuaacaguaaagagaaaagaugaaaagggauaacucacugauaaguaaauaguuguaguccugugcgaugccucuccucucgggguaucuggacacugcugccaaaacaccugcucacggaggacuggcugaaguccugaauggaugggguccagagucugccucuuccuuccacgguaucagauacugcugccugauagucaggauccggucugguuggggcacaggcucuaaaagagcaacagccuucccugaccaaaugaucuuuaauaaggcagcucucuaagaggaucuuagcuuguuuguauuucuucaucggagguagguuugauuggauacacuuuauuaggguaaacuuuauuggagggacaauauccaggaugaggaaaaggucauuuggcugaaggcuaauguacugaguugccucaguacugaguacaugguugacuaccucguuguggguagccuggugaccagcugcaagguagcacugagacagggaaggagcugcucucuccuuuuccuccuagucucaucuacuccugcuggucucaaggguugagguuuccgggauuugaacaugcucuaccucaccaguucugugccaguuccuguuguggcacgguccacaugccccaccaauaauagaguaauuauugguuuugacacaguguaucauguauuccacaggggcuucuuacuucagucucccugugacuggcucugccuacuguacucauucucacaagagaagauuuauuuaugaauaugaaaguagguaaagccuugaacaacaggauuuuugcauaguguuaauacaaauauuccuaucauuaauagcuuauuuguuggggcuagagagauggcacaauaguuaaaaguacuagcugcuuuuucacaggacccaaguucaguucaugacaccuaaaauggcagcuaacaaccaagggggaucuaauuccuucuucugccugccuuaggcaauguaugcauaugaugcacagauauucauaaaaaaaucuuuaaaauauugucuguauuagagagauggaucagugauuaagagcauguacuucucucuuuacaggucucuuuaaauuacuuucuauuuauguaguaugcguggguguuuugccauuguguuuauguaccacgugcaugccuggauugcccuugugguuagaagggaaaagcaaacuuuuugggacuggguuuacaaaugguuguguugccauguugguguugggaaugguuuucuggacaagcagccagugcucuuaaccgcugacugcucucuccagccugagugcacugcucugcagaagacccaguuagauucccagcaucuacuuuaggcaaccuccggcuugaggggaacaagauacuucuggccucuugagcagcugaacucacauacccauacccagacauucacauacacauaauuaaaaaugauuuuuuuuacaucuuuacauauuuguuuuuacaaacaaagauuuuuguauuaaagucaaguggaaaaauuguaaacugaaaguccaguaaaccaggagauggcacuacaacuaaaugucaaaacuuccauuauccuagugagacuucauauuagauaucugauacuacucaguaaagauucagcaacugauagcuucccuggcauucuugcuaaauacucauaaccucauugcauugucaucaggagaacacacuagaccacugcaaugaagucacagccggcugcagaggugggucagugguuaggagccauauccugccugugcagagauucugguuucaucucccagcacccauaugguggguggcucagaaccuuguaacucuagcuccagaguaucugcugaccuccacagccaugcucaugauacgcacacgcacacacacaggcaaacacucauacacacagaauaaaggaaaauuguuuguuaguuugucuuugacuaaccuugcuaucuugaaacucacucugcaugcaguucagguuggucuuaaacucagagauuugccugccccugacguccaagugcugggauuaaaggugugugcuaucacacuuggcuaaaauaaauaaauccuuuugucuacuuguuuuauuucucaagacuggguuucucuguauucuuggcuguccuggaauucucaggcuggcuuuacauuacacuacagagaucugccugccucugccaagugcuaguaauaaaggugugugucaucacugcauggcuuuuuuauuuuuuaaauaaguaaauaaauaaaauuuaaagagauagaggagagggaaagagggcuagggugauuucuuaguggguaaaagcacauauuuugcaagccuuuaccagaguuggauccccgaagccaggugaaaagcuugcuagucugguauaggucuguaaucccagcacuucuacuuaaagauagaaggcaguggacucuugggacauguaguaaucuggaggauacaguaggaaggcagaauugagaguccugucugaacaaggcagaaggacagagucaacucccacaaaggugucuucugaccaccacacggggcucggccaugcauggaccucuacacucacaugaaaaaaagaaagcuaaaacaaaacaaaaacaauaauacaguuuuucaaaagcaugguggcucaugcuuguaaucccugcaugcaaauaagaaaauaaaugcuuaagagauagcuacaauacaguggguuuggggguaaccugaauuaaugaaagcaagucucaaaaauaagcaauaagaaaauaauagucacuuugcaaguuucugucaugcagcacugcaaccugccugcuucaucaugucuuuucaauuuuuguauuuaugugcaugugucucuguaugugcauguggguagaaaagcuaaaaugggaugucagaaccgugaaguuggaguuacaggcagugggugcuggaaauguaauucuggcccuuuacaagagcaguaguauuaacugccaggccaucucucuagccccugacugucucuugaguaauuuuucuguuuccuuucuaucuguuuuuccuugagaugcuuggucaaagucuagaugugcugucuuuuucguccuucugagguucccccuuaaccuuuuucugcaaugccucugauuucccacuauuccucugccuauuuucuugugcuccaacucaaaaaguggcaauauuucuuuccauucucuaucuuuccauuucuaucuaguaauugaagagacuuacauguuguuuguucuguuuuucuuuuucuuuuuuuuuucuuuucuuuuuuugguuuuucgagacagaguuuuccuguauaggcuuggcuguccuggaauucacuuuguagaccaggcuggccuugaacucagaaauccgccugccucugccucccaagugcuaggauuaaaggugugcgccacuacgcccggcucucuuuuuaauucuaaguuuauuacacuuuucuagcaaaacaacuaauaccauuucuuaaaacuuucuuccucaacuuguuugaaucaaaucaggaauucuauagaaucaugaauucauauaaacagcauaguuuaucuuuaugaugauaugcaggaaaucugaucacuagagugggcuaauguuuggaaacuaaaaaggggccugggaaagaggggguagggaggauagcccacgucuggccagaguuccaccuaugcucugggcagguggaugugggagggcugccaggugggcauucaagccucugacccacucgacaggggauggacaagggguagcccccuaccugggugccccuggggccauacccuguaucccugggguucugagagagagggcugagggaagagagguucccacacagaugagagugagugcagcugaacagagacugucuaugguuucagagcuucauuauagaaaggcagggggaaagagagaagguagaaaagagagauaccagccauggccaagcggagagggggggggaaaggagagagagaaaggcuagagaguaagagggagagaggagaaaggagugagagagugagaaagaacgaggggccaaacagccccuuuuaaaguaugcuaucuuuucuguugcuagguaacuggggaggaguuuagcugggaggucagaagcuugggacuuuacuuacgugacuucuaacuaacaaugcuucucuugugggggcuuaguggggugcuaacuuaggcagaacccagaguuccaggagcaugagagaauuccuucugucccauguagguaaauuaccaccaccggguuccgggguucaacaucucagcuugacuggagacuagccugucugugcauagcccgacacuagugcccagggauuauuauauuaauuuaauaaugacaggaaaggcauaucagcugcaagaagcaauccugagaugaagucucuuugggaucuugccaucaagcugacacauugcagacuauaaaaauggccaccuccaggaagaccaucugcuagccuuagccuaccccuaaauggcuuccaaacaauguggcuacagauuuuuaccauccauuccauauaaauaauuuuuagaaaugauaauuugaauacauuuuuaguuggguccuggagauugaaaacccggccuuguacaucccagacaaauaacucuacuuaacuuuaggccaguaguacuguacuguuccuuuucaugugugucuguguguguguagauauggugcgggaagagagggggauaugaguaugaaugugcaugccugcugaagccagaagaggacauuggaacuccuugaccuggagguagaggcaguuuugauccacucuauguggauacugggaacugaacucauauauuuucaagagcaggaaaugaaugcucauauccacugagccaucucuccaguuccagaaauuuugccauaagccccugaguuuucccucuggcaauagaaaaauacuucagugaacuuguaauuugcagguaaaauuuacacauaaaccaugcaguaauaucuugcaauuugagaauuuugcuuagguucuuaaucucgagaggggcuucaugagauuguaaacuuguuaguacuguaggagcaucagcuggauaugucucuuccacguuuuuggagauagguuuucacuauguagaccuggcugacuuggagcuugauuuguaaaguagccuuuccguggagauaaggcugucauggcuuccugagaacugagaugaaugucuugagcccccccccucuauuuuacuacuuaaauuacuguuuuacuuacaugugugugugaaacaaauguucaauuucaccugauuuaaugccaauaucaugagaauuuuacuuuaguaugacuguuuacugucuuaagauuauuuuauagcuuaauuaugguuuugauauuauuauacacauacauaaaaguuaaguuugcagucucuuggucagugucaacaaauauuuuucuuuuuaaaaaauauuuuuuuaaauauauuuuuuuauuacguauuuuccucaauuacauuuccaaugcuaucccaaaagucccccauacccuccccccuaaaaaauauuuuuuagccagguggcaguggccuuuaaucccagcauucugggaucucugaggucagccuagucuauggaacgaguuccaggauauauauuauuuuauauauuaguuguauauauuauauauuaauauauauauaauaauacauacuauuuuauguguuuuaguguuuugccuacggguauguauaugagauacaugugcaucuguugcccauggaggucagaaguuaguguuggaucccccugaaguggcguuacagaugguugugagcuaccauguagauguuagggaccaaacuugggucuucuuuaagaacaacagauccucuuaauuacugagccaucuucucuaugcauaguaagugucugaaaaaggacaaaauagcaacugucuuuugauaucuaguucaacuacuuugcuacuauggccuuaaaguaaccauagacaguaaaugacugauuuacauacagguuuuguauugagaauccccaggaguuuccuuaaugguuuaaugaacguagaaaauauuuuuuuauacuaccucccaugcauaauugaauuuuuauguaguugguucuuugugguaauguacuuuugauuucuuuauuuaaagguuuauuagcauauguuaauuauacauaagagaaaucauuauaacauuuuuguaucuagguaaucuauuugaccauauucaaccccaucauccuuucuuguuuuccauucauuccugcugguccccuucaucccaucuuugguuagacuuugaauguagauuauagauuguagacuuucuccuuuuuuaucccucaccccacccccucuucuuacucuguccuaguacuggcuugaacuccugauucaugcuuuuuacauuuuagaccagucuuuuaccacugagcuacccucuuguccuugaucuauucccuaagcagauaguccaugcuagauuuuuuuuuuuaauguucauguaugucugugugaaggugucagagucucuggagcaggagguauggacaggaauaagcugccaugugagugcugggaauuaaacuucaguccucuggaagagcagcaagugcucuuagaugccgcucagccaugucuuuggccccacgauuuaaaugacauuacagguuuuacuagcaaguugauuagaguucuuugauacaugcauaguuauauauuggacuuguguuuuuguuguugacuuagagcuugcaacaaacuagaaggugaaaucucagaugccauaagcagcccucagucacagacuggguauauacaguguaacaacuugguauagacaguggaacucacaacaguuuuacccccagcuuccuaccccuccugaauacaguauuuagaagcucaaaugugaaauuugugcugaaauuuaaaauaaaaaauauuuucagacacgaagaagagcaucgucgucgugaagaagaaaugauccgucacagagagcaggaggagcugaggcgacagcaagagggcggcuuuaaaccaaacuauauggaaaauguaagugagauaccggcuagccaagaugauucuauauauuguaugauguauacuuauauuucuuuagauuuucuuuuuuuaauaguguauuuucuacuuucugaauuuuucagggcuguuaaacuagugguuuuguuaaugucuuguaaguaguacauuaguuucugaagucauucauagcuuauaaaauggcuguuauaguucuucuguuuuaguugauugguaaaaaauacaugcucuucguaggauaccuugauaugagcaucagcucuaccugaauuuguauuguauuguuuuguguguuuauuuuugaaaguuucagauauauacagucucuaaccauaaagccucuaaacauagaacugaaccuuuucaucuugcacauuaccuuuucugaauuauuuuguauaaaauaucuaacuucauccaguuuuguuagucgguauguucauauuaacuguuuaaagcccaaauuugcaaaggucuuaaauagauguguaaaguggccucugacuguuuguucccugaugcauucauucccuuuaguuugauuuuguaggagcuucccccucuccuuuucuucuuccuuuucacaccaugcaccauuauguagacuaugggccuuccuuccuaguuacagaguagucuacaguuuuuaucucugaauuucuuucaagguaguccaggcuuaaauuuuuuaaaaaaauuauucauuagguguugguagcuuguuccaugguguguguguguguguguguguguagguagguagguuauagggcaacuuuggaguccuuuuuacgcguauucaggaaucaaacucaguuuuucagguuugcucagcgaaugccuucuugcugaguuuagguguuuguucucugguuuuguuauuccccaaugauggcggcuccauaaauacuucauaaguaccauauucuccaaguucuuaaugauaguuaagugagaguuucacuguucaccugaaagaauaccagcuauagucuuuauucugaaaaauagucgguguuaguuuuuuucuauugucaaaagcaaugauucuuucacaacuaaaacuuaauacauuucugaggcugaaaguauuaagucuuuggugcuagcuacuuauuuauuuauuucaaauucccuuucucauuuuuuuguauuuggaaauguuaguuuuguuuuuaacuagaacuuauaaacauagugaaaccuuaacugauaauaacagggaaaauguuuauccuauuaucaacuaaauauuuuugguuggaaaauaucuggcauuuaaauuuaguugaagaaauguucauaauuauucuaucaacaaauuaacugcugaagaaauuuuaaguccuauugaaauuucuauuuauuuaauuucuuucuuucuuucuuuccuucuuucuuucuucuuucuucuuuuuuuuuuucugagacaggguuucuuuguuuugcccugguuauucuggaacucacucuguagaccagacuggccucgaacucagaaauccgccugcuucugccucccgagugcggggaguaaaggcgugcgccaccacugccgggcuagcuuuacuuuucuguugucuuuucuuccuugauauuaaguauuuaacaacuuauuuuaaacuacaguuucgauuuugaacauaaaucuguuggaauuaucaauguaaagauacuguuuaaaaggaaguggaaguuaacauuuucaggcuaauacugcuuuuuagucuuuaauaaucauauguaagccauaugugauauauuucuuacagaauuuccauugagaauuaagaaauaauaccuauuauuuuuauuuaucugaauauuuacaaaaagauuuucucauaguaaaauagguaaauauuaacuuccuugguauuuuuccugacaugagcuguacauguuuuauaaugaacauaguuauuuguaguauuauuaauacugucauugcaguggacuagaaaggaaagauuuaguaaaguauuccauuucuaaacuuguaaagaaucuuuuuauuuauaaauauuaguuuaucauaccauaaaugcaguuguagaauguuuuugaaauaaugccauuuuuugcuuuguggaaauuaacauagauauuaauaugccuguagauauaaucaugaauggcugguuuuaauuuuacuuuucuaccauacaacguaauguuauauguucuguggcugggaaacauuuuaguuuaaaauugaguuaugaacuccuuaaauuugcuaagguaaaauuggcgcgugugaguagggugguugugaauggaugagguagccagguguggaguucagaggacagcuuuugggaguuggcuuuuucuuuucauuauggguuccaaggauggaacuucaggucuccuuguugagacauguuucuggcccugaaagauuuuguuuguuuuguuuuguuuuuguuuuccaagacaggauuucucuagucauggcuguccugaacuucauuuuguagaccaggcugccuucaaacuuauagugauccuccugccucugucucccaagugcuguaaucaaaggcaugcaccaccuuuacucuguggcuuuuugacuuucuuuuuuaaugauaaaaaaaaaauuaggaugcauaucucugguugcguguauugugugugcuggcugggauuuccuggagcuggagugaacugaauugaucugaacccugcucuuuuggcagagcugcaagugcucuuaacugcuaagccaucucaucagccucuaaauucauaaaaaaauacaauuuuccuucagaaaauuuuuaaguugauaaaauuuuauaacuaucuagugaacuuggggaauaagagauauuagauauuuaaaauacucaggcugaauuuauugccuuuuguaaaguauauaguuuauucuuucacaagauuauuuuacuagaauaggauuagauaguauauuuaaacauuuagauaguuuucuuuuuucuuuuuaaagacuuauuuaugucauuuaucugagaacacuguagcugucuucagacacaccagaagaggacaucagaucccauuacagaugguugugagccaccaugugguuguugggaauugaacucaggaccucugcaagagcagucagugauuuuaaccacugagccgucucuccagcgcaauuuagauauuuuucaaauuauuuaaaaaacuauguuuugcaugcuuaaagccgcauaauaaaaaucugauuagaauauuaaauuacagccugugacuacugcccuuugucauacuaccaaaauuuaaagauaaacaugcuccuuucguuuuuaaaaaagguuuugaggaggcuucuaaguggcugaguguaucaaagcacuuuaugccagguuucugggaucuacaccuuggaaggacacaaaagacuugcagaaguuguccucugaccuccacacaggcuguaucauauguacagaaacacucagaaagauuguugucaugucugggaugugaagagagauucgguguugacugcaagcaggaggacuugagauuaauacauggccaggcuugcuuaguuucagcaggaacagugggccagagaggguagaugguggagucaggcaaagacuggcccauuuccaauugucuggccagguaagggagcaccagguuccgugagaggccuuaccucacaagcuaaguuagagaagacagggaggaagacaagccccugucaccuugugcacuucaccuggcaucccaugacagacacaagcuauugaaggguugaacgugauagcauauacuuguauuccaaguacuuuggagguagaggccugaggugugcugcaaguucaagacucgccugucucaaaaaacaacagaaccaaaaauaaaaguaaaucguuguuaaaaugaaagaagcuagguuggugcaaguuaacaguggcauuugcuucaaagucagaugacuuuagagucucaggacuauacaguuaguuuagaacagcucucaagucaaaggagcuguuaucuuuugaccuucaaaugcauaaaauagaaaagcauaaguguuuaaauuacauaaacacaugcauaaugaaugaaugaacaaaaaagaaaaaguggaagaaagauacuaaagacucauuccaauuuacuuaaacauuugaauuauguugaguacaucgguuggaauauuuguaauuuauucuuaaaauaacacuuaguuuguaagucuauauagcuacuauuuucuggagagcagucauauuuugacuauacuuaaugagcuugaucaugaaauaacaauguaauuaauacagggaaaaucagagguucugcuuagauuuuuuuauuuuuaauuuuuccuauuuuuaaaaaaauauuuauuuauuuauuuauuuaauuuauuuucgagacaggguuucccuguguagcccugacuguccuggaaccagucuuuagaccaggcuggcuuugaacucagaaauccaucugccucugccuccuaaguguugggauuaaaggcaugcaccaucacugccuggccuuaaaauuucuuuuaaagaauuguuucauguauaugaaugcuguuuacauguauacuugcaugcaaaaacagggcaucagaucccauuauaggugguugugagccacuguaugguuucugagaauugaauucaggaccucuagaagagcugacaguacucuuacugcugagccaucucugaagcccuguuuuuguuuuuugagauagggucugacuauguaguccaggcucacuuggaacucacagagauccccugcauaugccucuggagugcugcaacuaaaggaauguaucaccgcgucugguuguucagaauuuuuuaguagauaagaaacuuuaagcacaaguucuuuagcuuuauaaugcuuacuguuauuguaaguaaacuaaacuuacuagguugcucaguguaucaaagcacuuuguagcuaaaagaaguaguagaauaguuuuuuguucaugggcaaacauuguguuaauaggcauagugugaggcaguuuucacauucuuauacuuagaaaaugugccuuuggaaaaguuauuaagcaguuuuaauuuuuuuuucuuuuuugaauuuuaaaauuagaauauuuuuauguguucucucuuuuuuuacuguucaguuuaaaggaagaagucuaauggcaaguugaucuuucccaaauaagagccuaagcaggcuuccucaguuaguuuaaugugcuccugcuagcuuguccuccccucacuggguguacuugaacagcaccaagggcacaaauggaggccauggaguguacauuuuuucuuuuuaagguuuauuuauuauuauauguuaaguauacuguuagcugucuucagaugcaccagaagaaggcgucagaucucauuacggaugguugugagccaucaugugguuacugggaugugaacucaggaccuucggaagagcagucagugcucuuacccgcugagccaucucuccagccccuggaguguacauuuuauuucaucaggaauauuguagcauaggaugaggaacaauaaugcuuaaucaauuuagacauuuuuugguaguuuuuaacauaauuauuuuugauauacauguuuuagaauuucagggauauaaauuaauuuucaucagucuuaauuuauacuuuauuucuuuuuagaaaaugucaaauucuuugauaauuguuguaauuauaaauuaaguacgaguuuucagucuuguaacaugucuuaauuucgcuaccuuaaguauguguguuuguuuauacauucaaaacuuuuucuuauuucauguguguguuuugccugcauguauguaugugugccaugugagugccuugugccuguggggaucagaaaaugcauuggauccccuggaauuggaguuacagaguugugagcugccacaugggugcaagggaauugaaccuauguccucugaaagagcugccaguguucuuaaccacugagccaucucuccaggacccugccuaccaagugcuauggguaaagguguccaccucaagggccaguggaauucucugugcgguuuuucauaaauauauacaucauauacuugagaauaguauauaaugugucaacuauuaauucauguuguguccaguuuucaguggucuucuauuggugcacuccugucaaggcuggaaacgugguuggggaugaaaugcaccuucauuaauuuaacauuaguaaaacucugaguucaucccauacugcacaaaccugccaggaugguauagucuuguaaucccagcacuggauagguggaugcagaagggucagaaggucaaggccucaaacuuacaggagaucucccugccccuuugccuccuuauuggugggaguaagagugugcaucccauuguucccaguaaaucccuacauuuuauaccuagagagaauuuuguguuugugugauuagaguagauucuggcauguacaccugggcauaguguucugcuaaaccaguagguaacaauucgugacauauucauaaacuaaugaaauauacuugagauccaccaauaucuuguaaucaguagguuuauauuggagacauauaguuggauuuuaaaauguuggacaacuuacuaacuguuuuugaagcuuaaaaugcacuuaaauguguugaaauuaucauggucguaauacaagacuugggcaaacaugggagagaauuggggauucauauauacaauuuaaauaguacagcuuucuguaugaguauugccugguggauuuggaugucaaccuucaauugguuucucauacuauauguaugcaggagauacagucucaaguaaugauauuguuacuuuuuagugauuuauuucaucuggaccagggaucagcagacuagagaaggccugcucaaucugcaugccuucuguuuuguauuuaaauuugaaauacauuuguuagcuuuguuuguuugcuuugccuuacaaaggcuaaggugaccaguugugaacaauauaagauacuguaucaagaguuucugacaagcaaaggcuagaauauuuacuacuuggcccuguuugcuacucccugaucuagaaucaguaugauaauugggggauuuuuuaaaaagggagggggaacucagauuauccaaacucaacaguugguaaauuacaaugcaaauuaauuaauuuauauguuuccuuuccaguguuuuuagaaggcccacugagcagaucugcucauaucguaagauccaagguuccugaggaauccaaauuagguucaugauagucuuguaaaagucagagcaagagucaaagaaacaacugcuaaagugaugcugccaaacaugaguccuuacgagguuucagauacuuuucuuucuguccauagaggcuuaaauguauucuguccaaugcugcuuccucuuagucaguagcaucaacuuugguauguuauuauugauuuugugucuuguauggguauuguuucccauuaccuccaucauuuaauuauacuugauuugcucuggugugacauguauaggacucaaaacaggagguuugggaaugauaaaacuugaguaauguaagcuagcaaagagaaaugacaccuauuguuucuuacuaacgaggggagggaggcacacauuuauuuucugaaacuauguauuuuuuagacaagcucuaauuuugugcuuucuacauggcuuauucaaguuaucuuucuuucuaaguuaucgaacaaauaauuugauugcaauagaaguuuuuuuuccccccagagaaguggaaaaagacaaacaaaugaacauuccaaggauggauuuuauaagucauuuauuuacauggucuuuucuuucuguggaaauaauugagggaauuauaaucaaggcaggguuuguuuuaguuugguaugacuugcaggucagcuaguugauagauguuggacauguugguaaaaccaaaugacugauacagugguguugcgauggucacauuuaauguuuuagcuucauccauuuugggcuaguguacuuucacuuaauuuuuuuuuuccucuauaagcgaaggacuucuaaauauuagggagggcuuuuuuuuuccccccagaacuccuuuuuuugaguacaguagaaaagaacaaggagucuggguaauuaauucauuagaauaccaucuguagcuuaggguauguaauugaaacaacuuaaacuuauaaguaaacaaaaauacacuuguuaagcugauaauuacucauguuauugacaccauucuuuaggauuuugaugauuagauauauuugaauugaaaguacugguaagggaauugaugagacaccuuagcuauuaagagcacuugcuuuucuagaugagggcucaauacccacacuguauauauggcaggcuuacugccugcuguaauugcugccucaaaggacauagugccuucuucuggccuccaagggcacugcaugcauguggugcacagacaugcauggagguaaaacauauccauaugcauagaaauacuagacauuuuuauuuagauaauuauuuaauuauaccgaauauugguuuuaauaauauuuaguugcaacauuacaagguuuuuuguuguuguuuguuuuuuguuuuuguuuuguuuuguuuuucgaguguagcccuggcuguccuggaacucacucccuagaccaggcuggccucgaacucagaaauccgccugccuccugagugcugagauuaaaggcgugcgccaccacuucuagcuacauuacaaguuuuuauauaaaucagagcaaauuaauagugcuguaaauuguuuguuuguuguuuguuuguuuguuuugagaaagugcgagagugcucaagcucucuguguaguccuggcuauccuggacuaugugucuucguguagaccaggugguccuuuacucagagaccucuaugccauuaugcccaccuguuaaauuaguuuuaaaaugaaagauaaaacauuuguuaguagaaucacauacauaauuuaauaagauuaagaacagggguuucuuugauuaauauguaaaaguuuuuuuuuuucugaauacauuugauggaaauuaugggaauaucuuauuuauauguuauucaccuuaucaagagacaacuugguguuucaggacucuauaacccagauauaucccucccucccccuuccucccuccuucucccuuucugggagauggcguguuuagacaccugcaaauuauguucuaaguuuuaaaaugcuuuuguuuacucuuauacuaaguauuuagaggucaggauuuguuuauauaguuauuuagaagcuaacagaauuaaauaguuuuguguguguuccccaccccaccugccauuguaggucauaauggugcucaagcuuauaacccuaguacucucaagagguaggcaggaggaucacgcaucugaggccaucauaggugcuacauagggagauguuguacaauaaaagaaaaauagguaaguagguagauaaucugaaaucauaacuuuaaauguacuuuaugauuuacugugccuugguauaucgucguagauuaagcauuugguagauuuuuggaaaaacacuauggcacugagguaaagcuacuggacuguuuuuauagacuucaugguggaaucacauaaugaauaaauaguucuuuuuuuaacugucaaauaaucaacuuucuuaugugcaugcuugguugucagcaaaccuaacuuuuuaaugugagacuucuacauacuuuauaggaaggcuaguuuccauuacaagaaauuuuuuccauuuagggaaaaaaaauccuaccuuauuuccuguguucuggguguuuugguacagaguguuuaugcagggaaggaccucuaagagauagacuaaaguauucuuaagauuuagggaauaaaguuuucuacugggaaguauuacugagaauuuauuuuuaguguuuucuaaaaucuuaacagguaaaauugguguauuauucugcuguguuauagguauaccauauuugaaaugguaaguuuuaauuuuuguuacaaugguacuaucuuauuuuuagcagauauuuaccauuuuuugaguaaauggagaagagaaucaguauuggagauuugaagugguugggcuaaacauggcuuuggaacugucauuaauauguauaauguagucaauacauauggauuguaaguaguuugaauuaguaacagauuguaagaagacauauuuagauuguuacuucugcugugugacuuuagugcagagccauuuugcaggaauuauuuuccuuggugauuauauuuuucaagauguuuauagaaucgccuauaucuaacauuugguaacuuuauuuauucauugagaucauggagcuauuaucaccuaaauauuaagaauugcaaauuaagcuagauaaauaggcauuuuaauuuuaacugcuagagguguaaaacuugguuuguaaacauacucuagugguaauguuuuuaaauuagauuguugauaauuauauuuguguuuugaaagacuuauugaaaaauuucaaacgaaauguauugcuuuuuuccauaugucuucuguaucuuaaaucuuuuaguuguaaauucaaccauauuugauguaagcugacuucuuuugcuauauuaguacaucuucugcaucgucaacauugauuuguuaguagaaauagcuucuuuuacaacuucauauaacugaagcuuuauuuaguaguugaaaucuaagcauauauuaaagguguuacuuugaguggccuguuaugaauaaugucuuuguuagcacaucagugcucccgcaaaacuguuggugugaugugaacagcaaaugagcagauaaagaccaucuucuuuuugauguauuugaugcuucauaauauuggauccagugaugcguucuucauugcuuuccucucuccuagggaccacuuucagauugucgccuguauuguauaugcuugcuuuuugguucaucuuucauaaguugaccuguccaauccuaagaguugcguaauguucauaauaaaaugugcagggugauacagagacaaguaaagggauguagacccccucccauugguguuagaaagcuuuguuacuaucugucugucugucugucaguaguaucugcuuguagcugaugccauuguucauuccuuuaguaguuugguauuaagaaaaaauacuaaacuaaauuugagggcuaauuaaguauuacugauagauucuagcaauuacacguaucuuuucagugauguaaccccaguagucaggcugaaaaagaaggagcaagaguuuuaguuauaaccuaccucaggaagcaaagcaaaacaagaauauuuucagagaauuucauauggcauuugaagguuauaguuauuaauguucucagguaaauguauuaaaaauaaaauucuuaacucaguauauguguccaaauauuaguuuauauacaguguauuccccuuuuguuuacuauuaccuguuacauuuuaugugguuuguucaauucagucucagaaauaccaugaauuaaaaagcagccauugauuuugcugcauuuuaaaaucugaaaaaugcacuguugugguaaagcccuuguguuuuuuuuuaaaagauuuauuuauuguuauuuauuguuaaguaccagaagaggacaucaggucucauuacgggugguugugagccaccaugugguugcugggauuugaacucaggaacuucggaagagcagucagugcucuuaaccgcugagccaucucuccagcccaaagccuuugugguuaucuaucuaucuaucuaucuaucuaucuaucuaucuaucuaucuagauauuuauuuaauguguaugggugcacuguagcuguacagaugguugugagccuucaugugguuuuugggaauugaauuuuuaggaccucugcucacuccgaucagccccacuugcucugguccacuucgcucucucagguacacuguagcugucuucagacacaccagaagaggaugucagaucucauuacggaugguugugagccaccaugugguugcugggauuugaacucaggaccuuuggaagagcagucagugcucuuacccacugagccaucucaccagucccaagccuuuguguuuuaaguaaucucucuauucguuguuacuuugauuucugauugggcaaagaugaacuauuuugauuuuuuuuuuaaaugacuaauuuaaagcauaaauuuaguuauuguuaaaauggaaacaugagacauuuaucuuuuuuaaauuuacauuucuuuuuuuuaauauauauuuuuuauuauuacguauuuuccucaauuacauuuagacugcuaucccaaaagucccccauacccugcccccacuucccuacucacccauucccauuuuuuggcccuggcauuccccuguacuggggcauauaaaguuugaguguccaaugggccucucuuuccagugauggccgacuaggcgaugacauuuaucuuuuaagaauuuuuuugaaggcuuguuauccuauccacccuguucuucccuuugugauguuuccuccuuguuuucuucccuguuuuauuuaguacauucuuuuuuuuuuuuuuuuuuuuuugguuaaagauuuauuuauuuauuuauuuuauuuauuauauguaaguacgcuguagcugucuucagacacuccagaagagggcgucagaucuuguuacagaugguugugagccaccaugugguugcugggauuugaacucuggaccuuccgaagagcagucgggugcucuuacccacugagccaucucaccagccccuauuuaguacauucuuaaaaguagucuuaaauuucuagcaaagcugauaggaagguaugacgauuuccaucaugcuuuaucuccuguauccuccuaucucuuccagcauggcauauuugauagcacuuugaaccuguauuggcacaucauuauccauuacaggcaauaguuuaggguucacuccauguguuagaauuaagagaguugugauuuuuaccauucagguauuggccagaguguuuuuccaaacacagcucuccucugucuuaauccuuuucuccgcugcuuuaguuuuccuuccuuacccuuacagucuguucuuucuaguugugcccauguuuuauugucguucccccagcacgcacgccccugcuccccuacccacccacucccacuucuugguccuggcguuccccuguacuggagcauauaauguuugcaagaccaaggggccucucuucccaaugauggcugacugugccaucuucugcuacauaugcagcuagagacaggagcuaugggguacugguuaguucauauuguuguucuaccuauaggguugcagaccccuucagcuccuuggguacuuucccuagcuccuccauugggggcccuguguucacuuuucuuauuucuauuuuguuaacauauuacauggugauauauuaacauuuuuguugguuauuaauguuuuucauggaaauuuggucauuuaucuaauuuuaguacccucuuacauuccuuuucuuuuuucuuuuuuuuuuuuuugguuuuucaagacaggguuuuucuguguaccccugguuauccuggaacucacuuuguagaccaggcuggccuugaacucagaaauccaccugccucugccucccaaguucugggcuuaaaggcgugcgccaccacgcccggcucacauuuucuuacuaaagaauaggagaaaagaaaaauguaaugaaaugcugacuagagugaugacucagggguuaagagcauugucugcucuuccagggguccugaguucaauucccagccaccacaugguggcucauagccaucuauaaugagaacuggaacccucuucaggccugcagacauaaugcaggcaaaacacuguauacauaauaaauaaaucuuuaaaaaaagaaauguaagguaugguucauagauuuauaaauuuagguuuagaaauacuuauugauaagauugaaucuauuuuuuaaaguuuauuuuauguauaugaguauauuguaacugucuucagacacaccagaagagggcauacuuggugugaggaagaaucauuuucuucaaguccuuuguuuuuuauauaaacacacguucuauacacacaaaauaauuguaagaaacauaaucacauuauguggaaucacauauuuguucugaauguuaaaggauauauaguaucagaugccaguaguggcauguuuaacgugcuuugggaauagauucauguagacugguguagccuuuuuuuuuucuuccuuuauaauuuuauugaggaggaauguuuagaacuugaaagauuucucuagggucuagagagaugguucagcauuuaagagugugaaaugcucuuccagaauaucugaguuugguuccucgugcccacgucacuggcucagaacuaccuguaccuccagcucuaggagaucugaugcuucuggcuuacucacacacccagacgcucuagugaugugcacaugauaaaacaauuaaacaggagcuugaaagauggcagaacaauuaagagcauugucugcucuuggaggagaccagcacccacauggggguucacaauggucuuuaacuugaguuucaggugaccucauguccucuucugaccuguggguaccaggcaagcauguggugcauauauauauauauguauauauauacauacauacauauauauauauauauguauauauauauauauacacauauauauacauauauauauauauacacauauacauauauauauacauauauauacacacacauauauauauacacacacacauacauauauauauauacauauauauacaaauauauauauacacacacauacauacauacacacacacacacacaaauauacaagaaggcaaaauaccuauauacauaaacugauaauagagaaauauucccaaaagaaauguuuucagugagauuagcagcauaugccucuauuccaucacuugagaauuaaauuggaauucaaggccagccucagcugcuuuaguaagauacaguccaacucuuauauaugagaucuuuccaaagagagcaaaaagacauacaacaauagcaauaggaugccacucuuuauggaaucuaaauuccuuuauuaaaauuuacugaagacccaaaagaacuuuuaaauguuaucacuauuugccauuuugcaaauuacagccaauuaaaaauguaaggguuguuuguagaaaugaugcuucaguggcuaagugugcuuacucuuccuccagaggacccaagcuugaucccuaacaucuuuacuagguugguggcccacagccaucuguaacauccucuauuggcuucuguggacaugcauaaacgugccgcgcgugagccgcguacacacacacaaacacacaaaauuaaaacuacaauuuuaaaaaugucugucucauuuuauguuucagagucuuaauguuuaacuuugugaaguugggaaacuguuuaaguuuguaaauuuguuuaauauuuuucuguaauaaauaguuaucuucccacauuugauuuuguauuucaagagaugcaaaaauauuccugaagccaaacaugguaguauacguguuuauucccaguacuugggaggcugagagaggcagguccccgaguuuggguucagcuugaucacccaucaaguucucagccaggcaggguuacacagugagagucuauauuacuugcccauaaaaaugucuuuaaaaaaacucuuauauaguuuuuuaagcuuuuaccuuucuuacuuucaucucuagcccuccuucucucucucccuuucccccucucuccacguggccauggcugcccucucucuuucugucuucuuuccuucccccugccuuucuacaauaaaacuccacaaccacacacacacacacaauuuucuuauauaaauaauauuugacugguagugucuuagaaaugcuuuugcacuaaaauguauuggucugccuucaacuuggaauggaacuuuuuaacauggaaaaaaauuuaagguucauguaaauuauuagaaaauuauugcuuuuuaaaagcaaaucaucuaauugucucuuuuacucaaaaacuauauuucucaguggcagguaggcaguuagauacuaacauccuagguaaaaauguuacuguguguugaaaaugguuuguuuacuauguagcccaaucagacaggaacugguuuugaaauaaccauccucuuuuauauuguagcagaaacacuguuuguguccuguuugacuguucaggguacuaauaacaucuauauugguguugauaaaaguuuauaaaauuagucuauucuuggugcuucauucaaauauucauaaucauuuuauauuauauauauauacauauauauaugucacaaaugugguaguuacuauuauuauauaguggugucaguuucccugguuuguguuaaaacaucagaauuuucuuauuaccauuguuuuugccacauuggaauuucaugaauguugacauuaugcaaaugugugguaaggucucaauauuaaaauuuaguuuuagcacuuuuaguguuaaagagaauuuuuguuacuuuuguuauuuucugaaagagcuguagauauuccaaguaagacuuuauaaacugcuagccugcacugugcuucuaggcuuaguuuuggaaaacaguucuacuuugcuucuucuuuugucaucuguucauucauaauucuuuaucgagcuauacauucuuuauaaguuaacuucaguuuuuuuuuucaauguuggcauuguugaagauuggagguaucuuguaauggugggauuuuaugaguuuuauuagaauuuuuguaagacaacuuggucauuuucacuuuguauugccuugaacaaauuguuuacuaccucuguaucuguuuuaucuucugcuucaggggaauagcuauagaaauggacugaggagauggcccaguugguaaagugccuaccauccaagcacagggcuacagaacccaugaauauaacccagguguuguagccaggcaugguuguaugagccucuaauucuaaucuugguggcugugugcugggugggcauuggagccccauucugaaacuucuuguccuucuaguugaugagcuugaaguucaaugaaagauucugcuucaaaauaaaaagcuggucuuggcaugguggugagugcuuuuaauuacacgcacucaggaagagguggucugauaccuaugagucugaggccagccaagguuacauagaaaguuccaggccagccaaggucucaaaagcaugguguugcacugugguaauccugguacucaggaagcagaagcaggaggauuuaugugaguacauaacaaguucuaggauagucaggucuaaacagugaaauucuaccccuauuccugggguagaauaaaaacuggaaaaggauugaggaaguaagcccagcauugaccuugguucaccaugugccagaacuuugcccauaaaacacagaggucgucugccuaacaggguuaaguuucuauuuuaaaauuugaguuuuuguuguaguuuuauuuuauuggaaggaaaucuugaauccuguguguuauugugcaugcacaugagucugcaugaauuaauuuguaucacacaaguccagguaccuacaggaaccagaagagguuucuaguuucccuagcugugagcuacccaguugugagcuacccaguugugugcucagaaaugaaaccccgaucuuuuugcaagagcaguaagugcucuuuaagugcugugacccaucucucuagcugauauuaaacaguuauuuuucguuuuagguuucuucuucuuuuuuuuaauauaggugucuuugugaguauaugcuauguaugugcagguagguaucuuggaggcuuggguccaucagauccuuuuuuuaaaaaggggauuuauuuuuauuuguaugaguacccuguagcugucuucagacacacacaccagaagaaugcuucagaccucauuacagaugguugugaaccaccaugugauugcugggaauugaacucagguccucuggaagagcagucaguuaacugcugagccaucucuccagcccaucggguuccuugguacuggaauuagaguuggcaauaagguguugggugcugggaacugaacuuaggucucuggaagagcagcaauugcuuuuaacuaugauccauuuuuuucuguuuccuauuaaaagucuguugagauguugguuacaguuuuuuucuguuuguguguuuucaaccuacacuagaauaauuuuguaaaguaaauaauuauggucaagaaaauguuaucuuuuuuucuauuuuaaaacauauuaaaggcucagcucuugucuauccgcuugaagcucugaguuuuaucuccaacaucauuaagagaacuuaauggcacaugguugcgaauucuuuaaguuguagauagaugguauucuggagucucuucgagguuauaaaaugaccaugcuaaaagcuuugcuuccuuugcauuuuaguagaaguaucuggaaaguaacagccugaagacccaaggaaauuuaauaauuaacauguuuaaaguguuugcuauaugaugcuugguugguuaucauuuugaucuuaugaucuuccuuuuuucguuuugagaacaggaucucauauagcccuaccugacuugccugcaccucacagaaauaccuguuucccucugccuccuggguguacugggaugaaagacaugcucuaccauggccagcuuuagacuuaaccuuuucauauguuaaugauaguaucuauuaauaagcaaauuuuaugagaaggcaaaaaacauccuucuaggaaaguugaaaaauagcuuuuauggagguauuguguuuguaucuucuaaauaaugcaacgaaacauuucuuuuguuuggauuauaacuuuguucauuauacauugcuuuuguuaauguucuauuaaaauauauauuucguuagacuaagugggcaaggcuuugccccccucaugccuaugccuggggaucuggccauggacuuugugcuugguagagcugcucuaccauuaaaucucucugcagaugucuuugaaagaagucgcuuauuaaugccauuuauucuuccauuguagcauuuuauggccuugguuuuguaugguguucaguguuauauuauuucguuuacuaaaauuugcuuuuaucaaaaauaauuguguuucauucagccauggauugacuugaaacauucauugauacuuuuguaucugauugcuuuucgugauuuggacacuuaguacauugguucagguaguguugcgauuucauuguuauugagugauuucacacagauuucauugguuuacuuuugaaguaagucauaguaaacaauucuaugaaguagcugcuguaaugaaauuucaaaaguucuuaauuuauaugaccugccucuugcguuauaguuaacuucuacaauguaucguuucagaacuugguaaauguaaaagaauuuauuuauguuuuaaguaaaacaacugcuuauuuaaagggaagcgauauugcauaaaaauuuuauaacucccugugucuacugaaagaguuaggguguaucuguagaccacagguggaauuauaccugguuaguuaaauaaaaaugcaagacuccuuuguuuguuuuauauaaugaaaaccaccuguaacuuuuaagacuuuacuuuaaguuaaauauaauugacguuaauuauuaaugcucgguuuuucucugauauaaggucuaggcaaguuucucugcaguagcagccuuaccgaguaauggaacauuacucgaaugguucaugugguaucuagucuuccaguguaaauggguauucuaagacuuaauggguauuagcuuuggauucuugaaggcuugguggugcuuguuguuguuuuuguuuugaauuuuguuuuuacuuuuuguuuccucucuucuaguagucuuguuaaauaaauauuguuggaaauuuucagaauuuuuaauggacagugauaucccaacucacucuuuucuguuugauuuuagaugggaaaugucaaaucauaagaucgauagguugacucugacaacuauguuuacuuacagagagaacaggaaaugagaaugggugauauggguccccguggagcaauaaacaugggagguagggauuugaagcaaaagacuuauaaaacuuacuuguaauucuuuuggggacuguaugcugguuuugguaucuauaugcugagaaacuaagucaugcaaacaguuaugaaguugauaucuuuuuuaaaaauggaauaaaaguguaucauaggaaaaauauuuuacagcucaaauaugguuugauaucaucagugaaagaagccucuuagcuagguuuuucuauauggugagacaaguuuaaucauagugagauauaaauacauugcugucauauugcaaaaaucaaguuucauuuuaccuuggaugcugauaguucuugaguuauuuucaaaugauuuuagaauuucuauuuuaaauuuguuuuuugguuguuuuccuuugaggucuaggcuuuuuauauaguacagaauauuuuaaauguuuucuuuguuuacaguauuuaguaugaaaguauuuuucaagagucuucaguggcuuguugaggaaaugagauguuaagaagguaguuauauuaaaauuuucacuauuguauagugaaauaguguugugaaccaacgagaaaauauguggcauaugaugguucuuauuagaaacauuaaaauuugaacuggcauacuuuaaucauuucccaauaaugauauauguuucauuuuuauauuaaauugucccaccgaaacuucucaugaaauuaaagucuguauaauucagauguacaugcuguuugaauaauuacacuauuagaauagacaauauauaccgaacucauauguucuuaaaauauguagaguauuagauaaaacuuaaacaaggaauguguucaugaauauuuucuauggcuagcucuuaaaaauucuuguccuuucaguuauuuuagucagguaauauaguuuauuacuguccuuuuggucacuuuccuuggccaccaagguguacugacuagcauuuaugauaugcaaaggaagcaugaaacuguguaguuagugcguagacacagggagucauuaguguaagcagauuugucuauaauggggacguggcucuuuaguuuuuucauaguaacuuuuagguaguauauaagacaauaaauauaguuucaagggcaguuagaggaagauacaauuaaguacaauuucaaagacaguuauaauuauugucauuaacaucaguaucaaacguauuguaaauuuuuaagcaauuucugauagugcacauagaucuggaaauauuuuuucauuggauuaaaaacuuuaugaggagaauaugcuuuagaaauuagacuuuuauaauguuccuuagaaaauuauaaucuguuaguaguuauucuccuaaagucuaguccauuucuuuaaucuucaguguuagacuauaucuugauggcuuauugcaguucuuauuccguugaauuguugaauuguuaaaacuguuguagcacaucaagcuuuguaaauggggcuagaauuuguagcucagugguugugcucaaggccuuguauucgcaaccacauaugaccuauugauaguauggcagcaucauuuuuugauguauaccaguguauauaucagauacguauguacggguauuauuuuacauauuuugacucguauuuuaucuaaguuauguacuauuauaaagaagggagccaugguaacucauaccuauaguucugucauggaagauacauuaggcaggaguaugugacagcugacagcaaaucacccuaggcuacaaacaagaccuugucacccauucacucuccuuuuaaaaacagugaggggaaaacaguacuuuuaaucuguucuuuucaggaaagcugagcuaagauaagagggcuuguagauguuaccgucuaccuuuugucucuauuaucuuucuuuauuauauauagccuucaauauugaggaaguagaaaauuuaagcuuaaaguguugguuauuuaaauagaauaaguugggauuaagaaaacuauuccuucccuugaaauugcuuguuucuugaauuagaguuguaagagcaguagcaggugacgugauggauaccugaggagugcuucuucuuuuugcugcuccuuagccuugacacuguagaguguucagcugcaguagucauuguucuguggacuuaaauacaccaguguuuuauguguauauuuaagaaguucaaaucugacaauuugaaaacuggccuauauaauguagaagagaucucuaaauuggcaucagcuuugaguuugaauuuuuaugauuaaaagguacauauacuuuuuaaauaaucaaauccuuugagauguuuuucuugagacuaccauauauguuacaggacagcucagacaacacugugauaugaaacaggugguuaucuugaugaccaaauuagaagcaucauugucucccugucuaaaguuguacuuguuagaaguaggcacauaaucauuuuauuuguuugcaugaacuguguuuuaaaacauagcuucauccuaguguuuuuggguuuuuuuuuuuuagauuauauauuuuaauauaaaauugaaaaccauucuuugauacguuuuuaaaguauuuaguacuuauauaaagccacgugauuaguuuacagcugucuuugugugauuaucuagaguaauuuuccuuaauauuuauuauuuuuuauaugcuaauauuuuuagcucugacuuuaggggaaaacaaguuguguuuuuugagugacaaaccuuuacuguuuauuaaagcucauagaauguaaauuauucagagucauuuucuuuaauuuaauuauaagcuacaccuaauauuacugauuuuugaaacucuuaauaugauaguuccaauggcucuaaaaaauugacauggccuuuguagguuuguuuuaguaaugagaauuuuacuguauauaugauguuuauuguugaugguuuaguauuccacucucaaggaaggaaaguuauuuugaugauagucuuguguauagauuugaaugaauuguauaguuuuuaauguucacugaacuaagauaggccagcucuaaguguagauuguuuugcauagaugcauuuagcccagcaccugcugguacccaagguccuccuccaaugauggguaugaauaugaacaacagaggaacuauaccuggcccaccaauggguccugguccugccaugggaccagaaggagcugcaaauaugggaacuccaaugauaccagauaauggcgcagugguaauguaucacuaaaauuuuuuugguuauauuuuguaaauaagcauuuugcugccucaaagauaacuucacacuuaauauaacguggugucauuuccuuugguaguauggauguacagccagugaagagaaagcaacuuuguuaaauuucaauuuauuagagacaauuuuaaagugucuuaguauugccauccccacuuauucuucuuccucaauagagcgcacgucucacuacaguucucugcagugcguuuaacuccugucugccagugaauggaugcaaggcuaaauguuuaugauugcgcuuuuucuguguagacucuuuacccuuagaaacagaacucuacuguguguggaaaaaaccaaguuuuaguuuugacacaucuccuuguaauaauuuauuucaaaacauuucucuuuguugacaaaaaguuaagauuaaaauuuuaguuuuucaaaacauuuuaaagguuugcaguuauaugcucuuaaugugacugcugauggcuuuuauuacuaaauuuaauauguacagacuuuugauccaggagugugaagauaccuuuguguggcuaaaacguaaaaauugauuuucucuguuguaaugucuaucaucuuuacacaccaguuagcuggacagauggcucucaccaccucugucugaaguuuucuagaaaucauuucuuccucaggugaugauuccuuaaaguucugaaaaagaaaauuggugaccagauuucacaaaggcuguuugguuuugggauuaccguccuaaaaguuagcagucuaccacuggcuaaggaggaaaugcacuggcaguuaauguagacgggccaucccuuuuacauccauugggaucagagagagauuaaaaggaaggcaucguucauuguagaacugaagaguaauacacuggucuucuugauaucauuuucaaaucuauuguuuaaggagguagagaggcagggucacaguauccaggacagagagauggcacauaaaguggucagugcguuugucccuuuaagagaggcagcauuuauauaguguaaucccugaaacuugaaguauguugguucaauuucucuucugcauuuaaucauuagcaguaacauagacauuauuggcuguauuccuauacacuuuccuaaaauuguaaauuuaauuuaaaugucauucuuagguuuugugguuuuuuuuguuuguuuuucuuauuuauacauuuauacuucuuaagauugaccuuuguaaaguuucaaagaauaaaugacucagauauuuaaugugcuuuuaguuauucauauuauuaaaacaguucuuaaaacauacuguuuucuuacaacuggucuuuaaaggagcacuucauaugucuccauauuaaaucccugaauuuuguguuguuucuuaaugcuuuguuucuuaaaagcauugaucauugaguuuguagaauguuuacuuuuaaaacaguacgaugcagcuccucaguguacaucucugauuucuuuuuaaaaaguuucuuucuuaccaggccugaugagacauguuuauauuauagucccagcaccugggggcaaacgcagagacagaagaacccugaguuagaggucagccugggcugaguagauagagacuccaacucagaaacaaaaacacauuauuuguuacuuuccauccuaguuucaugcaguguaaacuuuuuaaaaagggaucagagugguauucuaugcugaucuggcauaaggaggcauuugcuuaugucagaaucaguucuuuccaugaaauggagcguagcauuugcaauuuguaaaucuucagaugcugcuuauuauuauuauuacuacuacuacuacuauuuuuuaaaaacaggaacuaauuaacuugcuccuuucuuccuucuauguuugauccugacucugcuggacuuucugcugaacuuccugacaccaccacuugggauuuugccaauuuuucuugucacuuuuauuuuggcguguuccaaauggacuuuauuauaugugauuauagcacaaugauagguuuccccaaggaccuccaucccagauggguucacccaugggaaauagaacagguucugaaacuccccaggcaccgaugagugguguagggccuguaaguggugguccuggcggcuuugguagagggagucaagggggcaauuuugaaggcccuaauaagcgucggagauauuaaauaaugguucauuccugacuguuuagaaaaacauucaaugguaugucuuuacaccaugucuguuacuagggagaaaugguuuuacuguuaauguauguagacuaaaguuuuucuuuuguaaaacuugaguuuuuuuuguauuuucuuuauucauaagcuuuguagauuagcuuggugaaaaagaugcccaucauugugaauguugaaaaguguuugugaccuuagcuaacgauagcuauguggcauuauuauuaagucuguguaguuacuuaaucucaauaaagaaaugauuuugccuaauuuaaaauguucuuagugguauucccucaugaccuuacaaaacuugcuaugguugcuuuagcuaauccuaccuauuuaaacgugaagaugacuuuguuuuucuguuuguuccuguagcccuuaagucagacuguuagugaaagcugaugucaauaagggacacauacuguaguauacuagugggugggaggcauggggguuaagauuguauaaaccauagauccuguguaaguuagaguuguugcuuacauuucauauagagucucacuauucauauauucugagaaaaguuauugaggcuaucuuuguucugugcugauuuuuccaaauaaaccuuuugaaucuuaaaaaaaauguuugaaaguaaaucucuuuugcuuauaaaauaacuccugguuuuaaucuuuugccaucauucauuuacauuucccccaguuaucacuuuaagaguuaguguuaagcuuuaacccaaccagccauaccgacagaguguuggcagcgaaaggaaggcgugaccucuuauuccuaaauacuaggucagccacuuagcauuuccuguuguuuuuaagaaguguuuuaaaagguaguguaacugauguauuggaauauuuccauuuuguuaagucuguccaguaacucccauguaauguuaguacuguucguuuuugaggaauauccguucaaacgcucauucucccuuuuuccucagccugguaaggucugugacacauccuucuuggaaauacaguuuugaacuuuccuuuuuaguuccucagagaaagugaugccauauugugauguuccuucucuauuuauuuaaaauuucaauauguauguguguguguacauuuauauaaguauauggggucucguauuugaauauccaguugcccaacccaugaucguggcagguguuuucucuccuaacauuuccauguauucauacaucguccucuuacagaacaccucucugaagagcagcacacauugcaguagauuuuguuuguuuuucugccugguuuugggggaauaagcuauaauugggaaagaugacuucagucgaucagaagucuuacauaaaagcaacugguuauaaaacaugacugagauguaaucuuuuguacagaaucucauuuugucguuuuguguuucuacuccuuuugugugcagcagcaggguggauauauuuucuaaaaccuuggaauauucagaaacuuuguuuuuaguaauuacuuaagugauuuugagauuuaaaaauaagaggcagacuaauucccauuacauaugugucaagaguauaagcugauggggggagugcacuuuguuuuaacuuguaacauuauuuugggaaugaguucuuaaauucaacuuuaagugauuuaaaaaaaaaaacauuuucaacugucuuuucaguccuucagcagcacuuuucaccaguguuuuugauuccauccugaauuaagauuuggagaagcucaauuuuuuuuuuuuuuuuuuuuuuguuuauaccaagcugccuuuguccaaggcugugaugauuguguuauuauuuaagaacacuuagugacccuagucuccucagagccuaguguccaggcucagcucuagcuccaagacaagagucuacacagccuuuuucacaucaagaaaaccccguuccagugcuuaccaagguuucucugagagaagucagccucugagggacagucaaguggaacaucaugaacgucuagcuauucaguuguuaguggcuuugugaguuaucuuacuucacagcucuuuuauucaggauuuuuaauuucauuaauuagcauuccauaggugauuugaauaucauucgcuuaauaauaggaaaauucguaaaaaaauaauaguuuuggcuuuucugauuuagugugacauugucauauguacuauuauaauuccuuccuacaaaaguuaauaugccauaauuuuauucuuauaauaguacuacagucuuauuucuuuucuugucuugaaauaaucaauuuuaaaaucuugaagaauucagaaugcucgugcuaauuguaguuaauaaucauauaauaaagaaaaaucuaauuuuauaauuguuuuauuggaauuuucuguuuuuauuuucuaagucaacaaauugauuuuuuuuucuuccugucagaugugggguuuuuuuguuuguuuguuuuuaaggcagaaccuuggauuaucuguauuuuguaaauuuucaccuauucugacauuugugggcauuucuauuagaaaucuauguucaguaccacucacugaaauaauaaauauuuguuuuagaaaugucauuacauuuggggggaucaucuuaacugugauugacauuuaauagcaauaggauuuauggacuaggacaagucuacaagucuuuggcucuuguuuaccaaacacuaaauuauaacuuaaauauuuauucagaaauacuuguugaaugcuauaguaucuucguauuuauauguaaaccuucuauuaaguaucagugugaauggcuaauaacaggacguuaacaguuacaacauagauuaugaaugagggaaggaaugcaaauauguuauucaaaugaaugggauuuuaugaaaacuacgaucaaauaugugguuaaacuuuaaaugaauugaaauucagugucagacaguacuagccaaaaugaaaagcucauaguccuuuguuacugcgcuagaugcucugggaccuaggaaauggagcugaaugaggugcacagaaaucacagugucaacuuuguucagcgcaucagacaguuuauucucagaggguuaugaagagucacaugaguaaaguguauagucacauggauaagcugcagacaagcuacacuugccuuuaaaacauguuuuucuguagaagaugauaacaaauagcacuagccagcugugauagauaaucucgaggucauuccugucuucugcaccuaggaggggaugaaagcacauuccaagaaaaauuuuguguuuuuaaagaaaauauggucacaauauucuuaucuugguuuuuuuuuuuuugggaauuuucucaaaagcagucagaauucucacaugacuccacucuugaacaguguucuaacaacccuuaauuccauagcugguuauagaaggccaguuugggauauaugaaacucugucaaauauguggaauauguccuuauagaguaaauugaggcagcuuccugaagauucaagugauaguuaaauguuuugcguauauaauuuuguuaaggccucaaagauaaccaacauauaaccuuaacguugacagggugguucauugaauagaagaacuugcuaccaagucucauggcuugaguacuagccgcuagauucaagcacuagaauccacgugguggagggagagaaccauuucugccaacuauucgcugacugcguggggacguaagaugaaaacccccaaguaccaccacuaggagaacuaaaaccuuaauuuuuuuuuuuuuucaaaaucccaaauucugucaaauaugaugcaccuaacuaauccuggcuaucuguagucugacacaaguaacuauuuuacauugaaggcuaguaucaacuauugcugaucccagucagccagaguaacaggauaagaaaaggccacgcugggucugucagggucaggguugcuccaauaaggcccuggauucauucucuaguaccacugauggaaaggggaaagcaggggguguuugucucuugaguuacaaauguuacuuucuagcuaaauauauagguaaggagucuucuuuuugggagggugggguagagggaagcaaauagauguagcuaacuuuucacauacagcuccuaaaacuauaaauaucuuaaauccaacuucauagaguauauucauuuguauaucaaauaaaauguaucccaguaugaauuucuuuuauguuuacagaaguuggaaauuguuuucuguaucaccaacacgcuuucugugucacaagcauaauaauguuuuguuguugugguuuguauauuacuaaauagucauuaaacuucagcugggcauuguuagaacaaaccuuuaguugcagggaggcagagacaggcagaucugagguuggggccagccugaucuacagagcaacccagagcagccagagcugcaccgagaaacucuugucuccccacaaaaacaucaaauaaauaaauaaaauaaugcuuuaaacugugaaugaagacucuuaaacuccaggaacuguugaccuuucaguaaaacuauuucuagauuauaaauaccucaaaaaguucuuuuuaauuguuuuguguuuaauuacuugguuaaguuaaugcuuuauuguuuuauauuuuguuuuccuauugaauaacagaaacaaccuauuuccagguccaaguuacugaaauugucuguauggccgguauugagauauaaauucacauugaaaguaggucccuucaagcauauucuuguaugguuugaauuagccauuguugcuucugcuuuccucucugcaagagauauuuugucaauuaaagauggcuaagucagaguuguuuaucagugugccuuucuauuuuauuuuaaaagacaacuacuggggcucaggagauagacuugcauugccuacucucagagaggacugguucaaaucucccacaucaggcugauuauaacuguauuuaacuuuaguucaagaggauccacuucuggccucuguagucaccggcucugccagguacgcagacauauaugcaggcaauauacucauacauacuaaauaagagguauuuaucucaugagaccuuauuaaaaaacaagcuaaaggcuacuuaauguuuacaguagugcuuuaucauguagacuauuaacuacuuuaguuccuaugaggguuucagauccaaaguugagaguuggguagaauuaaguucaagcacacuuaauuugaaaaaaauuucuuguucauuuuccuguauuuuaaaguucagucaguaggaaaauguauagagcccuuucuuaaaguauguaaaaguugcauauugagcaguuuuaauaauguaggagacuuuagcauugauaaucuuaucaaaauuuuucuggucauauugugaaagaccaaagucacacaaaauuauauauugauuauaucauguaaggugcauacaugcauuagugucaaaacuuaaagccacaucauucauuauguuccaugcuuuugugauacggguuuaauaaucugugcucuggccucuuuuaugagaaaagauuuguauuuaucagucaaccaggcuaaauaagguuuucaaagaacuauguaagucuaugccuauuaacuuuguuuuucauguuaccuauaucuuaauuuucuuaugccuuuguaaauaauugaguuuuuaaaguuauguaaucucccacaaaauacauaaaacuuguguuguauguauuuugucaguaauuacagcucauuuuuuucccuggguauuuucaauuauuaguuuuuuucacagguucuuuuagacuuaaauguuagcagacauguuuauggaucagaaacauuagacugaaucucaguucccucuugaaucaguaguuucugaacuuuuugguccuagcaguacuaauaauuugccugggauuuacuuaacuucugcuaauucuuugaacugguuagaaaauuuuacacauaccuagguuugaguauucuauacauauaaugguagaccuaacaauuuugcagaauaaaaaugaucauggaaauaauuguuuacacaugauguuuucuuaaucagacagaugcugggaagauggcuaaggcguuaagaacacuggcugcccuugcccgaugacccaccuuaacagcucauaggcaacuguaacuccaguuccagggggucugaugccuuuuuggccucugugggcagugggcuguaggugauacacagacaaagcacguacauaaaaacaaacuucuuuuuaaaaagauaaaucugugggaaaauuggguccuaugugggagagcagcaaugagugucccuuuaagucaguauuuuucagacuuccagacaagucuagaaucucugugaggcuccuucaauacaaauucuguucuuuccacugcaugcagauuuuuauuuuuagugaaaccagaaacaaugaacauugcguucuaccaaguugucaugugauauugaugccagugcuuugaggaccacacauggacagugugguaggcuucauuacucagaagagauaaagggcugacugguagagcacaugguacaugcaccugucccuggguuaaaucccuggcaccaucuacaaauuuacuuuuugguuauagcuuaaugucccaguuuauuguaggcuguuuaagauuccuguccauuguaccgcgaaugacuccccuaagcauuuuuagcuugugacaguuaacaaguacugccacauugacuauuccaguuaggaaauguacaggauccugaauugcuuuguguuagauuaacaugcuuauuacacuuuucucaccgucuguugcauuguguucacaaaccuuccuaaugcaaaugaagagauggagaaaaguucauuuuguagggagcuagcaacagcuaucuuccaugagcuuggugguuagccauccuugggugggcaggugaacagcagcaucuuaguaguucuuuucuauacacauguccucugcacauguguacagaccuaaaugaggacauuuugaaagucgcauuuaaaaauuucacuuuauucucgucuguguuaguguuaguaaugaaaccacuuaacagcucagcuaggguugguauauuuggggucccuggagaagaggcacugggaaacaguuguaaucugugcuuacagcaugguaaacgaugccuaaaacgauagcauuugcuguguuaguaauggguugacuuugauggucauauuuccuguggucuuuaaguauacuaaacaaucuucuuuguuuucuagccuuguguccuuagucauguuagaaaguaguacucaucaaaguucaagaggaaaauauuuuugagaccaagaaagauauauucuaaauacaucucuguuuaaaguuaauucaaaauuauguaguauauuacauuuuuaaauugguuuauaaugagaacccauuguuauuagguugacaauaauuuguuucaaaaaucaagcucuucaguuguggagaugcagcucucuggagggaagaccauccugggcuacauagugagacaccguuucaaaauaaagaaaaaacaaaaauaaacuugcucaugcuuuacauagaaguuuuaguguuucagaauuuucuucaggaagauuaaauuguugggaguguuuugugauccugcccccccuccucccaacuaaaguaggauuuggcucugugaugauuucuucuacuuaugaucaagaauguuguccucuuuacuguauuauuagccuuuuuauuuuaaugaugaauuugaguguuugccuuugcaucauguguguaccugaugucucuugugggcaggaggaacuggaggugcagauuguuguaaacuaccacauggcugcuggaaccugaacucagguccucuuaagaagcagccagcacuuauggaacucugagcuaugucugcagucccagguuuuguguguguguguguguuuucaagccacgguuuuuccuuguagccaugacaacccuggaacguacucuguagaauagaguggccuuuaacucagagaucuacugcccguuuccacuucuuuugugcugggaguaaagguguccaccaccaccaggccugggcugugaacagaugcuugcuuccucuaacuuuuuucuguccagaagucagaugaauccuuuuugaaucccaggcguaagauaaaggccucuccuacaugaagaugauuaaccaaugagccuguuucuaaauggguuauugccauauagacucagauccuuuucaaaaucucauccagguacagaauugcaugacacaguaaacuguacauuguuuucuuucuuuaagaaacgauugaguccuguuauacuaaaguaaguugaccccccccccccaaaaaaaaaaaaaacuuaguucuuuacuuuuagauguaagaguucaguaaaguggggaggggcucugggaauagccuuugcccuccaaguauaggcaaguguucuuagagcuguauccuuuuucuguugacacauuuuaaaaaguaaaugggcauguuugccaucuugaagaagauugaaaucugauuccaaacaugguuugacucccuacuccaagcuacuuauuuaacaguaagacauugacacuagaguguauuuaccuuuguacauaguacucaccguugaaauucacauuguagcuucacucuuacugucacaugucaauaccuacuuggagccauugugguuuucuaaaaaucagaagaaaauuagaaaauucuagaaaaugacauguauugauauucuuaauuucugccuuaaauaaaauguguaugauuuauuuuuaauggagccacaggaauagaggugaaguaaaccuuagccuuagguuucauacccgcuuugauacuucuuaauguaguauccagagguuguuggaagcuacaguuaucauaaugugaguugcuuuggaauauuggagugauagaauagaaagauaaccuguuacaaguugguccuuauguuuuuauaauuuauguucaguaccuuagcaauaucugauacucuuaauucaaaacuuaccuccuacaggugcugugcuaugcccuucaguuuggcaguacuugguccaacucuauggggucgcugggucugcuuucccauggcuguguguauuguaguugagaagaacaaauaccauagaaagaguuucccauguaguagcacaggaagaagcacugguagcuacucucucucagaucagggagaauaagguucuugaaagaagacacugcuggcacagugacucgugaacagguaacuggaugaagugaagccugcuagaccgcacuguccagugcucuaugcauggcuggcuguugacuguguguguggaccuagugagucuguaagacuuugguuaaauuuuauaaugucaucuuugaguacaauauuaaucauaacuccaaacaauguauuuaaauuuuuguaccuucacuuuuuguauucaauuauagacauuuuauaaaggaaauugucugaaucaguuguaaaaagguuaauaucaguaaaaauguaaaguagcuuauuuuagcuuuuuguuagggcgauaauaagaguaucuugggcucaaaucaaccauucagcuaguaucuguuacuuuuggaaacuugaaauguucauauucuggacaggacuuguccaacacagcgacuuugccaaccuuuaucugguuauuuguguuccuagaaucccauuacauugacugucauuuugacuaauagcaugcugaacuuucagugcuggggauguaugaagugauuauuaaacauuuguuaaguaugagcaagccacuagcucucccugcccucuacaaaccagauaagcaguuugauuauucaucauuacacauucgaauuuguauaagaucuauuucuuuaaucaaaauaauggguguuugccauacaucaaaggaagauuuggagcaggcaggucucuggaaguaaguuacauuguaucaauuuuauuguuauuaguuguauguauuaccugcuuuaucuauaaaagguauauauauucaauuucugaaaagggauuugucauacaaauuuuuucuuaaauguauguaucauguucauuuuugucccaucucaauaccaggccagcuagguguggugaagcagguagaucacaaaauucaaaguucauaaaauucacagugguucuuagauuccugaugucugagaggaguuacauaagaccuugauggaagaaaguaaagccccaucacagauggcaggaauguagucuuucacucaguggugguggguuugccucagcugaggcuuaauccccagugucacaacaaggaaaagaaaaugccagccccaacaguguaagaacuuauccauuacauagugauuuauguuuguuugcuagcaaguccuuaguaaguguuuaaugaaugaaugacaccaguuuaagcacaggugugguauuuacuaaugaaugugcuccaaucugaaaaugcauuauuacccuguaguugggauuuaaaauuuaaugguuuauggagagugguacugugguagcaagaaaggaugcaaaauguuuugaggggagagguacuugcugugcaaaccugcugauccuagcccacaugggguggaaggagaaacugccuccugcgaguuuuccucuuccugggacagcaugggaccuauaaaacacuuggaacacuuggaagcaaauacucacuuccucuugagaaaauugcgaagaagucacugggauggcaacauuuaaguagaccguguauauagcuuuggguagauaacuuuuagacuguuugaguccauaguaauguuguaggaagcagagaccuuugcugcucuggaacagucuucaugugaauaauucagagugaguuuagcuuuucuguugccagaaaagaggaagauacaagguguuccaugaguuucuagugccaacgguaaguucaggauagaaguguggccuugaacgaaaaacuuuggcuccuuuccuggaagugauguuuagcagugaucugguggaauuuaaaauuauaaaaagccuuucuaggugaugaauaguguccuugggcaggugaagauggcucaacaguugaagcgucacucagauccaucuguaacuccauucccaggagauccagcacuuguuucuguccuccuuggacacugcaugcauauggugcgcagacauacacacauacaggcaaaaaauaaaggcaaaguucauaaacacauuagaaaguauuccuuaacguaucgucauuaguaccugagaccaggacagcagccucgccauccucuuguguaguugucuccacagaauguugagugcauccuuuaaaggauuagccucuagcccuguucuuuuuuacauggaguaguugcacaccuggaaggaagcaguuguauuaaaucacagaacuaucugacguugccaggucuugucaauucagucucucugagccuguucacggaaguguuuggugggucuucugucuccagauggcaagcuuugcagguucuaaggguuuccaucaccucucuucaucucucugcccuguaaggguauccauccccagcucuuucccugcauuuuaucuuuaucaguagccagaauaccugcacauucucucugacacucacugcagcuugccuuuucucuacaaguuccaaauucauggacucuaccagcguccaguuguacauacucaaagguauucuggccauguacagggcuuuucauguuacuccuuaagcugcagacauauaguucaugucuguagcaucugauuagauuuuaaguaacuugugacuuaaaaucuguaagagcauugugcauaggcucuaugcaugauccccagcauacugucagggaccuagacagcagcgugcuauggugucugaggaguuguaggauuccaagugauggccuuaguucucaaaccgaugaggucuucaggagaaaaaaaauauugcuugauuuuaaaaguuuccuaaggcaaguaugaaggugcauaccuguaauucuguaucagaaaguuguggugaagaucucaaauugaagacucauguugacuaagcuacauagugaaaaauggauauuucaauaccaauaaaauuauguuacugcgaaucucauaguguacgcauucaauaaauaauuacugaacauuucugucucagccugugccuaaaacaugagagaaaauucaguggguucuuuugaguuugaggccuacuaguugacaagagaacuauggggaaaagcccgucaaaaguuugagcuacaccauugugucagaccaagaaucgcccaguuuucaggagaccauaauaaaagaauaaagcagacagaaagaaaagcugagugggugaguaccaaggcauccauccaucucugaggcugggaaaguaaugaccaggcggccauucugacaauccaccuuaaaacugaaaccauagucuauguucuguaugucagcucuacaaaaugcaaugguguuugguguuggauuuccaagcaugaagacgggaggaucuagaaguuuccuaggccuaccaacaguaucugcaggaaaguggccuacucuugauugaguguaaaaacuaagcuggccagguuuuauaaguuugugcguuuguuuccuuuaauuuugucugcauugaagauuuaaaccaaaaguggagaggauugcucuagaaguugauccacauccaugcccuguguaugaacuacuucugcauggcuacccacacuggcugucuuacuguguaaguucuaaucauugcuguggcaggaggugcugugucgucaggacaaaacccucaagcauguucugaugaguaaguugguaugcuguagacaucaacugagagcugacugccgagggacagcacaguggagggacacucgacccgcgugccugaagucuccaggaaguggcacgaaccuuaccggucucaguguagaaguauauaauucauaauuuggugcuacuugcagaacauccuacuuggucuauuuuuuuuuuuuuuuuuuuuugauuguuaaaauacuuuggagaagccaggcagugguaggcacuuuuagucccaacacucaggagacagaggugggcaaguuccuggucauccgggacagcauacacccugucuuggaaaaaccaucaaagagugggagaaaucuucaagguccucaggauucuucggcguuuucacaugcuugcuuccacugugguguuggggauuaaauggcagcugucccgcugagcugugccuacaucccuggguuaagaguugguucuggagccaggcaugguggcgcacgccuuuaauccuagcacucgggaggcagaggcagguggauuucugaguucgaggccaaccuggucuacaaaguuaguuccaggauagccagggcuacacagagaaacccugucucgaaaaaccaaaaaaaaaaaaaaaaaaaaaguugguucuguucaauaggggacugcacagauuuacagauuuuaaacauuacugagcuuuuauauggauuagguuuuuuuaaggaggcguuaauuacuuccuauuugauauuuuucuuuauagaguaugcauacuucucuuccuuuauaaggcacaccccgcuccucugcauccuguaauuaaauugauuugcaugugcgugcugcagagcucacugcaggcuccuuucucuccaguccaugucaugagugcaugugccucaugguaugagaggagcuuggaacuuuucgaguuacauuauuggcugauugugcuacuuugcugauacacuacugauguaucucuuuugugcuuuuccacaaagauaaaugguucagggcagcaaaaacuggcuuguuccuauauagcaaaugcauaacaaauaaauuuuuaauauauucaguaaaaugauaguuaauccagacugaauagggagcagguuuuuaaagacaauagcuccuuggaguaguauuuauaaauuucauagauuuuuuuuuuuaauguauaguuuagugucugcgauguuccugugucucaguuuauuuuauccuaccucugguccccagccucaccccagcuuuccccuguauagaacugucuuuucugucugagcuuguuuuuuccagaacagcucccucuggaauagaaggacuuguggcugcauuaaucuuaguuaggccacuugacuguugggauggucaacuaccucugucugucugucugucugucugucugucuguccgcccgcccaucuaucuaucuaucugucuaguccuucaguaguuccuuucuccuggccuccgcagucauaaacacagucaccuggguacuacaggaguaaacaguguacaaaaguaaugcaguuaguuuggauuccuucaaaaauaauucacuacaauguuaaaaguaauuuagagucaagcaugguggcauacaccgugucccaugucccagauuuagucucugagacaucauggucaugagcuggagguuagaccuugucugaaauccaaaagguuccaaauaugaaacuugaggguauugacaugaugccauaaguagaaaaugccaccugucugugugggccaacagguaaagaggaugcauuagguaggacccacugcauagaaaacgaacaugacucacuuccuacauaugucacuugcuagcuguggugcaaacugcagccuggccuucacugaguuucaggucaguuggagcuacaugguuggacccuaucuaaaaacaaaagucggccaugguggcgcacuccuuuaauccuagcacuugggaggcagaggcagguggauuucugaguuugaggccagccuggucuacaaagugaguuccaggacagccagggcuacacagaaaaacccugucuugaaaaaccaaaaaaaaaaaaaaaaaaaaaaggaaaaagaaaaaaccaaacccaugcaauguguauauaaacaucucugaaucccuccccaccaaaauggcagcaucuaacagucaucuuccaggcauugugccaggggauccuuaaugcauaguaaaaguuuaauuuaguacaaguauuuuaugacugccaugccacaguugaagcaacaaagguaacacaguaucuggucaauaauugacuuuaaaaaauuguauagggcucaagagugaauucuaacaugcugcugucacauuugugagcaauauagauuguuucugcuuagguaagaaaauaagccgguguuacgguguguacccuuaaugccagccugcagauggcugagguugagauucaauguugcauugugagaacuuuucacaaaaggagcuacuauaagcaguugcagguuaggaauaucugguucucuagugggcgugggagacugaauaaaagcucuuguuagccaguguuuggucuucugaagacuaaggcagcucacgagcuagauguagacuacucucuuacaaaugucagguagcacgcuccgcagcagugcagaaaagguuagcaaagcagcuguagagaagguuaacuaccuuaggcucgccuuccagauacacaaaggaaagcucagguauuaggaguugaauauaacagaguccuguuguccagggguuugcuugguaugaaugccuaaaugucauuuuucaguugauuauauaugccuguuuugggugguauauaugaacagauagucccuuccucauaggacauguugggaucugggaaguugacacaagcuguagggauuccuaauaagacugagaaacuagauaguucuaguuccacuguuaggaaccauuagaaaauucuugccaagguagucgugcuaauggagucaugaucagugccucuagucccaacuauuugcuaggguaaggcacgaguucaaagccagucuggucaaaagaaccaccuguucuuaaacacaaugagaggauagauggauggcuuggugccaagucugaagcccugagucugguuucuguguccgucauucugggguuaagaagugacuuccccaacuuguucccugauuuccacaccuguacaguuguaugagucaaccugcuuggauguaaaacacuuuaaagacauucucaucuguuuuuuuuuuuaauuuuuaaaaauuuuauuuauuauauauauguacacuguagcuguccucagacacuccagaagagggagucagaucuccuuauggaugguugugagccaccaugugguuccugggauuuuaacuaaggaccuucggaagagcagucagugcucuuaaccgcugagccuucucaccagccccuguuaagauaucuagcaauuuacgcauuuuuuaagugccucagauauagacaauccagaguuauggcacgguaacuaggguuugagaguauagaaaucaagaccuggcaguuggcaugggaugguagagcacaugggaaugucacaaggaccuggguuggcgcccaagcagcacauaggcccguggauuaauuagugcugaguuauuuacaacgcagcacuuuaauuuacuggcuguuaggcaucuuugugaaucaaagggcagagauuguguuugguuuuuuaauuauaauuaagaucaaugucuggauagaaggcucuugucacauuuaaaaguuuaugccccauaaaaacuggugcuuaggggaaaucuuagcuaacuguccucaguaaaaguaguagcguuuggguuagagagaggguucaguugcugcucuggcugagaaccccaguucaguucccaucacacgugugguaccucaaaacuagcuccuggugauccagcagccccuuuuuguuccuuugaacuguacucagguguacagacaccugcuuacauauacauaaacagcaagaauuuaaaagguaacugugaauaaugaaaaagugaggcccaccauggugcgcacauuuacuauauccagcacuugugaagcagguagaucucuaaguuccagggcagccugguucauguggucauacuugucucuuuaaaaaaccaaaaccaaacaaacaaagaugaaaauugaugucuucuugagucagcugggggccauccugcagugcgcugugcgacugucuacaauauguaacacauaaucagacaagcaggacguguccccuagacaggaagggaaagucagagcucugcagaauuccuagaaaggaaacacaagugagaaaugagauggcauuaaccuugacagccagagccuuuuucuucuuagucacuuuuaggaggaaaugggaaacaguuugggcugcuugaagcauuugaucuuagcagcaugagccuggucugguguuuaaggcuucucugucuaguccucuuccgagaacuuguucaaguuucucuccagcacuaggucuuagaccuuucccauaguuggacugaaugauucuuaccaauuguucaguucuuggcccucugcuaagggugacuucuuggggcacagagaccucauauuggugcugacugcacuuuuguugaauuagugaacaguuuauuuaagguaacacugguaucauuaccauaaucaacaugggauguugggggcagggcgcacgugcaugugcucucgggccccaucugacuaaaaugaagcacagugaagauuaaggaugccaugaguuaagggaggagccgugcugucugcacagagccugcacugggaaggcacugaagaccucaguguuaggcccacggaggcagacacaucugagaugggaagucuuauucugcuagauucaugugcacucuuuaauaugguuugauugcuuuaacagaggauggcugaaauugucacccaggcuggccuuguaacuguaaucugugccagccucccaaguagcuaggaucacauccugugucugaggacccagcagcuucuuacuaggguuuuuguaccccucccccugccugcugacaguggcaaacacuguggaguuggauaagaaagucauguucauagauccacauuugaucuuaggaaauuacagcugaguuuauugggagggaccaaccauggcagcuacuuggcuguauugaaaauguucacuugagagcagauauguugugcacaccaagguggacuugcugguugguccuguuugcugguugagcacccuaccucagcauggucuguauaacaccugugucauuccucacuaaucggagaguccccaugaugucuggaucccaucagugcuacacuuggacacgguaaugcacgugacaggugcaaugcuuuuccucaagcuuggcuuccaugucaucugcagaggcgcuacuuuaauaccuggugagaaaagcaugaauggaauuuaauauuggcuagugccuuucacauuuuuaaugaaaaagaauacuuguuuuucuuuuauguguaugaguuuuugguacauauauguaugugcaaucacacacaugccuguugccagggaggccagaagaaggauucauaccuggauccagagccuccgugugggugcugggaauagaacucagauccucuguaagagcagcaagugcuccugaccucugagccaucucuccagcuccucguacugcugaguuauuucuccaaccccucucucucaugccucugguauacauaguaaauaaguggcugacccuuugaagauggucauugaacuuuuaaaacagugcagcauucugaguucaucacccucaaaccaaaugugaacuuacuauucccuguaugugugcugcugccuuccugucccggccacuaaugacgggcagagagccaggccaggggccuuacauagugggacacuauuucagacagcaaauuaaaauaaacauacgucacuaugguccagcucgcccuugacuauccucuuacugcuuucuuuaccuagcuauugacuuggacgugcauaagaaacuacacaggcgauuuuggaucuauguuugggaugcugggcauuguggcacaucccugccaucccagcugcuccaaaaguucaggcaggaggaucacugcuuugggccuguaugugcuucugagcuaguucaggaggaauuuaagcgguagacuuaaggccccucuagucauuccccugcaucugggaccugccucccccugggcagggugguugcuucagauugucucuggccuggccuacaaacugagguggggcuguagaaugcuaugucucaaaagcacacaguaacaaaaggagggaaagucuguagaacccgggugagcagggcugaaguccucagccuucccuccugcuguugacauuggugcuggaguuugcuguguuucaaguccgauuaucugaaccugggccuaauuauuuuuucuuugaaguuccuuauccacuggaaauggugcacgcuuaggagauggaguagggaaggucagaguucaaggucaucuucaacuacauagugcaaaguuagugugauguguaagaucuuacaaacaaaaauaaaaaucauuuguugaaagcaguaauuuguaaauuacuagauuuuuuuguguuugcaaacguagcguuucuuuaguaaccuguaaccuuuaauggaaagauaacaagcugggagagauggcucaguuacuaagcacuggcugcucuuccaaagagucugugcuuaguucccaguaccuacaugguggcccacaacccuuuagcuguagucgcaggcccacauguacugcacacaugugcagacaaaaagaugugcacaugagaguuuaauuaaaaauauuaaaagauaaguuuucugaauccuagaccucugucccugcuuuagacaaaugggaagggccauaguugguuguaguucuggccucuaugucucucugguggucauuuccuaauaaguccccuggaaaugugcauugcuugggaaagagucccuguuauugaguagggagcaccuguggaaugucauucuucccggcagacaacugcagacaccagcaaaugucaccauuuauuuguuacuuuauaguagcaauuuuuaaauguuucucuuuaaaugcccuugaguuucuacuguucauguguucuguggauaacucagccuccauuggugugugugguuaucuguuaagucuuccuuagcuuccgacagacuuagcaaauuaaacagcauguguuguaucugauacauagugggcaagcccuaucauuuucuacuaccagagaaugguuccuagaaacacggugucguuaauauucuuguagucauaggaguaugcgugguacuguguaucugaguauacaaaagggcugagcucuuguugggggcuggagagauggcucagcaguuaagagcauugacugcucuuccagagguccugaguucaauucccagcaaccacauuguggcucacaaccaucuguaaugggaucuaaugccuucuucuggugucucugaagacaguugccacaguguacuugucauauauauuaaauaaauaaguaaauaaauaaauagagaaaaugcccuuguuuagucuuuugguguacuuaagagauccuaccuccucauacaguuauuaaaguugauuuauagcgcauaaaaccaugcuuccuauaaguucuuaggguuucuuuaaaucauuaauguauauuaguaguccugugaauccccaguaaacaugugcagaauuuuguaagccuuuuuuacaugaauaauccaucgaaaauuacgauuggggcaauauuucuuaugucagguuuaagaccuaagcaacauuuuuauacuguacuggucuagguagaguuccaguauuuugugguuauguacuuucugaguucaaggccagacuaaucuacugaaugagugaguucuaggauagccagggcuacacauuaaaacccugucucauacacuugccauugccauccccacccccaaaaaaaaagggggggggagaagaaaaaaagaaaaagaaaaaacccugaagcugaguaugauaguugugauuuuuacauugcuccaucuuucucuuauuuaaaaaaucacguuugugcucucuagagagcaucauguaaaguaguucucuugauggagcacaaauguacgcggccuuugcaaaaggagagaaagguuuugaagguagaaaugaagauuuuuaucugaugcacuaucauuuuaauagauacaagugggaguucuguaugcauggacucuugguacacaugugugcuuaguacccacagaggccaaaaggcauugagucccuggaacuggaguuuauaaucacuuuugacaagagaccauaugggugcugagauuuggacccgucuucuggugcucuuaacauaugagccccuacagcaggguuguaaaguagugucaagggacuugucauuugugaacaagaacuacgguaaagacuuaaaaaggguuucacugagauggcacugugcuaaaggcauuucuugcugagcaugaacucaccugagucugaucucuggaauugauaugguggaagaagagaaugucuucccagagguuguccugugacaugcucacacacucauacauacaauguaaaauuuaaaaaaauugucaguugcagauuugaagaucauuuagaauuuaggcaauauauaaauauugccaugguauaaaauuagucuaaaucuuaguucagccaguguucuuagaugacauugggauuguuuuggaucagaguaauuaauuacccucaauaaaaauaacucuucaaaauaaaaguaggucaugggagcuagagagauggcucagcgguuacgagcacugauugcucuuccagggguccugauucaauccccagcauccacaugguggcucucagccaucuguaaugggaccuggugcccucuucugguguguguacuuagguuuauuuaaaaaaaacaaaaaaaaaaaaacuuuaaaaauaagauuuuaaaaagcaggccauguaagacaaaaugguaucuuugugaaguguugauuauuguugggcacuugagccagugucugaauuuuaaaggucuaaaauuuuucucucccuagguuguugagacagcaugaaucuacugaagccacugcuguaauacagaagaguuuaaaagccaggaagucugggcucacacugcugcuuugggucaguuggagucucuucucuguguagaaacugagcugcugcugcuuacaguucugaauucucccguuuggauugugcuuccuacacucuccauagguaauagucccaguguuguuguuugguuugggacagagucuuaauuguguaaaccacugugucguucagacuauucauggacuuuguuccccuccaucuuucuguauaugaucguuuugcuuguaucuaugucugugaaucacaugugugucuggugucuccagacuccagaagguggcauuggauucccugaaacuggaguugugggcucugauguuggugcugggagucaaaccugggcuuuccggaagagcagccacucucuucaucucuuugcuggguaccaggcgugugcacgcagagcuuccuuuugugucuggugcuucugugccuuugcacaugcaaaugucucaucacugagcugcaaccuuacagcucuaccuguguucaagagggguuuuuguguguguguuuguuuguuuuuuuuaauuccaggacaguggacuaauauaguucgacccuauuuuaaagaauugggggaaaaaguuuaaaucuuuuccuuuuuuuuuuaauaaggcagguucauugguaaccuccucuugggugugugggugaauuacuggccccaaggaugaaggccagggaaguuaucaugaggaaaggggaauggaaguaaggggagggaaagaaaaaggggcaugcuccagcacagagaaaggagagcccuccagucuuggaaucaguacauaccuagguuuucuucuugggcggaagauacccucaaagucacucacugccucugguaaagcuccugauagguggccucaugucacucauucaccaagcugaguggguaguccacgguguggcuugcccuggcuaaaacaucccaccuuuuaaaugcuuguuugccuggaaaguguucaucuuuuucuacugccauuccaaagucauuucuauccuugaucuuugggauaagguacuagguccauguggucaccaaguccagacuucugauuugaugugcauggguugggggggugggggggcguuuagaaugaaauguuuagugugugucucugucucucucagauuuuuucuggcaacacccacuucuuggccaugcugcuccagcugcuagcuuucagugcuccugucagccccacauuucccacugucacucuguucccuuggaaaguauauuaaaaauggcuaauguacaguagauaugcuagguauaguggcuccugucgccuccaaucucuuuaggaaagacucauacauuuucuguuuugaaaacaacaacaaaaaaaaaggucaggcuggaaagauggcucaguaguuuagaacaguaacugcccuuccagaggugccaaguucaauucccagcaaccacaugguggcucacaaccaucuguaaugagaucugauacccucuugugugugucugaagacagcgacaguguacucacauauaauaaaacaaucuuuuuuuuuuuuuaaaguaaaacagaaaauggcaaaaccccuggugcuucuguccuucccaccuguccuguucuggcugcuucagguguggugcuguggaccaacagugaugcuguugccugggaccugagaugcacaacuacaggcaggacauagggaccugaugaaucagaucguccauuuuuacaaggcucuggaagacccaugggcacauagucgaggaaacacaguaucuguuuuaagguaucuguuggcauucucuuauguagcuguaccaaggacgccuugcagcuugguuuugcuaccuguccuuuaaacaagcagaacauacuguacuaggcccgguccuggccagagacacuguuaguaccaguguuaaagucuuuuguacgacuauguaaguuuaagcaacuguucagauaugcuuagaguaagauuauugauucugugguuaucucacuggaauuaaauuuucaaauagcuauauauguagauucuuccuuuaaguaaaguuugaaguaguaaucugaacauaggccauguaugacagaaucaaagcuguggucuaauuuuuucccccuuuccuggggauggaggguuugagaaaggguuucuuuguguagcccuggcuguccuagauugacugugaauucacggaagucaaccagucugccuccugagugcuggcauuaaaugugccauuacugccuggcucauguggcauucaaauagggagaaaauaagauuuuuuaaaagcuuguaagugcauuugucauuacuuaaagcaucugcuucauaacauuuuuuuuucuuaucaaguagaaacauggaaauggguuaacuauagaaagauauguaaaccaaauuuaguugauaaaaugauaaaugugcuuuuaaaaauagugacauacaugaaccucccuucauuauaaacuauaaaaauugccauuucauuuaagaaaaaagcaggucuuguuggcagauuuggagauucucugugcauaugaggacagucugguuacagugaguucccaagacagccaaggcuuagaggaaaagaaaaauuaccuuaaagugcacacauauacacacauauacuggauuagagaaugcauagauaggagaaacguauugacuguuuaaggcuugccucuuggcaauuagggcugaaaccucuuuuaaacaauagagaaagagacacacaguacacaguaacugaggcgugguagaacacaccuguaauccugagucuggauuugaggccagcagggcuguguuacaaaggacaaaaugcaugcaugugugcacauguauaccauucccauuuauugaugaaagcuuugucucuuacagguuacagcacgcugugaggaaaaacuccuaaugacgcaaaagccgcaggcagaaaaccuuauuuugugauuuaugcuuaugagcagucacagcacaugucaagaguaugcuacgggacacauuucuacuguagagagaaucuguuguguacuguauggaagcaucaccugccauaaauaaguagcugauggccugcuagcugaggcaggaaggaaauagguggaaguucugguagggaagaggacucugggauaaucgggugaggggacagaauugccucugaccauggaauagaauaaacguguugguuaaguuacaagcgagucagaacaagcccaagcuuauaauucaaucucagaugucuuuauucuggaaacaaagaggcucagaggaaaauccugcagcugcauuguuacauuuuauaauuauaauuaaguugcuuuuccaccuuuaagaauaucaaacuuaguuguauaguaaauguuuaaaccugauuuguaaaagguucauguuguuguagacauggcuacucuugaacucaguaguggggcccacccugaaucugguuuuuguuuuucaaauacaaacucacaacgacuaguagaaaauuucaauucaaaagguuuuuaauuuccuuaaauauuucuuacacguacuguuccacauuguggaaauaaacuaagcagaacauugaacguuuucgaccaauggcacaaauauauguagacaaaccugaacaggcagcaggcuuaaauuuuaaguuuacaacuagguaggaacauuugagcugcaccagaauuccaaacugcuacagggaugguccuuggaauccagcugaaaagaggccgguucuccauccuuuguggucacugcagcuguacucuguaugcaccuauuagcaacuuaaccuaaagaagagaaugaaugucaguacacaaauuccaccuuguaagaacauccaaguuauugcuauaauauauauuagguaaccauuauuagaauggucuucuaaguaguccagcuuccuuuuuucauauggagggaucuguccuaggugaggguaguggcauuuuaguacugaagucaagauuuggagagcucagcagggaugcccccagacuugccaaauaugcuaugcauagcugccucagagagccgaaguuugcccaacauaagccgucuaguacaaagagcuugucugaaccaugucuccugacguuucuagugagaggauuuauuaguauugcuauuauuaugucagcaguuacuguguaaauaugaagcaaagauuuucaccuuggcaaagggugcuuccgucaaccuuauaaacaacuuauuggggccagcaacaggacugaaugaauaaacaaagugacuguccuagaggggaaagagagaagauaaagucagacucaagucagggcugugacauuuacaauagagaccaggaacuccgaucagcgaacugagggguuuuguuuuugaauuuuaagauaggaucucucugugcagccccccaaaaaccucaccuucaaggcuuaccaugucuaaagaguucuaggcuaccuagggcugaaauaaaaacaacacaugacugcauucaauacaagguguucauuuuauuagccucuggaagaguuccagcagcagaguguguuagaaugagggcguggcaugcuacuauucuauucuagucucacauuguuuucuguaggacauaugguagcacgauuuaagugaauaaacauuaacauguucuaacaau

SEQ ID NO: 7494 - RNA, 22850 nt, Mus musculus
ugguuuuguuuuguuuuuucucuuugaggcaguuaauguauccugggucagcuuugaacugauucugcuacuucugugccuuuaauacuggcacuccauuccugugcuaugaggugugggauuuuguuuucaaaucauaucuaagccuaaaccaagaaagcaguggugacaugcuuacaaucccaaugcuccagaggcagaggaagagagaggcaaaggcagaagaaagaucacagaguuccaggccagacuaugcuagacauugucuuaaaagagagacucauauauauuuuugcucuuuugguuuuucaacucaggguuuuucuguguagcccugacuguccaggaauccacuuuguagaccaaccuggccucgaacucacagauauccaacugccucugccugcaaguguuggaacuaaaagcaugcgccaccaaguccaguuaagagucauauauuuucacauauuauguaacaagaaccucaauccaaccuaaaagcaucaguuguaaucccgcuaacaaacaccagggcgaggugcauuucuuagguuacagggaguccuggaaauccggcaccaagucuucugccaaagacauggguauagacgaggaacaaaagacccucgugccgcccuccagcggcuccgcuccgaaugcguccggugggacucccauuagagggucacugcccacggagccaggaugaagcgaagggcacgcgauggcccgaggcccggcaaacguggaggacaggcgccgggcaggccggagagcgcgugcucggccaggcaccgacggccaaggccagacagcccaggucccaggggcgcgagcccgcuaagggagcccggggcuccaucuugcccggcggcagucuggggucaccacuguccuguggccccgccgcaaucucggcgcgcaaacucuuggcggccgaggacaaggccuaugguagagcgcgaucggacucguuccgggccaaguuucucguccccacggguucgguucugaugggccccaaguucucccaacagaucccacaaaauggaggccgacgucuccucccgccgcagccauggcggaggugggacacccuucccacgggccaggcaagguggaagcgccugcacggccgccagcgcaccaguccccuugcggccgcggccgggcucgcccccucgguccgccgcaggcauugccgggcucgccagucgccggggucuugggggccuggacagggaggacgccgggacaucgaggccgcgucucuccucgagcagagucgcaaagggccguggcgaccgucuggaggccgagacccagugucccgaucccgggcccaccggaagccucgacgaauaucgcccgcccccagggccgaagcgcgagccgaacugcgggcagcgccacucgggcuccugacccgggcagaccccgcgagugggggcggggcgggggcacggagggagggcggaagagagggagggccggcccagcccggggcuggcggcggggggggggggggggggggccggcaggcccgagggcguggcccaggucugacggacagccgccgugacuaccucaccgaggaggguccugaaagaaggccgacugggccaauggagccugcccgaggcauuccgugccgcccacgccaucagccaaugagcgugcggagggcggggccuccccgggccccgccgugccaccgccuccucugccuccuccucaccagcgcuaaagccgggacuggaccgagcggaguugugcgugucgccgaaggggggugggccgggggaggggagguucguuccgcggagcugcagccagaacccggugaggcuucuccccgccgucuuuccugucgagggccgcggagaguggggguggcugggagcagcgcagccucgggaggaggaggcggaggcgggggcgacuggggaggcggagaugggugagggcagcgucgggagccucccaccgagccgggcuuaacagcccgcggcggccggugucgcggcugcugcgucggggccugagggugcgcugggggccgcgcugauguccagggcggcuucgcgugcggccggaggggugagggagcgcgggcgcggcagggcuggcugggugaggcggccgcggggcggggagcgcgagagccuccgggugcgggcggcagcggccggaggucgaagaguguuuuccuuucugugcugcgagcgggcgggcgggucggggaggggcccuuuggcccucccgcccgggggccgcacucccacccugucuguucaaccgacaccccaaguuuuccguguuaaggggcguccucuuacgucccgcggcguuuucucucucucucuuuuuuuuuuuuuuugggucggucugucgcagcuuuuaaucuuauuugagccaguuucuaauggcugaccuggugccugucgcgggcuacugaggaguuaggcccuaaucaagugcuugcggcaaaugggacccaauuguugaaccucucccgggucggauuuguacuugagugguaacuacuuaggagaaaugugaaucccuuucuagauucgaggacgcguuuacucuucgacucagcugcgcgcucuacucauaauucugaaacuggaaagaacauaugagcuuggccugcugucguuuaguugaucuauuguuuauuuggagaagguugguagaacagcuugggaauaacuucaccuugacuuauuuauuuccuuuggcguucaggguuuggugcuaccucggagcuguugauguucacuguauguauguguuuuggguguuuguuuguaaauuucuuuuuauacuaggaucuucaagcuacuuuggugaaggauuugacaggaauaaggaaaacaucuccauugugagucauuuugcguagcuuuccugcuuaaaccacuaggauagacuuuucuauuuugucgaagugaagaguugcugccugagugauuucugcugagaaagccaagccagugugaucuguaguguguuaguggguacuacuaacauggcugucuucucagauuccuaaauaagacuauguucuuagucauaagaugcugugcacuuaacauuuuuguguuccuuucuaggagauuucuuuaauuucuuguauuuuuaaaccacuaagcaguuauuuauuuuugaaaaagcuuguuuguuuguuuguuuaaaauguuuucaccauugcucucuucagacacaccagaagagggcaucagaccccauuauagaugguugggagccacuaugugguugcugggauugaacucaggaccucuagaagaguagucagugcucuuaaccacugagccaucucuucagcccacacuaaacaguuauuuuaaauaaagauuaaauauuuuuaaaaauuacugacauguuuuaagauggaggacaaacgaauuacaaggguuuuuuguuuuucaguuuuaaaaagauuauauguuacauauauagguguuuugcuucauguauaucugugugccacuuggcugcagugcucaagaaguucagaagaagguagaggauccauuagaacuagacagcaaguuaugaacugcacuuaggcguauggggacucaaacccuggucccuuggaagaacagcugaugcucuuaaccacagagccaucucuccagcacugugauuucuuauauaguacuucguagacaugcacuucuuuuuuaauuucuuucuuuuuuuuuuaaagauuuauuuauuuuauauaugugaauacacugucguuaucuucagacacaccagaagagggcaccagaucucauacagaugguugugagccacuguguagucucugggaauuaaacuuuggaccucuggaagagcagccggugcucuaaacuacugagccaucucuccagcccccagacauguauuucuuacuuuuaaaaaauauuuagagagagagagagagagccugccuucuuuccauccuuccugaggaagccagaagaagguguuggguccacuggagcuggagguacauguaguuauguucuaggaucagcuggguucugggauuagaacucugguccucuagaaaagcaguagauauccuuagcugcugagacaucacuccaguccccaucagauguaccguuuuaaaguuagggcagugucagacuguagaauucugucugccuguuaagauuggagguugcacugggugugggugcauuuacagagcaaguuccaggacagccagaguuaaacagcaaaacccugucuuggaagagaaauugaaaaaggcaacugaggggcuggagcauguugguacucuugugagggaccugggcuugagucccagcacuuccaugacagcuugcaauagucucuaacuccaguucaggggaccugaugccucuucugaucuccucaggcuuccuacaugcucaugaugcacauaaauacacucaggaacacccacagaauuaaauaagcaauuugaaaaauagauacacuuuaaaacagugguucucaccagacugugguagcacacaucuuuaaucccagcacuugggagacaguaaauuugaggccagccuggucuacagagcaaguuccaggacagccaggacuacuaugcagagagaccuguauagugggacuaucuuggacccaccaaagauauaaauaacucaaggguuuauuaauauuuuaaagcuccauucuuuugcugagcagucuccugacuacuccuggcauuauuuccuucuguguggccagaucuacaucuuacacucaacuuuggucugucuguuuacuuccuugugcgcuaggugccuggaagauccaccuuccacuuccugcccaacuauugaccaggugaggaagauggaauauuuacagaacaugagacuagugaugggccauagaauuaacaguucccagauccugccagcauuuagcucucugccaguacaaaaugaaugacugaauauacagggacauaccuucacauaguauacccuaacaacacugucccaaaaaaauacaacaacaacaaacaaaacccacagugguuccaaacuuaccuaaugcuuugacccuuuaucacaguuccucguguugugguaacuccuaaccauaaauuauuuuuguugcuacuuaauacuguaauuuugcuauuguuaggaguuguaaauauuuuugaagauagagauuuaccaaagguguuucauccuauagguugagaaccccugcuuuaaaaguucaaagccagagggugcagagagggcucagcuagucucucccuguagcccagaacacccauacacagucaacacaaaaaagagcauggcuauuucucuguauagugcuggcuguccuggaacuuacuuuguagaccagaguggguucaaacucaagagaucgccugcccgugccuuuuaagugcugugugugccagaaaauuucuagauuccaucucaguuaaaucugcugguuucuugugaaucauagucaaguuuucagacccagcuaacugggaucuacagauuuaauuaugccacacaaaugauccuguuagucuucgcuuccuucugaacauaaaccaugcuuuuggccgcugcauuuuucuuccuacucuuguauuuaauagucuguugugaagggaagcuagggcagaagccuaaaggcagaaacugcauuugccugacuucuacaaccuagaauaaauugucccuggugguaccacccccagugggcugggcccuucuaccuuauucaucaaucaaggaauaccccacaggcuugccuacaggcuagucugguauuuucuacauugaggucuuccuucccuggugacuuaagcuugugucaaguuaacaaaaaaggaaacuaaccagugcaaaucucucuaccuuggcuauuaagcuuuuaauuuucaccagcucuuuuugagauacaauuuuuuaauguuuacuaauguuaucuaugagauuuauuauuugaaaaaaaucugcaaauaaaaacaacguaacagggcuggagagaugguucagugguugggagcacugacugcucuucugaagguccugaguucaaaucucagcaaccaagugguggcucacggccaucuguaaugagaucugaugcccucuucuggggugucuaaagacagcuacaguguacuuacauauaauaauggauaaauccuuuuucuuuuccaauuuuuuauuagguauuuucuucauuuacauuucagaugcuaucccgaaaguuccucauacuccccccccccauggauaaaucuuuaaaaaaaugaaaauaaaccacaauauaacaaauagauccaaguucuuuuuuuuauuuuugaagauuuuuuuuuaaagauuuauuuauuuauuauauguaaguacacuguagcugucuucagacacuccagaagagggcgucagaucuuguuacagaugguugugagccaccaugugguugcugggauuugaacucuggaccuucugaagaacagucgggugcucuuacccacugagccaucucaccagcccuugaagauuuuuuuaauuaauuaauuuauuuauuuauuuuuguuuuuucgagacaggguuucucuguuuagucuuggcuguccuggaauucacuuuguagacuaggcuggccucgaacucagaaauccaccugccuccgccucccaagugcugggauuaaaggcgugugccacuaagcccagcuuaaagauuuauuuauuauuauauguaaauacacuguagcugucuuuagacacaccagaagagggcaucguaucucauuaugggugguugugagccaccaugugguuccugggauuugaauuccggaccuuuggaagagcagucagugcucuuacccaccgagccauuucaccagcccuagauccaaguucuaaacaacucauugaaaaugacaauugaacgagaugaggaugugacugcuccaaggagugguugagaagguuuuuauuguagaugugagagagaguacagccagaaguaucuggaagagucuauagagcagggagagaaaguagaccgaacaugggcagcagaauagaaugggccaugggggugaaagguagguagcuagagagggugcagaagagaaaggaccuagaggacacauggccaacauggcagggcugucugggagaauggagaaguuaaggguaaggggcagggugagaagagcagagaggagcuacagguacugagugagccuggaagucagcagacauuuuuguaugcuaguagguaccacagccauuuguccagaguuuuauuuuguaccugacaauaauugagauguaauuuaaauuuuuuuguuuguuugguugguuugguuugguuuugacuuuucaagacaagguuuuucuguauagccuugguugugcuggaauuuguuuuauagaccaaccuggucuugaacucagagacauucaagcuucuauuucuggaggccugggauuaaagguaugugcuacuaccaccaacaggauuuuuuuguuuuauggucuuuugcuuuuuuguuguuuugagacaaggucucuuuaucuagcuagaccuggcuguacuggaacuugcuaagucagugguucccaaccuucugaugcaaugacacuacccauaaaauuauuuuguugcuacuucauaacuauaguuuugcuacucuuauaaaucauaauuuagauaacugauaugcaaguccaaaggugucauggcccucagauugagaacuaccaugcuaaguagacuccaggcuggccuggaacucacucuguagaccaggcuggccucgaacucagaaaucugccugccucugccucccgagugcugggauuaaaggcgugcgccaccacgcccagcuucuuuuucuuuuuuuaacauuuuaaaauuuauuuaauuuuauuuuauguacauuaguguuuugacugcaaagaugucuauaugaggguguuggaucccuggaacaggaauuacagauaguugugagcugccauguggguguugggaauugaacccagguccucuggaagagcagccaaugcucuuaaccacugagccaucuuucuagcccccucaaguuuauuuguuuaacuugugugucugugugauuaugugaguacaagugucuguggaguuuagaagauguuggagucucuggagguggaguuccaggcagcugugauucuucugguaugacugcuaaaaacugaauggaggucuuauaugaaugagacuaauagauacuccuaacugccaagcaaucucuucagcccaaauuuuguuauuuuaaauucaaagaaaacuuaggcuguuuuuguugugaguagaaagcacaaaguaagaagaauugaccuuuuuaaggacuaucaaauugcauauuuucuaucaaacuccacaaaaaagugguuaacaggaaaaacagaaugagaaucacauaaauaguuaauuaucuauuauuauuuauaaauaaauaaaaacauuaaaauuguugugaaauuaaaaauccucuucucucucuuaaagauucaucagugggaagacuaguugacuguacauuggacuuggacauggaagcucaucucgcagauauggaaucaucuggggguccaacuaguucuuuagccgguacaucuagaaacacacauguggaagaugaugauguuguauuuauugaaucaguacagccuccaauuugugcuccagcaauaccuaaugaaagaaacuuuguauuugcuuccucaaaacaugaaaauccaccaggaacugauuccacaauuuccccuucuuggagagauuugacuucucagaagggaaaucuaugugaaacaauuguaauugaugaugaaggggacacagacacaaauggaggggaggagaaaaauccuaccgacuuuauugaauggggaccgaauggaaauaaaaguaguaccaaaaauguggauuuccccauugccagucuaucaagaagcaagguaaauucagcaaggguuacuaauaguaucaucuuuagaagcagguguaagcccuaaaggcugggugagagaggaauuuaaugauuguacaucaccauagaguaccaacuugggagaugucacuaaaggauuuagugcuaauauacaaacauacgccucaucuuuaacuucacagaccaagacugcaguaggaccuuuuaaucccgguaggaucgaugucacggaugcguuucagaauggaagauuugcaguucaucacaauccugguaagcauuacguuguauuugccuuguguucagguaaauuuagcuuucucugugagucuguacucaugcaccuagagaccaaagcuucuuccucucuuggucacuaccuuauuucuuauauuuuugguugugagucuagccuuuaagggcugagccaucucucuagcccacuaccuuauuucuuaaaacuuuguuuuacugacccuggagcucagcaguucagccagauugguuagcugguaaacaccagagaaccuuuuaucugucugucugucuuucuuucuuuaccuuaacaaaaugucuuuuaagggucucacuauguaaucauggcugcucugaaauucacuauauagaucaggcugaccucagacucucagagauccuccugccucucuccugaguuuagggauuaaauuuaugaguuaccauuccuggcuuaaccuaaaaaaaaaauuucagauugcaguguguguguguguguguguguguguguguguguguguuugcuugcuacagcucauguagaagcuaggucagcuugcaaggaucaguucucuacuauauaggaucuaaggauccaacuuagguugucagguugacuucaagugauuuuacuuaguaagguaucucacuggccugcuuuuuguuuuguuucguuucacuuggguacugaagcucagacuuaggucuucaugcuuacacaguugugguacaagccuuguacuagcuaugccaucuccucagcucccauagcuaugcuuuuuagaauucauaucugauauauucuguauaaaauaaguuacuggccuucauauuaagauagaauguauuacuauguauuacuaaauauaacugugaaguuuauuuuguaucuguaauuuggagagggugauuuuuauuuuguuuuuaaagaauuauuuauuuuacagacacacacacacacacacacacacacacacuguaacugucuucagacacaccagaagagggcaucagaucccauuucagauaauugugagccaccaugugguuguugggaauugaacucaggaccuuuggaagagcaaucagugcuccuaaucacugagccaucucuccaacccccagauuuuuguuuuuguuuuuguuuuaaucuaaagcaacucacaucuuagcuguuuuaagggcuggagaaauggcuccuaggccuuuucuaaaacuauacuauucgagguucaaggggcugagaggagacuaauuugggaguuuaauuacuagugguuuuuaggguguugacuuuuaaggacuaaaaaguaaaugaccuaauaacacaaaaugagguuaauggucccugccuguaauccucgcacugaggaaguggcaguaagagggucccaguucauggcgugcugguguuacaugagacuuuaugucagaaaaacugaagcaaagguccagguaugacgucacaggccuucaucccagcacugaggagacagaagcagguggaucucuuuaaccaggucagccagagcuacacaaugggacccuguccccuccaaaagaaaaaccuauacagauuggucuugccauccuuguguuuuauuuuuguuuugcuuuauuaauauuucuagcuaugauaaucauucuaugauacugauucaaggaacuagguaauuucuaguaauuuuaguaacuagguaauuucuguuucuacugagacuauuugggaauaagauaaaaacuaauaaaauauccagcugggaagauaacugacaggugaaaugcuuguuuccuauacaugagggcuagaguucagauuccuuuacccuacauaaaagcugggugggugugccagccuugcuaaauacuagcacguggaagauggcgucauacaaucucuggagcaaacuagauagccagacuaagugaauuaaguuacagggagaaaugaacacaaauuuuguucauuuuguuugauagugguuguaguacuuacuaaacuuuggguaaauuuucuaaccucuaguucuuaauuucucuuagggauguguguguguguguguguguguguguguguguguguguguguguguguuuguagggagagaauuguauuucauuuguguuuuugagauaaggucucacucuguagcucuggcuguccuugaacuuacuauaugggcugccucaaacuggcagauccucaugccucugcuucccaagugcuggggaaggacugcacccucauucauaccuagcaugucuuguguaugggcuaaauaagauaggccucaaaaaccucacugccugcugaucagacuaucaaguucucagcugcuguuccagcaccaugacuuucuacuuccugccauaaaagucauggacuaacuaaccaucugaaacuguaagcaaguuccuaauuaauacuuucuuggucaugauaucucuucacagcaauaggacagugacuaagacugacacuucuggucuuaaaauguauccugaagaugggguauagaaaauuuugucuuaagauuucagucugaguagaaccacuaaaacucucccaguugguaaguuaauuaacuuauuuaaagacaggacaucuauacuccaggcuggccuagaacucagucaucuaagcagcacuugggauuacaagcaugcaguaagggcuggagagauggcuccgcagcuaagagcaccaacugcucuucuggagguccugaguuaaauuccuagcaaacacaugggggcucacaaccaucuguaugagaucuggugcccucuucuggugugucugaagauagcaacaguguauucccauacauaaaauaaacaaaaaauaaauaaguagggucugcagagauggcucggcaguuaagagcacugacugcucuuuugaagguccugaguucaaaucccagcaaccacauggugguuuacaaccauccauaaugagaucugauggccucuucuggugcgucugaagacagcuacaauguacuuagaaauaauaauaaacaaauauuuuaaaaauaaacaaaaacaaacagguuuuuuugguuugguuuggguuuuuuuuuuuuuuuuuuuuuugguuuuucgagacaggguuucucuguauagcccuggcuguccuggaacucacuuuguagaccaggcuggccucaaacucagaaauccaccugccucugccuuccgagugcugggauuaaaggcgugugccaccacgcccagcaacaaauagguuuuuuaaaaaagcaugcaauaauauacccagcugaacguuuuuauuuagguauuuaaguaguugcauuguaaaaauagauacuuagaaaagaaaucccagcacuugggaagcagaggcagguggauuucugaguucgaggccagacuggucuacagagugaguuccaggucaaccagggcuacacagagaaacccuaucucgaaaaaagaaaaaagaaaaggaaaaaaaaaaucugggcaguggugguguaugccuuuaauuucagcacuugggaggcagaggcaggucgauuucugaggcagaggccagccuggucuggucuacagagugaguuccagggcagccagggcuacacagaaacccugucucgaaaaacaacaacaaccaaaaaagaaagaaagaaagaaagagagagagagagagagagagagagaaagaaagaaagaaagaaaugaaaaaaccaaccaaacaacaacgaaaaaauagacacacuuguuuuauauaugugccaaaccuaaagugauuuuuccccccagauaaauuaccauuuuaagagccaggcacauuggugcauaccuuacuuuuaauccucacaugcaggagguauaggcaggcagaucucuuggaguuugagggcagccagggcuauuacacagagaaaccaugucucagaaacaaaacaaaacaaaaauaaccauuuuaagcaauguaauacugguaucuuacuuucuuaauucuauacaaauauauuucccuuaaguagcaggaagucuacaauguaaacaaaacuauuuggagaguugagguuuauuucucucauaguauuaauauugauaaaucugauaaagauuguuauguuuuauuccuacuguagauuuaaucuguuugcuauauagauuuaaauaaucagagaaaguuugaucccagacuauaacuucugccuacucuacaguugaauauguauuuaccuuauuccuugcaacacuggagaauuaaguguaauuucaauuuauacgagaaaaaaacaagcgagccauagggcugagaauuuagcuaaguuguagagcccuuaccuagcauauacaucuccagcaccacagagagaccagaaacucagaacuuucuguacuugcaugacauagucuauucaggagaguuuuauaccugaggaguaugaaaaugacuggugguuugccauauugcauaaucuuagaaaacaucauuuauuuuuuucccugauaaaagaaaauauuccuuagaauucaaaagcuugaggaaccaguuguagcugccugaaaccuuugcuuuuagagauagucuugcuacaguagaccaagcuggcuucaaaguuguagucauucuccuguccuuuuguacaucauacuuugauuauagguugcaccaccgugcaggauagcacucuucuuacaggagagaacuggggcuucaaucaagcuagugcuguaccuuaagcccuucccuaaaucccccucucuaccagguaggcccuguguccaccaacuggaaaccaacuguugaaaaaugaacucgugggaaacuuuuuauacccaguggaauaguaggaagaauacuggauugauugucaaaguuauuuugccuuaaccacgugcuaugagucucuuaaacacuuaaauccaaagguugcuaauauguauuuguauuuguuuccaucucuuuuucuuacucauuuuguuuuuaagauucuuggaucucccagucagcaucauuuccucguaaccagaaacaacaagggguggauucuuuaucaccaguggccucacuuccuaaacagauauuccagcccucgaaccaacaacccacuaaaccaguuaaagucacuugugcaaacugcaaaaaaccucuacagaaggggcagacagcuuaccagcgaaaaggaucagcucaccucuucuguucaaccaccugccuuucuucuuucucccauaagcguacucgaaagacacggaauguaauguguaaaaaguaagcagaccuuaacauuucucaugugguuuagugcucaguacaaaugaauacucuggacauaauuguaagcuagacuugugguacgugugucagauguuuucacuuuuauugagauugggcuauuuuagaacuggaaucucauccucacugaaguuuuaaaagagaauguauguuguacagaaguguaguacccucucucagcugcuacauuugccuuuucuguucuacaucuuacauguuagcucuggcagccuaccaguucagucagugccuuuuccauugggccaucuccucaagcccacuauuaacuuuuuuuaaagauuuauuuuaugggauuggagaguugguacaguguuuuagagugccagcugcucuucuagaggaccuugguuugauucucaguaucuagguuaauuguaguuagcucuagucucugggaauccaacacucucuucuagcccuuaugggcauuguauccuugugguacacagauguacacacagguaaaauaaccauacacauaaaauaaaaauaaaggagaaaauuuuaaguccuguguguuguguuugacaagacucagagacguugcaucacccacuagcuggaguuaaaagguaauacugagcugccugauguaggcuaggcaucaaacucagguucuuuauaaagagccaaacguauaucaguaaaccauccguuuagcaccauugguuuuguuuuuuccuaccaguguuuuucuuaaaguuuuauuuaucugaaugauguuuugccuguguuuauauaaguacacucuguaggccugaugcccucagaggccagaaaucacuggauucccuggagcuggaguuacggacaguuguaagccaccgugggugcuaaggacugagccuggguccucuacaagaacauuaacugcugggccuucucuccaguccugagugcuaaggaacauuaauguuagaagaguuuucauuugaauuuucuucuguaucauuuaggaaggaguggaaguaaaguugaaaauggauuuucaaauacagugaucuucagauauuucuuucuccuuuguguuucagagauucuccugugagaaccacaacuauuguuccuccaguggagucaagcaaguccuuacaaggauuuuauaaugcaucgcuaucucccuaugaaaacugccagagucuuaggaaagaaguuuuuacuaagucaagauguauaaucuguaauaaauuaggagaggucugcucuucauacuguuacuauuuagacucauagaaauguuaauuuuuaagugcuaguguaagcucugccaucuauccaauguccauauccuaaauauucagauuggaaggacuuuaaaaguuuuacuucugcguuuuggugaacaccuuuaauuccaacauuuaggagguagaggcaggcagaucucugugaauuugaggccagccagccagucuauacauagugaguuccaggacagacaauaaauacuauauacuaaagagauuuccccccccccacacacacacacacacacacacacacacacaauucucauagugacuguuucuuuggaauuaguuguagccgggcaugguggcgcaugcuuuuaaucccagcacuugggaggcagaggcaggcagauuucugaguucaaggacagccuggucuacagagugaguuccaggacagccagggcuauacagggaaacucugucucgaaaaaccaaaaaaaaaaaaaaaagaauuuguuguaauaauucaguaguuucaggauaaugacauauccuauaggaguauguggaacaaaugguuugauaaauuuucaagaggaguaaccauacauucaagcaguccuauguuuuauuuaccuugucccugguagcuaaaucggauguuguguagcuuuggaagccauucagaucccaaaggacauaaauuuaccuguuacagcuuucaaaccacauuacugcauauucuaaguguagauaaugauucccuucaucugccucccaaauacuaauaugagaaaagucuaaauacuauagggcaauaaauuguaaaauacugucuuaagaaauuuuguuuucuuuuagguucgccaugaaaucaguguuaacaguauaacacauaagcugugcaguaauaauugcuuuaaugaauacagauugacgaauggucuaauaaugaacugcugugaacaguguagcaaguauaugcccaagaguacugggcacagcauucugauaacaggucagcaaaagagauucugcugccagaauugugcugacgaauauaaagagguaauucuuugucuugcuuuguaauguauuuuauguaauggguguuuuaccugcguguuugucugugcacuacaugcauccuuaaugcucucagaguccacaaaaggauguuggaucccuuggaacuguaguuauagacagaugugagccagcauguaaguaccuagcgaucaagcccagauccucuggaagaacagccagucucucagcacucuuaacugcugacguaauuucuccagccucuaauucugccucugucugucuaucuaaaaucucuaucccugucucucucuguuucuuucuuugugugucugugugagugcaauugguugugugugaggguuggagcacaaccugagauggcugugcuugccuacuaccuuguuugagacaagaucccuggaugcaccgagcuaccugaucuuccagcuccuggugauucucuuguguggcuguuccucaucguguugcaggagcacucagauuuagauggaugccacuguaccaggcuuucacauuuugauaccagggaugaugguguaugccuuuaauccuggcacgaggguggucaaagcagguaaaucucugugagaucaaggcuaccugauucuaccuagaaacuuagaucagccaaggcugcaaagcaagaccugugucauacagaucugacuaaauaucaauuuuuucuuuagcaaucucacacauaaauauaaugcauauguauaauauauuuucuuucuuuuuuuuuuuuuuuuuuuuuuuuccugagacgggguuucucuguguagcccuggcuguccuggaacucacucuguagaccaggcuguccucgaacucagaaauccgccugccucugccucccaagugcugggauuaaaggcaugcaccaccacugcccggucauauauuuucuuuuuauuaugcucauuccuugcccuuauuucuacuuugucaacuuuccucaccccuccauaucccuucucuauguucauguuuguuuuauuacuuacuugucuguuguugugauaaaauauuaugacuaaggcaauuuauagaagaaaggguuuauuugggguucccuauuccagagugugagguggaagcagcuguagcaguaggcaaggaaaugguaggaauauugaaaccucaaagccuuuuuggagaucucauucaaacugccacacugucuuuuguuuuguaaugaacugaguuuaacuagggcugccuuuguaaccauguguuuggccuaggacaccuaaugucauucuaaaacuaaacaugcucaagagugcaugcauucauauacuuaugugcacaugugcaugucccauacauaaacacauauguaaaaauaauagccaggugugguggugcaagccuuuaaucccagcacucgggaggcagaggcagguggauuucugaguuugaggccagucuggucuacagagagaguuccaggacagccagggcuacacagagaaacccugucucgggggguugggguguguguguguggggguguaaauagcugggcauggcaguguccagaggcaagcagaucaggccagccugaucuuacauagugggauucaggacugucgggaguacauagugacacccugccuugaaaaaaguuuuuguuuuuauuuguuuuagaaacuaggcuuuuacuaaaaguuuccaugacuaucuuggaacucacagcuagucuggaacucacaucugccugccucugccucccaagaacuaggauuaaagaugugugcuacaccucucugcuuuggagacauuuucuucacugagauuccuucuucuuagauaacuucagcuuguguuaaacugacaugagucaacauguuacagucccaccaagcccuuagugauguucuaauuuugccugagucacaucauguuuucauuugucacugucucucaguuguagccauccugauuaggagugcuucacugcauguguauacguacaccaagugcaugccgugggaugcuuuaugucuuugcuggcuaauagcgaaccguugccugcucuuaugucuuuauuucaacuuuuaaaaugccaaugaauuauaauguauuuccuuacagauaauggaagcaaaaucaaaacuacugcuuuuacaaaauagaaaaaggaaugcuaucagagaagaaaaugaaaaacgauuacgugaaucaucagguacacuuucaggaaacacaggagacauacccgaaaaaaaggaaaagucuucagagauaauaaaagucgcagcagacuguagccuagauacaucaucagaggaacaaaaugugaauuuaccuuguucuguggcaguaauaucugauacauuuaaagagcaacuaggagacaaaaauucagaggaauuggauauguccauuuuaccuucuuuggauccagguucauggccccgaauuuugaauaugaaacaacgugaauuucuugucaaaaacaauccaccucaaauaagaaauuuuaauuuuccaaaagauagugcaggcaagaaguuuucagaaacguauuauacccgaauucuuccaaauggugaaaagggcaccagacccuggcugcucuacucagccucgaaagacucuguguuuugccuguauugcagacucuuuggggaaggaaaaaaccaacugagaaaugagaaugggugcaaagauuggcaucauuugucacaucuucuuaguaaacaugacgaaagugaaaugcacaucaacaauaguguuaaguauucaaaauuaaagucugacuuggaaaauaaaaccaaugaagcuacagaagguggggaagauugugugcagcuacuguacacauaauguccugucugcucuacuuauggcagugucugcaguacccagacauacacuguguaagaggaccuuacaggagcucauuagcaauaugucuaacagcaaacaaauaguaaaaaaugcuccuguucuaaaccuaaaagcaauuuucgagaguguagucauucuugcagacuuuagcaaaggcaguuugagcuuugucacuguuaggguuuccaccuuguaaaauguuguuggagaacuugcacuuaauggccuaagagcaagagguggcaagaugcauauguaacaagcuaaagaaaaugcauucaggccacaugguggcggugugcaccuuuaaucucagcacucagacacagagaguuggauaucugugagcucuaggccagccuggucugcagagcaaguuccaggagagccaagguauacacaaacccugucuugaaaaaccaaaaagaaggaaaaaaagaagaaagugcauucaaacagcuuaagaagcaacagcuguuuguuauuaaaccaaauugaguuuuauuucuuuaaaacauuuuuugugcaaaacaguuauuuguugugguaaauagaaguaauuuguguuuuauugauuuuauauuucuguuuccaacuuaauguguaaauguuuuaguuuuguuaugagaauuauaaagaauauauaguuauuaguauaaauauaagaauuaaaaugugguauguauauguguguauacauauauauauguauguauauauaguuaacuuuucaguguuguuaauuuuucuugugaaaguauacucuaugugugaaauuugagaaaguaugaaucuaaaaaaaaauuucuucagacuugauuuauuuuuguuuucuuguguaaaagcccuuacuuauaugaaacugagaaugauggcacucaggaggcaggggcagguggaucucugaauucaaagccagccuggugugcagagcaaguuucaggacaacuggggcuacauaucucaaaaaacaaagaaaaaacuugugguagcuacaacuggagcuugggucuucuggaugaagauucucuuguggguuuucacaaguuugucacugaauuccugaaaaggagacuuagugaugacagucucuuuccagaggcuaggggccaaguagcuguagguguuaggguggccucaacacaauugccaaggguggcagggcaaccccugacugaugguaacaguaaucaguacuggcuggccaccagcaauagcuucuugggcacaggagcaggcacaauacaaguguccguggagacagggaagagauguaccaacacagaggcacagucaccuguuaccuugcauagaacuguggcgcuugucagucuuguuucuccaguagccucuccacacugggagaguggaaagcuuggccgagaugaugguggccuuuuggauggcaguggcuaccuccuuagagcaccuaacaccaagaccaaugugaccauuguaguccccaaaagccuuuaccuggaccgaugcucagcccucgucugcucucugcacuggcauggucuuuagagccucauccuuaaguaaaaagucaacuucagacuuccuaaugggcagggagaacaaacaggcaggucucuuccagggacuuggucuucauguccuugaccagguaguccagcuuguuccuguccuaccucuaagagcaccacggccaugaccacuacuacagcucccugggccuccaagcacucgagcuauaccagcuucauuggucauuugacguuuuccuaaagaagaagcaaauuuucugauggccaucuaugguccugaucaugcauuugauaguuuuuuggguuuguuuguuuguuuguuuuuguuucugauuucugauguuaauuuuaucaucuguuaaauucuuagggauacgugagcuuuguuuuccucuuuagggcuuuucuugcaaaacagugucauuaacaauggccuaagaagaugcuuccuucugcauggagaacaauugaggcucagucauguugcucugugacaguauuuucuaaaauacccacuaaaaccauuguagguaaauuauaccuuuccaggcagaggauguaguuugguuaguagaaugcuugccuagcacacaauaaacuggguuugaucugcauuggccauguggcagcaggccuaucaccauagcacucuagugguagacacaaacagcaagugugaagccacccuuggguuuaugaaucccugucuccaaaagaaaguugcuuuuaaucauuugggcuuggaucuaagugagucaugguggcugucaacuguaaucucagcacuagggaagguaacgaggugggggaugggggcggggaggauuguucauaauucacggcuaagccugggauacauaaugaguucuaggccagccugagcuauaaugugcuauucucauaaagagagaaacuggcugauuuuaauguaaauacagcuuugugauggcuucaaaauaucacuacacucagaggucuacaaggcuacuuuagaaaauauaacacuuuaaaguuuuauguguaggaguguuuugccuguauguauguuaaauguaccauguguguaccuggugccugcagaggcuagaagagggagguacaccuggaacugaaguuauagauguuuguuagcuacuguuugagugcuaggaaccaagcccagauucuaagggucuuaaagguucuccuugcugucuugauuugguggugugcugagaacaucgguguggaaauagcaucauucugcuguuggagugauccucuccacuauccacauacuuauuguugaaauucuucucaggacaggguugcucugugacuugaauacaaaaguauauagcuugccgggccuuguggcgcacgccuuuaaucccagcacucaagaggcagaggcagguggauuucugaguucgagcccagccuggucuacagagugaguuccaggacagccagggcuacacagagaaacccugucucgaaaaaagaaaaaguauauagcuugauauacucgguuucugacuggcauucagacaaaggugguagaaaaucugauccaauugugguguucugucuccugggaaucaguauuguguauaccacuuucaacuggaaauaaaaauuggguccaaguccuuuuauugcugauau

SEQ ID NO: 7495 - RNA, 2756 nt, Mus musculus
cacucgcggggucugcccgggucaggagcccgaguggcgcugcccgcaguucggcucgcgcuucggcccugggggcgggcgauauucgucgaggcuuccggugggcccgggaucgggacacugggucucggccuccagacggucgccacggcccuuugcgacucugcucgaggagagacgcggccucgaugucccggcguccucccuguccaggcccccaagaccccggcgacuggcgagcccggcaaugccugcggcggaccgagggggcgagcccggccgcggccgcaaggggacuggugcgcuggcggccgugcaggcgcuuccaccuugccuggcccgugggaagggugucccaccuccgccauggcugcggcgggaggagacgucggccuccauuuugugggaucuguugggagaacuuggggcccaucagaaccgaacccguggggacgagaaacuuggcccggaacgaguccgaucgcgcucuaccauaggccuuguccucggccgccaagaguuugcgcgccgagauugcggcggggccacaggacaguggugaccccagacugccgccgggcaagauggagccccgggcucccuuagcgggcucgcgccccugggaccugggcugucuggccuuggccgucggugccuggccgagcacgcgcucuccggccugcccggcgccuguccuccacguuugccgggccucgggccaucgcgugcccuucgcuucauccuggcuccgugggcagugacccucuaaugggagucccaccggacgcauucggagcggagccgcuggagggcggcacgagggucuuuuguuccucgucuauacccaugucuuuggcagaagacuuggugccggauuuccaggacucccuguaaccuaagaaaugcaccucgcccugguguuuguuagcgggauuacaacugaugcuuuuagguuggauugagguucuuguuacauaauaugugaaaauauaugacucuuaacuggacuugguggcgcaugcuuuuaguuccaacacuugcaggcagaggcaguuggauaucugugaguucgaggccagguuggucuacaaaguggauuccuggacagucagggcuacacagaaaaacccugaguugaaaaaccaaaagagcaaaaauauauaugagucucucuuuuaagacaaugucuagcauagucuggccuggaacucugugaucuuucuucugccuuugccucucucuuccucugccucuggagcauugggauuguaagcaugucaccacugcuuucuugguuuaggcuuagauaugauuugaaaacaaaaucccacaccucauagcacaggaauggagugccaguauuaaaggcacagaaguagcagaaucaguucaaagcugacccaggauacauuaacugccucaaagagaaaaaacaaaacaaaaccacaaaaaccaggcagcugaguggaaggcuauuagauggcucagagguuaugagugcuuccugcucuuaaagacuaccagauuuguaccuucguggagcaguuuccaacugccagcaacugcaguuccaggagauccaagcccuuuuuuggacaagcucuucuggccuaccuacacacauagauguacaaauacauucaugagcacauauacauaucucagaguuacagaaaccggaguuuuuuuuuucaauauuuaaaacgcacauccccuuuuuuucucuucugaaguaugauaaaagcaugcucauuggaugacaaacauauaacccuaagucauguuucuuguccguggguugauuggugggagaguuaaguaagcuuuuauauuacauaaugcuuuacucucuggacguuaccaacaucaccagcauuuuauuuaagucuucaauggcugaaaauaaauguguuaaucauaguaacauuuccacgacugcugaagaugauaaccaucccccuuucucuuaagcauuuggaaauacaaaacuguagguccacuaaguugauucacaaggauucucuagguuuggagagacuaaauguuuuuaggcuugguagcuacaggccauauguuuucugaagccccauuuccacaauucucuaauauuaguacuguucaaaauuaaaacuuaccuguuucccuuaguaaugacaagaaugaacgcugucccuuuagugugcugcuguguugagugugucaguuugaugcugcuaugcaagaguuccacauaccauaaauuagaacuacaguaguuuauguggcuagugcuuuuagaggcuagaauuucaguagggagacacaucugguaagggacucuggaaguauugcaagugcuagaaaacaagggcaggaacagaacacuccaguaacucacacucauaaaggagccacuccugcaauagauacuuaacucucagaauuucaccauauguccaccuaaaaugguagaaugcuuaagacccaggugucucucaaugugucaauucccuuugcaaucucagcagccaauaaguaauauggauuuuggaagggacauucaaaguauagaguuuugaaauucuggaacaaaguuuacucauuaauaauuggugcuuucauaaauuuaaugucagaauuguucgagcugagucugguggcucuccauggccaacacucaguaggcagaggcaggcauauuucugugaguuugaggauaaccuagucuaugcagugagucccaggcauacccgagcuacauagugagacccugucuc

SEQ ID NO: 7496 - RNA, 2368 nt, Mus musculus
acuuuucuuucuuucuuuuuuuuuuuuuaaggacaacauuuuauugcuaccagaggcuuuaucagcaguaccugguucugacugcagugccuucagacugcaaagggagcucaggguucagacauugcucagaaacaagggaauaauuccuuaucaagaaaauccuaauggcauaauaugaaacuaggguucugaauuaaauuauaaguuacagacucaaaucagggcugcuccaguaucuagacaguugcuucuacugauuauaaaugagcaagaacagaucaguuacaaaaaacuacguguauauuacauacauguuucuuuggugagcaccuggauauauuaaccuuaucagaaauucuuuuauauaaaugucaaaaaugcuuaaaauguccuaauuacggccauuuuauugagcuucaagauaaacagaaaaaggacaauaauaauuuuaaacuaaaaacugaaaugagacacaaaaaaagagaacuucuccuacugccacugauucauggggauagcuucaaagugcccuuuucaaacuaacauacuugaacuguggauuaagcauggcugccacacaaaaauaauuuacuuacugaauuacuuuaaaagaaaaggugggugguacucgagugaagucagaauacauagaucaacaagcacacaacuucguuaaguguucaaccgaggcaagaaaaggcaagaggaaaauaaggacacuggaacaagguuccuagcugugaguuugcaacuuuccgcuaaacauuuuuuuuuuugacauggggcaaauuuauuuaacaaugguggagcuuacauaguacaaagaacguuugcuuuacuuuuaaauauauuuuggaucuugagucuacaaauauagccuuuauauuaaauuacguuggauuguaaguaaccgcacgaaagauuaagagugguuuucuuuuuuuccuggcucacuucagucagucugauaaagcacaggccuucuccacagccuucccuggguuucuagucucaccccgaguagucagccuucgugugcacuggaaguugacaccugaaacuauaugacagaaacaggcugcaaagguggacaggggaagcauggcccucuugccuugauaaaucagugccacauacagaacccacauucucaggagcauuguccucauuauagagccacuugaucccaucggagaagucauccaccuccaucuccuccacuuuccguuuggcugcggggagaugcagguggaaggcugcuggaccucggacugguacuucugacuugcuguuguccuuggagaaaucugggccugagacagaggagggauguaauuugagugcuccuuugucacagguuaccagggugugcuugaggggacgguagacaaaaacggaauuuagaggcagggcagacugcagagcagaacggugauaugccaccagcucccgacaguggaucaacugggagcugcccaucugugcucccugacgcaguucaaucuuaagaggaagccaaucaggaaugaguuucuccauuuccagacuaaccauggccagagccagcauggacccuuugaacugcagaaguugguugcaguccauacagugaagcaugcugcuuagucaggacugccaaauguugagaugggcucaauuugggcaaacugaaaaguaacugaggccuaguugacaccgaaauggcaugaaaaaugugaagaaaauccaaugguguggccgugugaagaucccaauucaauuuauccagaauaauucucuccauucucaaaaucucagaugaggaacauccacagaaacugucucuugccaauaccuuuagcacuggaauuuucucaucuuccucaacagucuuagcagccagaaaaaaaaaacagcugauugcaauacaauucaaauauuuuggaugggcuuuuacuguagcuaaaaaccuauccaaaagacugcuugauagagcaaauguuucuggauagagguugaacugguauuugaguuuggccaaccauugaauuacuucaucucucugggauggagaaacauucugauuuguagguauuuucggcacauucaccuuccacaucugggcuucccuggagauugcccuuuccaacagagaagacaaucucugguuuuccaaagguccuggaaacuucaugguaucccuuuggaucugccugccacccagcuugauguagcuaccuucuucuucuccuccucuuccuccuccuccccggcagagcuguaggccucacaguggugucgcggggucauccgggggcccauuaucaucucaugauccucugcgcgcugcggcggggcgcgcgcgaccagggccgggccgaagagg

SEQ ID NO: 7497 - RNA, 1963 nt, Mus musculus
gaggcaagaaaacuugaaccagaggaaacccaaaccugcuacaauuauguaaggguuuccaguggccugcuggcuugacauuugguugcucuugcugugguagcccaguugugugagauggauggagucacagaccucaggcuucaagccaugucaaacgcugggcucagcucccugcuguccacaaagguagcucauuuuagucaggaccucagaccccaaaggcugccgcccuccuugcccugaaggguguauagaugggucagauagcuaaggcagagggguguggccacucacuugucucuccuccacacccuccugcuucuccagucagucugccuuggaggggugcauuucuauaaaaagcugcuuugugugaaauacuucaguggcugccaucaccacagcaggcaaccagcuugccucugccuaauuaaagucugaccacaucucccuacagagcugguuuauauuguuuguuuguuuggauuugcuucguuuugagggaaugggaaugaacgccacaucuaacaaacgauccggucacacacaaccaauaccgcaggcgugcccagauuugggcagcaaaaccaagcaaugaacacuugggaaguagauuaugacaaaacuuaauuguuaauuaagaauuccuuuuuuuuuuuuuuuuuuuuuugguuuuucgagacaggguuucucuguauagcccuggcuguccuggaacucacuuuguagaccaggcuggccuggaacucagaaauccgccugccucugccucucaaguccugggauuaaaggcacgcaccaccaccagcagcaauuaagaauucuuaauggcugucgaaaucagccuccuuuuuuuuuuuuuuuuuuuuuuggucugaggcaguagucaaggcugaccucccacucgauauguaacaaaggcugaugugaaacucuagcagcuccugaccucccacuuccuccccucccccucccccucaggcuuaugcagcauuagggaucuaauucagggccugacaauugagucacaucccuguccaacucucacuagccuccagacccagacauuagaugaggcuaaccgucaacacugcugcuuuugccccuucccuucucaaacagaggaaacugaaugauggaguuaugaguauacuuuuuuuuaacuacaacguuuauaaaaguaaaugucaggcaaauggcagugucuggucggcaguuaaagcuacccggaugguugagagcuuucagggcuguacuugggugaaucugcgcaguggcagucggucagcucacugggcugguucccagagagggcacaaguaccugcuuuucaaguccugccugcuggccacaggacacgcagucccacagacgguugccaugaaaggcaaagaugagguuuugcugaguuuugauuuuuuuuuaauggcucccaccccacccugccucacccagucaccccacacaauuuaaauagcauccugugacucauguaaaauauguggaugaaaacuucaaugugcuuuccaagaaaacccacauaugacuguagugccugaaguauuuuacacacaacgugguucuaggagcggguuugacuguggaggaagccgacugggaaggccagggagacacucuugggcuggaggggagcagaauucagacagcgcaggcagacugugaggcccucucaccuugucaucaccgccucuacuuucuccucagugucuuccccaagagcgcagccuuuacaagcuaucaucaggcugccacuccugaggagauagacaggaaaagggagagaggaagaggaggagaguccugcuccggaggaaguggugucaaaaggaaaagauguucauuuucaacaccaaccucucagccaaaugaaugguacucugcccaaaccaggagcucauuuaccccugaacaucaaauuaaaguguuuuugguugcuugg

SEQ ID NO: 7498 - RNA, 4094 nt, Mus musculus
caugcagggcuggguugccacagaagaacagcagggcugggagcuccucagacuugguacugaaacacugggagugggcucugacaaucuaauaagccuucuggaggauucugacucuggagccacuauggggaggaagaggugagucuauucugguuuggaaacauaaaccccaaacaacaaacucagagcccucaagaggugaacccugcagagacagcuaugcuauauauaccaguaauccuuauacauccaggugaacccugcagagacagcuaugcuauauauaccgguaauccuuauacauccaggguccuuggauucuucuagacaagccuuucaaaagcuagcuugcggcacugcauuuuuuguuuguuuuugagacgggguaccuccacauggccccgacuaucccagaacucacagagacccagcugccucugucuccugagugcuggggcuauagaccugugccaccacgcccggcccugcauuuguuuuuaagguacugcacuugcuaaaggcaggcuuuauguagaucccuguugaaagcuuuuuuccccaucugaucuguggauguguggaggcugaguguugccaugcugaaaaacuguuaggaaucacacacagguuaaccacgaugguguggagaaggggcucuuucccuccaggaucccuuaaaagggaauggaaggguagagugccugaagauggggcacagcaggccugaggguguccugggguggggcagccauagcuuguauauacugauuucaggguggguguuuacagagguguucacaccugacgacaggaugaggugaagacgucaggacugacacgcuugagguguuagaaaauaaggaacaaaaaggccaaagugaggagaaacggcagcacccagggaagggccuaggcaacccuuuaaacuggugccaagcaaaccaagcagcacgaggcccugcuuggaaagugccaccaggguugaguuucuccgcugagcagcuuuuugugagcacaaggcgcacuuguguguuaguauuuguuuuggccuggaaugcacuggaugggagaaagcaaacuugaugaaaguuggcaguggagccguggggagguggggcuggggcagugucccugacagaggcuuccuucucucacucugcuguggaggcuggaugcauucaggagagguguggaagggccaccaggagggggugaggcugagcagccuuccugccuacuacgagagcccuggacagacuuuccagacucccuccugcagugcauccuucacaggccuagggucuguacagcaggcuuucagagggauuucccaagucuauagaugaacagguggaccugaaaaccaaguguggguggugaguguugggaacaggcuagucuuuauucugaaaacucaagcuuuacagacaaguagccucagaguuuaaggaggcugaugcugaaauuuuuuucuuuuauugaaguuuaguuuuguauuuugaaacagggucucacucuauagaccagguagaccugguacucacuauuuagcauaggcuggcuucaaacuugugguggugauccuccugccucagccuuugaaguguggggcuuacacgugggacccaguuuagucccagacuuuuaaugcagcggcuauccuaaagaucagcuauaaaagggccacucauuaugaaagagcgcgggucacaugucucccugauucuguaaucaugcacuaucccuuuggacggggaaccuucuagaguuccuuucuuuuugggaggggagggaugacagggucucagaguguagaccauguuggcccagaacuccagaucuuucugccuugauggcccagggcugaggucaagggugggugacacuuggccugggucaagaguuucuuuuaaugcauguacagauucuugcugcacaauccuuggcuaauucgauuuuuugcaauagguucuuaagucucccacuuacaguucaaaagucugugagcugugaaggccagguuuucagguagccaugugugaacuucuuagguacacaccaugauaggagcuauguucaggcuugauuuuccucaguggggcuauucauaugugacacuggauuaagaacacagugcgugccucacagugagguguuguauguggcuauccaggagauacggcuaauacuccacacuaacuucuggcuucacagcaugcuucgcucagaaccuggacaggggccugugggcuuuacagcggccuccagcuaaugagggaauggugaccuacaucuuucagacucgagaugcagcucagucugacuggagaucacguggauucuacagagcaggagcuggggaggugucugggagccagggucaguaagaagacaaagcuacgggaugcugccaaggaggacaacucuuccuggucauggcaaacugccuuugaugcuccuucaacuaaggcucaacacuguucucacuucucacacugugucacggcucuuguggacuaaggagaaacaggucagaguugguucucaaggaaccaagcugucugguuagaacuaccugccacugauaacuacaacuguuaaacuuaguuagcaaaguagagcucugaauucaugcuagaaucuuugucucaacugcauuucuagccacugaaagaucagaaaacccauguguauucccugcccaugcagccccggcaguggcuuugaaccuguguccuaccaaggugucaacugucuugucuugaguagaugaccacauccuacuccucucccucugucaccgucauacucauggauaagaagagcuacaaggcaacacugcugguuaauuagccagugcaggcgugugcaggacacacaguccugggcgagggaaagagaggauguagggaaaggucaaagguaucaauuuagcacuuugguucuuucugucagcuucuuuagaaccaucacagguccaccaccuccaccaccucacagaagcugagaaaacggaacagaaaggugacuauaaugcuuuacuaaaaaaugaugucacaaggagcccaaagcaagggauuuaaaaaugucaagaauccccaaaaguauguaaaguguuuacggcuggcucacaaacacaagugugcugucaagaucaaggaaggacuugacaacgucuucucauuagacugcacugccacugaggacagacugaagauucaggcugucagcaucccugagaccacacuucucaugcuacauuuuuuacuugagaauuuuaaaauuaaaacacaguaaaaccucauucauaugcucaucuaugccauucaacaaccugcacuugauaaucaaugagcagaagcagguuuguaauuuaagaacuaaaauaugguaacauuuauaaacauauaccccuaucagaacaaucacuugccaaguuagagugagguuuuauuguguauauaaacaaacagacaaagaacauaaaacauauaaaggacacugcuggaugacugcaguguuucugggaaccugagugcucuggcacacagaugacacucaccacugccagcacuccccucucguuugcugcgagaacccccgcugcugucucugcccgauuuuaugcgcuacagcaagaaauaagaagauaaguagaggagaguaagugacauccuuucagaauauacagccaaagacaguaaauucaaagccagcauuaccacaugucucucaggaccacaucaucacgagcugauucaacaugaaaagggacagaauccuuuugaaagugugacuaccuggaacuuacagagcacacaucggcauuccacucaaaaaccaccaccuuugcacagccaaucaauuaagaaguaaaacaccauuuucuugaugagaaggaucaggacucaaacauaauaugaguuugagaaaaguaaguggaagaggaaaaaaaucauguaugugccaaagggcauuuccuccccuauccguacuguguaauaguuugucucagaccauuggaggguuuaaaaagggcaauggcuuuugacauuaaacuucuaaaaagcaucauuaaaaucucacauaua

SEQ ID NO: 7499 - RNA, 5757 nt, Mus musculus
caugagcaugaagucaguggccucaauacccacuugggcaagagcaucaagaaaaaagaagugggacacuaauacaguucagaaguccaaggagcgcuaggaaacaaagcagaaaacaaaacugggccaaagaucaaacuuaacacucaguaaagugaacaaacacacaaaugcccuguaagaucugagugggacaauuaaguggcauucucauuaucuaaaauacaguggggucuuuuucccucaucuugccacuaaucaacauucuggugaucauuuaagcauuauuuggucccaucuaaaauaaaucuuccuuccaucaacagggguguaacagaauuggaguauaucauccuaggaucuugucaaauguaauaaauauaguucugucugaauacaaguuauuauacacagauagaugccuugccacuuaccaaagcauccuucccuacacaucucugcuuugucuuggccagugaccuaucuauuuaguuggaucucaaagccuucugucaaaaggcccacacccuucauacacacacagguacacagaaaccacaccugcugaggaaacacagacaucaagaacaauacaaaauaugagugauugcugcugcagaucaauuaaagagaaaaaaaacaccuaaaaacaaccuuucuaaguauuuaaaauacaaagcauguagaauuauauuucuucuuugcaguagagauauuuuuuuccauacauacuguuacuaaauggugaucaacuuagaagaaaggauucucaaaaauguauggcccuaagcuucgcauccucgcacaccuagcaucacagguauaggauguaauuuagaugcucugcuucuacaguuacacaaaauucccagagcaucagcuauuaagaugcacgugcugugcaguucagguaggaggacaguacuugacagaugguuuagcagggagucgucaagaacagcagaggagccugcccuugcauggcagucucagaugcaccuaggucagaggccucgagcugccacugcacugugugacugugucagaggccugcuguuuauaaaugagcuuucauuuucauaauuaaagcugacacaaaaauuaagaggagcacgggagcauauaaaaauccugauuagaaaagccagaggaucuaaagagaauuuuucuuuuucuuuuuuuaaagauagaucauacauuguaacccagacuagccugaccuucauacucagcuuccuaaaugccaggaauacaggcaugcaccaccaugccuagcuaaaguuaaauguuuaagucuuugagauugaguuaguguggcuccugugacacgaggauagcgcccacuucagcauaauuauugccccugaugccccaaugugcaauagucugugugaauuagucauucacacccauuaaaaaguuauugcuuaagcaagccauucagaguagauacaggcuguguggcuggacagaaacacacugagaaagacaaccacgcugggaugcucuuccacucacugauaaacauaaauacauaaucaaaggggcaagaggaucauagcagcuaauacccaaagccaacucuuaagugucaagacuuaauuucucucuaaaacaaaucugguuugucuuuuccucuuaaaauuaaggcaaugaaauggcuacaguuccuaaagucaucuuuacggaacgaaaauauacacguauuuuccucaaguucaggcaucacagucugauuagaaaccugaaauaauuacacaaaaccugcaacagugaggcugaaagggaaggaaagggaggaaguggggagagggaggacuaugaaaccaacaaacacuuguaaggaucuucuuccugcguaauuauaaucaccgaaggggggaaauguuggaaagcacaaaaccuguuacaugguuucagcaucucuuguauugaauuaaaacuuuuaggguaaugaaaggaaggagcuuauuaaaaugguuacucuagaguccaacaaccaaauaugcuaaugaugcacaguagggcccaagaaucccuccuacaaucagcuccucagaugacgagggauccauggacauuuugaaaacuaaugccgagaacauaccaacuuuggauagccaccuaugcuuugacaaaaggggaaaaggcacugaauaugaauuucauggugcccauaucuguuugcacauauauggaauugcauuuugaaaaauauaaaucaccauucagaaucuagaagacaaguauacggcagaugauggcuaacaccuaaugacgaagcugauuucaaguugaccucuccuguuucacggaacuccacaucaaagucucaggcuuuccaaauccaaaauggucaaacgaacugaggaacaggacaagacucaagucaacuuucagcaauucagugcacuuugcagaaaggaucuaaguuaagcuuauagcucuguuuguuuauuuuacacaaaggagaccaccaacauuugccauaaauucuucuaaacucuuuaggaaggccaucuucugcuuccgguccagggcaggaggagugcugcucgcugugagcuuguugaaggcaucugcuaaucucugguaaaugacugggucuuguugacuugacaguaaugucucaaccaguucagaauauucagccugcagaagaaacaaggcagccauaacaauguuuucuuuggcggauccuagcaggaaugugggguuggugcugaggcagggcagacaaaaacucuuuccaacaguucaguguuuaggucuuguucucaccuuaucuaugcgcuaauuaauuuaauauguaugcuacuaugagauugacacuauuaauauucccauuuuacagauaaagacucuaccagauugaguaauauacugaaaaaucacaugaguacagacauucuggcuccagacccacauggucccagcuuugcggccuugcgucauauacauuuguucauaacuccugugcuuggaauguuaaggugaacaguucucuaguggcaaauacacuguucucccaguucugagggcagcagaagcguggagaaggguugagagcucucucaaaguagaggcagaacacuuugaaaaucccaagccagcaauguagcaguggcuuuggauaaugcagugguggcaucuucuauuuuuauuaaccacucucauaacacuaguaaacaggugagugugcagaggcuuaagggaaagugaccuagaacagagaagcacuauggaaaaagcuagucugccauuaaauuuucaugagcuucucagaacaucacaacauccaaaugagaaaaucagauauaauauagagcaaagagagguaggguauaguuucccaauccccaucccacugucuacaacacagagccagaggggcugccugaaccacccugugcaaaggacaggccugcucggaaggccagcauaagcuuagauaaccuucugacuguuacgaaacaguacugcuucugggccaggcagcaggaaucacacuagcuguucuaaagugcccacucucuuuuuucugucuuucaaaaaaacaaaacaaaacaaacaaacagcugggugguggcgcacgccuuuaaucccagcacuugggaggcagaggcaggcagauuucugaguucgaggccagccuggucuacaaagugaguuccaggacagccagagcuacacagagaaacccugucucaaaaaaccaaaaccaaacaaacaaacaaccccccccaaacaaacaaaccaaaccaaaacccucaaaccauuuuugacauuuacuuauggguauguguuauagguguuuggaguugguccuugugugugugugugugugcaaaaaaaaccuugcauaguuggcaccuucccuccaccauggacacaggacuaaggauugaacucaagucaucaggcuuggugacaguaccuaaagcauccuuugagccacccucucaggcccauggugccuuaguaaccaaauggacagaaaaggaaaaggaacacacagcugaaaggaggaauacucauaaguaguugccgcaagagcacagcacgcacuuccggccugggggaccuguuacauuagucccauagcaaugauguuuuaggaucuuuaagguucaacaacaacaacaacaacaacaacaacaaaauaauaacacugucuaggagaagggggcuuugugaguuaggaucugaaaacccuacuuugaggagagcaaagcuucuccaaccuaucacuugggcauacuaagguaugaggggaaaauuaagccacacacuuccccaauuuguucuuuuauauacuugauaggcaguuuuucagaauuaggaggcuagugugcuucuguuacauuaaucccauagcaaugauguuuuaggaucuuuaagguucaacaacaacaaaaccacauuguuuccaaaucacuaaauaaaauaauacucugaucuuuacauucuaugaaggcaaaucugcucccaaucugauucaccugccacucuaugaaaucugaauuccucaaagauaccacucacucucucguguacacacacggggcuccuagcauaagugauuaaagccaagcuuuugagugagaacggcaucagagaauggcuccuaacagagacgggaucuuuugaucugacaaacagauugccuauaaauauaaaacauaagccuagagcacaugaggaagcuaagaaacgucccuggggucaugggcuuaggugucccugaauccacaagugcuggugugcaaagggggugcaauaccuggugcaaacacaccaauguguagaaugcuucgccugcugcaguggucaucuccguguugugcuuuugcaagaccagcauaucaaaaaccagcugaaaguacauaaugagauacauccauaaaauacagaauaauaauuuauuuuuaaagacauuuuauuuauaugaguacacuguagcugucuucagacgcaccagaagagggcaucagaccucauuacagaugguugugagucaccaugugauugcugggaauugaacucaggaccucuggaagagcagucaaugcucuuaaccacugagcuaucucuucagccccagaguaauuauuuaaaucucuagucccuuucuggucugaaacaaggaucgggguuauagucgauuucuuacauuaacacaucaauuauuaaaucauuuuuuuaauccaugaaaaacacacagauguuauuuucuguguaaucuaaauuaaaaauaucaaauuccucguaauauuuauagcaucauucaaggauacaaaaugggcuaggcaguaguggggcacaacuuuaauccuagcacucaggaggcaaguggaagucuaugaguucaaggccagacuggucuauagaguucuaggauagucagggcuacagagaaacccugccuuaaaacaaaacaaaacaaacaaacaaaaagccaaaacagaaguggaagagaacaggggauuggucugcacacaccuuuaaucucagcacuuaggaggcagagggaagcaaaucugaguuaagaggccagcaugguccacaaagcaagucccauaacaggcaaagaugcaccgagaaacccugccucaaaaagccacacacaacuacaaaaaacagugaauaaaguauuuucucuucucuaacagaaugcaaguacauuuucauuugacucaagaguuucauggguuuggcaagauagcucaggggcuaaaagcacuggcugcccuucca

SEQ ID NO: 7500 - RNA, 5757 nt, Mus musculus
uggaagggcagccagugcuuuuagccccugagcuaucuugccaaacccaugaaacucuugagucaaaugaaaauguacuugcauucuguuagagaagagaaaauacuuuauucacuguuuuuuguaguuguguguggcuuuuugaggcaggguuucucggugcaucuuugccuguuaugggacuugcuuuguggaccaugcuggccucuuaacucagauuugcuucccucugccuccuaagugcugagauuaaaggugugugcagaccaauccccuguucucuuccacuucuguuuuggcuuuuuguuuguuuguuuuguuuuguuuuaaggcaggguuucucuguagcccugacuauccuagaacucuauagaccagucuggccuugaacucauagacuuccacuugccuccugagugcuaggauuaaaguugugccccacuacugccuagcccauuuuguauccuugaaugaugcuauaaauauuacgaggaauuugauauuuuuaauuuagauuacacagaaaauaacaucuguguguuuuucauggauuaaaaaaaugauuuaauaauugauguguuaauguaagaaaucgacuauaaccccgauccuuguuucagaccagaaagggacuagagauuuaaauaauuacucuggggcugaagagauagcucagugguuaagagcauugacugcucuuccagagguccugaguucaauucccagcaaucacauggugacucacaaccaucuguaaugaggucugaugcccucuucuggugcgucugaagacagcuacaguguacucauauaaauaaaaugucuuuaaaaauaaauuauuauucuguauuuuauggauguaucucauuauguacuuucagcugguuuuugauaugcuggucuugcaaaagcacaacacggagaugaccacugcagcaggcgaagcauucuacacauugguguguuugcaccagguauugcacccccuuugcacaccagcacuuguggauucagggacaccuaagcccaugaccccagggacguuucuuagcuuccucaugugcucuaggcuuauguuuuauauuuauaggcaaucuguuugucagaucaaaagaucccgucucuguuaggagccauucucugaugccguucucacucaaaagcuuggcuuuaaucacuuaugcuaggagccccguguguguacacgagagagugagugguaucuuugaggaauucagauuucauagaguggcaggugaaucagauugggagcagauuugccuucauagaauguaaagaucagaguauuauuuuauuuagugauuuggaaacaaugugguuuuguuguuguugaaccuuaaagauccuaaaacaucauugcuaugggauuaauguaacagaagcacacuagccuccuaauucugaaaaacugccuaucaaguauauaaaagaacaaauuggggaaguguguggcuuaauuuuccccucauaccuuaguaugcccaagugauagguuggagaagcuuugcucuccucaaaguaggguuuucagauccuaacucacaaagcccccuucuccuagacaguguuauuauuuuguuguuguuguuguuguuguuguuguugaaccuuaaagauccuaaaacaucauugcuaugggacuaauguaacaggucccccaggccggaagugcgugcugugcucuugcggcaacuacuuaugaguauuccuccuuucagcuguguguuccuuuuccuuuucuguccauuugguuacuaaggcaccaugggccugagaggguggcucaaaggaugcuuuagguacugucaccaagccugaugacuugaguucaauccuuaguccuguguccaugguggagggaaggugccaacuaugcaagguuuuuuuugcacacacacacacacacaaggaccaacuccaaacaccuauaacacauacccauaaguaaaugucaaaaaugguuugaggguuuugguuugguuuguuuguuugggggggguuguuuguuuguuugguuuugguuuuuugagacaggguuucucuguguagcucuggcuguccuggaacucacuuuguagaccaggcuggccucgaacucagaaaucugccugccucugccucccaagugcugggauuaaaggcgugcgccaccacccagcuguuuguuuguuuuguuuuguuuuuuugaaagacagaaaaaagagagugggcacuuuagaacagcuagugugauuccugcugccuggcccagaagcaguacuguuucguaacagucagaagguuaucuaagcuuaugcuggccuuccgagcaggccuguccuuugcacagggugguucaggcagccccucuggcucuguguuguagacagugggauggggauugggaaacuauacccuaccucucuuugcucuauauuauaucugauuuucucauuuggauguugugauguucugagaagcucaugaaaauuuaauggcagacuagcuuuuuccauagugcuucucuguucuaggucacuuucccuuaagccucugcacacucaccuguuuacuaguguuaugagagugguuaauaaaaauagaagaugccaccacugcauuauccaaagccacugcuacauugcuggcuugggauuuucaaaguguucugccucuacuuugagagagcucucaacccuucuccacgcuucugcugcccucagaacugggagaacaguguauuugccacuagagaacuguucaccuuaacauuccaagcacaggaguuaugaacaaauguauaugacgcaaggccgcaaagcugggaccaugugggucuggagccagaaugucuguacucaugugauuuuucaguauauuacucaaucugguagagucuuuaucuguaaaaugggaauauuaauagugucaaucucauaguagcauacauauuaaauuaauuagcgcauagauaaggugagaacaagaccuaaacacugaacuguuggaaagaguuuuugucugcccugccucagcaccaaccccacauuccugcuaggauccgccaaagaaaacauuguuauggcugccuuguuucuucugcaggcugaauauucugaacugguugagacauuacugucaagucaacaagacccagucauuuaccagagauuagcagaugccuucaacaagcucacagcgagcagcacuccuccugcccuggaccggaagcagaagauggccuuccuaaagaguuuagaagaauuuauggcaaauguugguggucuccuuuguguaaaauaaacaaacagagcuauaagcuuaacuuagauccuuucugcaaagugcacugaauugcugaaaguugacuugagucuuguccuguuccucaguucguuugaccauuuuggauuuggaaagccugagacuuugauguggaguuccgugaaacaggagaggucaacuugaaaucagcuucgucauuagguguuagccaucaucugccguauacuugucuucuagauucugaauggugauuuauauuuuucaaaaugcaauuccauauaugugcaaacagauaugggcaccaugaaauucauauucagugccuuuuccccuuuugucaaagcauagguggcuauccaaaguugguauguucucggcauuaguuuucaaaauguccauggaucccucgucaucugaggagcugauuguaggagggauucuugggcccuacugugcaucauuagcauauuugguuguuggacucuagaguaaccauuuuaauaagcuccuuccuuucauuacccuaaaaguuuuaauucaauacaagagaugcugaaaccauguaacagguuuugugcuuuccaacauuuccccccuucggugauuauaauuacgcaggaagaagauccuuacaaguguuuguugguuucauaguccucccucuccccacuuccucccuuuccuucccuuucagccucacuguugcagguuuuguguaauuauuucagguuucuaaucagacugugaugccugaacuugaggaaaauacguguauauuuucguuccguaaagaugacuuuaggaacuguagccauuucauugccuuaauuuuaagaggaaaagacaaaccagauuuguuuuagagagaaauuaagucuugacacuuaagaguuggcuuuggguauuagcugcuaugauccucuugccccuuugauuauguauuuauguuuaucagugaguggaagagcaucccagcgugguugucuuucucaguguguuucuguccagccacacagccuguaucuacucugaauggcuugcuuaagcaauaacuuuuuaaugggugugaaugacuaauucacacagacuauugcacauuggggcaucaggggcaauaauuaugcugaagugggcgcuauccucgugucacaggagccacacuaacucaaucucaaagacuuaaacauuuaacuuuagcuaggcaugguggugcaugccuguauuccuggcauuuaggaagcugaguaugaaggucaggcuagucuggguuacaauguaugaucuaucuuuaaaaaaagaaaaagaaaaauucucuuuagauccucuggcuuuucuaaucaggauuuuuauaugcucccgugcuccucuuaauuuuugugucagcuuuaauuaugaaaaugaaagcucauuuauaaacagcaggccucugacacagucacacagugcaguggcagcucgaggccucugaccuaggugcaucugagacugccaugcaagggcaggcuccucugcuguucuugacgacucccugcuaaaccaucugucaaguacuguccuccuaccugaacugcacagcacgugcaucuuaauagcugaugcucugggaauuuuguguaacuguagaagcagagcaucuaaauuacauccuauaccugugaugcuaggugugcgaggaugcgaagcuuagggccauacauuuuugagaauccuuucuucuaaguugaucaccauuuaguaacaguauguauggaaaaaaauaucucuacugcaaagaagaaauauaauucuacaugcuuuguauuuuaaauacuuagaaagguuguuuuuagguguuuuuuuucucuuuaauugaucugcagcagcaaucacucauauuuuguauuguucuugaugucuguguuuccucagcaggugugguuucuguguaccuguguguguaugaagggugugggccuuuugacagaaggcuuugagauccaacuaaauagauaggucacuggccaagacaaagcagagauguguagggaaggaugcuuugguaaguggcaaggcaucuaucuguguauaauaacuuguauucagacagaacuauauuuauuacauuugacaagauccuaggaugauauacuccaauucuguuacaccccuguugauggaaggaagauuuauuuuagaugggaccaaauaaugcuuaaaugaucaccagaauguugauuaguggcaagaugagggaaaaagaccccacuguauuuuagauaaugagaaugccacuuaauugucccacucagaucuuacagggcauuuguguguuuguucacuuuacugaguguuaaguuugaucuuuggcccaguuuuguuuucugcuuuguuuccuagcgcuccuuggacuucugaacuguauuagugucccacuucuuuuuucuugaugcucuugcccaaguggguauugaggccacugacuucaugcucaug

SEQ ID NO: 7501 - RNA, 3079 nt, Mus musculus
ucucuggaucauacuuuauucuucuuucacuguuuaauuuugcuaccauaaacaguacagcaagaaacaaauucacuaguaucuucuguguuacugcugagcauaaagugguacaguauuaauggacaccauuuugacaguggcaguguacaaaggauucauuaccacuuuuaagacuguuccacacacuguagucauuaagaaugcauguauacugacaugcuugacagcaagguuuauuggagaaaaaaaaauaaauguccauuaccaauagauguuaacaggcauaucuauauuauugugcauguaauagaaauaugggaucuguauagauucacaaaaaggcccaugauacacuaaugcagucaacaagcaaguuugcuaggcaugguggugcauacuuacaaucccagcaauugaggggaagaggcaggaggaucacugacuucaaggccagccugggcuacacauuuaaaaaaaggaaguucaaaucguugaaaaauguaaccaccagaauggauggcaaaggaaauaaauuacauuaugcauuuuuaaaaagccaauauaaauuauuuuacuuacagauccuucuucccaaaaacagagaugaacaauaguggggaagucagguuucuacaaagagaaugaaggaugcuauagcaauggaaccaugguuauaugacaacuaaguagacuuguacacauaaacaugggugcauaugcaaagcucuacagaguauagcaauuucuagguuuugauaugguuagaggaaaaauguuacuugguuauaguuacaauggacuuguacuuuuuucucuugguaacuuuaugaaaucaccaacucaaaagauuaaaaaggauuggguaugguaguauauagcacuagggagacagagaucggugcccaucuaaauuugaggccaagacuauacaguaagaucuguauuaaaaaaauaauacuauacagagaaacccugucuugaaaaaucaaaaaaaauauauuaauaauaaaaaaaucccaaguugcucugcaucuguagacccagaaacucgggagacucggucaggaggaucaauucaguccauaaguucaacaaccuacacagaccuacucaaaaaaguugugugcacaggugguggugguacacaccuuuauuccagcacuuaagaggcaagaggaaggcaguucucuaugaguuugaggccagccuggucuacagagugagucugacaacaucuagggccacacagagaaaaccugucuugaaaaacaaaccaacaacauuaaaaaaaaaaacaaaaaaccaaaaacgguguuuuuaaacaaacuuuaaaaaaaaauugcacuguuuguauccauuuaggaguuccaggcuaaggugggcaauauagacgagcucaaaaaaccaaacaaacagaaauuuuccuguuaacaguucuaguaaacaucuuuacuucacacguccacucacagaauccaaauucuaaaagaaaacacucuucuuuugggaaauggucucaucuaucucaggcuggccucaaauuugcauggaaguugaccuaacacuucagauccuacuuccacuuacagaaugcugugaaaucaaaggcaggcucuauucuagagcagugguucucaaccucccuuacacucuuuaauacaguuccucauguuguggugacuccaaccauaacauuauuuucauuguuacuucacaacuguaauuuugcuguuaucauaauacaaaucucugauacucagccucaugaaaggguucugcaaccaccacaaggggucaugcccaacagguugagaauggcuauccuagacagaaaguaagaaaacaccccuuguacaacaaagcucuagccaaguaccucagccuuaagacucaucaguuuguaguuuuacagcauuuaaaucuaaaaggugcaagguaugguggcacuugccuuuagucacagcacuugggaggcagaggccaguagaucucggaggucaaggccagccuagccuauacagcaaguucuauggcuauauagugagacaaacaaaaaaaaaaaaaaccccacauuuuacagaagggcagggaaccaugccuguaauuccaguagcuaggcacagggagggcugcugcaagcuuuaggccagaaaaaauaaaaaacaacccugaaaauagaccgauuaugcacauauggagccucaaacagucucuuuuggccuucugagucuaggucuuacuaacuacaucagcaaagauuuuccugccuccaccucuuaauguugggauuacaggugugaaacaaacgccuagguagggucccaaguauuccguaugagacaacuauuaaucaaucauguuugcuuuaauaagauacuggucgaaggggucacacugguacauaaauuacauuuucucagcuccaggaccaaguaaggauagagcaguccgguauccauaaucuugaaggguuaggaccauuucuucgagauguugagauggucuagcuggucugcaauguaucuaugcuuagggaacuuggaaguggccgcugccuugauggcuucaaaagccugggcccgucgcuccgcggcguggccgcacuccugcucugcugucauguagggcaugcugagccaguagugguucucggccuccaccuccaggcgacggaucaugcucuccuucgcuuggaaagacacgguacgcggccgccggugcuucccgauccacugccugcccggaaugcggccgcggaggaggacagcggugaggaacauggugccuccugaggaaaugacacgaaagccgcggucgcugagccccggacccgggaagcgagcaaccggcgugccaagcuugcgcccacaucccgcggccgaauccagagcacgcucggccucucgccggaagugaguggccgggagccgacuacacugcaggauaugggggugggggcuccccgaaaacccaccucgcguaccaaccggcccgggacacgcuccccucggcgcuccgcgucccccgaccgaugcggcggcgcgcugcuuccggucucucuggggcccugaugcua

SEQ ID NO: 7502 - RNA, 1017 nt, Mus musculus
cacccggaagcuuggagcgugggcggcgcgcaggcccgaacucgggaccccucgagcagcgagccgugggcagaaacccacggacaggggcccccaccgccggagaagcgcgggccggaacccucggacguggaacccacgggcuggggaagcgcaggccgccccgcggaaucagaacgcggcgccgaggccucggccugccacccgcggcccggcccgccgcccgcgccucccguacucacucacgcacagcuccaccacguacgcguaguaggaccagacgaccacaaaggugaugaagagcaccggaacccagcccaccacgcguuggcagcagcgccagaguguccagggcgccauguuccucugcugacugccgggucccgcugcccacgauucuguaggaccacaagaccccagcggcccugucgccagcuuccccgcccccgaggcuccgccgccgcaagcaguggcgaagggcgacgccacaacuccgccccucccugcgccuggcccggguccgccccugaccccgcccucgggcccgccuccgggcccgccucucaucccgcugcgagcugugaagggcgacgcugcaacuccgccccucccggcgccuggaccggguccgccccugccccgcauccugccgcuccgccccuagucccgcgccuggcaauccccguaggggguggggcuacccggccgaaggaggcggggccugaaguuggggcggggcuucugcucaggcccgcccaugggauuugggggugccuugguggaaaagagaggagagugcuaaggauguguaggaggccaucuaggacugggugacgagagggauggggaugcgcaaggggagaggaaugaauucuuagcugcccugugugccuuggguggcacucuguauaacacucuuccccuaggucuuucaggacccauacaagucggguucccuauuacauaaggcugugcaucacucaagcgugcaagcaagaaaaauauuauauauacuua

SEQ ID NO: 7503 - RNA, 1309 nt, Mus musculus
guuuuuuuuuuuuauguguguguguuuucuucucguuguuccuuuuuaaagcaauugaucuauuccuugguucuggggggaaaauguggcugugggguuaccuacauugacccuacaacauggagacaucaugcaaaaaucaucuggcccauaugucucuacucaaaaucaacaagcccccugucccacgacuguauucaauuaaaaggacauuuaugcucauuggaacaacaauuggaacccauuguaccuuggcuacagauuauauagauucaaagaauccaggguccaacuguaucccuggaaauacaaccaacacaguaccaaucaccuaucugaccgagcaccugagugaggaugcugaaggaggccucaagacgcuggcaugaguccuuccggcaccugcugagcucugcaccucagagccaaucauguagguucuguauuguuuuuauuugguacuugaacgagauggcagccauggaaagacuggauauuauaagugcacagccccacagccugacgccccagcacacugggcucuguguaugaggcugaagcaggcugagaaauugggucagugaacauucaccacaugccaacugcacacacuguguguggcugagccucugggaaacagaauacuuauagagagacucuggcuucaaaaucuuuaucuaguaaaagaccaauaagaaugaaaugugaggccagauauaaaccagaauugccaccauuucucagucuggugcuguccccuggcucacagcugcacacgacacacuccagguuaauuuagugagugcuaccuuuuucuaaacagcaggaucagaugcuaccagccuucuugaagcagacucauuuuuuucaaagcauucuuuuuaauaguugcuuguuauaaucaguuauucuugauguuuuaaagcgccuugauaauaaucggauaacuuagauuaaaccucuaacaguaacaaucugcgccauagcucuagucucuuugaaaugaauaaaggugacaaaugcaaacuagcacuugucgagucauguggagucaugugagacacaugcgugcacaugcauguaaucuaauguucucucuaaauuucaaccagacaagauuuucggaucuuuagaaagcuuaaguguuauacgcccuaaccugucuuuccacgcuuuguugagacuucuagcuaucccucaaaauccacuuuaaaugcuacaauacacauuucccaaguacuucuuuaaacacuccucuguggcuccaagacauuuaagcauucuucaguuacagcaaaucuuacaucac

SEQ ID NO: 7504 - RNA, 3554 nt, Mus musculus
uguauaagaaggcaagcugaggagcuggagccuuggcucagcaguuaagagcacuggaugcucuaccggaggacccagguuugauucccagcauccgcaacucacagcagucuguaacuccaguucugaugagguccucugguaucugcaggcacugcaugcacacagggaacagauguaucuguagcccaaacacccauuagcacacauaguaaaaagcaagcagcgagcaaugaacaagcgagcaagcaaggaaucugagcaggucacagagaacaagccagcaaucagcuuuuccccauagguccugccucugcuucuguccugccccgacugcucuccgugauggacuguaauuaggauguaaaaaucaaauaaacccuuuauccccaaguuaccucuguucaggguuuuaucagagcaacugagaaacaaauuaggauagugguauuuauuugcuuaauauuguuuuauuuuuuuaaaaaaaguguauaugugggcaucucucugugugugugugugugugugugcguauguguguguguucaugagacaccgugagaggugcacaauuuucaggaguagguucucucuccacccagugugugagauugaacucgagucaucaggcuugucagcacucaccuuugccugugaaaccaucucacuggccuuauccuuccugcgugaguacaagaugucagguaugugguaaccaauacuuuacagaccguugucacagauggucaaaaaugaagguggcucuguaaaugucuuccaagcagcaugggaccaguagcuaugugugguugacugauggugagccagaacacagcugggcuguacuguaacauacacauugaauuucuaggacaguagacaaaggaaauuuguggggugugguagcccgcaucuuuaaucuccgcauucaggaagcaguauggaugaaucucucugaguuccauccaguucaguuuacauagacaagucagagcuacauacugagaguauauauauauauauaauuucaucauuuauucauggccuugaacucacacaaacucaccugccucuguuucuugagugcugggauucaaagacaacaccaacaugcagagcuuguaauuuuacuuuuauuuaguauaccuacaagaaauuuuuguaaauuaauuacuauacaaaguauuagauauaauuaaaaaaacaaauguuagaacaauuuaaaauguuuucagcucguguuguauuucugcugaacaacacgguuacagaccaggcucaagcuuuaucuugcucuuugacaauucugugcaugucacauuauucauguuacuccuauugucccuccucuuuucccuagauacucuccaacuuuccacuuuccaccucaugcccucugcuuccgaguccaguuagugcugccugcugaaaucugucuggucuuguuggcuugcuaucaugcaggccuucugcagguaaccguagcugcaauggauucaugaguucaaacaucauugcuccauuccuaucggaaccauguacacucuaauguacaaugguccagguaggaagcagaggccauggagggugaguuccagacccuugccuaggguucucagcuucuucccagcaaggacaucagagcucauguuuuuagauucuuccagaguuccuuccagggcuuuuaucuucuuaccuuguaugaaacccccuuugggcacaaucuagauuaauuuugaaaaugaacuaggucauaguacugagaaauucuauucuauuucuuugaacccagucucuggugaaaucaaacugcuucagucuuggacuauugucugauaucaucagccaugguuuguagagacuguugaauaugauaagcuauggauucaugagauaagggaccauguagacaggacagcaauacauauucuccagucaccaacuuucuucaagaucagcgacugucucagauguaguuuuuuucuagucauuaaugaguguugagcuagguuucuuuuuagagaaacaggauuuaacccacccaccccucuacaugcaugccuucuucuuacuauguuacuuucucaacuaaguguaacagaagcaugggaaguaaaucccaaggggggaaaacccuugaauaaacgguguuugcuaugguuuggcuauagcuugaguuguucuccagagauucuuguguuggaagccagguuuccaguguggugauguggugacgugggacuuagcaguguauguuuaagucaucaaagauguugaagucauucuuaugugaccucuaaauuaguucuccgagaaggugauuauaaagaaugagcuggacacuuggcagccucucucccuuguccucauaccaugugacucuucucccuaccuguguaucugccauuauaauaccauucaucaugagauccucaacagagccucuuugaggcccugaaccuucggaacugugaguuaaauaaaccucuuuucaaauuaaaaugauucauguucaggcgcuucaauagagcaacagaaaauggaccaauacuguguggaaacacccugggacuguuaccaaucccaagucuuguggaaaagauuaaaauagguuuuauuacaagggaugaugugaaaaugcuuuagcuguuuaggacucagagaccugaagaauuccuuuguuuguuuguuuguuuuuugaagcagguuucucuguauagcccuggcugucuuggaacucacucuauaaaccaggcuggcaucaaacucagaaauccaccugccucugccuccugagugcugggauuaaaggugugcgccaccaccaccaaccagcgaggaauuacuucuaaauugcauucauauauuuuguuaugguaacuaggccacacagugugacuguguguaguuaacauugcuacauauaacguuggguaguaugugguuagugcacuugcacugaguaucugggagucucauguaucaggaacagcugggauaacuacugugaggguuucuguggggacucuuaggccacaugagcauggggacagggagugagacuguacacaggcaaggggagcccacccaucguucuaagucucucaucuagacuuacuuuauauaaaaauuuuuaauugaaaauauauucuucucuaaugcaauacaucucgaccacaguuuccccuccccccacuucucccagcuccacccuauucacucuuagauccaccuccacuccacacugguuucccuccaggaaagaacaggccuccaagagacaacaaccaaacacaacaaaacaagauacaauaagacaaggcaauccaccaggaggaaaagaguccugggagcaggaaaaaagagucagagacaccugcucccacuguuaagagcccccgaaaacaccaaccuaacagccgcaacauauaaacagaggaucuggugcagacccaugcagaccuugguacuugcugcuucaguuucuaugagcccauaugaacccugcuuaguugauacagagggcuguauucuccucgugucuuccauccccu

SEQ ID NO: 7505 - RNA, 3342 nt, Mus musculus
auacaaaagaaguaaauauuuugaaaagaaaacucauuuuuuuuuaaaagucuguuguuguauauucuguccauaaagaguccuguuaguagguggaaagagcuggugggguuugaacucugaaaacagaaagguccuuugauuccagucucaguuuagagccguuuuuucauugagaugagaaagagcaacaugacugcucaacuccauggucuaacugugaacccuggaggcugccuuggccaacaacugaaucugcaguucaguauaaguacaguauauaaguaacucugaaucugcaaaauauaaguaacuuguggaaaauaaauucaagagaagcaggaaagacugguguuuguauguaaauaguauauacaaucaaauaaucacuauauauaaucaauauuuuuaaaauaggguuauuaaggauuauaaaacaugaaucuuuuccaaauccuucccuauuuugcuggcaagcccuugguuaggaaaagcuacaauguuagcaguugucuucaaagucagaacacagaaaccuuacccacacagguuguucucuggaacccaguucccuuugccucuagaccaguggggucagaagcaaccacagggacgaccucugaccccugucugguuuuccccccuguccuauugggaaagacagcgagugggguccuuggguguucuuagacagggguaggcugggcacaacagagagagguauacuuaccauaccccugaaugaaagaggaagacugagcccaggccucuaagacccaccugcagagggaucagaauucuccaaccuaaguucucagugugcucagucuauugugaccaauugguggcuucugugacuuaagccccaugucacuggggugggggauaaaagcuuuguggucucccaaaggaccagcgaacccuaggggacuguugcacuuucguugcugagagcugcuaauugguauuugacugacggcuguugcuucuguaacaggaaaucagagccacaugaucagaauacagcaucaaccugaagaggacuacauucggcacuggaccagacgcaggcgugaacagauuggcauggugccucuugggcuuaguacccacacgcuaagaccuaugugaaggaccggagaaagauaggaggcugcaugaaguccaaaacagaugauaaaggaaaaggcauuguucuuuguggacaugggggacgcauguguuaauuuuugaagcugcgauccuaggaaaagcugggcuagaggaagaagaaccugagguggugagaaucaacgcacugggauccaaagcccauaauuaugaauuucauuuuuuucuuucgccucgaggcugcgaugaaggcucuugcuacacaaaaaccuauguggcacccaggauauuauauaagcccuuggcaggaggggagauaguccgguuugugcgcuucagccgccgcaguugcaguagccacagcgcagcagcgagagccgcucagguugauuuagaacgcgggugacaguggccuggcgcgagccuacggcugacgacagcggcugaucccacucgguuuccauggagacgggcaggagccgcggcggcggcgcggcugucagcgagcgcggcggcggcgcgcgcgcgggggucugcgggaggcaggagcaggccggggcccucgcugcagacauggacucgcauugugagugcgccgcggagacgcccgccgcagagccgccgucggggaagaucaauaaggcugcguucaaguuauucaagaaaaggaaaucggggggcaccaugcccagcauuuuuggggucaaaaacaaaggggaugggaagagcucggggccgacgggaauggugagaagcaggacccacgacggacuagccgagguguuggugcuggagggcagcaagaaggaggagccgccuggcgggagcgaucacagcggggcccggccgauccccggaccccccaaacccuccgggccuggccugggcucccuggccagcagcucgguggccaagucccacagcuucuucucccugcugaaaaagaacgggcgaucggagaccggcaagggagaccaugccgaggcgagcaaggcuggcggcaaacaaaagagggggcugaaagggaucuucagcagcaugcgcuggcaccggagggacaagcgcggcaaggaggaggaggagaaggcggugcgcgcggcgggcccgggcaaccugguucugcccgguucgcucaccgccagccuggagugcgucaaggaggagccgccccgagccgcgcgccgcccggacagcccgggccaggacgccucgcgacacgcagcaggugagcccgcagggggagagcaggcgcccgcguccgccgagagcgccccggagcggaucugccucgaggccgggagccccaccggcucuggcgaucaaagcucccggggagaggacgccgaggggcaucggcgcgaggagaagcccggggcagcccucgagucgggagccggugagguccaggcggccgaggaugcguccaagacaggugacguuccgauaaagaccgucccccuugucgacuccgaagguggcagcggccgggcgucugcugucccugacccuuccucuguugauccacccucagacccgucggcagaucguauuuguuugauguuuucugacgugacuucacugaaaagcuuugacucucuuacaggcuguggagauauuauugcagacccagaagaagaggcaggccccagcugugacaagcauguccccgggccaggcaagccaguucucucuaaaaagaacgccagcgugguggccuaccaaggaggaggggaggagauggccagcccggaucagguggacgacaccuaucucccggaauucugggacauguugucccagacugaggaccaaggacaaggaacucaagaaggcgcagcgaaggcagccacugcuuccgacaucaaguuggccccugagaccuccagugauacccgguguggggaagcagccaaggacauguccucggucaagcgcaggaggcuccacagaauucccauugagucccagcagaaggaggagcccaaacauccggagaaggagcaucaagaagguguuccuaacagcgaugagggcuacugggacuccaccaccccuggcccagaagaagagagcaucagcaacagcagcagcagcaagaagguggucauccccagggauagcgacaguggcgaugcucucugcgaucucuacguugaaccugaagcaagcccagccacccuuccugccacagaggacccacccugcuugucccggcuaaagccggugucucca

SEQ ID NO: 7506 - RNA, 2039 nt, Mus musculus
ugaagcucaauuauuaauuuauuuauuggaaauagaagggccaugacauuugagccauccuaugaaggccgagaaaggcugagauggacuugauugaugggaaagguuaaagaugugguguucucacacacuuuuggggguuagguagugcuguggaggaggcuugggcaaccuugggaggaaugggcacaggaauguauagaggcuuggauguaggaccagagggaagaggguauuuuagucauauguccaugucuugaguuucuaacagccccauguguuuccucacaucacucuauggacaaguagaacuuucugggugucuucugcacacagccuuuccuccagcuucucuggcuugguauguugugcccugagucccuauaaugccguaaguuucucuuacaguuuuccuuagucacuuggccucugucagaacucccaggaguccaccaaccgagccccugcucauacaggcugguguuucaguaggcguguuuggaagucacggugggguugauguuucauaauaaaagaucccuuccguucacauaaagaacaaggucuuaccauuugcguuccagggucuucucgggguuucgggauuucuccguugugucagauguacauccauagcugucuuuuucguuucuccuuugaggaauacaucauuugcaugccuuccacucuugcuuugaugagaaguagauuuuagaguaauucuuaaugacccagccuuguccuggagcuugugggguuuuucuucuguuagcaguuguuagcuugaacgaucagccucuauagaggcgccuccuuggggacaaugguuaaacgccugcuuuguuuugugcugcaggcaguagcugugacuacggauccagaugcacacagcagaugugaaagccaggcugcuguccuuggagaugaaggucuggagcagggacccccaguuaccggcgugaauggggguuugagccaggcugcccaccccaagaacaugacaacagcccaggauggccaugggcaaggugccacagccacuuguucagccuccaacccaaaggccccgaaaauggugacauccucagcaugucagaauggaggcugcaaaagcagccccagcagugaucccgaagccggggaaaccaggcucagcccaucgaagcugguacgucucuucucugguagucggaagaggaugaauucgaacucugagagaccucgcucagucguccuuguggggaauuccuccacguggaaugcccuggccuccuuccguaaaaugggcuccuuuaaaagacuaaaaucuucuguccuucaaggaauucagaaccgggagggggcagaaguuuccaaggaggagccuacaggagacccaggaagggcugcucccaauggcaccguugccauccugggaaagggccugggcagguguacauccuugggcccuguaggagauggcgccgggucugacugcucagaccccgaggacacggaggacgccuuccagaggagcacacaccguucucgcagcauccgcagggccuauggccugggccgcaucagccugcuggaccuggggcggcagccagugccggagcccgccgugugugagauccaaguucgagacccugaacccagcagggcugugccucugccacgcagaagcaagagcaucgacagcuugagcguccugaagagcuccuucaagcgcaagucugcauccaaccucacggaacugcagggugacaggcagguucccuccagaaccuugagcagcuucuucacagacccggagaagccggguggcucagagagaagaaccagacgcuggaggagccccauccgggccaaggacuucgacagaguccugagacuggugagcaaugucaaggaugcggcuuggaagagggaggcccccaggagugcagccccuggcccuggucccggucucggggaugagaacccacuacuugcgccacgaagcaagcuacacgaugacuacucgcgucguacuagcagcagcguggagccagaug

SEQ ID NO: 7507 - RNA, 25169 nt, Mus musculus
guuuggcauuggggaaagcacccaacuuccccauuuauuauguggacaggacuugaauacacagagaguggcuaggucauucaagccagacuccagggucuggagccagaugucugagcagguagaucccuucugcugucuuaacaaggaaaggcaucuucaacaggcuguguucuucaccucccagguccucagcuuaugaaucuguaagaugaagacgauaauaauaguuagccgugcuaaacaauaguccucauaaauguuuaagaaaaggccuggauauccaguuguggugguuugaauaaaaaugacccccauagguucauagauuugaaugcuuggucauuagggauuggcacuauuagaaguuauaucuuuauuggguuagguguggucuuguugaaggaagugugucacugggggugggcuuugagguuucaaaggcccaagccaggcaaguccagugucucuccuuccugcugccuuccuguggaucagaauguagaccucucagcuccuccagcaccaugucugccuacacaguaccaugcucccugacauacugacaaugaacuaaaccucugaaaccguaagccaaucccaguuaagugcuucccuuuacaggaguugcuguggucauggugucucuucauagcaauagaacacugaccaagacaccaguaaauauccauuuuuagccaucguucucugucagcauuaaaacugugguuggagugaaagggucauauucuagaaaguagcaguauuacugacuugaagcuuagagucuaccuuucaauguuagaaggcaguaaguaaggaagagagauuggaaauaacuggggcagauggggcccguaggagauaacgaaucagcagacagcagagguacgucuccuuuacccaacaugauuggaaccauacauguuuuaagacuggagugggguggggaguauuugcauagacaaaugaaaacucugggaauggcgccuacaucuaaacagaaauugcauuuguuuuguccacagcuucuacccuuagcccaagagugcucauaugcaguguccucccugugcugcgggcuagacugugcucugucacacaggcugugugggauuucccauuugucagugguguuacgugguguuagcauguuccaggguuuggcuuuuggagauuacagauucucaaccuuuacaauaauagacagaagaaaugccgcuugcaccgacugugucugacuguaagagguuggugacaaguagcuuaauuaucauuagauguuuugcaaaugccaguugucuucguaauuaagagagcccaauuaguuuggaaaagagaaacuggggcgugaucugucacagggcuucugggugcucgcgggucucuacugaccucuacugacaugcugagcuagagcagcgcacugauagguaguuuuuaaaggcugauaaagacauuucuuuaccaucuaguuucuaacggacuagaaguuauggguagcuguuuuuaaaaucacauuucuugggcuggagagcuaagagguuaagagagcuugcugccauaccagaggacagcucacggccaccuauaacccaaguucgaaagcaucuggcgcccucuucuggcuuucaagggaccugcacacaccugguauaagcacagcuaaauaccgauuuagaagaucauuugucuguuagauuguuugcugucauguuggguguugcuuuuucgguagcuaugaaaguaacucuagaacguucuggcugagaguuuucuucagcgaucuuguacuaauugaaaaucuuuacaggucagcacagaggccauucucugguuccuugaagcccuuucgaacgucucucuuucugugguuuguccaguucacaucccagccagaggccuguccguuucuuuuuuucaguuuagaggcucugcugcccucuggugucucuguguggcucugcagguucuucucuugcuagagguauuccgggaauauggagaugacugucccaaaaguaagauggcaaauaccaguccuucaagagccccugcaagucagaauguguucugauuaggagcuugcgugauacugaauguuuuaccagaagaaaccuuagcggcgcgcgcgcgagagagagagagagagagagagagagagagagagacagagagagagagagagagagagagagagagagagagagagagaacgacuaccaccagaaugcguuccccuccuucuacuccccaagaagaaaggaccagacuccuccucucauuugcuccaagcugaguuggccuccuuguacccucugggccaccgcagacugccccacucuccuuugcacuuuguggccucccgcggcagaacagugccagguggggagaggugaccccuggcaacguuaaacaauucuuaaguuuuccgugcagcaguguagugccugagcucaccuugggcacuccaugacagguuucuggguuuucaaaaccuccaugcacuuuuacccgugucuaguuuuuaagccuguguuucugcagagaaugaggaccccaguccuaggaguuucaucugcacgcuguuaaugagaaauucaauguaauugccauucuucuugccccaugaguaagcuuuccuuaaaucuaguucucuuugagugguuucuuucuucccuguguagucuaacugugguuccacgaggcaggcuucugaguacuucuaguugguauuuuguugcugcagauugaaucuaaaauauucucucacaggcuaacgauguaaacacuuucucuggguggaggugucauuauaaagacucuagagcuuucaagauccgggcucuggcuggcggaacuagguuacuggggguggugauaacacuuccaaaaucacucccccucuguaagccagccccaauuaaaaguuuuccuuuauaagaguugccauaguagccaggaggugauggugugugccuuuaaucucaauauuugggaggcggagguaggugaauuucuaugaguuugaugccagccuggucuaccgaucaaguuccugcauauagaaacuaugucuuagggggugggggggaggaccuaauuugaagaaaauaaauagcaaaaauaagaaucagauguaagaaugaucccauuaccagaucagguguuuguuuacaauccagaacaacaaaccaacccagaacuucuuguaaauucuuguaauuaccaguaaagacagagguugccagugagcagcagaagugugaugguuugagugauaaugacuccauaagcucaaagaugugaauaucagucccagcuggugaaacuguuuuggaaggauuaggaaguguggccuuggggugggcuuugagguuucuaaagauucauguaauucccagauggcuaaucucucugccucaagcuuguggcucgaggugugagcucccagcuguuccugaacccaugucuuuguucggccaucaaggacucuaacccuccaaaaccauaagcccaaugaaacccuuuguuuuaaaagcugccuagauaugauguuuucuuauggcuauagagaaguaggacaagcaagggaagucccaagacagaaaggcacucuaagauaggggauguuauucuucaagacauuauagcaggcaugacaaaugucuuugauaggcauuuaguggugaucugaaugugcuuggcccagggaguggccuuguuggaguaaaugugucacugugggaguggacuuugagacccuccuucuagcugucugaaauauaguuuccuccuggcugccuucucaucaagaugcagaacucucagcuccuccugcaccaugccugccuggaugcugccauguucccaccuugaugauaacggaccucugaaccuguaaaccagccccaaugaaauguuguccuuuacaagaguggccuuggucauggugccuguucacagcaguagaaacccuaagaaagacaggcuucauaaacaggaccugguagaucacuggccugaaggucucagaagaaacugaugaaguagaaguaagcaggaaaaagaaaagagggacagagagcgacagagaagaaggaaggaagauggcaaaaggaaaggaggaaaggauaguggacacagagaaccagaacagcacagcugagcccugugggcaacuacaguaggaugccaguacaacgcaguggacacaagacgagagaauagaacucugaaccugcguuucaguccccagcacucucaucuggcagaucacaacagcugguaacuccagcugcagagaaugugaagccuccucgugcacgggcacauacauggcacgcgcacacacagaggcuccagcauggaucugucggcagugugggugcuagaggagggaggacggaggacuguguuucuacaggagcauggccacuggcagguugcuaugcccuagugggugaacccacacccauguauacaugugcagcacuaauugaacucuggaucuaaauaaauauaaaauaagaacauacggcugggaaagagaugugaugggcugcguuggggugauuagaaaggaagagugggggugguuacaaacaagaacgugguaugcaugcaggaguuuuucaaagaaugugaccgccugaacaugaucugaacaaagacaacaccaguagacacagaugaaggaaagcccacaaggccucagccccacacaaagaccugcaggcaacuaaggaugcugagggcaggaaaaguagauguccccgcaauuaacacaccaauggguuuuccaauaccaaauggucagcccugaaaacacacauauaaguaacacuauauagacuaaaaagguuauauuuauguguuuaggaaugugugugugagagagggggggagagagaauuaaugaaauaagaggccaugaauuuggaagagagcgaggaggaauguauggaaggguuggagcaaggaaagagaaaguaaaagcaauguaauuaaaucauagucucgaaacuaugaagaaagagauaaguggauaaaauuuguaaacauauauuauaaauucaauaaaaauuguuacuagaucuaauaaagaagaauuuauagaaaauuuaacaacaaauuuauuaacaacaauguauuggguuauacaagaccuuguuugcaguuauaauagaaaagucuuccucucucucugucuauacucacaacuuucuauugugucuuucuaucacaccacacuaguuagguucuugccuccaagaaaauaauguccggagaccuuaguaagggagcauuaacugacuucccuaggaggaacugcaaagaggccauaaacacaugcugugaucagaagcagcacccgguggauuguggagagcuuuggggcagcuucuagaaacuugguggcaauuugauaucagguggggacaaagaaguaggggaacugacuuugggcuaggacucaggaaauaggcccagauuaagaauaguuacacuugaguuaaugcacagcucagagcgggcucagcuaaggcaccuguggcauuccuuuugucuuggucauccugacuagccccuagaaagguguuugcgggauuuaguuuauugccuugcuuguuccuugacccagaacugaucuuauuauuuuacauguacuuaaaguaauauaacagcagacuggaaaaacauaaaccugcuucagacucagaacuggcggggaucaugcuacaguguugucuuuuuucuuuuuaauccucgcuccugcccuggagaaccuguugacugacugagcugacucagucaauggauggacugcucacaucagcaaucgaccacaugacuagucgcuaaauagcugccaggcaucugcuuaugcaugcaagcuaaucuagacaaccccucacagcugugcccagaggcuaaccuaaucuagacaaccccucacagcugugcccagaggcuaaccuaaucuagacaaccccucacagguguguccagagacuaaccuaaucuagacaaccccucacagguguguccagagacuaaccuaaucuagacaaccccucacaggugugcccagaggcuaaccuaaucuagacaaccccucacagguguguccagagacuaaccuaaucuagacaaccccucacagguguguccagagacuaaccuaaucuagacaaccccucacaggugugcccagaggcuaaccuaaucuagacaaccccucacagguguguccagagacuaaccuaaucuagacaaccccucacagguguguccagagcuuggggucuugggggacuuuugguacuuuccguuuaacaauacaaaccauuacagguaacuugcaagcaucauaccagaaagaaugggaacgucugaggauuugagagccaauagagcauagcuaaaacagaaucucugaauucgcgagaaauuuccaaguugcuacuagaugaaagagggaaaaggaugaaauccaagcagaauagugaagaacucaggcaacuagacaacuguaaccugugugugggagcgggaggagaaggagaggcgagcaugagaguguggcgacgaugacugagaaucuccuccauacuaaaguuggaccauagacagcggucauggagaucagagggcccagggcaggaucaaugacagaaaugguaucuagaguuguuguauuaaagguucccaaaagcaacgcuuaauuaaaaacauaagaugauaauuagguuggggucaugugacuggagaggggugggggggaacuauugcuaaugcuggcucuugggugacaggucagugggucaaguccuuggggcacaagagugaaaaguggagcuuggauccaagacucauggaaaugucagguacgugacauguagugacacauaaccacagcaugggggugugccacacauagaucuggggacacaucugccucaaaguguaggcagaaugguguucagcaggcagugcugcucugaagggugugugcccugcuguauuuggugaugaugggccugcacagcugcaggucaugacgacaggcuuagagccacacugcuucaagcuaagcucuguguuucuggccaccauacgauaaacaaugacggcaugcucagagaagaaccugagcugcccuuguggcauguccuccauacaaugacgaagguugccuccucgaaaagaaagcucagaccuaccauuaugaaagcagaggugugccucguguucuucaauaucauugugcuuuggacgcuauuugaucuuggccucuccaaaucacgagcaagaauucaucagaaaacaaucggcugaggcaugauuucagcccagguccaaauuauucagcacagaucuugcuuccuuccuacagacuuccuucucacccugcauuuuugucucauuucucagugagcccacaugaccaugauaccauggucuaugaagcaggccuauggguggggaguuauccucacaagcagcauguagaagaccuucaucaccagcaugugguagagaaggccaucucugcacuaaacacacaaagcauagacucugcaaagacauaaacauuucauuuguaauaaacaaugggagcaagcugaagagguuucaaagcaaggaaaugugucagacauaaaaauaaaaaacaagguauuguauacuuuaaaaugucaguauuuaaagaggaaaugagaauugguuuuguucaucuaucaaaaacuauuuuaguuguaaauuucaauggcuuuuuauuagaaauggccagggcaaacauagugaaagucaguaagcccacauuucaauguaaaaggaccgggaaauaccugauugauguggcugaccucaggugucuacucuuguuggagugcuacaaguuaggccacauucaugaucacaaaacccaucuucauaaaguuaaaaauggaacucacauuuuaaguugaugaaguaucagaaacuaaacuggaacccacacugauaagaaaagagggucugaagcaugaagagagugaugugucuguccaacgggcccucuaagacccgcuuuaauaccacagucucuccaggugaaauauuucucacauuacaacucagacauccagacucauaaaacagaaaucacaagcacagggcgaaguguguuucuaacagguuguggcuuugcugaagagccuggcugguaugcacagacuuguagugagaguuuugguuucuuuauaagcccaguuauguuaucuuauaugaauauguuuuuguuucgauccacaggugugggagaagaggcugcuucacagcaggugauuaugauuugucucauacacuaccaggggugugauuuuugccagcuacagguaguucauguauagaauucugaggacucuugagaggguacaaaugggagaguccugagagggccugccagggcugcugcucccccugcugcugcggguuccuuuuguugagauuugucacgugaucaugagaaaaacugaugagaagaggaaguuggggauauucugacaaugaagauuaaacuugcccucaaggaacccagugccccuaaucagcaggaaguagucuaaugaggucuacaccccccuuuccccucuaaccuucuuucucuccuaccuaguguuggggguuggaauggauuaggauagaauaaagguuggaagggagguagauauaagaacccaaugaaauagcuuuuuaaaaaaugugccaacacaaacugaguugcucacuccccccaguuguuuacauucaguucuccuuaguugauuuucuaggaccuagaaucuagguaagcauccagaugggacaaucguguaggaaugcuuccucagacugccuugucaucuauauuuccaguuguuucccugcugguacccuaaccacccaggcaaaccauguucaaguagccuaugaacuggggcugacuugucuguccuuugccuaucccucaagggaaaauggacagauggcaucuuacuuuccuuccacucgcugugacaaaauacccuaacaaaagcaaccuagaggagaaagggucauuuugcuccugacaguucaucuccucaggaaguccuggugggaaaaaccugaaacaguuaagucauaucaccuccaguaguaaagagcagagaggaugcgcucaugucgcugugcucagcucacccucuccacacggcugaggauuccccugccuagggaauggugucaccaacaguauuaacucauguuauacauguuacauuaguaauauaauuaauuaacucaugauaaucacucaaagacaugcucacaggacaacuugaucuagacaauaauucauuuaaacucccuucccuggcaagucuaaauucugugucguugacaauuaaaauuaaucugcacagauuguuugcuuuccacuuuaagcuuuucaucucugucuuuuaaagcugugccaugcagagaggaguuguuaagauuauccacugcuggagcugagaauuauacagagccaucaguaauacguagcucuugauuuccucacuaagcugaugacagcugaauauguguugaaaggaaaaagaggcaaaauauugaguaaguucccuggacauuuccucauacacacguuaagcaucauggucugagagcaaucucacauaaaccaucuccauuuauggagggaacccaguuguuggccauuaugagucagucaauacauagugaugcauaauucugguuacauaguguguggacaacagaaagccucaccuaaaaccuacucacaagccaaaaacuuaaggcuugucaacagagaagaguuaacuguagagaaaaucgucugguuuacuauucuggggaaucucuacuucuguacagucaugaagucauaguacacacagaaaacugccuguguaaacaacaaaaagaauccuggaaggacuucaagacauuccuacaaaugcguaucaucuuaccaaacuagguucaucacaaguggaauguuuuucuuuucuguaccuuuuuuucuaauuuucucucauacaauaugucuugaucauauuauuugcccucccucaacucauucuuuaucuccccuaccugacuucauguaguuucucucaaaaacaaacaaacaaacaaacaaacaaacuauauaguuugcuuuauguuggccaacuacuccuggucugugggugauauacccagggucacuccacuggaaaaacuacaccaguguauccugcaggucagccaccauuguaggucucaggauucacagccaggugauuuugaugauuaccuuucgccuccaguaaguugcagaguaccuugcagcagcaucagaguaccuugcagcaucaugaacacuacucaucaguaggggugaaacuuagauaccagcuaaguuucuccaaguucaguccaguuccuagccauagaggcaguguagggcaugggguucaucucauggugugugcuucaaguuaaaccaagcauugguuggccacucccacaaauucugugagucguauacacuuuuaacccaacacucaggaggcagaaacagguagucuaugugaguucaagaugagccuugucuacauaguacauuccaagccugccaggacuacacaaugagaccuuauguaggucucuguagaggaucuucauaggaaucuuuuguugauuuuuuuuuuuuuuuuuuuuugcucaugaugcuacucuaggaacaagcaccuaagacacagugucauagacacaugagcacacauauauguauauauacacauucauacuguuaacaugggccaaaggccaaugguuuuggaaaacaguauugccuuguguaaagaaaaacuaacaugggcuuggugguggugguacacaccuuuaaucccagcacucagaucuggaguuugaggcccaaccuagucuacagagggagguccaggacagccaagguugaaaaacaaaagcaacaaacaaaaagaaagaaagagggggggaggaagagggagagagaaagagagagggagaggaaggagagggaagagagggagagagagagggagagggagagggcgagagcgcacuaacaaggaacaugguagaggggaagauguaguguuggggucuggaaaccaucacacaaaccacucagacaccaaucucaggcaaacagggaugauugguugaaugugcucccuaacacugacugaucagggaugcaguccagauuugggagcugagcuguaaaguccagcuaaacuccuauagagcuuuuuaagucugaaauucacaaacaucugugacaaguuauuucaccaaucaagauuuaggauaugggguuuccuuaggagcaugucuuuguuauuccuuuauccuguucucauugguuggggguaagcagcuguggcaggggacuugucuugccuaacguucaugucuuaacuugcccaccaggaugcacaugucuccuucugucaaguaggaugucauuucccauggaggucuuagaaacguaaacuuuauuugacccccuacucaaaauggaaguuuuaauccaaacaacuucuuacauuggugcaggugucuuucuuaugcugggguccacaccaggggcaaauuauaaaagcaagaaaccauaaaagcucauacauagguacaggaagugcugcuggcuaguugguucggguccaagcuuacuguggcuaacuauucaaagcaguucuaacugacuucuguugugauuuguuuccaagaacacuaaagcacagaacauaacagaauacgcaaucaacucaggcaugagaaaguuuccuaugacagcacaugaaaaauuuucuuuaugacauuaguaacagcacaaacuggcuggccagacaggcaacaguuaccuaggccuucacaugcagcaaugguauuuucuaccugacaccgucccugcuuucuucuugcaaagaguggcacuguuuuauucagauacugagagaccggaacaauguucuuagagaacaugagccaagauaagagaagacauuucuugcucuggccagcgaguaacaguaacaaaaugugugaacacacacacagugacaggagaggacagccaccauucuuucuuccugcuuuuaccuucacucgggggaagauaauucgaauuguguaaggacacagcacccaucuaaugaugaucagaaacgcggaaagauggauuccuucauaaaccuaggcuggaagccaaccuggaauucagcaccacauucugcugagcugcuccacacaugcaacagagugugcuguggcuucaggcuucaccugcccauucugaugacacagaggaguccaugaccaacagcugauagauguguaaccaugacaaccaugauggacaacauucucuucacugucuccagucacugcuaaaaaaacaacagcaacucaaucauggugucacagaacugggcacuaaaagaucuaauguauaacauaaauggggggggggcaguaagcaacaucuaaacucaaagcaggagugguacagaagcacccuauaugucaaaguucuaagcaacagguaauguucauuuccucugucccagaaccucaacccugcgaucuauccaaugaaguaauucuuuaaucuagcuucuuuguugaggggggaaugguacacuuuguuuuguuggcuguuguagacuugagcaauaaaucacauugcuggguggaguuuuucaguguaaaugaguagaugucuccgccucagguuaucaacacaggccaaguaacaguuccauuccaguguggcuuggugcgccagaauuuauuuaucuugcagaugcaugcauaaggaucacuaacaggagggugaguggucccaaaagggcaguaucgccacaagucucaccucaguguggauggagacuuccccauagaggcauugauugauagaguccuccuuuuagucaaccuucuauacuugguauauguuaugacugugaagagacaccaugaccaaggcaacucuuauaaagguaaacauuuaauagaagcuggcuuacaguuucagagauucagcccauuaucaucauggugggaagcaucaugcagucugccuuggugcuagaggagcugauauuucuacauccugaucugaagacagccaggaggagacucucucuuccauacugggcagagcuugaggacuaggagcccucaaagcccuccaauacagugaugcacuuuuuccaacaaggcuacgccuauuccaacaaggccacaccucuuaaugguggcacuacccaggggccaagcauauucaaaccaccacaguaugcucuuagcauuguccuggccguggacagcugggguagaaaucaggaggcauaggacacagcuguuagaaucacaagugagggccuagugggucuccccagccccuagcaugaaggaaugucaacagaucccauucugagggaggcuuguaggugaucacagcugcucagauuaagaacguaaucgcuauugagcucagaggacaauagucuacgcacuccucaacaguauaauuaugaagacauuacacuguuuuugcuggagacuggaguaaaaucacguaauuuucaauacaaucuuaagugaaaaaaaucagaacccaagagugucuauauacucuaccaccauggggaacauagcuauaauuagccugggccguaacugacaaacagguuguuaaauaugcaccagcugaacuuggagaaggaggguguugucgauucaccaagcugcucaggcaagaaggcaaagaaagaaaagaccacauugauaaccaugacugcuauagaaggcauggcucuucuccaccaagagcaucagauggauuucaaaauggcccaggcagccaagagcagagcugaaugugcccagagcuucaaagguguaggccgucucccuacuccacacaguaaguauccagagcaguagcccaaaccagaacaaggccagcaauuuaaggagcaguggaggccuggucaugggggaaaacugggcagcuaccagguacugcuggcuugauaaauauuucuuccagcguguucacuacagguguguggcuucugugaaagcuguguuuguggucagugggagaaagcaggaacaagagagcagccaugucccagugacgcugaccaucuaggaaaccugcagaagggcacucacaagugcauguuuccgagcaugugaaaggacccaugaaauggugagauguguaaaggagcuugccucugggucugacaacuuggauuucauccccagaauccacauguccccuauaaauaaauauuuuuaaaaauuuaaacaguauaugaaaauaaauacauagguauuauuacauacuguuacacgcuguuacauacuguuuguuacauacuguuacaugcuguuacacauugcuacauacuguuauacacuguuacauacuguuuguuacauacuguuacauacuguuacauacuguaaauguaaggagauuucuuugcacuuucuguccacuguguccuguagcagacuuagccuuucuaucuucauucaucaauauucuuuauuuuugaaacaaggucucgagccaguaacccaguccauacucacuauguagccaagggugacuuuggacuucugguuuuccugccuccaccucccacauauuaaguaaugacuuguuaccaugcagauuaugaaccacgcuuuuucaagaaagucgcacuaucugacuucucugccgcaacacucacacugacacccguguucccaccuggcccacaggaucuaggcagaagccugcucuccagaggaguaaguccauguccuaccuugaagaagcagcccacucacucagcacaggucaccucagaugucuuccgauucaagcuccccccaauaccuuccuucaacuucagauccuuacucauggcugucccccaucuggcuauguuuaucucuacaauggagcccuaaaaugaagggaggccccuucauuuuuuuauauaacauauuuuuauguacuauauuguacaauaaccauuuugaagaucaaagaauggaacuguaaguaacacuguguuaucaaaaccccuuccuugggagaggcaaaaauagcaccuacccuccuccucaggucccagugacaaaccacggagcaaguccuccagcacucacugggaacccaggagugugucaggucaaugggggauguuacagacaggggcauaggugaucuuaaccagccacucuagaaggucugcacccgggaggaaugguugcuuccccauagcugaguagauggagccuccuccccucauccuucccaaccuacauccucuagcucaucccaaaagaccccaccgccacaugcaguuagggaagaauugcaaacagcugguuggggauguguguggcuggaccuucccugcccucuccuccuaugaagaaugguaaacagccaauaggcccaacugcauaagcuuuugacccaggcucaacauaaucccuguucuacacguauacauauauauguguuuguguauauacauauacaugcacauaugcacgcacaccccuuuggaggguuuuuuuuuuuuaauuuagaauuauacucuacaauuuaacacacacgugguucugucuaaccagagggacucucugaagucuaaugccauuuacuugggaauagccguacacugcaauguggauacaugcagcagaggaaacuguguuuauucaagguggauugaggcaggugaaagguuuugaaggaagaaaugaggagccaugagcugcagagauggcucugagaaccaagugccugucguacaacagaaggagcauagcaccuuguggaagcugggcagugucaucaccuguaacccagcacugggcggccagaggaccccagucuagacaaaugaaugagcaccacagaggugucuuaggagaagagccucucccuaugcggaggaaaaggcugagguccagguacacagacaugcacagggccgugaggacaccgagagacccagucucagaaaauacaguggagaguaacugaagaccaugccagaaauugaccuauggccuccauaugcaugcacauguacauacaugugaauauacacccacacaaacauguucaugcaccacauguacacauacacaugaacacacacaauaggagcauaacuauaugaaaccaucuuaggcugcaaaggaaaauaacaagggucguacuauuccaaaauuaaacaguuguuggacagacaucucuguagaaccagugugugagagcgugugugugugugugugugugugugucuguguaagguugugguucuagcagagucuuuuaugaaugcuuaucagucaugcacgcacaagaucugcuccuuuauguacuuauuaauuauugauuaauucauuuuuuccuccuccuuuuuuguuugggcuugacaagucacuccauuuugauucugacaagcuucacaguuuugcaaaucaaagagucucccagcaccagaaaaccacugcugcccgugcuggguggccugcgcuucaggauucccagggagaucacaggagucaaggaaaacaaggaagggugacacaacucugaacuugugaagucccucagacuggggaaacuggugcugggcggggcuccacuaacaacggagagcugagaugucuugagacacacccccaauaugggaggaugucugcccuaaccacucgagagaggaagcaaaaacaggacagauugcaacagccacuacacuuccuucauauccugcucuugggacauggcgaccagcagaaagaagcuugauuguggagaggugcccuagcggagggaugucugccacaguccaggcaaccacagagguaacucuaacucuugcucuuuuucucagggcagaagugaaugagguuccuuccuuuccuucagugauaucugaugcacauacuccuaagagugcuaugguccaccuucugccucucuaacuuucuccuaaguuguagauaguucuuaggccuucaugguuagaauucuuuaaaacacacacacacacacacacacacacacacacacacacacaaacaugcacacgcacacaguauucuagaggcuuuuuauaugguguggaaaaguucuuggcucugacucaaauuugccugaaucagcagugguugucaguagguacuggagagaccaaugugcagguccugggaggaguucuaagaaguuagcauacccugaccuggcuucuccacucucuggaaugcagugugcugccacuucugaguuuaggccccaggaaggaaacaggagggucagagaccacagagugagaaaugaaaaugccuuucugcagccucuccugaacacgguuggucggcugcugcuuccuucgccucuacuuuaacuacuuaggaaggacgcuggaguucugcaucuucaggugguucuccgccagcaccagaggccagucagcugcuguugacucacacuuccucacuuccugggcuuuucaggguccagccugggucugaaacccuucccuaaaaugacuuguuuuguucuaggguaggagcucagugcaugcaugcauggauuugcauuucuucagaaaagaguagcugaugugcguccucagccuuucugcaggaggauuuacuaggggccaucaugggcucugugaauuccagaggucacaaggcagaggcccaggugguaaugaugggccucgacucugcuggcaagaccacaauucuguacaaacugaaaggaaaccagcugguggacacccuacccacuguugguuuuaauguagagccucuugaggcuccuggacaugugucacugacucucugggacauugggggacagacccagcucagagcuaccuggaaggacuaccuggaaggcaucgaccuccuuguguacgugcuggacagcacagaugaagcccgcuugccugaggcaguggcugagcucaaggaaguccuggaagaccccaacauggccggcguccccuucuugguacuggccaacaagcaggaggcuccuggugcucugccguugcuugaaaucagaaacaggcugggccuggaaggguuccaaaagcauugcugggagcugcgggcuugcagcgcucucacaggacaggggcugcaggaagcccugcagagccugcugcauuugcugaagucccgcugaaaugcaguaaccucugacuccaggcuggagcaggacagggagcagggucaggcggaccccgugagcgggcagaacagcuuauccuggcuaugaacagacggggccaguugaaccuugagaaaaggaagcucaguuuaccacacgagaaaccacaauucucuuggacaguauauuuucuucucaggacuuauucucaguggcaguuaugcugaaaaucaacuguucuucaaguaacaauagucagagggaauauaaaaauucucacaauaccccggguaacagcccacuacaaagugccaauguaacaaaguuggugacauaguaauugaccaaguucacaaaugaaaagagguuccaaaacugcaucugagugucaccuggccuaucacugucaucugagugucaccuggccuaucacugucaucugagugucauugggccuaucacugucaucaggagcaacucuuccugcugggcucugggcaggagccacugucacuuuuguacacuuagcugggcugacagcagugaggggcaggucugcucccaggaugcugcaggaauccucccagaauucccccugcuuuccaacuccaacuaacuuuucucugcccuacaucauauguuguaaaaaaguaaaaauaaaacuccacuuauaaucuccuuuucugcaugcaugugugugcauguguguguguguguguguguuggaaaauauauaucuuccauccucaaaugaauaaauauuuuaaacaaugucuuccaucagaucaagcccgggauauagcucagcgucuugagugcacgcacgaaguuuuggguucaaucucuagcacuggauugggggugcaggaaguguaaggaucagcagugccugccuguaaucccagcauuugggagucagagauucaaggagcugcaagauaaaacaacaacaauaauaaaauagaucagaugaguugguuuuaauagaaaauauguagagagugagaguguuguggauagcccuggggcuaauuauauuugauguuaauuccuucuccugugagugguugagaacaaggaaugagucagcacucaggugauuuccuguaaaccugcuucccaccugaauuuguaaaauaaaggagagcugaugauugggcaaauaaaagggaagguggagcugaagguggggagagggaagaaggagaaaauggaagagggagaggaggaggaggaagaggaggaggaggaggaggaggaggaggaagacaaguggagcagaagcacauggccuggagaaacugcaaguucuaaugggucucauagauguggaagaugguaguguagcaauagaucugcccaauccaggcacacggcauauauucauauuaauugaguuguguuuucauugccaggucauauuuggguuggagauuuaccacacuuaauuuguggcaagccaaagacaaacacuuggucuuuuggcugcaccacacuggggaggaggcucuugaagcucugaggucagaccagccuggucuagauagugagacucagagagaaaaagagagggggcaagagagagacagaggcacaaagagacacagacagagagacggagacagagauagaagaaagaaggaaggaaggaaggaaggaaggaaggaaggaaggagaagaaagaaagagagagggagagagagagagaaagagagauaaggaaagaaagaaggaagaaagaaagaggcuggagcgauggcucaauggcuaagaguacuggcugcucuuccagagaaccuggguucaauucccagaacccacauggcaggucucaaaugucuaucacuccaauuccaggggaucugaugcccucacacagacauacaugcagguaaaacaccaaugcacauuaaauaaauaaauaaacaaauaaauaauuuugagagaaagaagagaagagagaagagaagaggagaggagaggagaggagaggagaggagaggagaggaggggaggggaggggaggggaggggagagaaaagaaagaaaaggagagggagagggagagggagagggagagggagagggagagggagagggagagggagagggagagggagaaaguuaguucaaggcugggagggagaguaugucagguagggacugagggaugcugggagaaccuggaggccaggucuacuuugauauguaaagcaugcaccuuaaucccuaguccuagggucuuaaaccaaacagcaagcagccaguacagucagcuucaguacaaccuuacccuucagcuggcacaucuuuugcuaggcuacauacauuccuaucucauagaacaagcucaggggagugagaugauuuaaggaaggccgcacagaugguaacccugaggugucauccucuccaccuccccccaccuccccccacccccagugccauacgccucaggucugcacugggccccucccugcugcacacacacagacauggauggcacaaguacagggccuuucugaucaaugcugagcucugcugagccaauccugugcccgaggcuugacagucgcauuccacacagagagagagugcuuguucaacaacacucauaucccagaugaauauuaauaauccuacucugaagugcaugcucauguuuguggauacacacagaugcuaccaggcacuagaccucacuugcaugcaagugagcacuuaggcgugaacuuugcaaggaacaccucgauuuacacuaacaucauuuguuuucuuccuacagauucacagauacguuguuaccucauccagagacucaccccucuccacaacacauuccuauuuggagacuaaauguguaaauuuauggacaaguaauacuuagugguauucaguaagguggcuacuagcuacaugugacuguugauuauuuaaaauguagcuauucugggucuggagagauggcucagucagagaaguuuuugccuuguaacaugaaaagaagcagagauggcgucacaucuauaaucccaggcaaagaggauggaggcagggagguccugaggggagaggagagaggggagaggggaggaguggagagaggggagaggggagaggggagaggggaggagaggggagaggagaggaagaggagaggaagaggagaggaagaggagaggaagaggagaggaagaggagaggaagaggagaggaagaggagaggaagaggagaggaagaggagaggaagaggagaggaagaggagaggaagaggaagaggaagaggaagaggaagaggaagaggaagaggaagaggaagaggaagaggaagaggagaggagaggagagaagagaagagaagagaagagaagagaagagaagaaagagaagagaagaggagaagagggaaaggauugaugaaugaaacaaagaaacaaaacccaaccagcaaaccaauguucccugggaaccaggacuuacagaugagcugugaccugaugaccugaugaucguggugacagcaacaguccccucucacuacagcacgggaacaggagagacacaugggguucugcugugauggguauaguaaagucacauuugggcuccauauugugaacgggggaucugcaggcuccauauugugaacgggggaucugcauauguguguguuauuaagagcuuggcgucugcaugcuacaaaugguuucuugcucugauuaaccccucccagcccagaugcucccggaggaguacaagcuaaacacuggcagaaaagaacuggacucagcuuuaagaaguaugggcccagacaucuacagagugagggaagagaucaagggagggugagagauauggaagucucagaaaugcugaccagcagacagaaaggcaaggcagaccucuggggugaugcuggccuuugccuacacccaccccugaccccaccaccauagagacuguugugagggaggauaugaaagucagguuuuaggguguuaaacagcuuccuugugucugaauaaaguacucguuggccuuuguaguaagggacccauagagcuccacaccuggcuugcagagugggcuucaggucauuuuucuacagauaaggaucuaacgaguucgauccgacauucaaagacacgugugacucccagaagaaucccaaaagcuucagucucaccuccaguucaucccuccugcuccagaacacugucuggcgucuagagcuuucccugacagagcuuaccugcagcacucaggggaagugacagccucgagucccacccugcuaacagccuacaucuucugggguggcacugcugaaaaccggccccagagcaagcaacgccaaaagcauaaacaaacacauguguuguuuucuacagucucagaauuuaccgaguaaguucauagcugcguuugacucguuggcuguaaguugccacguaguccugauugcccuuaacugccagcuacuggcaaacagagauucuucuagacagccuuaaugauugacaggaguucuccagcuacacacaugcgugcacacacacacagcuccaguacaaaaggguuaaagaugccuucaaguucaaagaggccuugcagaaagcagaggcagagagagcuaagaagacaagagucacuguaggcuguuagguaggacacuaaggcacccaggggugaaggcugaaggaaggcaggaucuuaagguagacuuguggagcagauaacaguuggacugaugagcuaaggcccuggagaaccaugcugaguugaaaccccagagcagcugacuguucucugucacuccucugcuuugaagcauugaggugggugccuuuccccuccuuggucuggugcgugcaguaaguucuugggccuguuuuuuaaaagagaguuuuaaucucuccauguguucauauggucucaguuuucauuuugucuauuugagacagucucacucuauagcccugacuagcaugggaucacuauguagaucaggguagccuugaacucccaggacucugccugccuuugccuccugagugcugagauuaaaggccaccgcaaccagcccacaugaucucaguucacuuugaguuuauagcugggacuugucucagcaucugcacucaaaguacagccucuggcugcuuguaaauggagucacccagggcaaggcacggcuggaaagccaccauuucacaguguggagucaccuagagcaggguccaggguucaaucccuaaaacugucuuuuaaaaaguuggggagagggcuggaaagguggcuuaucaguuaagagcacugacugcucuuccagaggaccugaguucaauucccagcaaccacaugguggcucacaaccaucuguaaugggauccgaugcacucuucuggugugucugaagacagcuacaguguacuuacauauaauacauacauacauacauacauacauacauacauacauacauaaacaaauaaaucuuuuuuuuuuuaagugggggagaguggucgggagaggaacgauucuccugacccugguuuuccauguaacaguuauuggagguggcuugucauuuuaaguucuuucuuucgccucuuuaguauuuauaugaaucuuuuuuaaaagcuaccuagguaugccucuguguagcuuuggccuauagggaugaaaucaagagaaaacagggacucccaguucccguaaaggaggcggagccugacucagguuucagcugcaaaccaucccuguccugaagaaguguguuuuccuuugaguagagacagucagcucccccugguggugacuucauuuuccagguaaguccagggugagcccgagugacagagcuugggaacugacaucacuggcuugaggacacugggucuuccugcccaccaugacuaacucuagagggccugccugcagagugcccagccuaacugaaagcuugcuccagcuaacaaauugccuugcucaguguagucuuacugucauuccccugcaggcacggaucccuggaucugggagcuuuuccuuucacucacucgugucaaaagagcacaaggccaccguguguccuagggaacacagggagguuuugaagaauucuguauuaggaagaccgagaauguucuaggcucagugugaucagcaagccugcaaugaacgaacacugaauuccaugacugccucccugagcucagccaaggaaggcgcucacaggcaguaugggcugaacagacucauaaauguggaagcucagagaaaaacacaaccacuucagggggcagagaguauuccuguuugucuugauuuucaucacucuaacauauucaccguugaggaacaugugcuccgaagcaacagacuguggaguuuaaggcucucccugccagcugggcaggcagcagagaguacucauggccgugaggacccagguuugcuguucuguacucacauuggcaggcucccacucaccgguaacuccagcuccaaggaugcucucuucuggccucugcgggcaccaggcacacagaugauccauauacguacaugcagacaaacacucauauacauaaacaaaaauaaacacaucuauaaaaaguaaaaagaccuccuguccuuugucccuuggugccagugcucugagaagacaugcaggugcugccuccugugagcugcaggaaacacugcaggcaugucggacggucgcacugugcacugacuucagcagugggugacaaaccaugucguuuugucuucuccagcagcuuaaagcagaaaguauuuaaacccacugccaucuugcccaucugugugauaucccauagaacuccauggaagguucuugaugggaaagugcggucuga

SEQ ID NO: 7508 - RNA, 1396 nt, Mus musculus
acauuuauucauuuauucagcgucaugaucagacuauuacauuuagcaaucaacagcaugggugaaaaaggucuacaguaaaaccuuuuguuggaaugcuuuacacuuuccacagaacagaaaguaaaagaaccuguuaugcaauuagucacaaauagugacuggaguuuuugcccacacacaugaguauugucuaaaacaugucuucuuuguagcagcuaggcccugccaccacugugcuuggcugaggucacaaaucuguuguaaccuguagcuucccugucacuucucuggcucuccucuccugcuaagcuuuguuuccuggcuguauguaauuggaaccuccugccacugccauagcuacugcugcugcuggaaccuccauagccaccuugguuccaugguuuagcaaaguacugaccuccaccaccauaagggccagagcuccugccuccaaaguuuccucccuucaucggcccaaaauuugaagacugauuguuguaauugccaaaaucauuguagcuucuaucaccuccaaaacugcuuccaucauugccaaaucuauuauagccauccccacugccaccauauccaccaccaccauggcugccaccaaagccaccacgaccacuaaaguucccuccucaaccaaaauugucauugucaccaaaaucgcuuccacgaccaccacccaaguuuccagaaccacugggaccucucuggcuggaugaagcacuagccaccucuugcuuugacagggccuuucuuacuucacaguuguggccauucacaguauggcauuucugaauaacaaucuuauccacagagucauggucaucaaagguaacaaaagcaaagccccucuuuuucccacugccucugucagucauaauuucuaucacuucaaucuucccauacugcucaaaauaaucucguaggugauguucuucagugucuucuuuaauaccaccagcaaagaucuuuuucacaguuaagugggcaccuggucgcugcgaaucuucucuugagacagcucucuuggguuccacaacucuuccauccaccuuguguggucuugcauucauggcagcauccacuucuuccacaguggcguaugugacaaacccaaaaccccuggaucucuugguguuuggaucucucguuaccacacagucgguuaguguuccccauugcucaaaauggcuccucagacucuggucgguuguuucgaagcucagcccuccaaugaagagcuuccgagcuguucuggcuccuugggagccucugauuuagacaugauggcaggguuacgagagccuucagccaugcuuccucggcagcgucaaagagcagaaaggaauacgauaacgaacgugccccacccugccuccaucuu

SEQ ID NO: 7509 - RNA, 24934 nt, Mus musculus
cgagaagcuccgcccacaagaggcuagcucgcaggcuccccgcucgccguggugugcuguggagccaugggggagcauugggcgcugggcccggaggcaggcuccuccuugcuguugugcucagcgcugcuggccguagggugcgcgcugggccugcgccugggccgcgggcggagcgcgguggagcguugggugcucgccuggcucugcuacgacucacugguucacuuugugcugguaagugucgccccgucgcagccugccuuggggcuccgcccaacugaggagggaugggagcccgcagcccugaugucucuggcggccugauggugcagcuuuuggccuagauggaucccucaguucaaaccgagcgcccuacuccucagguguugccugguuuaucaaacgaauugaaaauugagaaucaaauugagaauuguuagaggaaugucgccuccucccuugaaacuuuaacuuuuguaggucagacauaucuagaaauucauuucuuguagguuuccuaauuuugcaaaauauagguuuuuaaaguaagagggcaucagauuucauuacaggugguugugagccaccaugugguugcugggauuugaacucaggaccuuuggaagagcagucagcacucuuaacugcugagccaucucaccaaccccuaugccuugcuuuuaauuaugucuuccaaucuacuguuuugaauuugggguuuuuuccugccuuuucaaacucuccaggugcauuauuaaguuauuuuucugaccuuuuuuuuuaaugugggcacugagagcuauaacauucccucauaggaauuuucauuuaauucugaggucuuuuuuuuuuuaagcuucccuugauuuauucaacugccuauuuauuauccaauaaucuguuguucaaucuucuuuagucuauggauuucugguuuaauguccuuaagauacaggcagaaugcaaucagauucugugucaggcuacagccugaauggccucuagcccagcuugcaguagaggucuucuccucuggaaucucacgauccagguucuaaugucuuccuaucucucaguaaccuuagcuuccaaacugguaccagacuguccuguuaagcuuuucuuagaacacuguagagcuuuucuagcccaaaguuucaaacugcucacauucuuacaacucaguuccaaaggcccaagaaccucauggucagguuuaccaaguuuaguuacuuguugcugcaacaaaauccugacaaaagaaauuuaaggaaggaaggaaggaaggaaggaaggaaggaaggaaggaaggaaggagggcuuuguuuugacuggcaagaacaggcagcagcugcacgccgaggguccacagucaggaagcaguagauacugucuccuguauuuagcccaagccccaggaaugguaccacucacauguagagagggucuuuucaccucagguaaccuaguauagauaauccgugacauggacggguuuccauggugaucauagaucccaucuaauugaugguugauggucaagauuaaacauaaccuggccaucaaauucaccuaaaauaaggugacuaauuuucuuuuuuuauuuacuuguuggcgggguuguagaggcauacagccgccauaccauugcacauggggaguaguugacagagucagggucaguucuguccuucccacuguuggguuuugggaaucaaacucaggucauuagauuuggcaaagggccuuuauccacugagccaucuccacauucccucgccccauuuuagaaaucgccagugcaacugcacauaggcaguucuggugucuuacucccucccggcuuuuaaaaauauaaucuuaaauaccuuuuuuuuuuuuuuuuuggacaaaaucugacuuagucuccaucugaacagaccugcagcuaaucucaauaaucuuacaaagaaaacacagagcuggccaucacuuagcucugaguauugcaagcuaaaugagugugaugccaaguguuugcgcaaagaugagauucccuauuuccuaagaguuaauguguaccguuauuuuccucaaagccuguguguaaagaguugauuuucaagcaaccacuugaguacaccuaauccccccgaagaacaaaggcaguaaaacagguaguguguggugugugugugugugcgcgcgcgcgugugugugugugugugugugugugugugugcgcgcgcgcgcgcgcgcauuaucccaacacuugggaggcagaggcaggcagaugagaauuccaaaguucucuuugguuacauaguaaauucaaagccaacauggccuacaugagacccugugucaaaaauaaacaaacaaaacccaggucccacugaacagaaaauacauagcuagaacaguccagaaguauaaaaguauaaagauucucaaaaaauguauuugucgggacugaagagauggcucagcgguuaagagcacugauugcgcuuucaggacguccugaguucaagucccagcaaccacaugguggcucacccaucuguaaugggaucugaugcccucuucuggugugucugaagacagugacaguguacucacauauauaaaauaaauaauuucaaaaaaaaaguauuuguucaccacccaguuuaaguugacuucucaagcacagauacaugucacaugacacaggccuccuuccauucauagaaccuugaugccuggccuggcccucucagcccccuucagaucuggaggaagccuccuauagagccuguggugguugccuccugugaagagcucuucugugauggcccugccuuagcuuuucccaccuaaguuauaccuuucuccacagauggaagugaccacccacaagcaccacaagcuacuugauugacaccuuaaucucucugaaacugagacuaauuguucaaaaccuaaucuaauaacucuacaucaauagacauucuuuuuugcuguuacuaacaaugcuuuggucagagucuuuggacaccaaccucagagguuucaguggggaggacccuugaauuagcagugaggucuguaaggaacacguacuuggcuggauuaguuuuggcuagcaguuugcugcaagggcaaucaaaaauaugggaugcguuguuacuaugaagaagaaccuugggcucugaaugcccccacucucggcacuugagcugccuucauuaccucucuaaaccucccaaguuugcuuccugccaccaaaccaagagcuugccucugacacagagguuuuuggguuuuuuuuuuuuuuuuuuuuuuuuuuuuugguuuuucgagacaggguuucucuguauagcccuggcuguccuggaacucacucuguagaccaggcuggccuggaacucagaaauccaccagccucugccucccgagugcugggauuaaaggcaugcgccaccacuccccagcccugagacaggguuuaaaccgagggcagcucaccucaagcgucuaacuagaguaugccgaauaauugugaacaucagccuggcuggauucagaauuuccuggagacgcguagagcucaccuccguguguaucugugaaggcaucucuagaaggguuaaguuggaaaggccugccuuagauaaagugguaccauccugaaggcuaggggcuggaguauggggacacaggagggaacuggaggcacagucucugcugcuuggucaccuugcugugaucuguucugcucagccacacccgugggaucucaaaagagaucuucuuaaaaucaccuaagugucacaguugugaaaagucuaauagaaguuggucaauauggccuccagcacugagccagcccaguguggcuagagugaaagguagcaggagucccacgaugcacagcugcgugugaagaaaagaaggugcuuugguacauggcuuucuccugucacugagugcaggugggugcaggguuuccugcaguugagcacagccgucuagauauggccagaagcugaggcaggagguucaugccgagguguggggaaaauccaacagauaucagacaaggaagccgcugguggucuggcugagaagggggcuggggugacagggagugcgcacggcuguuauguggugggaaggauuugaauaagcgcaguguggcugauguuacagcauucccuguuuuuggguuuugaccauuccuucaggcuuggaauccccauagcucuuaccguuuccuaaugacuggagcaaucagguuaaagcauuuuggcuuuugccauguucccaaagcagcuugggaacaacuucagagcaauaaagguaaagaugguaucuuaguuaggguuuuacugcugugaagacacaucaugaccaggaacucuuagaaaggccaacauuuaauugggucuggcuuacagguucugagguucaguccauuaucauuaaggcaggaagcucggcaguguccaggcagaaacuuggaguucuacaucuucauccaaaggaagcccagagcagacuggcuuggaggagggucucaaagcccacccccacagugacacacuccuuccaacaaggccacaccuacuccaacaaggccacaccuccuaauagugccacucccuggaccaagcaaauucaaaucaccacagaugguaaagagaaguuauaaugguggggucccgaggccccagaagccaagucuuucucugaacuucugccuuccuuccacaggcuccuuuuacucuuaaaggcaggcauuagagacuugauauucucuucuccaaggugggucauagaagcagagcgaacacacauacucuugcccuugcccuuuccugaagcugaccauuauacuggucuggccuccaucucuggaagaagccaggaagaauccgcaaacaggccuugcuggguguuccccacuguggccacugauuuucuguguuuuguuugcaccugggccaggaaauccccgugaacuagagacuugguagagugauugacuaucaugcuugaaguccugauuucauccccagcaccccauaaaaacagaugugguaguauaugccugggauaccagcacuagggagucagaugcaggaugguugccacaaguucaaagccagaguggccuacauagugaguucaaggccagccaaggauagguagagacuguuaggaugaauguucaccaucacaaagccuaaaaucacauggaagaugaccuucugggcaugaauguauggaauuguccugauugugccaguugauucgagaagauugaugggugcugguggacauaaaaaaagccacaucacccacagugacacaccuacuccaacaaggccacaccuccuccaagagggccacccucuaauagugccacucccuggaccaagcauauacaaacccucacaaggggugaguaugagaagcagcaaaaggaaaagcaggcuaguggagaaaagcaguggaauugugguagcaggaggggaggagugugggagagcaagaagcagguucagacaggaaggggcugaguuuggugaaguugggaagugugagcaggaagggaagggagggaugaagaagugucaccuagcaacaauagcugucugcugguugagugucagaauucggcccuuuuaaguguaccuugcuacccuggcgauggaauggaaucugcuaucucauguuuugaucagccuuuguggguuuuguuccuagcauacauguuccugcagcgcucuguuuagacuuguucuuugggauagagggcagcugucucagggagccuggguuucguuugcagcaugcaugcuccuuaaaguuugucugugugucagguguuaaccuuuuuccaguuacugacaccagcugucucucaccugaugcugcuagaauguugaucucugacucucgggccuaaacggucugucuuuacugacugauaaaccauuggcuuccuaggcugccugcaguuuccuggcacugccaccuuugccucacuugauacaaggucgagucaaugaguggguguggggcuuuggcugugaagcccagcugcuaaguugccagcccuggggugagcacucggugauucuguccauuuugauugucucgaucggcagcccuuugccugaguagaauucaguugucucuaacaucaugaacuaugucaccuauaggacagcaaugguugucuggggcugagugucagaauccuguccuuuuauguguacagauauuugaaagacacuucagaugccaagagaaucgaaguuucuccuuccaaaauagcuuacacuuucuccugaccgcagaaacaacaugaauguuucuguuucgcccuggcuaccaugaaacuuagacccacacagcagagguugucugcacggauggcucccuccaaccccugagcuagauuuucuucccccuuugacuaaaaauuauaaauucauuuaaauguuuuugcugccauugacauaaaaucguuucuguuuaaaaaaaaaaaaguugugacagggucuuacuauguaguccuggcugaccuagaacuugcuauguagagcaggcuggccuugaacucacagggaucugccugccucugccccugggugcuggaacuaaaugcuuauaccccauauccaguggguuuuuuguuuuuguuuuguuuuguuuuauaaaaaaggaauucggagucuucagaaacgcugcuuauucuucugggcauggugaugucugugaacuugggaggcagaagcaggagaaucagggguucaaggacauccucagcuccacagcaaguuugaggucacucuaggcugcacgaaacccugucucuguaaaaccaaacaggcuagaaagauggcacagcaguuaaaagcacugguugcuuuugcaaaagacccagguuugauuccaggcacccacauggcagcucacaaccauuuuuaacuccaguuucagaggauuugaugcccucuuuuggccauucuguauaccaggcacgugguauacagaugcaggcaaaacaccaugcacauaaaagauaaaauaauaacaaccauguuuuguuuaucauuucuuuuguuuuugaaguuaaugauuacaucaucuccaaauucucuuuccucccaggaagacaucccuuauaucccuuacugccuuccaaauucaugaucucuuuuuacauuagcaguuguuacaugcauaucuguauacacacacacacacacacacacacacacacaacuaaauacauuuacuuguguguaugguuuuacggcugagcauuugguauuaaauaaucaauugauuuguucuuccccgaggaagaugauuucgcucccucucagcauucuuuagucgccuguguuuuguguaggguugaggucuugugggcuuucccucauccacuucagcaugcccuuguugucguauuuauucagcuuguguucaggcagucguguuggugagacuuuauagguguagcuucagacauuccuaggaaacccagccucaaaccaaaaaucaaucaaccaauaaauuaagccacaaagcaagcacaauggaaucccugugguuuugcuucuagacauggugucugccuccgaagaccagcuguguagcccagguuaguuucagacucacauugcuagcugcuguucuucuugccaccuucugccuccuaccugcuguagguucucuuuaaccacgggucggccgggugugguggcacacaccuuuagauccagcacuuggaaggcagagagaggcagguggaucucugagaguucaaggccagccugguuuacagagugagugcaggacagccagagcuacauagugagaaccugucuugaaggaaggaaggaaggaaggaaggaaggaaggaaggaaggaaggaaggaaacaaacaaacccaggguuaguuacuaaccauucuuucaccauuugaguaggcaggcucuggggcaugguggugaaaggaagaauaugagauguggguauaacagaugcacacuugaaucacuguguuacccucugccuacuaggaagccacaggcaggacccuccgacagcaaacccuuccuguaaugaagaggauaagggaggauggaaacuccuguucuccguuuccuuauccauuggcuggccucacuugcuuucuguugcuguuguauucuaaccaaaagcaggagggaaggaaaggguuuauuucaucuucuacccccaggccacaguccauccuggggggaagucagacaggaacuccaggaggcagccauauggaaggcugcucugcuagcccacacgccagcacaacacauccugggcuagcuaucuuucuuuuuuuuuuucuuuccaauuuuuuauuagguauuuucuucauuuacauuucaaaugcuaucccgaaauuccccuauacccuucccccacuccccuacccacacacucccacuucuuggcccuggcauucuccuguacuggggcauauaaaguuugcaauaccaaggggccucucuucucauugauggcugacuugccaucuucugcuacauaugcagcuagagacacgagcucuggggguacugguuaguucauauuguuguuccaccuauaggguugcagauucagcuccuuggguacuuucucuggcuccuccauugggggcccugugggcuagcuuucuuauacauaccucuaccugccuggcaggacagugcuuccugcaguaagcuaggcucuccaaaucaucaguccagacgaucccuuagagucacggcuacaggccaaucugaucugggcaguuccucaauugaaacuccuucacuacuggcuuuaucauggagacagcugaagcuaacuagcacauccauaaaacccuggaacuagcuguucuccucagaggguugcuggaaacccaggagucauggggcucacgcuuaaaaucuuagugcaugacugagacuggaggauuuugagauggaggcuagcuccagccacaaaucgaaacccugucucuaaacaaccacaagugguuaaaaggauuaaauuccagugauuucaaggaguguuuuucaaaccugaccgugcacauaagucacccugggguuggcugagauucuguacuugugcaagcucccaguuguuucccggauccaggguucuuggugcaaggacauaggguaccuggcacgucccuagcccuagacauugcaguccccucugucugcaucccccaucagcucgccucugcccuuugcauucuguuccugcaucagacagccauaagcucuguguucugucccagcgagcucccaggcuugcccuccaguccuuaauggcagaacagcugucucagcagaaaugaggauugucucgacaggacagauguucucacguccuaaauccaacacuaagcugagugucucggggacagcagaacuggugugacugacuucguaggagccaucacuauccacugguuaaugucaggugacaucugucugcugggacugggaaagacuccaucagagcagaguggucaugucagcagagaguggcagcuuguaguggguuuacauuaagucaguaaagccagggggaggggcugcagcaguugguccuucuuccugcaaauaguggugcagacuauagccaugacaggggaaaacccagugugauuaggcugagacccguuggugggaucgaugaagaacuagugcaugucacguauggucacuugaggguccacucucaccccaccucaaucuccacuaaguuuucagugcuacauuguuugugguugggcagaguauguguacauuaguauagccucugcagugggccuggguuuaucauuuguguuugucccaaguucuuucauggucagagcaggccaggcucaagucacagaaccuuccagagauaccaucuggaagagguaacaucuaaugggaaguucuugggucauuguggaguaugguaucccucaugacagcucacacaagagucuugcuguaaaaagaccaggccugguuugagaugcacuucucuguccaccauucuucauccacccguggccaagccaucuagacucucaaccacugagaugcugagcugaagaacguccuuuuuccucugaaauuagccccucucagauguucugcugggauaaugaaacgcugacuaacggguugggaagcaggugugugguuguggggaaggguugccaggccuuagccuugcuauuugguuucaagacagucagugacacgaccacuguuuagaaaggaucuagugcucucagguauaaaguaguccugccaagaauaguugcuuuaaaagagcacccuggcuccugccucaccuggcuuccucuuucaccaugugaucuccugaccucaugcacacuccuaccagaaagccaaccacugggcugagcugcagccagaaggcuauaccagaggcaaguggugucuugggccuucagagccgauugugagcuaaauaaaucuccucuauacaguacccagcuuauuuuguuaugggaacagaaagcuaaguaccaagcagugauaugugaauuuuuaagcuuuuacauucuuagcaaaaaguugaaaugauucaagaugggcaaagggauagacaucucggugaagaagauacccagauggucaaccugcacacgcagagaggcucaacguuaccagucacuaaggaauuacaagucaaaauccacaagauaccacuucacacccacaaaaugacuauucuaaaacagcagcagcaauaagcacaacagauguucccuagcaaguagagcagucaccucagguauuucccuuggucuugguggcaacuuggagagaugacaguguguuaucacaacuuggguguagguguugaugcagucugcuaaucuucaguuauucaagauaagaucgaaggguaucccaggauagccuaaagggucaucugacuuccaaaggagucaugccccacaugucgagaaccacugcccuuguacauucacuaccucaaucagcuagcccacuaaucauaggauucucaguuuuaccguacguguguguguguguguguguguguguguguguguggugucuggccuuuaauucacagcauagcccacacuggcauugaacuuguguacaaguauuuguggcuaccaugccuguucuaaaucuccuguaaagaaaaugcauuuuggauugacuugaacaaagcacacuuacuaauuacaugacccaggaagaauguugaaaaaaaacaaaaaagcauaaagcuuccuuccaagcccauguuaacagacaugagaguagaaaaagagcugaaugacaccaagagauaagcaugaaagucagagaaagacagucccugugggaugaacagagacgccucucaccggcaaggccuggcccacauacagagcaaacuaaugcagccugauaaguagggaaggaccuuccaccuauaacuugagcacucagugacacacagcuggaucagcaaagaaaaaccaccugucguccaccuccgugaacacugcugcuccaagcacaguggcaauggcuuuugaguggccuuucugaguuuagaaucuggauccaggaugagaauguaaucugugugcaucgucgucuguguuagcaagcaaaaugggcagaaguuggccgugggaagccuggacgagaguaugggaacauggggauugagggguucuugugcucuuagaagggccuacacuacacagaugaaugggugggcagacgcuuccaguuuauuacugaagucacacauuugguuaauuaaugaaagagugcuauaccuaugucuaauaaaugauuuuuuucaacaacuggcauuagaaaaucagagauguguucuuauauaggaaaaaaaaaagugacguuucugcacaagaagagcuccauuguuguaugaaauagaguaagcccagcugggugugguggugcacgccuuuaaucccagcacucgggaggcagaggcagguggauuucugaguuugaggccagccuggucuacaaagugaguuccaggacagccagggcuauacagagaaacccugucucgaaaaaccaaaaaaaaaaaaaaaaaaauauauauauauauauauauauguauauauauauauagagagagagagagagagagagagaguaagcccagauuuacugcugggagaacuaagaugggguaugcaugagaaacguuaccgugugaacagggugaagaaguagguagcuccagaagugaugaaacagggaccgaaagaagguagaggggaugcagagagcuuaaaugucuuaugaggaaaagcuaucaacccgcaguaaaaauugucaagagaaccaacaucccaucagauacaccagugcguucuagcuguuugguuucuggaaacuugggcaaagaaucacuuccaugauaagggaguacugagaugccugcagacauguugaccgcuaaaugucaaaagaaagccuguacacguuuuaaggccucccuaaauuugcccuuacgcagcauaggaagggccucaacucugccagagacauuugcuggccacauguguuuuauuuuuaagguuaaaagaauaaacugcuaggagauccuucuccaagauuuaagauuuuuagaauaaccuagaacugcuuuuuuuuucuguauaauagucaagcacucucuguguaaaauuuugacuuguuuuuccuacauaagaacauaacucucauuuuauaaugcuagucauuauaaaguacauuuauuauaagguauggauauguucauuucccgaucuggguagccuccagaaaugaugugguccuccaggaugcuggccaaacuguggacagcuuacagaggggaggagggccuacugccaugcuuugcugggucugcugugccacccugugguggcgagacuaaacagagccugucucccuuuucuucucucuaggaaggcgcuuuugucuacuugucuauaguaggaaauguugcagauucccaaggcuugauugcaucuuuauguaaguaauuaaaaacauuugcauuugaaaugucugaggaaauuaauggcaagaauggcugucaauuaaccgaaugucugcaucacauauugugugauuccauuuacacguccuguccagaagaggugaaucuuuagagacggauaacaaauuagugguugcuugggacuggggaugagaguagggaugagggggacagcggaugacugcuggugggcguggcuuucucuuugaaauguucucccuuagauugugucuauucaaaucugugaauguucuaaaauugggauuguaugccuugugaauuacaucucggcaaagcuauauauuaagcaguguguauacagcuggguguggcucaguggcaaaguacuugccugacauguguggaccccagugcaacacuguaaaacaaagaagaucgaaaggccugcaguguuuaaacuaggugcuuucccuauagauugucuauauaaauuuacuuuuaagaaaguuguucuugccaggcagugguggcucaugccuuuaaucccagcacuugggaagcaagaggcgggcggauuucugaguucgaggccagccuggucuacagagugaguuccaggacagccagggcuauacagagaaacccuguuuugaaaaacaaacaaaaaacaaacaacccccccccaaaagaagaagaagaaagaaaucaauucuuauucgguauccucagaggccagacgacggcaucagcucugcuggaguugaauuacagguagugugagaugcccguguggagcugcccgguguggaugcugggagcugaacucaggucugagaaaagcacauacacucuuaacugcugagccauuucuccggcccacaguuuacuuuugauuguaugcuuauaccugucuucuucuagauaauucuccaaaaguccuccugcccuguagagcugucaaguaguuuccccguuuucuuaacacucaauguaaaucaaccaacauuuacucaacuaauacugacuucccaguguguucuguaccgauacgguuaagucagugagccagacaccagcaucucuguuacuugccuucagguuugccaucugcaguucugcacugugugcugugugucuuucuuuuuccuuauuuuauuauuuuacucugcuuuuauuuuaucuugauuuauuuauagagugucuaggugugugguauauacaaguauauguggguguguguuuuauguucuuauuuuauuucuuuugugauuuuaauuuuuauuuauuuauucucugugugugugcaugcaugcgugugcaugugugcgugcccaugaaggacaggggacauguuuugugaguugguucucuccuuccaacacaugguccccuggaaucagacuaagguugccugccagacuuggugacaggggcccuuaaaggcugagccaucucaccaguccuaauuuaugauuuuauuuuauuaucuuaucuuuuaguacugaggauggagcuuccugaucgauuguguuguuaaguguguucugaguuccugaucgcuuguguuguuaaguguguucugaguuccugaucgcuuguguuguuaaguguguucugaguuccugaucgcuuguguuguuaaguguguucugaguuccugaucgcuuguguuguuaaguguguucugaguuccugaucgcuuguguuguuaaguguguucugaguuccugaucgcuuguguuguuaaguguguucugaguuccugaucgcuuguguuguuaaguguguucugaguuccugaucgcuuguguuguuaaguguguucugaguuccugaucgauuguguuguuaaguguguucugaguuccugaucucuuguguuguuaaguguguucugaguuccugaucgauuguguuguuaaguguguucugaguuccugacugcuuguguccuuaagugugaacuggguuccugaucgcuuguguuguuacgcgugagcuucaucccuuugccaugucaccuagcccuguuguguuuucaucaugcccugaaaucacgugcucacacaaaggucuguguggacacucuuacucacuaucagcguuagaaaaugucuaaagaauugaacugucucaguucagccauuacuuccgaacacaaaauguguccucuuuggucccuucaggccugugcugcggacaggcagagaucugagccccuuuggccagagucuugcuccaagauuugggggaaaugucuguauuaaacuucgcuucagguuggcugaaaaguauugaggcuugaggaccccgccugagccacuacccuccucauguguguucagugguccccuuucugagaagccaggcugcagcucccucccuggcuacccugcuuugggcaucacugaaagggaacagaccagguguggcccaaguccaugaaaagaugauugacaggcccuuccuacgucacugccuuuaggugaacugcccuuuauuaugaaagcaaaugcuaggcuggccaccuccuggccuuggcuuccggcugugggacacccuccucccuccuggauagcagaccaagcaggcagcagaggcggggcuaaggaagccuccuccuaccaugaccuugccuccuuucccucugaaccucugccuccagcaguugugagucacaaaauaaauggaauugaucggagcccccauucuuaacccagucacccccgugaugaacugaagauucauuauuuuguuugucagcaagccugcugguacacaccucuaaccccagcacuggggaggguaaggcaggaggauugcuaguuggagaucaggcugggcuacauaauaacacuaucugaaaaaacacaaagggcugggcuauagcuuggcugccaggcgagugcuugacuagccuucagaaaacaguagguuuggaggcgagugcuugacuagccuucagaaaacaguagguuugguccccagaucaaaccagaguaguggcacuaaaaacaauaaguaaauuuaaaacuuacucgccuugacaugcaguaaaccuggagggcgcccgguauuuccauagagaagaguuucuagccaucagcccucuugauuauggagaucagacacugugcuuguuccgguggagugggcuguagaguugucugaugaguccgaguccuucgaguucucuuaggggauccgccucaccccucccuguuccuaccaagcccaccgguagguacggugcugggguuuacugucuucccagaugcagccuucaugggucccggcuuagugcaguggccuccucccugagcugggguugaugucacaguggcagguccagagagucaggcaccuuccugacagcagggugaggagggugaagaaucaucagggcgucuuccugggucucauuuuuuaaucuaagcaucacuuuuguccuuccuagugugagccgcuuucagacagaccuuauggccucguggcuacauucucaaggcccagcagagacagcccccauaagaccaaaaaaaaaaaaaaauacauguuagauaaggggcuggaccgaugccucagcgauuaaggguacuggcugcucuuccacaggaucugggucaauuuuuaacccccacguaguggcucacaaccaucuauaguccagucccgugggauccacaccaucuucuggccaccaccagguaccaggcaugcacagggugugcacacauacaugcaggcccaacacccagacacauaaaauauauauaaccaucaaaaagaauggauagagaagugguuugggguuucuguuuguaaugucuaagcauucacgaaucucuucccuccuaaagcauugacauuuuaugaaaaugaucuuccuagauuuuggauaccgcgauugguuuguuuuaccucuuauuuauacauuuauauuuagggauuuuuucuuuucaauacugccuggcuuucuacuugcuacaguuauuucugaacauggcagauggcuugccaaaaucuaaugguguguguggccuuacauggugacuccucaccuguguggcccgucccuuaaaauagccuuucuugaaagaccuuagucacuagucccaaggcauccugucucuggccacgauuagaugagagcucccgacugcucugaucagucagacaucagagcucaugucuaaccaguuauaccuucucagcgucacaugcgggcaugccugaagggagagaggucccucuuuuacuuucaacauuugaguucgagaucagcuucuacgacuuuuaccauuuaaaaauuaaucaggugcucacuuuggcagcacauacacuaaaauaggaaccaugcagagauuagccuggccacuguucaaugaucauguguaaauucaugaagcauuccaugaaaguuaacaaaauaaauagggguugaaguggcaacucauaguuaagggcacuuggucuucuuacagaagaccugaguucaguccccagcagucauacugggcaguucacaaucaccuaugacucaguuccaguauaccaagcgccuuguauaaaaaccaacuccaaauggagcaagaaccuuccuuaaguccugaaaugcuaaacugccagagagagcuguagggaaaacaaccucaggauaaagacacgagcaaggguuuucugaacagacauccaacaacacaggaaauaauagcgagaacuggcaaaugggauugugugaaguuuaaauauuucuacugugagagagugaggagaggagagaaggaaagaaggaaagcuaaucugcaccagccauaccucccgcacagaguaauaacuagaaucuauaaagaacucaaaagaguaaguaucagaaucaaagcacccagucaaucaaucaaugggcaaauaccgugucucugugaaucuagaugacaagcuagauauugcaggaacgcagaacguugcugcuuagaggaggaaagagagccacagaaagggggaccagagagggcgguggggcagugagcaugggcagagcacacucaugugcuugucugcaacugucaugaugccgcccauuagucugcacacugccuaaaaaccuaacaagagacguuugccaguugagagacuaagcguggguguucugucuucagggaaagaguauggcaaggcugacacaagauggcuguauucugaucccaccguugugucuuuggaaauccugacuguuguccuagaugggcuccuggcguugguccucauuuaugccauagucaaggagaaauauuacagguaaguccgaucccguacagcuaauguccagggggacauuagcugcccaagugacauuuggaugaaguugcaagcacauuuguccacaagacaaagcuuuacauaagacuuaagacaagauuuaucgugaaaucucagcuaggaaagagugcucccagcuucugagaccuuuucuccaccacuuuuaagaggauuagcaguaacaaugaacuuuucuugguuccuuugcuauuauuuuggccccaugacuacaauugcagacacguuacaaauuuacauauguguugucucaaacaaugguugacugugagucgggcacaagaaaugaagccccuuuaucagcaaauuucauuuacucuccaugguaccuuuugaggaaggauuguugucaccuuuugcaacaggugaaacugacuggugacaagagccauacccaggucucuuugaagguccgaggugaccucacuagguccucuugagaacagugcaggggacagagcaguguugcuuccccaaggaaagauagcgccuucacugucuaagcugacauggcccaucaaagaggcaccacgccggagccuacaaacuucuguuguaagacuguuggugcugcucuagagaaaagcugcuguaacuccgaguuccaagcugugccuguuucaucucaugucuccuccccgcaggcacuuuguacagauuguccugugcgugugugagcucuauggcugcuggaugaccuucuuccccgaguggcucgucggaagccccagccucaacaccagcagcuggcucuaccucugggucuauuugguguuuuuuaauggccuguggguucugaucccaggccugcugcuguggcagucauggguagaacugaagaagagagauucccaagaggcuaauuuagcgaagaagcauaaauaaguucucagggcaacccauucugacgaucugcuuuccgagucagaauugaccagacauuccgaucugugcuccuuuuuuacaguguuuugaagcggccauuacagaugggcuggaagggggcaaacuuggcuguuuguuuuugguucuuugauuaaaugaugauaugaagagaacuuggggugugacuuaguaguguugugcuugucuagcauucacaaggcccugaauuguucccuuaacacgacuagggggugcugaguacguucucaccugucacagaucauauuuaaugagacgcucagucauggcuggcaggcuaguuaugccguguuaauaagugagugucaaagauacuguaaggaguagcaucaauguuuacuccaaaaaaaaaaaacccaaaaaacaacaaaaaucaaaacccuuuuugcuucagcuuuuauucuucucuguggucucgggguuagugacggaaaccaaaagcaaaaggaguugguucuguguuaugccuacaaacuucaaauugcuucaaauuugugugcccaacagagaacgauagugguaaucuggaguaguggcguccagguguacuugggaagcugaggccgguggggggcuugaggcuccuuggggcgauauuguaauauucauuugaaagaaagaggcagaggagggagacucgauguaaggggcagagggugggacuguggcaacacacaagaaccaaaaaaaugugguaaaucuuaacaguacaacuauaagauaaauuccagaagauuccaugaagugcaguuugugccuuaacagucuggguggcugaggagggggggcgcaagcuugguacagaaucuguacccagauggggcaggaucaugcuggguuucaaacccugguuccaggaagugacugccaugguucucuuacaggugggagaggguacucacaauacgacuuaacccaucccucugcucaggagagcacccacaccuggacccacgcccgcuucgugguacugggcacuggagccaggccgcucacucuuugccagucuggcugcugguccaguuuaggucucucuuccccuucaucucuuauucuuggucguuuuguuaaacguaugaaggucagugucuccagcaugcuaggcaaccacuccagacuugcuacccacaauccuccugccucuaccuuccaggugcugagauugaggcguaugcccaagccgcaguccuaaguuugggucuugaguguguugcucaucagccgguguugcugaagcaggagaggcggucuuagguggggccugugaggaaguugacacacuaggauuugcucuugaagggaugucaagccccgccucucuguucuuuaacuuucccgccgccaugaaguaaauagcuuuacaaaaaaagaaaaaaaaauuguuuuugagacagacuuacucaguggcucaggauggccucaggugugagacaguaacccucugaagugcugggaucacaagaggccaugccuggccgagugagcagcucugcucugucacugugccuaccaugacuuccugugccaccacaggucuguccacagcaacagggccaagccacuguaauccgaaaccacauaaaccaugagccaaauuaaaccucuccuucuaaguugcuaccuuggguguuuaucucagcaacagaaagcuuccacacaacagaaagcuuccacagaucaucugauuuagacugggacugugaaagcaacacccgccccaccccacccccgaugguuuuuaugaucaguguucugugggcacaugugugggccuugugccgaggcuugguggcaggaaccuuuacccuccgggccauuucacugacuccucaaauguggccuuacuuuauguuucaugagcuucccugguuuggggggcggggggaggcaguuggcaagguggcagccaaaagacagacugaggugggaguggcuccagugguggucguuggucaggccaugccucccuuggccgaguccacccugugguuuggaagacaucccuuauaacugagagacaccucacuuccagguccagacaucacagagugucugauaggcacacucgaaauagcgguuauggccuggcguugguggcacccaccuuuaaucccagcacuugggaggcagaggcaggcggauuucugaguucgagggcagccuggucuacagagugaguuccaggacagccagggcuacacagagaaacccugucucgaaaaacaaaacaaaacaaaacaaaacaaaacaaaacagaaaaagaaauggugguuauuugucaccacaaauguuaggaaacaaagguucacacucaugcugaauuaaaacaaaaugaaccugcuacuaaugacaucacagaagaccaugccgugagaaugccggcuauaugauuuuaugucuaaauuucccaaacucguaaguugagugucccugacuggaaaugcuuagggcagaacugcuuccugacuguuguauaugugcguguuacaugacuguuguauaugugcguguuacaugggcugcacggugcacauccuaaucuggaaauccaggaggagccacccaccgccuuggagcuguuacauuaaggcuucucagauugaacugcugggugguguuuggaauccaggcggagcugccuuuggggagagccuaccacuaggagcaccugcggugcugaaacggucaucuccgugagugcuagucacagugugacaguccuuugggacgcacacuuaggaauucugcacuucucacuacaugugucguaguaaaauuagaaaagcugauuugaucuucuaauuugucuuuuaagaaagugucacaugggcuggagagauggcuuagugguuaagagcacugacugcucuuccaaagguccugaguucaaaucccagcaaucacaugguggcuuacaaccaucuguacagcuacaguguacucauauacauaaaauaaauaaguaaaucuuuuaaaaaagaugguauaacccaggcuggccugcaggacacaggacaggcugcaguccccagaguaccuggccucuucucccugaugggugauugcuaaggaagggaaaugggggcucaggcucccauugguauccaagaacagacacgucccacugucaagugugggacacucuaguucucacagaagugacuuggugucuugaccuccagaucccuggcacagaguacagcagagagcugacaggggacaugcauuuuuagggugcauuuuucauuuaaugcauuguaacuuagccuuucuuuucuuuuuggaaguucaguacacucugcuggcuucuuaguaucaguguggggcaaucccugcaaaaugcuccucuaccacagucccaucaucucaagaauauaaguugggcuggggagguggcucaguuuguagugucugcccugcaagcaugggggcuugaaguccugaccccccagcaaccaugugaaaaaacagacguggcaguaugcuguguaggccuagggguggaaggacagaaacaggaggguuugcuggguagccagacuggugggauuggugagcacuggguuuagugacaagcccuaugucuuaguuaggguuuuacugcugugaacagauacaugaucaaggcaagucuuauaaaggacaacauuuaacuggggcuggcuuacagguucagagguucaguccauuaucaucaaggugugaguggggcaacaucuaggcaggcauggugcagguagagcugagaguucuacaucuucaucugaaggcugcuaauggaagacugacuuccagguagcuaaggugaggguccuaagcccaugcccacagugacacaccuaguccaaugaggcuacaccuccaaauagugccacuuccugagccaagcauauacaaaccaucacacccuaccucaaaaaaaaaaaauuaugcuagagcaauugaaggcacuaagcaucaauguuugguuugcacacagauguauacuugcauauguacuggugaacaugcuauguauauacaaaaauaaaauuaaaaucuacagcuggagaguugacucagugauuaagaagaacacgugcucuugcagaggaccuggguuugauucccagguagcuugauuccacacaguagcucacaacagucugcaaccccagucucagggaaacccagugcccuguucugacacacacauguuacauagacacacgugcaggcuuucaacauucauacacauaaaaugaacaaaaaauauuuuaagucuaaauuuugcucagaaccuuaggaaucaguugucuuaacuucucccuaucuguuauauggaugccaaagaaacuaggaaccgugagaucggcagaagcaaucuucagguuguagggggauggguaauuagaauacaugugacaugaaggcaggaggggauggguaauuagaauacaugugacaugaaggcaggagggcuacugagggagggaagaggaacagcaggaggaggacaaacaagggagaaguaugugugaaaaagucagaaggaaacccacuacuugguauauauaauuuuuaacaacaacaacaaaaguccugggcuggagauguagcuaaauuggucaaguguucgccuagugugugggcuaguuuuauguuaacuugacauaagccuaagucauuugaaaguaagaaaccgcaauugagaaaaaugccuccauaugaugggggucgggggcuauaggcaagcauguagggcauuuucuuuucuuuucuuuuuuuuuuuuuuguuuuuuuuuguuuuuuuuuguuuuuuuuguuuuuuugagacagcguuucucuguauagcccuggcuguccuggaacucacuuuguagaccaggcuggccucgaacuuagaaauccgccugccucugccucccaaaugcugggauuaaagacgugcaccaccaccacccagcauguagggcauuuucuuaauuaguaaccgaugcaggagggcccagaacauugugggugguaccaaccuggggcuagggguuaggauuguauaagaaagcaagcugagcaagccacagggagcaagccaguaagcagcaccccuccauggcuucugcaucaacuuccuccagauuccuggcuuguuuggguugcuguccugacuuccuuuggugauggacuaugauguggaaagguaagccaaagaaaccccuuccuucccgcuugccuuuggccaugguguuucaccuagcgcauucaaaguccuggauucgauccuccuugacacacaccucucaggagguugaggcaggaagaucagaaagucacucucagcugcauagacaguuuggggccagucuaggauacacaagacaggaagaaggaggaagcaagaaggcuuggcuuuuccacccccacuugcuauuauuaauacucuaaacuucucuuguaaacuccucccauccagaaagcauugagcagaugucuucauacuucaucugagaagagucuggguggcaccgugaccuuguaucugucuuggcuccacuaaucaauccucagugguaauaauuaauaccugggcuguaaaagcagucugcauguugaggugugagaa

SEQ ID NO: 7510 - RNA, 7724 nt, Mus musculus
aggcccccacuccuuuguuuuuuggccuuuauggaaggagcuucaguuaagagauagagaucauccuuugcguuugggcuaacaguggaguacaggcaggacucgggcaaaacggaaaucuagguaagagcgcuaaggggcccugcuggguuuggaggaacucaagagaaagguggauuagcuccguagaaugacacaaguuucuaaagagcuggaaguuuaguuguaggaucaggcuuauaaauaauauauauuuuguauauaguuuagaaaaugaagcuaccuccccgaucuagcagguuuuuaccccaguuuacgcuucacgugucaagugguauacauaaacgguuacacgugccguuggaauuugaggaaacccuccacagcuucgucuugguuuuccaccuuguagaaaaccuguucauuuagaggauaaggcucuugguuccacuguaacguucucgugaggacuaaguuagaaaugacagggauuggucuuaggaaugguguagccgggaccacaggcaaugggcggaagggggcaagaggggcuuuuccaugacuuggaaccgcgcuuuccccaaauuugcucuccuaaaggcccaggccuucccaagcgggaguagacgugcuccuccagcacacaucacccugcauuuaccggcuuucaaguuuggauaggaaccaucuuuuucauccucuguaaccacggucuccgcauaggagguggaaaucagggcgagauauuuuauuuuauuuuaucuuauuuuauuuugguuuuucuuuauuuuuuauuuuauuuuuauugauugauugauugauugagauauuuuaaaaccaguuaaaaguuccugccucugaggggaaccguaguagugccuuucuuuucuuuucuuuucuuuucuuuucuuuucuuuuuuuuuuuucgagacaggguuucucuguauagcccuggcuguccuggaacucacuuuguagaccaggcuggccucgaacucagaaauccgccugccucugacucccgagugcugggaaguagugccuuucuauaaaguugggucaaugguuuucuacccagagaucgccgagcccgcuggguccugaaaaguaggcaaaguggugugaaggguugggcuguguuuuuguuuuuguuguucuugaaaaaugcaaguaacaacaacaacaaaaauacagcaauccaaacucggcgcgugggcgucaccagagcacuuauccagaggcugggcgaccuagguggugcgcaggcgcgggacagcgggaagcagagggcguggucgccguguccauuuugcaccggcgcagcccggccccaguuggcugguggaggugagcagugugcuccgaguagggaccgggggccgggagucgcuggccccgcugccgcggccgggggacaccugcgugggcggugacgggcggcacggccuggcggcagcggugcuacugucgcggucgggaaggucagcgcgccgcuggggaggcccccuggcuaggagggggccaagaaugcagaucugugccugugacacucuuucuccuuucucuacaguguucuccaguuuuaccgucaaaacgugagggaaaacgaacuggcucucuccacagaaaauauaguaagcuugccaaaagcauauacuugccuggaacaaagguaaaccguauuauuuuucuuuauguucugguauuuaugaaggggaaaaauacccgauuuuauuaguccuaggaccauuccagauggaaauaaaaagaauaaguauaucuucaccaccuccuuuaauaauagggccuuuguucuuuucauauuucaaaacucauggauucaaaaauccaugcuugccauucauuuuuuugguaauuacuauauauaauuuaaaaaaaguaugcucuaaaggaaacaaauccagcaacauuucuucugugugguuugucuuaguuguccagcuacuggggcuguagagcagggcuuuagauuccugcagcuuucuagacauuuguaugaggagugcuuuuaaaacagaaugucaauauauaggcauucuuugugcuaggacucaauggggcuauuaaucaauuaugcccccccccccuuuuuuuuugcuuuaaauuacaccuuggaguaugcuaucacagucuacccgggaacuacaccucugcccuauuuaaugcuaagcaucaguuucacacagccuaauaucaccugaaaacaaucugaacugaguaauuguuuuucagauuggucuguggauaugucuucauuuacacugggcacacugugggcagcucuaucuuuaggcugaugaaccagcuaagcaggagcccauuauggacaggcagccauccacauucuugauggugucugcugguugggaguggguuccaugguggaaggcauuguuguggggaauagagagcaguuuguuuugccuugaguuccugcucugacuuaccucagugauggacugauuguaaccugcaagugucaguugauuuuggucaguguuuugcacugaaaguaacagguccaggcccagaagacccaugucuucagccuuccuucccaacuguucuuuccauccauguauuuucugguaggucuggaaguugcucacucugggcaagcgcuuucagugagcugcaaccucagcccugcucugugaaagggucucugacccaccgcaguucaugcuucuguguuucugguacccuaguuguauuuauuuucaaguaauaugaagauaguauuguaaagauccucauuuuguaaaagauaaaacauauuugugaaaacuauaagagauuuuuagaaaucuauggaguaaacuuuguuuugggaaucuaucccagugccuuuagcaugcuaaguauaccucugccauuagcauauucucggcuccuaacauaggaaaaucaucuuuuuucccccuuuuugugacaguuuccuaguuagaccaggcuggccuugaacuaacguaucugccuuccucugcauucagagugcuggguuuggcuuaaggugucugccacuacgccuggguuagaauacuaaauuuuugacuuacuuucuggagaguuuugaauccuagaacuuugcaaauucaaggucugugcuuuggugguagaagggcaaggagagucaggccccauguuuuuccuccggaaguugggggcuugguuagcuacuuuggguuuaagcccagaacuuacguuuuauuccuaccccuuuguucucaagauaagugacgcaugcuucuaguaacugauuuaaguugguuuacguuuuaaguccaggcggaaacaguaagaaugagaccuguucaguguuugcuaaggugaggaaauacguggagagacggaguguuuuagaaaccaggauauguuuguacaaacuugugugugugugggucgagacugguauacacaccccaacacucccacacgccauuuuuacuuuuuuuuuuuuuuuuaaggcaggguggcuauguagaccaaguucagguuaucagucuuccucccaagugcugggauuaaagccaugugccaccaugugcagcuauacacacucuguuuagaagaacacuugacaaucuuuuucaaguugggugucagugguacacgcuuuucaucccagcacuugggauccagaggcagguugaucuuugaguucgaggccagccugggccacaaagugaguuccagcacagccagggcuacacagaaaaacccugucucaagaaaacaaacaagaaagcauagcugagucagcaagcgaucccacugcaaacaaggaaagguggagaagacugaggaaagacacgaguucuggccucggccuugugcaagcaguguacgugcauugcacacacaugccacagagagaauaagugugccugggcaugugcacugcucagugguaugcucugcucaucgugggcacugcuggaccuaaucccugucuccagccacagaugguugucugauggccaguagagugccaaguacuccauccuaguuuguuauuuugguaauauuuuuguauuccucaguaaacugacuaaagaaauacuuauuacugauuuuggaggucuuagagguuaagguacauuagcaaauuugaauugaguacuauauauaauauacuacauauauaaauauacauuaguacuauauuagaaaugaaaucagaggucucuaaaacauguuaaacucauuuaaagcaacacugauaaaagucauuguauguuaccaaaaaaauaauuuaguaaaaauagcuccccuacuuugaaagcgguggcauucuuuauagauugacagcuuucugucuuugggggacuugggagugcugcacuggugauuagccuagggcaugucaagugugcuugcuaacagcuuuugagcuauauucccagcccuggguauuuuguuugauugaaaaaaacuguucuaauuauuuugauacacgcacaagaaaaaucugguguuacacagauuuguaguugauaaagggaguagaaauguuuugagauaauuuguuguucuucuucaauacuguaaccaaaucucaacaaauaguauuuugucauacaguaguguaugagaucauacuuauuuuuuauuucugcaguauugggaauugaacucagggucuuggcaagugcucucccacugagccacacuccaacccuuucuuauauuuuaaacaagucuucuaugauuuauaacauuauuacagagaccuccaaacauugacauauuucauuauauaauuccccaauaacccucacauuuguuaacuuuacuauuuaucagcaucuuuaaugggaagauuauaaguacauuuugcaaaaauucaaauuuuaacauaaaaacccagccuuuuuccuuuucauggucaagaaguaucguguuucuggaaguacccagcucauuuuauucauuuucaggauuugucagcucccuaaaucuacauacugcuggcuuccauuguuuuccuaauagcagcagcugucucagcuuguagcugagucacgugagccuguacuccuuucugaccgcacccacuggccacacaagugccuuuguguauaguucaguauacaagaauagggauugauaaaaugaguaauuuuugcagcuucaucaagcuuuuauuauuuguuucugaaauagggucucaugguccauacuggguugguacuugcuuugaagccuuguuggccuugcgcugauauccuucuuccucugucuuucugaguauugggauuauaagugugugcuuuagucagccucauugauuaaucacacaacaguucucauuggaaggcuccucccacuuucguuugugugcucuggaagaacacugauuggguaguggcacagcucagugcuucuuauagacuuguuugauucccguuaaaguuccagcagugucuaccuggcuccuguagcuuugacacaguugguaaaugucagucgguguagcgcaucauuaugagaaugccuuuggcuucaccagcucucuggaagaggaacacguagguuucugcccgagagagagaauuaaugcuguaaaguagaagagauaggaugaguuugauuguuacagccaaccaacagaaauauaaaaauucucccaggcagcaacagugaaaaucuaccucauuuaauccucuagucaagguugaccuacaacucuugugcuucuuacacuaugaaucaaagugaucaaggccacuccuuuccacccucugauuugcccacaagcccuuugauaccaguuugugggaggacauuaaacuaguugauguggauaaauuguaaucuugucuuugaaauagaaaauaugcccguuuccaguaaaagcuagaagagagcaugcuuggauuuauauaugugcuucugucuuuaaguagcauaccauuucauauuugugggcccgaaguaaagagccuauucugucacagacagugagacucuuuguuucugacuucuagaagucagcucuuguuuuaaaacaauguuggguccuguuggcucaguuugcgguugucccaguccuaacccuguuucagcaaaggcuguuguugggaggcugucacaaaggccuugugugcaggaguguucuugucccagugaguuaaaugugccuuagcauccaggccuuucccaagugucucccauauauucuuugguuauuucaguaggagaucaucuuauugggaaagaggauguuuucuacuuauuccagaguggcucaccagaacuaaauguuuucuuucucuguggcaggauguaauggagcugcuugaagaagaccucacaugcccaauuugcugcaguuuguuugaugacccccgaguguugcccugcucacacaacuucugcaaaaaaugcuuagaagggcucuuagaggggaaugugcggaauucccuguggagaccaucucccuucaaguguccuaccugccguaaggaaaccucagcuacuggagucaacagucugcaggucaauuacucccuaaaggguaucguggagaaauacaacaaaaucaagauuucucccaagaugccagugugcaaaggacauuuggggcagccucucaacaucuucugcguaacugauaugcagcugauuugugggaucugugcuacucgaggcgagcacaccaagcaugucuucucuucuauugaagaugccuacgcucgagaaaagaaugccuuugagucccucuuucagaguuucgagacuuggcgccggggagaugcucuuucccgcuuggauacuuuggaaacaaacaagaggaaagcccuccaguuacucacgaaggauucagauaaaguaaaggaguuuuuugagaaguuacagcacaccuuggaucaaaagaagaaugaaauccugucugacuuugaaacuaugaagcuugcaguuaugcaaaccuaugacccggagaucaacaaaaucaacacuauuuuacaggagcagcggauggccuucaacauugcugaggcuuucaaagaugucucagaaccuauuauauuuuugcaacagaugcaagaguucagggagaaaaucaaaguaaucaaggaaacuccuuugccacacucuaauuugcccacaagcccuuuaaugaagaacuuugauaccagucaguggggagacauuaaacuaguugauguggauaaacugucuuugccgcaagacacagguguguucacuagcaagauucccugguaccccuaucugcugcucaugaugguaguucugcugggucuccucauauucuuuggccccacuguauuccuggaauggucuccacuugaugaauuggcaacuuggaaagacuaucuuucaagcuucaauucuuaccugacuaagucugcugauuuuauagaacaaucuguuuuuuacugggaacagaugacagauggguuuuucauuuuuggugaaagaguaaaaaauguuaguuugguggcacugaacaauguggcagaguuuauaugcaaauacaaacuauuauaaagucuuucaauuacacaguucugcuucuugaugggauuguuggagaacacaggaauaauucagaucugaucaagauuucagucuguuucuuuuuaaaguauuucuucaaugucauuugaaguuuaguaguccuaaaccuucccuuccuucuuaaagacaguuuuaaaauaaauacuguuucucuaaau

SEQ ID NO: 7511 - RNA, 80352 nt, Mus musculus
aaugguuugccccaaucacuccuguaaccaaagaguaaguccucaagaaccgcguucccuugucaaggagucggaugcgcaaaugccuggggcuuuaagcagcugggaaagcgagaaggaagcuagcgugaagcuagcugcaccugcggauccagagcguccgccccgcgcuucccgcgcccagcgcuuuugccugggagcugcugcgagccacccccgcaccccucacgcccguuggccgggggagcgaggccuagcaagcggacgccugcgggagccgccgcacguagggggcacagggacuuguccaggccgugggcuccaaagcgaggcccaaacgcgcgcgcucucugcaaguagggcgguggcgcucccagagacggagggagguagagacgcccgagcgagcgagcgaacggcacgcucggggccacuccgcgcgcaaggcucggguccgggagaaauuccccccccccaccccccgucgaguggucagagugcggguccccaggucgugcacaccacccgggccggcgaccccagccaggagcaggggagcgccgcagggcggaggccgcugccacggaaccaggcgggcggcgcacagccccggggagcugguuuucccgagagggcacgugacgggguuggcagcgcucgggcccgggcggggggagggggaaguggcgagcaggaggcccgggggcgggcggcuggcgcgcuguguacuuaggucgugugcuggggcuuuucucuccugggagcgggccgaggggcgggggaggggccaccgcuccgccuucuucuuuucgcaauguugacgcaaucuauaaauaguggaacaaaaggaccaacuuccucggagcuuugcugaaacugcacaaaaaaucgagcugggggguucccugguccccgauguuggggcggagagcgcggcgccgagggagggggcggcgcagaccggccuaggggacaccuggucgagcgcagccgccgcuccgcucgagcccugcgcuccagugcccccacuggcuggagagcucgcccagaccgggggucuuccuccgucgcugacaggucagugcgcaccgccccuuucgacucuaggcugcuuuucucccuccuccagccuccacuuuuagaagggaaccggggcgggggcggggggcgguaaggaaauagaacgaggagcagcagcgacagaaggaaaaaaaaaaaaaaaaagcaaagcuguaaccccggcgugcacggagcgaagagagugaggggcuccaggaggagaucugcgcguggcccccacgggagacggagcuggcagagcaggcgggccgcagggugagaggagggggcuccccggaggccgugcgcgucucucgguccccuuugaacgcagaccugcagaguccgccugguccacggugggaggaaugaguggagaauugucgccgccgccacugcacccccgaggcccacgcacccugagcgccuaaauuuggggacagggugggaggggggcacccugcgcucagggagcaaggaccugaacucaggagcccgcugcuucgccguuggggagggcggagcuggcgcuguugacagcggugagggagcagggagggcgaaaguuggggagaggaggcgggagaggugggagucuaguugaaaaggggggggagggagcgcgcgcgcgggauucugaggggcguggaucacgugaugggcaaccacccccgcuacaggcuggcgguagggugacgucaccacccugccugcaggggguggcacuuccguuuucuccccccccccaccccccccagggcugcugcucccaagcuucugcacccuccugagggugggcaauagucugaggucaucaggugcuuuggcaacaaccgggaguuaggcaaugagggcuaggucugaagcucaagccgggccgccccucgacgcgccccauugugugagcagugggcgagggcggugccgggugccgggccccccgcggcucccagcuccaaaagggcggggaggacucuguuccgucaaggcggagucuggccacuagcugguuccugaguccagacuucgagaucccagcgacuagggucuuacucgccugacuagcccucugggcgccuggugguuaggagccaguucuauggcucugguccguggcccagcuugauggguguguggucaaucugucaccacuggagcgacucaauuccagcaguccuuaagagcuauuuugaguaaacucuggguuuuggugacucagcucggugagcggcgcuauuuauagguagaugaguuaagagcggggaaauacgcuucgauaggaucgguccgcccuauuauagcaaagaucucuacuaagaagcaacaauuuaaagucuuaggaaagaaaaauacuugguucuuagaaucuguguuguaaggagaagacuuagaacagugaaaguggaacauuucccggaguaaauggagaauuuggggacugucaugaccauuaacuggcuuuucgguguagguuacugacucuccuagacaccugcaacauagaaugcccauauuagaaugauaaaaggggaaacuaaaugcuggcaaagucccugcacuauauucuguaacaggaagggaugugugauauuuaucuagugucaaaagucuggucuggugggaauuuuauguuuaucacccaauuucuuccaagaaaguacaacaaaaacgugugcuuuucuucccuaguguguaaaugugccacuaguacguuauugcuuguugggguguuaugauuuuaauuuucacauucccacauuccuucagccuccacuuuagaaauccaagaggcauaugcuaugagaaagauugugagguugucugucgggugggaagaguugagugagcucuccuagccgcuguagcuuuccauagguagugucaccuggggugucucuugaaagaaagauggugacuuccugagugguuaggucagcuaagaauaaaaguguccaaaagacuacagaguacacacacuggggccugcaagauagaugugcguacugguacgggugcugggugggaguugaaaagggguaagagggaagcuggacagauggucagggccuucaugauucagaauaaccaugcugaggaauuuguauuuguaccugaaugggcauuuuuauuuuuuuagccuuuuaggaugaacagauaugcuuugaggggaaaaaaaaagcaauggguggugguugguuuuuuuuuuccuccuacaaguaaacagaaaauguagcacaggauuucaaaggguuucucugcuuugugaugccucagcucaaaaccugcaagaagggaaaaccuccagaagaugucugauagaugugacaauuggucacauaggccuugugaggaucugggaggcuuagagaugggauguaaaaggauugugagcuaagauagaaccugcuagaaccaccugccauguacccaagagaagucauuagcuguuugaggucaagggaugcacagucuugucuuugggugaguaagaagguguggaccucgggguaaacacauuuuuuacacuaugggggaaccuuucccagggagguugguguaaagucuggaucucugaagucacuaaaauauaagugguagcuaaagccaugggggaggcuaagaggaccgggaggcugucuaguuagccagaacuccaaggaacacucacacuuagugcaagucuagagcaggaggaggcuuuaaaggacaaggcuaaguaaagaaauaguguccuuaguguauggcuguaguccuccauggcucuaauccuuggugcauggcuauaguucuguaggccauccguccugcuaccugaaaauaaagagaaaccugcugcuuccuucauaagaccaaaaagagccaggcaugaugcuuagugccuguaauccacucgggaggcugaggcaagaggacuacugugaucucaagaccagcaugcaauacagacuaugacugucucaaaaacaaugggacuggaaagacuuccacucuuaguggaaaagaaagcauaagaguugcauguacuuuucccauuuucacaguaaaugcuaagucaacaguuaccagguaaaugauuggcuuaauauaucuagagaacuaaaaauaacacucauaucaagguaaauaaaauguucuuuauaaccugguaucuuuuacaguuugccuuaagcuucuauuauuuauguaucuuugauguuagauuaaauaugcuucucuuuuagagauaaaaauaguggcugggcuauuuuaauaauuaauauucuccuaaaggcaacucagaauacuuuucuaguugcauaauuauauuuacgagucaaaagcccuauacauucaugcuacacacauuuuaaaauaaguacauugcaggguggagagauggcucagcuguuaagagcacguauagaucuuccgaaagacuggaguuugccucucagcacccaugcugggaaaauugccugugacucugauuccagggacaccugguaccucuggccacuguggcaccugcacgcacauaugugcacacucgaaucacacacacacacaaauacaaauaauuaaaacuaacaaaaaucuuuaaaaaauaaaaacacccauauagugagaaaacaugagucuuuuguagaucacuugaugauuuuuuuuugaaguagcuucuuaaaaaauacuuuuuaaaguuucuuauacagcagugauuuuuuuuuaauggacacagcauuagcauuacauuaacauacuuuguuaucaggccccaaaccuucugacuucucugugaugucacagcugccauggaggcagcccagaggaacugaaguaaacacuuucagaugacauaaugcagcccugaaggaggaacaaccucaaccaaacucuacccuauagauuugcacaugcaguuuuuccauaugccggaaugcuugcaaccuuggugugauggcuagucuugguugucaacuuaacuacaccuggaauuaacuaaaacccaaauggcugggaacaccugugagggauuuuuuuuucuuaauuaaaucauuugaggugagaagacccacuucuaaucuggaucuuugagauagaaagauauacaucuaauccagauauucugaggugagaucuaccuuuaaucugggccacaccuucuacuggcagccuauaaagagaaccugaaaaacagaagcguguucuugcucuccuagcaagucaguuccuucacuggcaucagaccagcugaggcauuuagucuugugggcugaacagcuacuggauuuguggaucuuccauugguaaacagccauuguugaccgagguggaccacagccuauaagccacucuauauauacacauaccauucugaaguucuguuccucuagagaacauugacugauaagauuuuuuaguaccagaagugagucuagagcaucagaaguauacagaugaauuuuuuuuuuuuuuuaaguaucuggauuuaggcuuucuaauuugccgacgaauuacugcagccucuccuggaaacuccgagauuacugaaagccuguggugugaacuauuuuacaagcuuaaggggacaaauggauuggauuaucuugauucaccaguugugagaagcaacagauauggugagucuguacauaaaacuggacaaaugaggacgcggguugguuguuccuagcaucucuggauaaaucgacaaaggaaaggaaugagcucugugauuacaaaacaaaacaaaacaucuagcauuuugaaauauguuggaggaaaaugaacccagugauuaaauggucagcuccagaugcacagaagcagucuaaagguuuauaagggugcccuggaagugaaucugcucuccagcagccauuacagcucccauuauagaaaaaucaaacugaagcccucguuauaagguuagccaaauuacaaugaaaauucaaaucauagcauuuggaggauaucagcuguuaaaguaagggcauuaacugguaaagcauggauccuguaauaaggggaggaacucuaugggaaugggaggguccuauugaaucugagaucucugaacccugagauucuccaggguuuuaucucaccugaagucugcagccucagcagauguaccccugcccucucucccacccccugaaauacugccuuuucugacuuugacuagggaaguuaaugcuucgucgucugguaacccagcagugaguuucucugagaaaaaugacaggugagacauuacugcuaucccucaguacccaccaauaguugccucuagauccauagccaauuaagacugagcaggccccggaggggagcuagaaaguaguccaugaggaggggcgcuauacuacuaaagagcugaaggaguguuaauuuauucaggcagagaucuggagaauaugugugggaauggauuucaaggcuguuggauaauggugaaaagaacauaaaacuggacccagaguuuauuaauaugggcccaguggguugagauucaaguuuaauaugggaguaagccaguaagcagcacccuuccuuggcccaugcaucagcuccugccuccagauuccuacucaauuugagucccugucccaacuuccuucaaugauggauuaugauaguguaagcaaaauaagccccuuuuccccucaacuugcuuuuuaucaaagcaauaguaacucuaacuagggcuccuggcuacagaauuacuacacauuaacaaaacacaagggcuggaaagauggcuuagcaguuaguagcacugacugcucuuccagaggucuuugaguucaauucccagcaaccauaugguagcucacaaccaucuguaauggcguccaauacacccuucuggugugugucugaagacagcuacauuguacucauauaaauaaaaauaaauaaaucuuuaaaaaaauacuuuacaaaaaccaauaacaugaaaggaaaccggaagugggaccaucuaguucuugaugacucaaagucucagauggaguaagaauugaggaaaucauuucaaaguagcuaccuaaugaguguuuucuuuuuucaacugaguucaagucuacaaacugaguugcagaacaaccaggacuacacagagaaacccugucucaauuaaaaaaaaaaaaaaagaggguauaacacuauccuacaguaaaacuggcacacuaaggguucaaauacaagccacgguauuacugucuuaguuccuuuucuauuacuguguuaaggcucugugaccaaggcaaaauccuuauuugugacuuacaauuucuaagaguuaggcuccauggucgucauggcagggagcauggcagcaggcaaucaggcauggugcuggaguaguaacagagaacucauuauugagacacaaucgggagacacggaggagggaggaugagagacugacagacacauggacacacuggggauagcuugggcuuuuggaaccucaaaccacccccagagacacaccuccuccaacaaggccauaccuuccaauccuucccaaaaaguuccaagaacugggaaccaaucauucaaauauauaagccuuugggggcaguuccuauuuaaaccacacuuaagcuaaaagcaacaagucaaguguauggccuaacuguucauuaaauagaauaauucaaacucuuuguguuauuuuucuuuaccuuucuaugguaaagaaaucuuucuauggguuaaaaaaaauacaaauuggcguguuuguaguaucuguucccaugcaugugcauguagaauucagaagaaaaagguuuaguuaucguauuuugcucucguccuuggcuuuugagacagucucccacugaaccugaagcuugcuauuucgacaagauuggccagccagcaaguucuaggauauaugucuccaacuaccaacacgggaguuagagacggugucggguguggucaccaaguuucacgugguucuggggauucagacuugggcccucuugcuuggauagcaaauguucuuguuugcugagccaucuccucagccccugugcuuuauuuuguuuuaaaggaauauuuccaagcucaacuaagauacauauuuuuuaucaugugagcaaguccuuauguuaaacguaagccuugauguguucauuaugaauaugaccaaaaauucauggauggaguuugaagagaaauuauugaucauuuaggaaaauauuucuguaccacaaaugaccuuaguuacuaaauauugaaaguaaaaauagugcuguuaucuacauauuucaaaauuagaaucaccuccaugaaaaguaugauuacgagauguuuuauauuuaguucuuuuguggaaccuuaauuuuauugguuauuuggcuuugaucuauguucagaugcuauuuuugccauacacacacacacacacacacaauguguguguguguguguguacauauauauauauauauauacauauauauguauguauauguauauauauacacauacauacauacauauauauacauauagugaauaauguuuuuauguguguguauguguuucugugugccguguaccaugcggaggucagaggacagccugcaggaguccagccccuuccuuccaccguguggauccugagaaucagacugagacaucaggcuugccccaaucaccuuuacccacugaaccaucuuguugacuacuuuuuccauuaacuccuggugguagucacuuacaugugauaguuuaggguucugcuaccuuugaugaaaacugcagauauuuuuauuuauuuccugaugaauaauugcuuagaggaaggauaagaucagcuugaugucuuccuuucuugugagugacugugucuucuguccggaggucugaaaagguuuuccuuccuuccuccugagcaucugcuuauccacagugaaguaugggugcacaugccuauaaucccaggucucaagaugugcaggccggaggaucuggagcucaagagcaacaucagccuggccgacgugggaccuuaucucacucaaacaacaaaaauaguuuaaccaggauaugccuccaauuugaagauuauaugcccauuuuguuuaagcauuuucugcagauaggauuuguucacuaguuuugggaaaugcucuucuguuacauccuugagugcaauuuuuuauuucacuuguugcauuauguaguagaugagugcuuauauauugugucuuuuugucucacuuggauagugucuuccuugcagugacuuuggucuguuuccuacaguguuuguuucaaguccugcagcuccuuaauucuaccuguuuccuguaacuuacugaauuccuuaacucugagccaggcaccuuugccucuauaaaguuuauauuauauugcagugaggaaacagcuuaguauggcagggaguggggcugagguaaucccagaucagaaacuagaaagcaggagauacuuccaguaguucucagccugugggucuaacucccaggggucacacaucagacauucugcauaucagauauuuacauuacaauucauaacaguagcaaagugacaguuaugaguagcagggaaaaucauuuuauggcugggggucaccacaacaugaggaacuguauuaaagggccccagcauuaggaaggcugagaaccacugcuuucgaucgaguuguuagaaggcuuuaagucugacuuugaaaagagaccugaauacagagaggaagugaacuuggcaaagacccaggcaucuuagauacagagaauggugucuacaaaggcccugugggagagcacugugugcaaggcagggaggagagccagucuaaguaucuugcucugugauauagugcuugcuuaccaugccaugcauaagguucaggccucauaacaauaauaguaauuuuuuaagaagccaaaugaguuaaaagggaaaagauggaagguuagagaaaaagauggguuuaaucacaaaaauuguaggccauagaaaaguuuggguuugguucuaauugugagaagcgugcagguggccucugcugaauaggaaccgcacacagaacagaaagaguugucucccuccuggagugguagcacacaccuuuagucccagcacucagaggcaggacauaggcaggagaaucuccacgccugugugggaccagcuccuggggaagugaaccucacugcauggaguuugacugcacuuauuccauugccagacacugcucuaagggugggaaagcacaaccugggaugugggaaagcugaagcugguauucccugaucccugggcacccaguacaugccugggacccacccagaggagucaggaacaaagcguggggguccaccggccacuuggaggccaggauuguugggggcccuugggcugagaguggagucuaaccugggaccaggacugggagcucuguggugauuauccuuagcuugacugugguuggcuagagaacuucuacaggagacuuaggcaauggcucucuaggcaaaggcuuucuccaugcucccccuauggccaccgugauagaugaaagagacagcccuugguuccacauuguuuauugguuguucuuaguggaaaauggaugcauaccaacuucucaggauggaccagagauuaauuaccuuuugcagggccucuagguaccucauuagcauggagaacucuguucugggccuacauaaccacaggucacaguuccuuaugugggaaguguggcacguguuccaggccaggaguucggcagggagccgucuaccaucucagguauguacucuugaguuucugggaacucagacccauucuaccaaguuuccuggcaugguccacugucucacaagucugaggccagucugucuacauaguaaguucuagacaagccagggccacauagugggcaaagucccuaucucagggcaggggauggaaggagaaacauuuagucaaacagauguaagacuaacagaauaauggagcaaccuguguuagcaguuacuauccucuugcuacuaagaaaccagggagagauggagagggagguaccagccgauggggaggugccagccacuugccacccuguaccugaggacagcugaggugauccuucgggggacuguaacuggagcaguguuuauagguucucaccccucuccugacucucccuccgccucuucuuauucuugacugauggaacagaaggaauucuguuggagauauggaauuagguuuuugagagcaccacccacagcaacacagaaacagaucucaagaggguuguugcuuagaggugacaguaaacugccacaacgaguugaugguuucaaguuuguuugcuuuuugaccuagccacuugacuacaauugugcagcuuauugacaucuaauaagauauaaaaaaauaugaauuauaaaagaaacaggaugugucuuaaaaugugcuaauuuggaggucuuuauuacauuuaaguggaguugcuggccaaaccaaugaguuagaaucuagaacucaccagaaguaucagggccagaacacaaguucuaagacuccuacgagcauagauaucauaaaacauagagauggcaaacgugggugagaugaccuuguggggagaugaauccccacaaacaagggggaaaaaguaugaauuauaugccugggggaugaucuagaagagaguuugucaugguuacuuuucuauuguuacaauaagacacugugaccaaggcaacucauaaaauugcuuaauugagcuuaaguuccagagggcuagaaugcaugguggcagagcuaaaauaaagcagguugcaggaacagcuaagagcucacaucucaaacugcaggcacuacggauggaugaaaggaagcuuuugaaacuuuaaagcccacccccagugauaugccuccaauaagaccacaccuccaaauccuuucagacaguuccaccaacuggggaccaugcauucaaauggucgugccuaugggaaccaugcucauucaagcuaccacauucuacugcccuguccucaaaguuucauggccauaucauaauggaaacuacauuuaaucccauuuuuaaaauccccauagucuuucagugaaagucucaacacuguuuaaacuguuuaaaaguacaaaacccaauaucucuucugagacucaagacaaucuccuaguugcaucccccaucaaaaaaguaaauuacaugcuuaaaacauaugguggcacugaauauacauuacuguuccaaaagggaagaaccugaguguagugaggacacacuggcccaaaacaagacugaaaccuaucagagcaaacucuaaaucggguagcucgguguccaguguuaaaagacuuaaaugaaucugucccuccggcuuugcugccuguagugcacccacucccuaccuucccugucucuuacccuccuuucuuggacugguuccacuccuugugcaaaucucuccuuggcuugacugaacuucguuuucuuuuuucagguuacugucuauguaagaauguaggggaagagggaguaugcuccgucaguaaaaguccuuacccugaaagcauggagacuuaacuucaauccccagagccccauauuuaaaagggcugggcauaucuacacuggugcuugcuagcagcaaaagucuagcuaaaugggugagcuccauguucgaugagagaccuugucucaaaacaaaacaaaacaaacaaaaaagauagaaaaggagaauaaggugagaaguaacagagagaaaaucaguggcagccuccggccuccauacucacaaacaugugagacauacacacaauauaccaauauaaaaggaauacagcagagaagagguccuaaugcuguuauauauuauuacuaugauggcuaccauuuacaaaauacaaaccaggaagagugcuagacacuaacuagcauugucgcuaaaacuguaacaauccuguaagguaagcacuguuagagguuauuuccacaagaaacccauuuuuuuuacugguaacaucagaucacagaaucuuaccugaagcugacauuuaaccaaaauaaagaagguaauaagaaauuuucuugaggcuggagaaacaccucagcaguuaagaguacuauugcucuuguagaagcccagguuuaguucccagaaaccacaagagagcuuacaccaucuguaaguccagcuccaggggaccuggaaguccccaggaacacacaugguacauuaauauccaagcaggcaaaacacauaaaucuaaaaaacauaagcaaaaaaaaauuuaaaggacaaucuauaauucugucuuuacugaaaauuaacaugcaagagacuuucuugggccagccauauggcuccuggguaacuacacucaucaugcaaggcuggcagaugacuuaagucucuggaauccauaauggaaggagaacaccaacucugaaaacuuguguucugacuuccacgccuaugcauuggcacgugauaaugcacacuuuccauccaacauguuucuaagucuugaaguugcuccuaggcagcucuccagugucaguuuagagucuggaggaacauccaaguuaaaaauuacuuccggcauacuauggcuugcaccagggcaucacagucauauaugacagagugcugguuaagaaaaggaagagaugaagucucacaacacaaguuguuagaauagcugagaaaaauauccuuauagcugagaacaguaugcuaccuagcuauuuggagaagagggggcucuuaacgcauuuguuacagacacaaaaccagugaugguuacauauuaaauccaagaaaaagaccuggucauuucauguucuuacaaguuuuuuuuuaauauuugauuuuguuucuaaaugacauuuuauguuuccuaacuauuuuuccuaaguguaugugugaguguauuuggccuguggaggccaggagaugucagauucccugaaacuggaauuacagacaacugugagcugaucagugagcacuggggacagaacuccagcccuccagagagcagugagcgcugagucaccucugcagccuuccucuuaggguuuuuaaugaacaccaugucaccagucuguuccuucaaacacacaaagugcccuuacacuucuuagugcucauccacaguacccacaaguagugggaaucaguuuggcuacgcuguuaucacacuucugggagggauguuuacacaaaccuacagccucaacuaggaaauauguucacacauguuauaauauaaauggugcccauuaaaauugugcacuauaggggcauugaggguaaacuaauugcugugaucaacuaaaaaauaaguaauggcuccgauuuguuucuuccugaaguaaaugaauaggucaguauggaguuuuggaggcauuucuucacagagccuuuuagaacugaaugcuccaagauuuccuugagaucuucuguucuagucuguugagaggagagacuuacagugcuuuucauuauuuuggacaggguuucauguaucccuggcuggccuagaacuugaaauacagcugaaggugaucuguaacucccugagugccuggacuaucagcauguaccauacagccaauuuaugugguauuagggacuaagcccgaggccuugagcauguaaggcaacugcugcuccagcuaagcuacacccucagcccacaaagauuuuuagggaagggucucaaaguaauagacaucgguccauucucacuacacugacuauaguuuagucaaauaaugacuauaccuaucagggaaaauaguuucucugauauggccaaaaagugacaacacggcucuugcugucuaguuaggaaccgauacuugcuuggauguucaccaccaccacuaccauacacagauucucaagugggaaguagacacugaaaaaauaaauucucaaacucaguuuuuuuuuuaauuaguauuguguggcagaacaucugaaaugggaagucugcuauguaaaugucaguagaacaaaaaaaaucuauaguugagguuuuauauuucucauggguucguguuagugugugcuuuuauaugcacuagaaaagugcauauaaaaugaagaugguacucuccgacagccuaucacacuccaggaaccugugaagcacccuaaacauuggcacuuggguggagggagagaaaaagacuaacagacugcugugccaggccaucauuagaaccugcuuuaguauucacugccuggcuuuaucguugcugggugacggguagagagggaagcugccugagagugacuuugucucacuuaaacuacuugaaaaucuacuauagaaaacaugaguuacacuugcacagccuuaaucuggcaccucagcaauccucucacuggguccuaucacaucaguuccuuccuaaggcaacaaggacuaguuuaaggaccguagagagccaggguaauguaucccggguacuucucugaaaggaaguagagauuuucuuaaagcagauuauucaugugaacuaugugacaugagucccauaaaaguuucuaugaaacugccaagacuuaaaugacuaguguacaguuuuuauauuuauuacugaaaaaaucuuaccaauauauaaaugcuuuuauaccuuuauaugcuuuuccuuagaaaaguuccuugguuuuaagcagaauauugaggaauguauuaaaaucauacauuauaucaauaaaauagcaaaaauauaguuuuuguauauaaguucucuugaaagagcauagacucagaauaugucugucuacugauagugucuauuuuucuucuuccucuucuuccuuuuccuucuuccuccacguucuuuuuccucuuccuucuccuccucuuauagauauguaaaagaaaauaauaauauauaagaaaagcacacacauguaaaaugaaguaaaagcuauuaauuaauugcuaagaauguguaauaugaagugacugaaaacugaaauuuauaggagaauguggggagugagaaaagggcuuuuuaaacaaggucucccuauauagauggaaggcuggguacaaacucauagcuuucuugcuuuagccuuccaugagcacaucaccacacccaguucaggcaaauucuauauaugcaacagaguguguguaugucuaugucuaauuuuaaagcaguaauggacuuggauuaccagagaaaaagguuaaucagauuuauugacucugugcuuaguaagguuccacacacuagaaauagcaaagaacaaaacugcccacgaggaggaagguuguuauuucacaagcacguugauaggcauuuugauaggaauaaauacuagaaagaagccaggcauagaagguaacaucugugaucccaacacucagaggacuaaaguaggaggaacaagaguuugaggcuacccuuggcuagaaugagcuggcugugcagugagagucuaucagaggagaaguagagaagggaauggggagggagaugguaauggacucauauuaagaggccuucaguguugagcaaauuguuugguaaaucaagcuaagcuguuggcuugauuuacaguaugguuuucuucacuugugugcuuuuccuuacccuaggaacuaaaaaacuugcauaauacaaaauaaauguugcccauaucaggaauuccagcugagguaugagguaagcaaagcuucaaucuucuaucucuuuaucaccccaguggcuaacaguuuacagugaaugagcacuguagaaacggccuuguguccagcguguguccuuguaguccugcaguccuggucucugggggggcucuacuaaucugcuuucuuuccugguggggucauuaaaagaaaaaugagauuaucauauuuaaauucacuuuucccggggaaccagguuuuccuuauucacuuaguuacacuucccucaagugucugauccaaguguucucuuucuguacagguugguguaguaagggaaagggcuagggugucuaccaagaggcaagcggcugucuaugaggaagcaguaaccaaaaggaggaacaaguuuagcaaugguuuaucuuuauccuuggggaaggggaaagaaugaggaaaugaacacaagauuguuacucugaagauguaaaaucuuaucaccaacagcugcuaauuuggaaacgauaucuucagauguuugggacagggcucaacagaucuugauagcaagcuaucagaccuguuguuaaacaugugaaaguuacuauaacauagaaaaugaaauccuagggacugaagaaagaguggaaugaaacaccaaauggcuccaccugaacuuugauucuaaaaggaacugaauuucagacuaaucacauacauaccacuuuacuccccauuuauggaguccuaaaacaugcaaacuaaucuauaaucauagccaaccaaugacucccugagaaaaagggugggaggaggcaggacaaugaagaggaugagagcacucucagagaugauaaauuucaucagauuuauuucaguuucuugacugauugaguaagaacaguuaucuuuguaucauuccuggucuuggaaggcauuguuagacauagguuaucucugagcuguuguacacuuuggguuuuuuggcuuuuuggguuuuuguagcuguucucagauuuucucuucaucacugguucugaacacuuugguuacagguacuucagggcagugucucacugcuucagaguaguuagaauaugugcuguaguuuccagcaaauucaaaacauugggccaagauuuuuucaaauuucuguucuauggguguguuucuuccccuuugcucacucccaucacaugugcaugagaccccuggaaauuuaucucauaacucacugauucucuugucauuaaaauuuagugucuucauucuuucuuucuuuuuuguuuguuuguuggguggguggguuggaaagugcaggugggugggugggugaggggugaccuuugaggucagaaagugucagaucucccagugcugugguuuuuaggcaguugugagcugucccaugugaaugcugggaacccaacucagggccucugcaagagaaguacuggcucuuaacugcugagccuucucuucucagcucuuugacuaggacuuugacuuugacuuucuggggcugggucuucaaauucacuagucuucugccaugucuaauaugcccugaaucauaguuaguugauuuuauucaucccaaaauuacagcuuucaucuccaaaauuuuguuuuugaaaauguccuauaugucugcuguucaaacauguaggucauuacuauaauacuguuuuaugccccuuucggcuaauucagcaugaauguccauauaaggucauuuucauuugauugacuguucucauuaugggucauuuuucuaacuucauuauguacccaacaaucuuuaauuagauacuaggcauauugcuagacauucuucuauuucuguaaacauuucugaguuuuguucugggaugcaauuacguugcuuaggaaaguuugguccuuuggucuuacaauuuugucauagaguucagccuacagcucacugcucugggcgugaugcagaggcugaauacuaacccuuuaagguuaagaccuagauuagcaaaaggcuuccuagcuggcccucgagcacauuuaacuccauuucugauuuaagaaauaaaacacauuucauuaaaauuauacuccaaaaaaaaaugaagugugagaaaucaagaacacugaacauuccaacaacucugcuugugaguaaaagcgauuuuggauuaccaacugcccuauagcagugcauaaaagugugaaugaacauagugcuuaagaccuggguaugaugaacacacuugaccguacaggccccuuaaccugucuaagccuguguugacaccuguaaaacaccaugguauuuuacaaaguaaucuagaagacagaaaacuguuagucccaccaaacuaaaauaugcugauaucaagagaacuauacaacuucauuagauacuauucccuuuccugucuccugcaguuucaaagugguuuaaaaaaaaaaaucaucuagggcuggagagauggcuuagcgguuaggagcacugauuucucuuccaaagguccugaguucaaaucccagaaaccacaugguggcucacaaccauccauauugagaucuaaugcccucuucuguggugucugaagagagcuacaguguacuuacauauaauaaauaaagaaaacuuugggccagaacaagcaggcuagagagagcaggccagagcaagcaggcucagagagagaagaaaaagugucugaagacagcuacaguguacuuacauauaauaaauaaauaaauaaauuuuaacaauuaucuagaggguggaaagggaaaggguaggugaugugauucuauuuugauuaaaaauguauaaaagguauagggguguaugcuuuuaauccuagcacuugggagacagaggcagguagacuucugaguucaaggcagggcuacacagaaaaacccucuggaaaaaccuaaauaaguaaauacauaagggaaaaaaugaaucaccugaaacauucacaacuuaaaaacuacaacuauggagacuaucucauaagacacuugcuugguuccuuauaguucagccauuagugugcauguguaaacuuauuaauaccagauucuagagucgguuguuauaaauuaaauauuaagaauaauacuauuucaaacagauuccaauacuaaauuaaguucuaccugcuucauguauagacauugagcaggcacaaagcaacaagaauuuauucuuaaaccuauagcugacagcauauucuaauguucugaacaaaauuaccuuuagagaacaaaaccggguaacuaggcuuucuuuagaguuuccuuuuagaaguauuuuagaguauaggaaucuuaggagucagaaaccuccucuaaacaguccugugaucuuauucuucuaucaaugaaagaaucauuuaaaaaucauuuuauucuaaaaaauuucccugaccacagcucucugccugauguggacaaacauuccccuuugcuuuuugggaaacacgcacaguuuugcuugugugucuuucuuaugguaauauguucaaugugagaucugcccucuuaacagacuacagaaauguucuuacuguauucugagaauugggguacuuuagagucacaccuccugccaaaagaaaggacaaccaagaggguacaggcugguuauucuucagagguguggguaguguuaugaggauagacagggaugagcucugucuuauuauaauugaaaggcgcuugcuuuuggagguuggaugcuguguguagcuucugcuacccugacuaagcucagggaaccggccgcaauacuagcccccacccagagaauauuggguccguggaugaaaaacacacacacacaguuguucaauuucaacuugccuuuuuggcaaaauugcugggcgcuacuuaucuccugccuggagaagcauguccuuaucaacacucuuagcuccacaccucuccaccugcccucaacuugaguugcucaguuacauuuaaucacugcucaacagccccaacugcccaccuguagaaguggccuacggccacgccaccugagaucucacauggcugcuugucuuuccucucuccgaagcauggugaccucuuccucugcuuuccuugcaucuguuuccuugcuuguggagaccacgaaguccugccuacuccuuacacccagcaauuggcccauggcuucuuuacugauagaucaagaaccaauuggggaucaggacauuagcaucagacccaucccuacacuuggauccauauuuuacuucagguguuaccaucauuugucaaagugggccacacucccuugauguuacagcugggggugaagacuaauguuauuuuacagccagacaguuugccaagccgggcugaguguuaaaugucugcaguuucaucaguuaggaagcugaggcaggggaucaugauuuacaggccagccuuugcuacauggugagaccuugucucaaaaaaaaaaaaaaaaaagucagaauucauagacaguugaaaacaaauuacuacucuuuggaaaaauaggguauggcucuauccauaacauuaaaucacucuguuugcccaguaagacuguuuugugcacuuguuaugaugaagugugagauaauacaaaaggaugcuucugaacauucauucugaauucucaguuucuaugacacauucauguucaaggaagauaagcaucaauuagucuguugcacagucuacuauaaauagccuuggcuaagcuguaaagaaaacuaaaagggucauguuauacaaccacagaauggccuagaaccuugccucuaaaaguccagcuuggaacacagcagggauggggaguggggcuguuucuaugugccuagaggauuaaaagccacugggggagggaaagaugauggggggggggaacucuaccuaaaauaucauguuuacacugagacugaaaaaacugcgucaucauuauauuuaaaacaauggggcauuuacacuaaauuuagaacaaaacauaaugcuaaagaaacuuaguucggggucaguuuuuaaggcacuuguucacucuucuaguaaccauauuuuuggcggggggugggagauggagaagagguucaguagucuuaaugacuuccaaaauuugcuagaugaagacagauagcaauggugguuauuuacauuauggauauauuuaguaccacaaaguugaaaacuuaagauuuaccacaauuuaaaaccuaagaggaaaaaaaaaacccuuacucaaauugaauguuaacacaugugaaaguuuugauuuaguaugcaguuuuaaauuggccaguauuauuuuagcucaugaaucaccucuuacucugccugugaaguguguguguguguguguguguguguuuaugugcauagaauaggugguuaugaccuguccgacauagaugcuaagaagcuaguaaguacucauaaccacugaguuaucucucuggacccgauuccacauuuuuaaagcauacaucaucaaaugcccuugugaagaacauugacuuugccaucuucacuccuggggcugucagcaugcaugcauguaugaguacucacuauucuguccaaguucccaauuccaaucagagauggaauaaaaaugcacaauuaaaacacuauaacaguugagauaaagaaaaauaguuucucucugaaacuauucccuaccaaaacauuuauuuuuaagauauccuuacuagaggcuggugagauggcucagugguuaagagcgccgacugcucuuccaaagguccugaguucaaaucccagcaaccacaugguggcucacaacuaucuguaacuagaucugacgcccucuucuugagugucugaagacagcuacaguguacuuauauauaauaaauaaaucuuuuuaaaaaagauauccuuacuauuaucucacugcagcaaggaaaaccuggaauuaauaaacauacucuaaaaugauuaaaauaaaugcaauuucauggcaacccuuaaauaguuucuuaggacagaggcucuuucucucuccaagucuuuccuacuuugcucucuaguugauggcugaaaguugaaaccuucuaguccauaaaauauuaaacuguaauuuccugaaaaauauaaaaaacaauaguauucaguaaucccaaagagauaaaauuaaguaaaauuuuuugagauaguuuucuuauauagcccaggcuagcuuugaacccuuugaucuucuggucucuguccuaaguguuagaauuggcuugugugccaccacccaacuaauaauguuauugguacuauaaaaauguuauugauauuauaaagagacaaacgugaggccuucuuuugucaauugaaaagagauggaaaggagguuuauuguuaaaugguuuucagcaaacaaugucuuccaauuauuccuaaugauuccagucauccauguucuucuuuaauauauaugcauuagguaauucaaggggaaaugaccccaaaaaaccugacauaauauauuuuuauagcaugugauuugaaaauaaucuugcacuuuaacaacuguacacacuacaucuuuuguaucuauaggaugcagaagaguacaugucaaagggagucagacgguaacuguaaucccaguacuugggaggcugaagcaggaggaucacaagcuugaggcuuaauaagcuuggcuacaaaauaagacccugucugcaaaaggaaaaccgugggggaggagcuggggggaggaaagagagaggacuggaggaccaucagaccagcacagaguccucaagccuguuguguagccuugcagcuuauuaaaagccuacagcuaaagcaaagcaacuuugugcuguuucacaaaugguguaacaucuaauuuaaacauccuuauguuuguuuuucauauacuucucuucuaauauggggagauaaaguaaacugauuaaauuacauaaagucuuguuuccugucauauuuaccauguauucuauaguuucuuucaguagagcacgguauuuacucuccugacuucucagagacuuaaaugguaacagacuggaagaaucaaauaauuaaacaucaacagcaaaaauuuaaggacuaaauaaacaugguauuccucuuaugacagaaaguauucccaguugggcgugguggcacacaccuuuaaucccagcacucuggaggcagaggcagguggauuucugaguucaaggccagccuggucuacagagugaguuccaggacagccagggcuauacagagaaacccugucucaaacaaaacaaaacaaaacaaaaaagaaagaaaaaaguauucccauuagagcuacaaacucgccuuuuugaaguaaguuucuucagaguugucuuuaacagucaaucuacuuaaaacaguaaggguuguaauauauuuuaucuuauuuccccacagauuuauucuaauaagaaccuuacacauguaucauucaacucaauugcccuaaagaacuggucacauauucucguucauguauccuggaaacuaguucuaauuucauuucuguuuauuaaaaacaaacaagucaagcauguagacuccugacuuccuguccuccucagcuuccaggacuaucccaaaucaccagaguuucucuugucaucagauguaaucugacauuuucuauacaucaugaaguuuuauucuucaauuaaaagucuuuuacauuuauuuauuuugugugcauguguguaagguaugggagaaggugucuggggauuaagcucagguggucugguuugacaacaagcaccuugugucccuccauuuuuuuaaaacuuuaguuuuacaaaaguagcaagguaacuuuaucaaaguccagggugccgagacugaccgugggccacaugagugacacuacucaagggccucaauuuuuuuuguaaauaaauugacaagagcagauucauuuuuauuauuuaugaguuuaaauuugcuuccccaaauacaggaaucuuaauagaugggacaaaaagugaguaccaacuguugggauauauuccagaacauauaaaccuggcuaucacuuuuugagagggguccuguccuguuaaauuacagucuaacccacaaaaaaagaguuaaaucaugaaacuacuaaggaagugucagagaguccauuaagguuguggggauuagcaaguggggacucaguugucauccagacugaaagcaauauuuaaaggguugucacaagugaguggaacauguuuguuuucauagcuucagggcuacuuggacaauaggugcagugaaaaagagguuuuaacucuaggauucugugguuccaaucccaaauaaaauaggcucugucucuucuaguuucucacgagguuuacauuauauuacauuacaucauuacauuauauuacauggcagaguuuacaaagcacuguuuacugccauguccaaagucagcauuucuacaucaacuuuagaaaguaaauaacugaaaaaaaaaaagagcuccuuauugguggagaguaaaaaaguuaauuagccuucaaauauuaauuuuuaauuuuaaaugaauuuuacuaugguccauggugguuuguaggaaagaacaugaaggcaagaugacacauacaggaaaagaaaaauaaagaacucuuaggccuguaugcugaacagaauuagaguuggaaaugcuguaaauaugaauuuguacuucuagaaacuaggucuauaaacaaugcaauguuaauuucccaagacagaaauacacuuccuggcacguauguaaauacccaccacugcugugcaacuuagucuaaucaacuuuagaagucacacgaaaaagguacagugugcacauugguguuucaugaaacaaaucuauccaacugacaaaauaaaucuacaccuaaacaauauguucucuuaauaugaucaucuaagucuacagagauagcucaguugguaaaguacuugccuugaaggcaugaggacaugacuucuguacccagaacucacauuaaaaacaacaacacaggcaugguauguucaguuguauuccaacaucgggaaagugaagauggguauaucccuggggcuaguuucaaacucaaaaaagaaaaaagaaaaagagagagaaagaaagagggagagaagaagagagggagggagggagggagggagggagggaggaaggaaggaaggaaggaaggaaggaaggaaggaaggaaggaaggaaggaaacaaacaaacaaacaguggacaggacccaaacccaaacaguggcacccaguguuguccucuggcuuccacggguagauucauacacuugcaucugcccuugccacaggauaaagcauacaacccauaucgccaaggaccagccucagcuuggagagggguucucaggaagggguuccuaggaguagcaaaaacgaauaacucaaagucaaauuguggguccaagcugaaggccuauauucugcucaagacaucuuuccagauugcucucuguauucugcucugcuacagacagcuuucucuuaguauuguuaacucucuggauagcuugucucuugcagaucaaaagcccacuuuuuauuuuacauauccauucagucuuuaccccccccccccgguuuuuuuuuuuuucccccugaaucaacaucacaugaccucagccccuugauucuuagagacagcaagcuuacagacaguaagauagcugagggggacuccacccugaaauuacuauuccaaccacgccuggaccaggcugacccuuuggaauccacuuuguaagcauagauaagcaaaacugggugggaucuugccuuguagccaccacucccaaucucuuuaucuccuuccuuaguaccuuucugagaaacuggcucauaguggaagcugucucuguuccuuuagaucugugaagcuccuuauagaauucauauugcauccuuauaguuuacauaauugagaaauuauauauuuccaaauucaugucaguguucuuucccacagccuuaggggcuguccugacuuucacagacgcaaggucacagcauucuaccauuuugcuauccccuccuggauucuugcugucucugauuaucacggagauauuaaccuuggcagagaggguaauccuugaaggaggaaugugaaaauauguacacuauuauacaaaccuuacgcccacaguaaucaucaauacuuguggaggccaaugcccuacuggcuccauuccaggggcaggaaaccaugccauacugucccuaacauggccaagccauacuggguaccauauuauauaaaugcccucugagaaggauuucuuucuaagaaagagauauuugcuauaggggagaaauaaucuaaguuauuugaacaaacuaaauaccagccuaaaauaaauuucaaauuuaaguggaauacuuagaugaguaaauccacaggacgagcucuccauauuccuacugacaaauuauggugugaccucuagguauauaauuucagugguagacuagaugcucuauugaaccaguucuucaucuugagcuuugacacucuguagaccuuaaaaaaagaaucuaaaaaauagccuaugaauuucuauaagcaaaucaguacacuacaauacuuaguauugacuguucauuuuucuaccacauagaaauggcaguuugcuggcaguggggcggcuugguggguaaaggcacuugcuggcaguggggcggcuugguggguaaaggcacuugcugccaagccugaugaccuuaguuugauucccuggaacugacaugguaugaggagagaaccauaugcauuuggcaaacgugagucccccuccccaugacacacaacacacauaaaugcuguaaaaacaaagacaauggcugguuacauguuuccuauugcugugcaguuacacaguuauaaaguuaauggcuguaaacaguuuugaaggucaggaauccaaaaugagucucaguaucacaaaacuaagaaggaggcaaaguugugaucccucugaaggcucuaugagaccccuuuuuagcuucuggagcucacaagcuauuccuuggcuccaaaccuuccaucuucaaaccugguugagccuuuuucaccucucaacaccgccacuucucugaugcugcuucuaccacacuuaaaagaccaacagugaugggggucuacucaggcaaucuaggauaaucgaguuuuagaccacauaguggucuuacuuucaaacggaacuugaauucuuucuugacauguugguuauguauuuaguagguuccagagaugaagacacagcuaucuuuggacauucugguagggcguuuguuuagccagagagauagcucaguggguaaagugcuugcugccaaaccuaacaacuuaaguucaauuccaaaaaccaugugguccuuuggccuccaaaugcacucacucuauggcacuuuugcacacacacacccccaaaaaagucccuauuuauauccagugugagcugccuguauuacaaugcuuucacaacacccuguacuuuguuacugcugagaguugugauuuguaagauuauuaaugucugguuuuacucauuagaccauaggaggaaaagugugguuguuuuauucaccguuaacauacuugauaacuaacaaaaauauaaaauccaugcagcacagaguaagugcugaguaguuaccuaggaauauuuaccugcaugcuaacaaauaauuccuuuuucuuuuauaccuuauuucacucuuguugccucuucuccuccaaguucaagugcucaauaauuuaccuggacaguucucuccaaaggaguuucuccauaccucucuguucucugaguaaccucauuaagaaaauuuuguggauuccuuucaaagauucauuuuauuuuuaauuauguauauguauuuguauguuuuuuaugugaaugcaaugcugagauggaaguauuuauguguuuauuuuuacaaaacaaaagaggaacugaacucagguccucuuuaagagcaguaaguauucccucauaaccucugagccaccucuccagcccuucauuuagaaaguacauuucuaaaauacagaucucaauauugggcagagcagcaguggugguucaugccuuuaaucccagcacucaagaggcagaggcagguggaucucugugaguucacgccuggucuacagagcuacuuccaggacagccaggguauacagagaaacccugucucugagaaaaacaaacaaacaaaagcaaagacaaaaaucaaccaaauuaauuuguuuaagauuuuccaauuguaucaauauaaaaauagcacauaaaaccauuaauggucuaaccucuauccaguugagcaggcugacuuuacucuuggcuuucaaagauacccaagcuacaaacuauagcagacuauacagcuaucugaaaugccagguucuucucaacgguuccauuuucuuacacucuaaugauucuacuuaaaaugccuucuauggccuaccucuccuuuaccuuguauacuaacacaacuuauucuaauccuagcgcgcucucuaccaagcuucuuucgacacacagucuaauuacuaccuccuuuaaguuuccuguguuacccauuuccauggauugcaugaucuuccucuauuuuuaggcuauaauuguuuggaaauuuuaucuuucacuguauauucaagugucuacuaaaagagauuacucuuuuuuugucuccaucuccgauucuaguuugaauucugguaaauguuuguuccauucccugugagaacauauguuaaaacccacaaagaguuuacuucuaggaaaucuuccaaucaauugauaaaacauuaaauuaaaaggggcauauguauaaaaauguucauuucagaaucuuaauaccaaaaacuagaaauaggcuaaaugcccaggaauagaaaauucuaaugacauaucucagaacauucuaaaauaaagauuaugaaaauuauauaguaacucauauguuuauggcauguuaagugaaaagggauuaagaggacuaugaaacuauauaauuauguauauagacacugacuaaaagggaacaugaaaacuauaugaauugauggugugggugugacuucauuucuuccucaugccccucccccaaccccuuucaguuuuucaggaccaggguuucucuguguaguccuggcuguccuagaacuccuucuauagaccagaugccuugagcucauggaguccuaccugccucugagggcuggggauuucauuucuuuuaucuagaacuuuaugucacuauaguugucuuuaaacuauauguaauuuaaaauuaaauuuauauccuuuacagauuauaagauuuguauauaaauauuugugagcauacacacacacacgcaaauauauuuugcaggacugucuccuacaagcugcaagaagcagauaauccaguaccaguaagcauacugaaccuugcucccuaagaucauuuuccacuaacauggaaacagcccucuuaaaaaggaaaaggcuuauuccauggaaaagcaaacuuaaguaagagauaaaaauguacuaucucauuauacaagcaacuaagggagugcuuuuuaaaaauaaaaaugaaguaauguuaacagaagcuacaaaagaaagugcuucuacuaguuacacauaagacaauuugaauaucaaaauaauuauauaguuuaaccuuagaggugaaaggcaaugguauauguaaccuacccuaagugauucagaaaaacaguacacaaauauacaaauaaaauaugggcagaguggcuggagagaugguucagcacuuaagaacacuuguggcuuuuguacaggaucuuuguuugggucccagcacccacagguuggcucacaacuccaguuccagaggaucugauacugucugucuucugaccucuaaaggcaccagacauaacaugauguacauaggcaaaauaugcacauaaaaaaucugaauuuugaaaaauauuuguagauggacaucauaaaugagaauaagcaaauauagaaguggagaaacaggaauucaaauguacucauauagauucugaauaguaagcagggaaccagaagggcuuuguuuacaggagaguacuauaggcugaaacugaagaggggcuguggauuuguccaaucaucuugcauccaucauauaaacuauauaagcaauuaugaaugcugaacauaaaaggaacuucugaugagugggauauaauguccccacaaacugcugucuauuuccaggaaugaaaaaagaguaacuauacaguggucacacauugacaaggggaucaaaauuaugaucaucagugaguaauauaugggugucauguucuacaagugacacucugagggacaggcaacagagucugugcaguacugaaggcugaaaugcauagucuccaucuaacuguaaggaaacauggagugaacauuauucugaaaaugugugacucuguauccuucaaauacaucaaggacuuacaagacaaagaguggaaauuuuccagaacaaaggaugcuaaaagaaauaggacaauuaaaagcauucccuggccgagacaggcaccugucagggagggaggaauacuauaaagggccaaccucaaaaauuguaacaugaugguaaaaaugcuguucaaguguauguuuaucaggcugucaggaaaugcacucccaggaauauagacaugaagagcuaggacccauguuugccugugaaaaguucagaagaaagggggcggggcacaggcaaguaauguauauuuagggagaaagagaacuuguuucccuacaagaggcagcaaaugaucuaauaacauuuuauagauuugaaacucuaguugguuuuuuaacaacaggaacauaaaagggugcugaaaacuggguacagagguaugcaccuuuacuucccguacugggaaagcaacagguagaucucugugaauuugaggucaaccuggucuacauagugaguuccaagacaaccagagcuauauagaggagccugucuaggagaaaacaaaaagcaagaacaauagaccuaaaccugcaaaccgcuaagcaguguuuaaacaaucugugguuuucaaguuaccauucaaaaggguuucugauucugacauugagucucucuugaaugagggugcuuuuacaguuuuuaacuaaguuaauauccugaagucaguguuccaucaguugcacuuccuaugugaaauaguaggaaggcaggggguggggggugggggcugagaugucaagaccuguuuuccauaguauccacauuuaccguucgcucgcuggugauugcauuccagguuuuaaauguggcuuggguccuacagaaguauagagaguauugcuguauacagagacuuaaacugaguggguggaagugggcagacagagaugauaacgccuuucuagaauacagaugggaauguacacccugauauccaaauacuaauuacuaucuaaagagugggauucguuagucucauaaggugugacauguuuuggaguuauaaaauucagauuggacauucuuccaagcuuuuaaauccugagugugaugaucugauagaaaaaucuuuuuuuuuucccuuugaaauguaacucgggaaugugcacccucuugugguggaaagaucauuuuccccaguggcuuucuguugacgcacagagcuuuguuacuugaguuuguuuucucccauuuuaaugacucaaugaggauuugugguuuguuaagauuuuaaacgaaucuuaacuauaugggacuuaaauauucuaaaugagauggccauauaaguuuuagucggagcaaacguagauggccgaacacuauucagccaugucagucuugaucuugguugcuaaagucucuucuuuuccaguuguaccucacugaugcaaaccauggacgccuucuccagugcacuuccucuuuggugcuuaaguuucauauccauggcuuuaacggacauaauaacaagauguaucuuuuuuuuauguucaaaaguuacaauucugcagggugugguggcacaaaccuguaaucccagcacucaagagacugaagcaggauuaucagccugagccugggcuacaaaauugaguucuaggccagccucaaagccauaaagaagauauuuuuuaaaguuacaauucaucacaaguuguuuuuauaauaaaaacuagagcaaacauaguaauaucccugauuuuuaaacuguuggguucuguuuugaaaagcaacauuugauaaggcuggagagauagcucagcaguugagagcacuuguugauuuugccaaggacccaggcuuaguuuuagcauaguuccaggaaaucccuccucucuugauguuugaaggcacauauaagaugcacauacacacauguaaacaaaacacucacagucauuuuuuaaaaauccaugagaaucaagugaaacauaaccaaacacagcccuauagucaucuaggagcaauggcaguuuuucuuuuuaaaaacuucaucuuaauuagccuaguggaagggacaaugucuugcaagcaaaggaucaaaagaugcuuuuguaagaaaaauuaaaauauuaacuucauuuuuuuuguccuguuauagagucauuuuuaaaggcgguuuaccuagcuugcucucaccagcugcaagacggcagaauuuauaaucggaacaucagguuucaauagccauaaaacaaaaauaauaccuacuucauagagguguugugggcagugagacaccugauccacaaagcguuugauaacaaugcguaccacauuaucaguacccaguggcucuuacaacuuuuucggggcuucauacaacgggaaaccuaucuggugaguccauaauuuacucuagcacuauuuuuuuuuucuuuuggaaaaguacccuagugacguccaaaagauuguacaucuucggcuccaauccagaaccgaaagcuccgucuccaguucagaauccaaaggcuugugcauggugggcuggucgcacaccucgaggucugggguggagggaaacgucggggugugacagccgcccgcuggucgugugauugaaccguaaaauuccuaccucgugagaugguucuaggcuuaggugugacagaucugggaggcgcuggcggagggcgagagcacgacagcgauacgcgguuuuaaguuccugagcggccacccagggcucgaaggcgcacucgguggcuuggaguuuaguuaaaagcgguuuuugucuuguuuuuacgaaacucuuaagauagucccugauuuguuucaucacuagugugucaccggaguaguguccgaaagcugaccaccuccacugccgcacaggggccacgcaggcacacacaggagcgcaagacacagcggggacuggaaccgaggaaguagagagccuugcgccacgacgauccugcgcaugugccgggggagagggagguagaaguuuccgcaugcgcagcagggucgcgcggggguggguggggggaggcagggacagcuguggagccggcccgcguucccggcaugccccggggcggcgggguuggcucuaacgaauuugaaugaggagucucagcgcuuucggcgccauuuucgagugaugccugaucucaucaaucuagcgggagggaagggauaaccuguccgagccuagcgcgacgcuaggaucacgccggaaaaucccccaaaaaucaucaaaaaaauuaacuuagagcagagggcagucgguggggcuucgccagaugcggcgcagucgguaagagccucaaguagcgaagcgggucucgagagguggcagcgaugggaccggaggaccgugaggggagcagggaccggacucggggucugcccucacuuucgcggcagaagcucccccaggggauccgguugcuguaaguuggguguccucggaugggcggcguccggccgcgcucggguggcgggagcgcggagcugggggaggggaggcgcgguuugagcgggacacggccgagcggccgccgcccgaccugucagcgcgagcggccggggagcuaggccggcgcggcagggucgcccgcgacaggcgcccgcccgcccuccccggugugcacggcgguccgggcgcaggccgucuccugccgggaaacuugggucgcgggagagacggcugcccgcggcccccgaggugcgcugcggagugcggggaagaaacgacgccggccgggccggucccgggccggaucccgaccccgggcgcggcggauggauggauggccgcauccagcugggucauuuugucguugcucucccggcgguccccucucucgcucgagggggaggggugucggggugaagggaaggacggggcugcgagcuugcgauuuccuggcgucgggcucuuagaagacuuuuuccuucuccgguccuugaaucgcagcgucucaaggaaaaguagcgugaaacuuggugucuccugccgacaagccuuugcaccuacgauuuaacggucauuuugcaguccucaacuuuccuuggguacuccugacgcugaggcggaagaaagcggaguugucuuuccuuugggggggggguuucuuucuuucuuucuuucuuucuuuuuuuucuucguuggcuguuggcuuuuugucaacccagagucgacagcucuugaaugagccagugacagcuuugacuuuagguaaugcucgcuagguacuagucuuugugaagaguccacguuaaacucuugugucgcuuuccucccucagcaccccuagauuaacccuuagcucaugggacguucugcgggagggucgcacggaccugccuuagugauccucugcggaugcuuuugcugcagcuucucgguuauucgccgaggacucaggcuucaggagacccucggugacuugcuagucagagcaggcccccuacagagcuuucucccucuggaauuuuaucagaacccuggauuuggugugugucugugaaaacugggggacccgcccucauuuagaucccuuccagaagaguaggagcgcaaugugauguuuuucaaauugagucuaacggagcucccaaacgccgggcuucuuacccacugauuggcuggaaggaagcgggacugggggguuugaauguugaucccagagcugauaauucuugaccuacgaaaaacuguguuuagacagagaacuauucaaauaaauacaaaauguaaaaucggaguuuuuuuuuuaaguuaguacauaauagaguuguuucuuccguaaaagccuuucagaugguucugaaauauauauauuuaaauguaaaacuaaagaggcuguuuucagaaaacuguauuucugcuguuggaguuauaagacauuucuguucuucauuaguugaaaacuucuccgaaggaucuaagguguuugguuuuuccuuugauaaaauuuuuccgucucagucuucauguauuuauuggauacauauuaagggaaaauuguuucuuucauuuugaugaaagugaacuuuaaacuuaaucuguucuacauuuuuuuuuuuguaaaaauugaauguacucuuagaacuuugcaaaucuguuuuuaaauguuuucuaacugggccauugcaguggauuuaaaaguuuaguuuacgagucauuuauguuucuuaguugagaauauaacaaguaaauaugcacaggugagcauauauauuaaugcauuccuuuuacaaauucauuaugagagaauguguuguaucgagcagugcauauguguugguuucuuugacugguuucaaaguuuuuguuuaguguuacuugagacaggcgucaauauuuauuacccugcuugucauuccuuuuaauuccaucuugauaauagggugugguuuucagaguagaugauuuugaaaggaacuuuuaaauuuuuauaucuuacaaauaauugaaauuuugaggcauuauuucaauuuaagacaaacaugcauuuagaaauauucaaaugaaaacauuuuuauaaauguauaggacuguaaauuaauuuauaauaaauacauucuacuuuguauuacuuucaugauaauuauguuuacugaacccauaaucuuucuuuuuuucagaaucuguuuaucuuggaucuuuucauaaaauuaucuauaaaauucuauuuauuaaauuauacgacucauuucuauucugcauguaaucauauguaaacccugucuugcuuuuuacugguuuguuuuuguauuuuaauuuuuauucaaauuaugugacuggaagagaauuaugggaauggagaaaaucuuugaauuauuuuuuugacacuuccauuuaugggauuuguauuauauuaagaccauaauugaagauuuuuuucuuuuuuuuuucuuucauuuguuugcuuuaccaacucuuugaaagugauauucuuuauuuaaacuaauucucguauugauuuagaauacacuagcaccuaaauaaauuucacaacauucaaaauauuuucauguuuuauguaauacuagguagaaggaagaauuccaauagauauauaccuacuuauuuaaauguuuauaugcaguuaucuguguuuuucuacagaaacugauuacuccaauuuucuauucuuuugugaaagcugcaaaaguuauuuauuaccacaggaaaacagcacugaggaauggugcugauauaguucucccggcacuccauuuacuauuguaggagaguggaacaaaaguaucaguuucccugguagcauugauuuucauuuguuuguucuuuauacuaguuccaauuaaaggucuaauuuuagacaauuuuaaaaagccuauuaacuugucuucaguguacauuuacaaaauuuagccucaaguuuuuguauaccauuaaauuaguaucuguuuuacuguuuauuaggaaccaaaucuaaggauaaaaauuucaagggaguauucauguucugauucccauguuuucuucucuuuugugugcugcuuuuuaauuuuuguuuccugaagacuuuauucguguauuuauuuguguuuaguaacuaaaaagaauguugacaaagucuucagucuagaacuauuggucagcugauugaguuuacagaaaggaauuuccagacuauauugaauauuucuucaauaagcuuucaacaacuagauuuuaaauuuacaguuauggaaaugaaguuaaucucaaaucguaagauauuucuaaucuuaaaagggcuuuugucuuuuuuauuuucuuuuuuuaaugacacuuaauccccacguugauuuccuuuuaaccccuuuuaugagaaacauaguaugauuauaauuagaacagcacauuuuagaaagaauuguaagacuauguauaguuuacccuuuuuauuuuuuaauugcacaaauuuagaaacuauaugcuuugcaauuaauuuuagcauauaauuagauuucagauuuugacuugcuguaacuuuguggucucaaaucucauaaaaguaaaggaaaucaguaauaaaauaccaccuuauuucaacuaaguguugagaaaugagauaaagcacuuacuuccaagagauugcacuauuagaaccuuacaccgugucuuaauugucuuaagagugaucguguauguuuaaaaauguugcuauuauguaauaucugauaguuaguauguacaaaugaucauaaauucuguaaauaaugcuuucugguaguuaagguuuuuuuuguuuguuuuuuugccuuuauaaaagaugcuuuaauggauuuuucuuugagacagguuucaaguaauggaguuaauaaauacaugugugugugugauuuauucuuaauacuuuucuugaaguucugaaucuaaugugcucuuauuugagcaaagaaauguuacacaggaaagauuuguaauguuuucuauguauaaacaauaaacuaauaaauaaguuuuacuuugagauuuuuuucuuucugucauaaacauuuuauauccaaaccuuuuguucauuauuaucuaguauucuuacacugcuuaaaaacauauuacuauaugaaaauuuaacauuuaauuuuuaauuguuuuauuuuuaagguugugauaccuauauuucaaugcacucaaauauauuaaaaaaacuuuaucuuuugaaaaauagcguuuuucccauuaaacaaucaaauauuuagcaacagacauaaaggggcuauugguauucauugcuuauuuuauuucuugcuucagccacucuuaaauaaaaguagaaaacuccuacaaagcauuaugguucauauguaguauuuuuaccccuuugguaauuuaauaauuuguucuuuuaauauaguuguuaccuguuaagucauuaagaaccagaaagggugaaacaaaugaaaaaaauaaauaacguugcauuuucaccucgauuugggagcaguaaaagguuagucuaguagugguccauuuauuucucaauuguuuaaaauuuuuaaauugguagaacuguaauaaaagauuuggaaauauuucacucaaguauagcaauacuaaaggugagaauaauagcaauuugucaucauugauucauuuaguaauuuaggggaaagauagucaaauuuuaucuuuauccuuauauacuuuuaagcuauacagauuuuagaauuacaaagaauauuuuuuauacucuuucucaguucuuucauaguuacuuugaaaaugaaugucauacagagaaaugaaagcagaaacuuacuuuuuuuuuuuuuggaagacgcuuuaggugauaaugccuauuacuuguuuuuaauaaguuauuuuuuguucuaaaaacauuuucagaguagugguucuuugaguauugucaagauggauuagaucaacuggaaggaacuacaggagauauuuaucuguugaguguuuucauguaguaauacauaccauuuuuauugcagauuuuaaccauuagaagaauaccaguucuggaaaacaaccaaaguuucuuugauugaaugcccauguaaugcauuggaauaugauaggcgauuaagguauacuaaugggguguggguguguguguguguguguuuguuuuucuuucuuaauucuacaccuacccaagaacuugcuauggauucuaagcuggccuagaacuacuaauuuuucugccucaaccucuuccuuagugcuggaauuguaaauaugugccaguauguaugcuuuauacuaacaaauuuucagaaccuauuauuauauaucuuuguaauauaauuggacuuaauaguaauucugaaaccuuugaaugaauuaaaaucaauaagcaaagaauaaacaaaucuugugaauuggcugaaucuaagugucuggcuuguuaaaauucuagauuuuuaaaaacauaguuauguuguagaucuaucugaauuuaccuucccccacccacucccuaauaaagaacaaagucuauauggugauuuuucuuuuuccugaggguguuacuacagugugcuauguaagguauuuaauuauguaguggacuuuauuguuacaaaaugacguguuuuaaagucaaguggaauuuaguaguuggcuguuugacaaguggagaaguagguagagucuaaaaaucagauaagacuaaugaaaauauuuuaagaaaauuugaaguauuccaaguaccuuccuaaccaagucacaacuugguuaaauugaaaaagcccuacuuucuuaagcagaaauaaguauuuuacucauacauacucagugcauuguuaauaucaauguuacagcauucuaaagauaguuauagaacacuuaaacuugcgauaacuacuaccuuauucucgaauacuuuuuuccauuuuucuaacauuuuuuuacuugauuuuuauauuuacuugagcauuucagauaguguucagcuuaaacaauuguuauuuccuagaugguaaucugguauaaaaaugaauauauugauauuauuacuaaauauuacuugguuaguuuuuuuucuaauaaaguauuagccauaaguuuuaaugauauuugcuaaauaaaaugacaguugcuaaacuacaacuacuuuucuuuagaauuguugacuauguacugacuaugaauauaaguaacaaauaacaaaucccaaagcuuugguuuucuuaagugcaauuuaaucuuaaaacuaaaauacaguuuuccugcccauaaaaccuuuugcuuuaaauaguuuaaauauuuuagaacacauuauuagguguguuuaagaaugcuagagugucaagauccauauuaaaauacuaauaaacgccgggcgugguggcgcacgccuuuaaucccagcacuugggaggcagaggcagguggauuucugaguucaaggccagccuggucuacagagugaguuccaggacagccagggcuauacagagaaacccugucucgaaaaaaaaacaacaacaaaaaaauacuaauaaacuggaguuugauauuuuuauauuaugagauagauaauccagaaaugcacauuuguuaauaauugagguaaaauagaaauguuaaauuaugacaaaacaguuuugaugugugaagaaugaauaaacuuuuccuuuaucuuacccaguguuuuuuagguuagagaguaauaaggugaaaauggagugucuuggggguugacagggaucgacauuuaauuuauaucuuuuaacucagauaauugacacaguuuuaaugaguuaaaugagggagaaagcaguauaugaguuuauaguguagguaaagaauuaaauaugugguuguuucgaauuuagaguuuaaaauuuauguaccugagagucuuagaauuuauuguuugaaccaaauauuugacaucauguuauuguucucucuauaauuauaaacuggcuuaugaacauaggaaauuuagcuuguuaaauaauuuaguaucuuuugaaagcgauaguagauacuaaaauuuuccuuauaguugaccacuuaugauacaguaagaaaccuuaauuuggcuaauaauaaaagcuauuacaguuauaaaugauuagguguccuuuaaccacccuuuaaaggacauguuguaaaucaaauuugcaaaucuuuccaauucuccuaaaaugugguuuauuagguaagaauuugaggacagagauuuauugaauugauuuaaauguuuuaguuaagauuguucuccaguuauaguuaauuauaucuugaauauaguauuuuuacuuucaguuaaaggcaugaucaagguuucaggaaaaauaauugcccuuaaaguacaguuguacuaucauuauuucuaucuuacugagauauuuacguuacaaugaagaacuauuuuaauaaacuaggauggggcuaauuuaacauuuguugaugaggggccuuaaaauuauugugauuuauaaugcuaguucauaaacuugcauuugaaaugucagaauuguuuucuuugauagagauuuuaaaguauugcaaagauuugcuaaauaauaauaaaauuaacuugaacauuuuaaauguuuguguaaagcaguuuugcacauguauauauugugguuuucuaaaguaacaaauaucccuauuuuuuuuuuccaaaauaagcccuaauguaucagaacugaugcuuucugaucgacauuuuucaacaggcaauguuuaguuaauucuaagucuucaauuuuuuuuaaaauaugacuuuggaauauaauuucuguucucagcgcuaugagccccacuuuggacauuucauuaucagauauuaacuagauaauguuauuuugauauaauuugaaagaaaauaugcagcauucuucaaaugugauuucuaaaauuaacccauuacuauuucuauauauccaaauauuauaaauuggguggugguggcacaugcuuauaaucccaguacuucagaggcaaggcuggaggauuucuguaaguuugaggcuggccuguuguacuuagugaguucuaggacagccaaagcuacacggagaaacuugaaaaagaaaacaacaaaaauaagcaacucaauguuauaaauuauauuacaaauaccuuucauacuaaauaaguauauucaaaauuaccaugcuauccuguaaaauuuuuaauaguuuauuucuaacauucuucacugacaauuuauguggaaaaaaauuuuauucauuuugauaaaaaaaugcaguuauuuuauuguuuuugcaaaauaccuaaauuuacuauauugcuacauuucauacuuuuaauuuuuaauuucaagaguagguauuacuuaaauuuaauaucuagcucuaaucuauauuauuuuguuuuuuaauaauauccaaacuaguguuuaugaaucaauacuuaaaguguugaaagauaacuugcauuuaaaguugagguccuauaaauaccauuuuaaaguauuuuaacagaauaaacauuccuauuuaucuuauaaauuaauaacuuugggcuuaaguauuuagcuguaauauauuuaacauagauuacaacgggaauuuuuugauauuugugauuuuuaaauuuuuaucuuauuacuguauggugggggugguacaugcacagggcucagaaaacaguugaguugggaccuucaacuguacauauuucagggaugaaacucagauuguuggaggaggcaauacuucagcuguggguuuuguuaacucuuuuaggcuaggucuaagaaguauuauuacaagugguagagcacaugccaaggccccagaucaauuccugaaaggggaaaaauauauauauuggcugaauacuuaaugcuauauuuauuuuuugccauucuagagauugaaccaaaagccuuguacuagcaaacacucuaccacaaagcuauauauccagugguugaaucucagggugguggugcuguuuugggguuuuuuuggugagaggagguaguugguugauuuuugucuaaguaguauauuccggucgugugccugggaggaagccagggcauuuugugagcaaaaguacgauuuuaauuuuuuuauuggaauuuguacaacuauggaagugugugcacucacucugauaaacuguuaaaacucuucagagagauuugauaaucgaguaguuacauguagccuuagaaacugaagacuguuaacguguuaacuuuuuaagaugccuuguagguucccuuucuaauaaccaaagcaguaauuuugucuucauucuccaccuuacccuuuuuaaauuccuucuuaaauaauuuuauccuaugauacaaguguaccuauuaaauaaaguguacagaagcacuuuuuuucucaguuagaugcauauguuuugcuuuuuaaauaguaggagcaucauggggaagaagcaagugucuuagaagaauugaaguugggugauugcuguugcuugucagcuagcuguacugcagagugcuguuaguguguaaucauagugccuaggaaguuugcacacaaguggaaaggcuucccauaugugcuuugaugaaugguuuuuugaaggauacuuucuuuucagugcauccuuaggagaauaguaaauauuugugguuuuuggauuuuuuuuaacuguuuauucaaugguguuauauuuaauuuuuauuuaagaaauuucacguuagaguugaaaauucuacaaauaugugugcuuuuuuaaauacuuuuaagcuaauagaauaaggagacuuaacuaauaauuaaguuguuuguaccacagauucagauguauauuugaaaaagaaaaguuguggucacuuuggaguauuucuaucacgguaugucuuugaggacauuaucuuccuuuuguagccucauauaaagaaggcugaauuauuguuagcuucacuauaauaaaaacauucuauauuucauguugucaguuauuagagccaacagaggccagaggugaaaauguacauguuguuauacuuuuuucuuacccuuaaacuuuuauauuucuagucauacuuguauuucuuuuuuuuuuuuuuuuuuuuccgagacaggguuucucuguguagcccuggcuuccuagaacucacuuuguagaccaggcuggccucgaacucagaaaucugccugcuucugccucccgagagcuggggcacacgccuggccauacuuguauuucuaaagugauaaaauauccuguucuguaucuuuuagaaauuagacuuuguaauuucaagugauauaguuuuguagacuuguacaaguuuaauugaaacuugcuucaaucuacauguuuuucuccucuuuggucuguauaauuacaguccuaggugagugaauacuagaucucuguuaaaguucggguuucagcuauaagacuuugauggaaaacuacaagugauguuuguuuuuguuaaucgguguccuaauuuaaagccugacauuugcaguuguauuuuuuaaagauacucaucauuucucuuucguugucuucauuaaaauuguuucugauccaucuccuugcuucauguuugcuuugccagucagaguaaacucacaauaccacuucguaauuguuguuacuaacaaaaauagcuuuugccauaugguauguuuaucugaguucauugagaccacagucuauucugauauugugaaauuaagcauauuaacuguaaguuguaauugcuuuuuuaggcuaguacuguuuuuaauauguuaauguaguuugacagauagauauacuaauauugccuaugcuuaaccuaaaaguuagcugcauaaucgucucuugaaaguauccucuaaccugauugacuccugcuaaaaaaugucuaucgacuggcuaguaaaauaagcuaaaauaaagcauuuuuccugaccugauacuggguauccacaauugauacuuuuuacaagcucuaaaagauuuuuccucuuucuuucucucauuucuuuucuuucuuuuuaaaaagaauaccacaaaugagauggggcaagggugggaaggauuguucauaccaaaccauuuacaucaggcuuuaucauccccagccacugguaaucuuggaucuacaaaauucagguucuaauuagaaagcuuaucauuucuacaacacuucuaaauguugguauuuucucagucauaugaagacuaauucauuaucagaacuuuauuuuugugaaacuguuuugggacaaauuuuaccuguguuagauaugcacuaaaagcagaagagaaugaucucuuaagaaaaacugcuggcuagagaaauggcucaaaaguuaaaagagagcacuugcugcucuuucagaggacccagauucaguucccagaacccacauggcagcuuacagccccaguuccagggaacaaaaaaaaaccaaaaaacaacaacaaaaaaaccuuuucuggccucuaugggcacuaggcaugcaagaaauacacagacacauacgcaggcaaagcacacaaaaacacaaaagagaugugaagacuaaaaggaaaauaaaaauaaaacucaacacuuuaaaaaauguuaauuuuuaacuagaaguagcuuuuuuuuuuaaaauguauuuucagauguugggaaaauuuguccuuuguggagcacuuggugacuuuguagugcaguugaaguuacaguagacucuuuauauguugugacauagucucauaaacuacauagccauuaaaacaagaguuguauaaauucugaauaacuauucagcaaauagaaaacaaccuuucaagaaaguguauauguguaacaguuauauuuguacuuauaguauaaaaacauauaggacauaaauaucauaucaagguuuuaguuacauuguaagagcccaaugagaucaaaucagagcuuggcacauaaggaucuuuauguguaauuggaaauuuuuuuuaacauucaguagaguuggcuuugggauagagauuuauauaggcauuauugggaaaggggaucaguguauuuugaaauaaaaagaaauguugauacuuugugagaaaguauuuugcaauaaaauacacacuuggaauacucugguaaagguauaaaaaauuagaguauucuuucuaugcuauaucuuguaauaaguacuuguauguagguaugcuggcacauuccaguaauccuagcaccuaggaagauaaauaaggcaagaguaccccacauuucagugccagucugggcuauuagcaaagcugccucaaaagugcaagugcagugucuaaucacaucccucagaaacaaaacacuaacugacugaagucucugggguaguucaagguuguuuuacaggaugggcugugaaacauuucugccagggugcaaggcucuaaacccuuucucuuacaaguaaaagucagccauggaaacaauugcagcagugcuaguuucacuuauuuuuggccucagacaccucuuagcaauauuuucuucugguauguucuagauguuuuauuuccauauuuuuugacccccuucagaguuauuuauccucauggauaaaaauauguaugaauguguguguguguguguguguguguguguaauacuuuuuuuuuaauguuaauuucuaacuagaaguagcuuuuuuuuuuuuuaauguauuuucagauguugggaaauguuguccuuuguggagcacuugguaacuuuguagugcaguugaaguuacaguagacuccccccuuuauauguugugacauagucucauaaacuaaauauaauuuuuuuaauguauaggaaucagaaagcagugauugcugacaucaauugaaaauguugcuuauguaauaagaucaaauuuuaaagucuuuacucuuuuuuuucuagguuuaacaauguuaaaaugaagauauuacuaaaauggcccucuaaauagcccaacaauuauuauuuuguaaguauuaguuucuagcuccuuccuuccucagugacccaucaccacugcaaugaagacuuguguuugguaucauauuuccauauaucugauaauuuuucuauuuauucuugaauaacuuaaauugcccauuaacacucuauucauguuugauauuaauuuagaacaagaaugauuucauugccucaggaaacuuuacuaguguggaaaguauuuuauagaaagucccugcuaucuccgagucugaagucaaaauauuaaauccuuucuuuaaaguuuacaaauaagcaaagauuuuuuuuaaggcuuauacauuucuuuauuuaauuugugaguuuaacugcauguauauauguguaaguguguauggaccugauaugcaggagagauggagaccaaggucaucaguaacaauugagugaaauucaggacagcccugcuuauaugaucccuuguauggucagggggcaguugggggacgguaaaauuuaaacaguuauaccagguucugaauuuuggugggguguauauucauuuucuuugucugagacagcuuaucugccuagccuugaaucuguauaguaauccuucuaccuccaucucuagagugccaaaauuauaggcauguuccacucacaacacuuagccacccaccugguuuggguaggaauuuaaauuugcaaauauaacaaucugauacaaugugauuuuuuuuuucacuuuuaagcauaaaugcacugggauaauauccucagaacauuuagugugaauuauuguugucaucuucuguucugaaauuugagcuuuuuaaaguaugaguguucugccuucguguaugucugcagugcgugcuggaggaagugcuuaggcuccaugugggugcugggaacugaaccugggucuuuuacagcaacaaaaugcucuuaaccacugaguaacucugcagccuugcaacuugaauuucaaaaauuuccauguaaaaaaugagcaaauugaaauacauauucaguugucagugaucaccauaccugacuuggccuaaacaaucaguuuaguuuuccuuucauagccauuaaauaaaauuuggguauguuguuguuguuguuguuguuguuguuguuguuguuguuguuguuagaacaauuucuuuuucaaauauguuacauaagcucauuuuccuagaaaaaaaucacauggaaauggaauuuuuaacuauuuaguaguaugcccuacaaaugauucugucacuuuucacauaucaaauuuuagaacuaggaauuuaaaauguuuagagaagaaacaguuccaaagauuuuauaguggcauuauugccacaucaaagauauuaacauacccagcuuuuaacuucccaaauuuguugcaguauuucaugccuuuagcuuugcuauuuaaguagauuuuuugugcccugagaauuguugcucugucaucagaacuuaaaccugguaguguuuucuccauguucuuagacaacuucauaagauggcuaugguucagaagcguccuacaaaggcuuauauguauguuaaugguucauuugcagauagggaaccagaaagggucaguguacuagaauaacagccaugggagacacucaaaggacagugucaggguucggaccucagauucuguauucugucauugugcuccaacaaauuacugguugcuuauuauuaaauucaaaaaguaucccauuauucugaugcagucaagaugaugauauagcuugggcaacaugccuauaaauguuugugaagugcuaagcuuuauggaaacaagaugaauuaauauuagaaguuuuauaagguaaaaaguaaauguuucuaaagaaaaauauuaauggaaacaaauagaguugaagggggaaauaggacaauuugguuugaucuaucuucuuaaauuguuguaaaauucuguuuucuuauacgaauaauauuaauuucagguauuuaaagauugccauguauuccuauguacacucaaguuaccuucuuaagcaaaacauuuuguuuucuuuucagaauggcuuuuuuuuccuuuuaagaacauuaguaaaaaguugaacuauguaaaaacccaacaaagaaaaauuauuuugguccuuaggccagaauauaaaccacugaauuuggaacggggcaugauggugcacgccuuuaauccuagcaugcaggagggaaaccaggcagauagaucucugaguuccaguccagccuggucuauagaaugaauugcaggacagcagccacuguccucaaaaccucucucaaaaaaccacugaauuugaaauuauaaucauuguauaaagauaaaggacaaaaucacuuuuagcagcuuuuaucuuuauuuucagacuuuuuuuuuuuaagcuggcacacuugaaagcaaagguuugaagauuuaaagacguuuugauauuucaaaugacccaacaugaacgggaauggagaaauggcauugacccacuagaaaacauuugcuacacaguaaucuaguuugaauggaaaaucugguaugaacuggaauaauaagaacaguucuuugugaagggauggcuaagucccccacuaaacagaaaagagucuucuuaauaguguaagaaaaccuagauauucacacacacauaaaaugaaguuggaacuuaacguaguaaaaauuuuguuucagcuaagucaaaguccugugguauaaaaugauacuccuuuaaaggacuagccuuuuuaacugggaaacacacaaaugguuacuuaggcuugagcuacaggauuucugauauauccuuuuaggaaaccaaauagaccuguuauccuaagaugauguucuggguaauaauaaaugacacugaacucacaauaacuauuccaauauugagauaaaucuuguguucauguguagauuggggguuauauauuuuuggggaauauguuucauguguaugucuucuaaauauuuugcuaguauaaauuucuugaaacugagcucuuacauguuuguucuuacauguuuccuuuaacaugaagcuuuguccuauggauuuggcuuugaaagaugugcugcucuuaauaagguaaaaaccaacuuuuguagcuauuucauguguuaagcacauucaaaaguuguuaguuuaauaaaugagguucuuaaguugguaugggaaaaugacuugcuuuucucguuucaugacuacaauaaauuacagcacuguauuaaguuuucuguacgcuuuuauuaaacuuaugauauggaaauacuuuuuauucugcugaaagccuauaaaauuaugcacauaccaguguuagauuuuuuucaaacauagauuuuauguguucuacuuuuuccuaaaaagccuuuucuguaaauuacuauugaggugcuaggaguuuucaaaaccaacccuuggaguaaaguagcagcacauaaugguuuguggauguugaaaaggugcaggccauacugugcugccucaaaauacaaggaccugaucuucugaagagaguaccugucuuuuuauucauagcuccuaugauagcaaugucagcggugccuuagcagcacguaaauauuggcguuaagauucugaaauuaccuccaguauugacugugcugcugaaguaagguuggcaauacucuacaacuguaauucaauguguauugauguuacuuguguguuuacacgguuuuucuaauugcauuagugauuuuauguuugguaugauucuguaaugauguuaguaacaacgcucuacauauugugucuguuaaaauacuauauaauugugggaugguaaugcagcucaguuggccaagugcuucuugcuagcaugcacaaggccauggguuuuagccuuaccacugcauaccagguacacuuguaauccuagaucugaggaaguggaaaaaagagaauuagaggcuuaacaucauccuuggccauaaagcaagucuaagaccuauguaaggaucugucuuuuaaaaacaaacaaaacauaaugacuucugugugaggaacugauuauaggacuucuagauacccagauuuguaaaugcuuggaucuccuguauaaaaugucugcucgugaccagugcauauccucccuuauacuuauuuaaacuuaucucuacauuguuuuuaauguguagugcagugggauguuaacauggauaguuguauuauucaaguuauucucuuaaugaugagaaaaaaacuguacaauucaguacuaaugcaguuuuuguccaagaaauaaguuuuuugguuuggucuuuugagccugggucucaccauguagaccaggcugccaugaaacucacugagauccucuugccuccgccucccaaauucuuuguuuaaaacuguaggccccaaugccuggccacccaaauguuuugaaugugugguugguuggauccacagauggagcacugacuaauaauauaacaaguauuuuuaagucuugaacaccuuuccagaguuucuugagagcuacagugguacagaauauacccaguaccaccaaggcucgagcucucuuuccagcauuuccauauaaaaguuuauuugaaagaguuuaggaaguaccaaauuguacaugaauuuaaacucauauuauuacuuauaauagaaaaauacuuuucucuugauuugaaguuuucuuuagauacagauaaaguuugaaaugcuacagauuauaacauaaucuugaguauaaugugccuaaauauuucauuuuaaaugaaggagaauaacacuaaaauguguacguugaauuuuuaaacuuaaauuuagaagaauccuuagaauagcugaccuuuuuauugguuaacugaggaaacaaucugaaauuuaauuugcaaccuaugacauauuaggguauaaauccuauaucuucuaacuuaauaauuacuguuuuucuuauuuuucacuaaaauguuuaacaggagauuuuuauaagucaaaaguaugaaagacaucucaucugugccuuaauauuuaacuucagauuaaagcuaacagucauuaauuuuauaaauauauucagaauauuuuaauuauuucaaaggaaauguucuuuuuuuuuuuuuuuuuuuuuaaagauuuauuuauugauuauauguaaguacacuguagcugucuucagacauucuagaagagggagucagaucucguuacggaugguugugagccaccaugugguugcugggaauugaacuccggaccuucggaagagcagucgggugcucuuacccacugagccaucucaccagcccggaaauguucuuuuaacuaucccaugugcuuuauuuuaaauguuuuacgucauuauuuuaaaauguucaagaaaacacauuaucucacaauaauguccucuaacucugucauuacuuuuuacaaggagucucuuaccuuuucagauuaaagguucauaauuaauucuaccguguguuguggagauccuaaaaguauuucaguuauuuuuuaaggaauuguccucaaaagaaccacuacucaauucuaauuuaaagguaaaauuaaguaaguuuuaacaaguugauuuaauuaacuauagacuccguuuuuggagcauuuuuucuguguaugaguacacuguagcuauauugaugguugugagccaucaugugguugcugggaauuuugaauucaggaccucugcuugcuccaauuggcccacucacuccagcucuguagcugucuucagacacaccagaagagggcaucagaucucauuacagaugguugugagccaccaugugguugcuaggauuugaacucaggacauuuggaagaucagucagugcucuuagccacugagccaucucuccagccccaaaauuuaaagcuuuuauaugauaaugguauugccucuuuuacaaaucucugugggccacugagguaagcauuuguuacuuaagcaugauaucucuucacagcaauagaaaacuccuuaagauuacuuuaauuguauauaacuuuucccacuacuuuucauagggaagaaaucgccuguauauauuaaaauauacauuuaaguguaaauuuuaaauauauuuucacugacuuggaaaucuagaguucauuucuaucuuugugacuauuuuugaaucauaaauaguagcaaaauuaaaguuauacacauuuacauuaauaacuaguuaucuuucaaggaaauaauuagacguggauguucucuugugaucuagaguuuuacacauacaauuuuacaaguuaacauucuaauuaaaauugguuuguuugguuuuuuuuuuuuccuuuugcaaaggaauauuacuauccuuguaugauauauuuuuucucaguguuguuucucauuaaauaccauccaaaaagaaaagaaaauguccuuaauuguuuuaaauagauuuggaucagcauguauuuauacauacuacuuacauaucuuggagaagaaaugaaagaccguuaaugcauuccaucuuccaaggaguuaagggguagcuuagaaugaguuuauuucuaauaccuggaaccuuuuacugcacagcuuauucguccaccagaaacugaaggggucauguucuuggcuuguauguuuaugaaguauguccuaggcgcaguuuccaaguccucuguuccuuuuucacuuucuguuguuuuguuuuccuuugguuuucuuuguuuucuuucaguguguagucauuaaacccagaaccucagagggcucuacuacuaaaccauauaccaguaccaaaaccgaaaaauauugacgauacuuuugugcugaauauuccucagccuuaacuuacuaaugcuuaugcccaauggaucuuccuucaugaaguacccucuccucccccccauuuaucuuuggugauuuuaauaaauaauaccuuuggaaaaugauaguuuguauguuucuucacuguguauuacaauauuuaggaaugcugauauguaaacuuuccaugugcaauauuuaaaauaccauuuuagugugaaucaaugaaaucuaguauugcacugaaauaaagagaaaauuuaaaucguuucuuuaaagaaauuguaaguuuuaauaauuacagauuuuauaucaauuuuuauauuuucuuuucuagugguaugaaaauauuaaauguuugucagauagcauuaaaaauauacuugaagugaaaugugguacccacauguaagcccagcccuguuuaauuaaaccaaaaaguacaaaaacagccaggcauggugacacgcaccuuuaauugggauugaagcacucaaggcagaagcaaguagauuucugugaguuccaugucagccugggcagcauauuugagauuuauaguauuuacauaguaagagauaaaaauuuauucuauuucagugcugaagaucauaccaaaaccaagcagauaagucccuggcguucaugggguuuacagugcugauggguagucgaugaauaccaggaugaagaaaaauauuaccguuuuauguucugugggaaaauuaaggaagcaagaugggccaggcggugguggcgcacgccuuuaaucccagcacuugggaggcagaggcagacggauuucugaguuccaagccagccuggucuacagagugaguuccaggacagccaaggcuacacagagaaacccugucuugggaaaaaaaaaaaaagaaagaaaggaaaggaaaggaaaggaaaggaaaggaaaggaaaggaaaggaaaggaaaaagaugggagugguaguuauuacuauuugaaaguuuuuguuuuguuuuuucaaguauacuuuucaaaguauguuugggggauguccccugcagguaacauuugaauaguaaaaaugagauaagguauccaaaagaagaccucugaauaguugaaaucacaaauauaaagauuuuugaaacuaacacauuugggguguuuacggggacagcaaagaguauauagaaaacagaagagugaguuacaguaauagaauggaaacaaguuagaaguuggggcugaugagucugcuaggaaaggcuccuguaaagccaagccuggugacugaguucaguuccccaggacucuacgugaucgagggagagaagggucucaauuaaggggugugugugugugugcgugcgugcgugcaucugguguuaauauaaaauuugguuuuaguacuuuaggguaacuuggacauuaaaauaaaauucagucuuaauauuguaggaaaaccuaaacaauuacauucuccuuaaccuuuuggcuuuuacaaauggaagaaaauguuuuuauucugacucaguagccuccauccaagaccauuaagagaacggggagaaauguuaaaaugagugauuagccagguuuuuauuaauagugcuuuguuggcucucaaauuguuuuccucuugaucaguuagcaagagucaaaguaaaugguuccaagaaacacugaauuuguucauguuugucagcggcccaaacagccaaagucuuuuaauuccuccaguuugggaauugcuguaccuaagugccuaguuauuucucauuucuuaguuaagucuuaacuaaggauuuuuuuuuuuuuuugcaucaguguuagucuaaauuuuuaucaccuucaauguauaucacuaauuuaauuuuuuuuuagaauuuuaggguuuuuuuuaagauuuauuuauuauauguaaguacacuguagcuguuucagacacuccaaaagaaggagucagaucucguuacggaugguugugagcuaccaugugguugcugggauuugaacuccggaccuuuggaagagcagucgggugcucuuacccacugagccaucucaccagcccuuaauuuucuaaaacacugcccuuuccugcagaauaaaauucaaaguccacaguuaguauaucaugcaucagucuuucuaaguuguuuuaaaaaaaaguuuuuuuuucagauaguuaacucuaagcuuuuuauuuuuaaaggccccuccacgugcaugcauuauugugugggcaugucccauguggccacgaagggcacaaacuuuguguguucuucccuuugacauuuaaaagaguuccagggaucaaagucaagucaccaaguuauacagcaaguaccuuuacuagauaugccaucuuguugguucccugucucugguacacuuuacauuuuagaccagaucucucaugugugccaaguauuuuuuuuuuaaagauuuauuuauuuauuuauuauauggaaguacauuguagcugucuucagaagagggagucagaucucguuuuuuacggaugguugugagccaccaugugguugcugggauuugaacucuggaccuucggaagagcagucaggugcucuuacccacugagccaucucaccagccccgugccaaguauuucuugagcagcauguuguuaacuauuccucccaugagcugaacaaagacccagccaugccugguggcgcacaccuuugaucccagugcucaggaggcagagacagguagaucugaguucaaggccaguguggucuacaagugagcuccaagacagccaggacuagcuauacagagauccuugucucugaaaacugaaagaaaaauaaguaaaaagaaaaugcccaaaaggaaagcuuugcaauaauagcuaucauaaguuuuuuaaaucagugauucugauuugcuuaggagccuccagaggacuuuguaguauuauaaguuguucauuugucuaucugagauuguauaucuguagcagcaacagcucagguuugacaucaggcuaaguucugaaaaaggaaaauacaaucagaaauguucuuucuagaaagugguauauugguguaacucaagagaauuuugcaaugauuuuaaauaucuucucuagaaguucuguguugguauaacucuagaaaacuuucuaaugccuucaaauaguugucaggaugucaggucuaaaagaaacuggggaaauggcuaacugugguguuuauuaguauaccaaagagcaugcuugccuccaagcccucagccuagaaagcaccuauuacagaauccaugcugguauccuagcucgcucuucucagcuuuccucacccaauccuuaccuucaagcucuucaauucaugggcuucccuuccuccagcuuuucauucugccggccauacuuuuucucccuacucuggacgccucuagaugacuccagcugugcucuccuucguaaucuacacacccuccucaaccauacccuggaccagucauguccucaucucagacacgacuuuucuggugagaaacugaauucuuucaaugcaugcuuccuuauaccagauugccuugguuucucuauagucaauuugaaggcuuaaauuugaauucuguaaauaaagauucugaaaaacuagcauacaaauucuucauuuaugcaaauuaaacuauugcuaauaaacauuugucuucccaaacuguuugugauuggaagucuuucauauauggcuaauguuaaaucacauguagaguauugguauaaaccaauugaaauaaaggaaaaauaugaaauauucaggugucuuaagaagcagccagaggaacuacaaggccuuuuaggggaaaaaaaauauuuauuuauugcacugaaggacaaaauugaggugaguaaacuuccagaagggaaauaaaccauaaaagcccaucuaccaacuauggaguguguauuaugguaaugacuaugucauaaggaccuuagaauugaugaaaugggaaggacauuuuaaaggcuucuugaaaugaagaaaugugauacaucagcuugaacaucaaaauucuuacuuuggggcuagagagauggcucaguaguuaagaggacugacugcucuucuagagguccugaguucaauccccagcaaccacagcaugacucacagccauccguaaugggauccaaugaccucuugugugucugaagacagaguguacucauauaaaacaaacuauuuuuuuuuaaaaaucuuaccuuauauuuuuaggucuucacacuguguuagaaauaaggaaggugauaaagaaugccuguaagguaagcuugaaugaggcagugucaagcacagguuguccucaguauuucacagugguacuagaugucccacuguuaggauuguucucaggucccacaauagcauaaucuucccauaagaaaaugacauuuguccuuaauagauauaugcuacuuauaguugcucauuucuagaucuuaaaguauauagguuuuauccuacuuaauuacaugacauccuucugggagcucaucauugucuagcaacacacccuugccauugaugaacuaaacuacuuggaaacacugaauauguguucaaaguacugcuguccuggaacucacuuuguagaccaggcuggccuugaacucagaaauccgccugucucugccucccaagugcugggauuaaaggcaugugccaccaccacccggccugaacccaugauaucuuagcucauuaaugacuaauguuguaaauaaggcuuuuaauuccacacuccauucaguaaauguuaguucuguuauuuaauagaauauaauaacaguauuaguguggcuagccaaauaaggacaacuuguuggucagcuagcaugaaauuguucaguaagaauuucaguccucaguuaaguaaaauuuauaggucaccaacaucgguuucacugaaagccaagaugcacgugaaaguuguggaacaauauuucaugaauagaacaauccuuauaaggauucuuuauucucauaaagaugacauaguaggauaaaguucacaaagcuuauuuaccucuaguauuucaaagcuaagagggucuaugguaauauauauuuuaaacauucagaaaacucuagaagaauaaaagugguucccagauguucuugcaaaaauauuaaagcacuuuggagauaaggaauuccaguuuugcuaucaccucaagauuauagguuuuaaauguauuaaacaccuuuaaucccagcacuugggaggcaggggcagguagauuucugaguucaaggccagccuagucuacaaagugaguuccagggcagccaaggcuauacagagaaacccugucuugaaaaaacaaaacaaaaauguauuaaguacauuaggaucucagugggggucaggaaaacauuuagaaguguuaaaacccuaaaguauuaacauauuugcuggaugugguggugcacaccuuugaucccagaauuugugagguagaggcaugcagaucucugaguuugagagcaacacugauauaacauuuuauacuugauauaauauaguagauauuaaugccuaauacucaaauauuuaacagcaacuucaaaggcaaaucagaaacauacuuuuaucaauguuuuuagguuuauauuugcauaauggagaacaugagaguuuuguuuuucgagacaggguuucucuguauaguccuggcuguccuggaacucacuuuguagaccaggcugccucugccucccaagugcuggaaauaaaggcguaugccaccacacccgacaagaauuauuacagaaauaguaaaaugagguuguuuuuuuuuuuuaauuucauaguacuuuaaaccuguuauuugcucauuuaaggaaaacaucaugcuagguuuuuuaaaaauuagaauuaagauuaauuaaccuacaagccgggcgugguggcgcacgccuuuaaucccagcgcucaggaggcagaggcaggcggauuucugaguucgaggacagccagggcuacacagagaaacccugucucgaaaaaccaaaaaaaaaaccaaaacaaaacaaaaaaagaaccuacagaauaauaugcaaagugaaacaaauauccaugagauuguuuagaugauucuacacauaaaaaucugcaaguuacuuuuuuaaccuuauuuuaaagguugcagacaauguagcuuccauucucauucagcaaggcagacacaauauucauugaucuaauaaguuaucuuuuucaaagacacuugccucuguuauuagucuuuagugucaccaggauguauuuccuuagcauaauaauugagcauguaugagaacuuuuaagauugccuccuuuuaguaaagaaggauaugaaaauaaaggagaggaaugggcaugaucaguguaagucauuuguacggugaagauguagcuuagaagaauacuugucuaauaugugcaacacccugggguuuauucccaagcacuaaaaaccauagauuugugggggaaaguuugcuaaggaaauacuuguguggcuugguaacuuccaaggaauaacaauguaaacaaguuuaaacuuuucuguccuagaguucaggguggucuugaaaauuggcugugcgcugguuagcugugaaccuuaaccaaauuugagaauuuggauccugucauguccugaaacuuuuaguccuaaauaaagaucaacuuucaaaaaauuauauuuacauauauuuaauauaauaacaugauacaaacaaaaggggaaacuugaagcuacauggaaaaugugaugucaccacguaauucuggaauuuuauguuuaacuuugccauaauacaaaacuuggauuuguuauuuuuuuccuuaaagcaaaauuaucuccacugcaccuuggagaauagguacaaaagggaagacauaguaaguaucgauggugcacacccuaaguuuaguacuugaacugaaagcauaucaggauucugucuccagaaagaauaaauaaauaauaagauaaaaucuaacaaucaccaaacaggaaaauaaauaaaaccuuuaaaauuuuuuaucagacaaaauauuuaguuuguaguagggaguuaugcagugcaguuaauugaagcuuacagucacuauuaaccuucaaaugucuaaaugcauuaguagaaacugcaguauuugugucaucuuaaaguacuauuuaauaagaucuuaugauaaauucuuguaaaguauaaugcauguagauauauauauaaaguauaauguguagaaauuuugagaauugcacugacuuaaaucauguaaccccaguauuuuuguacuuuuguauguaaccccuccuggccuggagcucaggucugucuaccuugccuugucuccugagugcugagauugaagaguacaagcugggaaaguagcucaguugccagagugcuugacuggcauucaggaagcuggaggguugauccucgggaucucagaagcugguccuagugguacacagcacuucaagagcacaaucaggauagaccucagauauaugagauccugucuccucccccacccccaaggaggaagaaauugaguuacuaauuuggcauuaaagauuuaacuugaagaauuacacuccuuuaaggaaacuaaucaaaauuguacuaacuucacaguucauuucaaagaugcacaacaaauauuccaaauuacaagugauuucaguuaaaauauauugguugugaacuggaaaauugcuucaaccaaaggaguugaauuaucaaaaucacuuuuguugaugaccuauaauaccaucuauacaguaguuuauagcauggcuuuguuuauauaauggagagauugcuguaagucaauuccagggcauuaguuauacuaggaaaacaugcuacacccaagcuacacccucaucccuuuaaaaacaacuuuauauauauauauacauauauauauucauuccuguugguuuguguuugauauuaaagguguugaacauuuauaauuuagccaaaagucaaguaucaaaccaacaaauaauaguuucugugguaaaacaguuuccuuucugucuuaaucugcucuaugacuuguucucuagaugugaauuuugaaaccauggagauaccacacacaccccuccccacaaaaaggcggggguggaguuuggggggguuggagaacugaccaaaccacuuagagcaugugaagaaggaaauaaacuagaaacagaaagacauuguacgaaacaaugucuggcaucagcucacuuaguagacaaaagugccacaugaauuaauccccucaguacaaaacuguaaguaauuugaagcacuuauacagagauugggcaguuaccaguagaaaugucuuugaugcuagggauguggcucaguuagucugccuaacauacacaaaagcccugaguuugaucacuaacacccaaaacaacaaugggugugccgguguaugccuauaguuuuggcauuugaaugguagaguuggcagaaugagaaguucaauuugucuucagcuauauaagguugacauuaagcuagccuauagagaaccccauacccccaaaagaaaaagucuuuguuuuauaaguuguggccuaccaacuuucaaaguauaggacacgaugcauucucagauauccugguuuauaguaguuuuguuuuuuguuuguuugcuccuugaggcagggucuuuguaguacugccuggccugggacucacuaugcugaaaaagcuguccuggaauucaugaagucuucuagcaaggaaguuggacgugauuauuuuugucuccuaagaguaaagaauaucuaaaucaaauagcaauaagaauggaacugauccugaagcaaagugauaccugcguguauccuagccauugggaggugaaggaaggaagugggaaacagcauaucaagguaaaaaacuuggaacauuauuaagauagaaaggagguauaaggagcccgugcucuuguucuggaaggugacggugauguuacugaaggaugagaaaccaccugaaacacugagccuucucacaauauuacauuugaacugauaguucggcauuuauuuuuaaaauguuuugauuaaaggucacuggcuuuaccaagcuaagacugaaaacuucuggauagacagacaaauuuggcaauaauucaaauaaagccaaugagaguaggcaaguucacugaaacucuguagcgaggacaauuaguuucuuuaaaaaaggaaaaaaaaaaaaaaaagccaggcggugguggcucacaccuuuaaucccagcacagagaaacccugucucaaaaaaacaaaaacaaacaaacaaaaaaaguugauaggacuaaagagauggcucagagguuuaaagcacuugcucuuacagaggaccaggguuuaguuccaacaccuucaucaugguucauaaacaucaguagcaccaguuccaugggauauacagacauauaugcaggcaagacccuuauaaauaaaucuuuagaggaauugaauaaaauuuuauauaguuauaaacauuuaugaaaauucacuauuuuauuacaauaaaauauuaaauauucccacuacugaaauuuuuuuuguaaaaguauaugucaaguguaucuuuuuuggaaaaucccuacacugucaguugagggucuaugagcaaaauguguuaaacuuuuuaagaaacugaggaauuaaagucuaacuuuaaguucaguuuaaaagacuaugaaauuuacaugguuuuaauuuuucaagugagaagccaaauaauggaaauugggggguggggugccagucuccagguucaagaaacacuaagacaaagaucuuccuaauuaaagagcuguaaugaaagaaauuuagccaguuguaguggcacacacuuguaauuccagcacuugggaggcagaggcaggcagauuucugugaguucaaggccacucuggucugcaagaauuccaggcaaccaggacuguuacaaagagaaacucugucucaaaaaaacaaauuaaaugaacagaaauuuggaaaccagaaagacaauugucuaaaacuacaacuguagcauuucaaaggagauuuagcaagagauuccagaagaugaccaaaaauaaauuuaauugacucauucuuaaguauguuucuucaaaaauaaauuggggagaaaaaaaaaaaacccacacagauuauugaaaucaggauuucagguuuuguaacaguucaguaguuaaaagcacuugugggcuggagagacaccucggcgcugacugcucuuccgaauccugaguucaaaucccagcaaccacaugguggcucucaaccaucugucaugagcucugacucccucuucuggagugucugaagacaacuacaguguacuuacauauaauaaguaaaucuuuaaaaauaaauaaauaaauaaaaggagagagaggaaagaaagaaagagagagagaggaaggaaggaaaggaaggaaggaaaggaaggaaggaaagaaagaaagagaaagaaagaaagaaagaaagaaagaaagaaagaaagaaagaaagaaagaaagaaagaaagaaaaagaaagaaagaaagaaagagaaagagaaagaaagaaagagagaaaagcacuuguuacuuuuacaaaggaccuagguucaacucacaugguaacugacagcuauaacuccagguccagaggauccaaugucuucugacuucugaacacuaggaacacagauaguacacaggcauacaugcaaacaaaacuuguauagcuaaaauaaacguuuaaaaaauguauagcuaaaauaaacguuuaaaaauguaaaaaauuaaaaaccuuuuuaagauuuauuuauuuuauguauaugaguacacuguagcuguacagaugguugugagccuucaugugguuguuggaaauugaaauuuuuguuuguuuuguuuuuuacagacaggguuucucuguguaguccuggcuguccuggaacucacucuguagaccaggcuggccuugaacucagaaauccgcccgccucuaccucccaagugcugagauuaaagacgggaauugaauuuuuaagaccucugcucacuccggucagccccacuugcuccagucaacucugcugacucagucccuggucgcuccaggccaaagauuuauuuauuauacauaaguacacuguagcugacuuuagacacaacagaagagcgugucagaucuaauuauggguguuugugagccaccaugagguugcugggguuuuaacuagggaccuuuggaagagcagucagugcucguaccuacugagccaucucuccagccccuagaaacaaaucuacaaucuacaugacugucccuggcauguacuuuggcaccaggaagacaguaaacuucucuaacuuuccauauaguagcuaauacaauacuaaaauuugcuccugguaauccuuuuguuguuuucuuuaacaacaaagcaacuaucaaaauucucuauggauagauaccuccaacagaacuguuucugucacuugugagaaucagcacaaacauaaagcaaagcuggugugucagauacaagcaguguagaaaaaaaucagaagugagcaaacucuguauuuuucaaauuguccuaaacaaucuucuacuuuagauucuugguuucauguguauuuuaaaggcugcucaaauuagcuccuguuuuaucacaagguaagagcuacaguguuuaacccaagaaaauuaaguuuuaguagcacccuucagaaaacuuuacaggaagaauuucuaauuaacuuuguaagucauugagguucaagaagaaucagaagcuaaaaccuuccaugccuagucagaaauaaaacuggaugauggaaagaaacuugauucuaaguuagaaaauacaagagucccaacuauuaaugguucuauuaggacugacaacgcuuagcacgccauuaugauguuuauuuguuagcugagaugauaguauuugggauuugugagaucaagguuuucaguguugcuggauguacugggugguucugggucagcuugacacaaguuagaaucauccgagagaaagaaaccgugagaaaaugacuccaugagauccagcuguaaggcauuuucucaauuaguaaucaaugggggagggcucagcccauuuuggaugggccaucacuggucugguggucuuagguucuguucuguaugaaagcaagcugaacaagccaugggaaacaaggcggucagcagcacuccuccauuggccucuucaucaacucuuagcuccagguuccugcccuguuugaguuccuuuggugauggacagcaauguggaaguguaagcucaguaaacccugucuuccccaacuugguuuuugguuaugguguuuccuugcagcacuagaaacccuaacugagacacugaacaagauagguuuuuuuguuuuuguuuuuguuuuuggcacuuauaacuuaaaauaauuugaggcuugagagauggcuuacuggcuaaaagcacuuaguacuuuuccaguggacccaaguuuaguucccagaacaccaugucagguggcucacaacuaccugugacuucaauaccagggaauugaauaucaucuucuugacuccuuaggcacauaaauaaaaauaaguauuuaaaaaauaagugaauuccuugaagaagauuuaauuggugacuauaugaaaaugucugccuuccuuucugaaagacucaugcugauaucccaguuacugucccauucaauacaguggaacagaggagcucacugagaugacagaugcuuccagaugggauaagugcuaaaauaaugaacucugcucauucugaaaauauacuuucccuaaugaggaacacauauuucuaaaguauggucaauuuauagggcaaugguggcacacaccuuuaauucuagcaaucaggagaaagagguagguaaaucucuggccagccuggucuacagaguuacaggagauacauacauacauacauacauacauacauacauacauacauacauacuuggguauauauccauggaaauguauaauauguaacauuuguucguacuaaguaauauucuuagcauggaggaccuuacuguacaggacaauaaucccuguccugcuacaguuaacagcacaauuuauaauauguucauuaaaaagaaaauucuguuucuaaacucaaaauugucaucugcaaaugugaaugacuaagaacauguuaauagcaucuuaaaccuuucauguuuucguccuugcuaaacugagauagaauauugucuuuuacuuaucaguuuuuaauaaucuuaucaacaaacaccauaaagaaacagcauauguaugucaguuauauucaacuaguuaaaucacacacagugcaaaaauuuaccaaaauaauauuuuccuguagaguguaagaaaaguacaccuaacucaucauuuucuaaacuaaaacaauucacuaaaguaaguuucagccaggcagugguggcacacaccuuuaauccuagcacucaaaggcuuuucagauuuauguauaugaguacacuguagcuauacugaugguugugaaccaucuugugguugcugggaccucucuucacuccagucggccccacucgcuccuguguacacuguagcugucuucagacauuccagagggagucagaucucauuacagaugguugugagccaccaugugguugcugggauuugaacgcaggaccuucggaagagcagucagugcucuuaacggcuaagccaucucuccagcacaagauuuuuuuuuuuuuuuuuuuaaggaagccaccaguucuacagaaaugcuaacaaaacaggaauuccuucuuaaggacucccuagcuuuuggaccaauaccauagucacugaccuaaacauuacuaaaagaauucuacuucuuauaaguuuuugagguacucuuuaaaaagguugagguuuuucuuucuuucccacaauuuaaauuucacaaaucugagccacccuuacaaauguuuuuaccaaguuuuucauuguuaagguguuacaguaagacuucugucaguaugaacaguaggccuuauuacuauaccacaagacuggccacaaucuugggcauacacaaucuuuuagauauggcuucucuuuccccaacccccgccccuuuuuuuuccaaggcaggguuucuccauguagccuugguuguccuggaacucacagagcuccaccccccacccccuaacccccacccccuaacccccacccccuaacccccacccucagugcugggauuaaaggugugugcuaccaccccugggcuacagcugccuccuuuucaauguuuauuuuguguuaguuuagccuuuccuucuuucuccccucccacucccucugcuccuuucaacagguuugcaccacaguguuucaauagcaaggcugaugacuugaguaugaaagcugugaaucaggaugccaggcagacagaauggauaacauucuaauuaaaugaucagguaacaucacagcaugcggaaugcagcacaaauauguccauuacauuuacuuuuuuuuuuuuuuuccuugaugcucagaggucccacauuguuuccagucccuucauuguauuuucucugagcccaucucagggaacuuuuuuuuuuuuuuuuuuuuuuuuuuuugguuuuucgagacaggguuucucuguguagcccuggcuguccuggcacucacuuuguagaccaggcuggccucgaacucagaaauccgccugccucugccucccgagugcugggaucaaaggcgugcgccaccacgcccggcuucucagggaacuuuuugaccuccaguagcaucaaucauuguguuaccucccagaucuucuaugcugaaggcaugcaaccccuugggguugucuuucuggaccugaagguccaccauagcuuuguugguacaguaaaacuucuaagaacuuaaauucuuuaauguagaacuuguuguaagccaggguaaccaagugcugcugucaagggagcaaucguaaugacugcaauccacucaacuugcacuguugaguaagagaugagagccacauuuaccaggaaacuuuuuccaauguuguacuguaccuagguaugaccaaaauaaacugccuggugucagggucaaguuugaaucaacacaggcucacuaaauccugcugaacuggaucuccuucucgccucacauggaugguuucucuaccagcccugguauuugcagggacccccacaaaaguguaaaccaaauaaacuccuccccauuuggcuuuuggucaugguguuucaugguagccagaguaacccuaccuaagaaaaauauuuaaaacauguucuugaaugacuugcauacuuugaaguacauacacauaacagcuuuucacucaacuacaagcaagcacuaggagccuuuugaugaaguacuuucucuuuuagguguuauccuaguguuuaacacaaauaaaacacaagagaaaguuauguguacuuuguuguuguuuuguuuuguuuuguuuguguuuuucaagacaggguuucucuguguagcucuagcuguccuggaacucacucuguagaccaggcuggccucgaacucagaaauccaccugccucugccuuccaagugcugaaauuauguguacuuuauuguucuaguguuuuccaccagauguagacacuguaugauugaugaguuuggcgcaauacuguauguauaguaguauuagaaacuuuucauagaacuuaucuuuaagugaagaaaaccugguuuggggauuuuuguuuuuggauuuuuuguuuguuuuuuguuuuauugguuuuuugagggaaaccugguuuuaugauaauaugugucuauacagaaggaucaucugcugagggguacaaucauagucauagagggcuuuguaugccugaggguucagucacugacucgugguuucaauagguguggcucccaauggacucaugugucugaacgcuuggcccauagggaguagggacuacuaggagguguggccuuguuugaggaagcaugucccuauggaggcgggcuuugaggucuccuauguucaagcuaugcucagggugacacaguuuccuucuguugucuaaggaucaagauguagaacucuuggcucuuccagcaccuugucuaucuggauacugccaugcuuaccacugugaugauaaugaacuaaaccucuggaacuguaagccagccacaauuaaauguuuuccugauaagaacaugacaucgccauggucaaggugucuucuuauaacaauagaacgcuaaggcacugacacugcagagaagcaaaaggcaagggagaaaacaaggcccuggagaagagauggguuugaaagcaagugacccaugaucauuaucauuaauaacaguuacugaaugccuaccacaugccgggcaacauaaugagaacuuugucuccuuugaggaguuacuuuuuuuuugucccuaguuaauagauaaaaauuaaaacacagaaauguuaaaugucucaauuaagucacauagcuaauaaaugacuaaacuaggauuagacacaguccaaguccagggcccauuucuaaaaacuaugagaguucauggcgaaagaagcaagggccagagcacaaaguccaaugcugauuugagagaagaggcaguguggcuuuaagcacugcucgaggaacccaaaguuacacaguacagaucugacagacaguccccgauauggaauguccaaagaacagugucacuucugagacggcgcuggcauggugguaguuucugauuuggguguuuuacucaucccaaggacuugagggguuguuauccuuucaaagacauagcauucacuuuuuucuccagaggcugguguucuagugcugaccagaugaaagccuuccuuuaauaaaguguccaccaguaggcccaagacauuuguuccguuggccaauuuucgauuaucaggcuuuauggaaauguaccugaggcauacaaagaaguaaucaauuacaaagcauuccuuuaauaacaaaacuacacauagaaauuauucauacccucaaauaaaggcauuguaccuuucucuucuguuuuuguuguuguuuuuaauuucguuuuguuugagagaguuauacuguguaccaugauugccucaaauucaugauccuucugccucaaacaaaaugcuaguauuacagaugugcaccccaggcuuggcaacagcuuguuuuuguuuguuuuuauuauacagucuuacuuuguaucccaggguggacuucauuucauagaccauacuggcuucuuuuuuuuuuuuuuuuuuuuuuuuuuuugguuuuuuuugagacaggguuucucuguguagcccuggccauccuggaacucacucuguagaccaggcuggccucgaacucagaaauccgucuaccucugccucaccaagugcugggauuaaaggcgugcccaugcuggcuucaaagucagagauuugccugccucuacuucccaagugcuaggauuaaagacuuaggccaucguaccuugccuggcucaugaucuuuuuuuaaaaacagauuuucuuuugagucuucauuuucaauuuuaaaucaguaacugaauauuaaaagagaccaugcuuccaacucaucccaauuacauuuaagaauauaguugaaaauguuggcuuuucagugaaauuauuuuagggauuggucaacuuggucaaagaauuaaacuuuuuugcuguuguuguuaauauagaguaacacauuuccaguuuuuucauuuuucuuuaacccaauuugacuaaauugauuuguuucuacuaacacuguauuuuuacaauuuuccacuagcucuaaucauuaguacugccauuguaaguugagauuuauuccugucaaccagccuuuucagguuaaaauuugaagguacaaaaugcuaagacuccaauuuauugcuaucuuuucaucaauagcuaccuguuauugaagagaaaauauaguagucaaaaucugauugaaaaugcaaaacccuuuacccacccacuaaguauucuacaaugucagcacauauacccauguuugcuuuaaugauggcauuauagcacagaaaauaucugucaacaaggauauuuuugugacuucccauuguucuaaaacugugacaugaggcuuagguuagugucagguagacacucuauaguuucuuggggguaaaacaauguuugagcacagcccuagucaugaacugagggcauggcugaaauggugacuacuggaugccaaguucagaaacuuuuuacuggcaaagaaaacaacaaccagcuaaaaauuaucaagcuacaaaacacauuucaagaaagguuuauuguguuugguacaaaauuuuaacaguaguaaagcacuucaucuuccaaguucagaucuaaauuauuugucagaaagucacagaauaucauaaaaguacuaggauacaaauagcaaguaguagguacuuacaaaaaguagaauguucuuacaauaacucauugagcuaaaacuauuguaucugauucccucugagaucaaauugaaaaggauuucauacauauaaaaaguggaugaacuaaagaaaaggagaaugugagcuugcauuucuagugcugcagauagagcccagggccucgcagugcaccccaggcagggacucucccacuaagcaccaucaccacaccuccccccccccacccccccgccucucccccacaccuuuuuuuuuuuuuuuuuaauuuaagggcaacuaugcuuuuucaucuaguuuaaaaaaggagagaucagaaaauggcuacagaagagacucuagaauccugaggccauaacuugaacuaaaguauauugucacauggauggacaucuaaagauacaaaccaagaaccugagagagaacuacaaacacauugaagccagccagacuuauucuaucauauccaccaucuaaaaacaucugaacagacaaauuaagaccaaaaacuagcuaaaauaaguaauugccaacuagccauauacucaaucaccauuuauguucauaucauuuuugggagggggguguugagacaggguuucucuguguagcccuggcuguccuggaacucacucuguagaccaggcuggccucgaacucagaaauccgcaugucucugccucccaagugaugggauuaaaggagugcaccaccacugccuggcuuguucaugucauuuuauagauucuauaucuagccugaaacuggcacucuguaaauuaaacaccagaagaaacuccaaacuuaaaacaaccaaaaaucccaccacaagcugggugaggucuauaaucuuaguacucagaaggcagaugcaggaggaugagacagucaaggcuaaccagggcuaugagacccaucuaaaauauauauauauauuuuuuucuggucuuauaauuaucuguuaugaaaauuuaaugucuuuuuaagauugaauugaaaaaaaauaaguccgcgcuguuccaaacauguaacaaaaaguuaggagucaaaccgggcgugguggcgcacgccuuuaaucccaggcagagggaggcggauuucugaguuccagaccagccuggucuacagaguuauuugggagaccaagaaauaaggaaauaauuuauuuggaagaccaagaaauaaggaaguguagacacuuaguugcacugccaacuguccucuaguugguagcugagacaaaggaguaugcugugcaagaagcauugaaggcuucuaccugauggcuacuguacaggcuaaaauaugucucucuuccaaacgugacuugcuuuuaaauacucuaaauaaugaaugcaugaaaacuauuuuccuccuaaaaguuaaaacuaguuuucacaguugauaauaaugacacacagcacuaagacauuuuuaacagggggugagguagugugucucugacuacagggcagaaaucagccuuugauuccagcagaggcagguguggcagugguacucaccugcaaugccagcacugggggacagaggcccugagacuuccaggccagccagaguuacagaguaagaucuuaucucaaguaaaucagaacaaggcagccauucuugagauacugacagccuauuccaguauuuuuaacagugauagagccaaagcuauagcaggacacuaaauuugccaugagauuugccugaaaccagcuuuaaaaauauucuucuccacugaagaaaagcagcaaacuggaucauucuaaaucauuccuuagcaauggaauauaauccacagaaccaguugcuguuguaaccacacagagcaguuucuaguuucccugggcaguguugguuuauuaccuguucaacaguaccuuagucuguaaguguccacguuuagaaaaugacuacuuguucuauugaacauuagucuaaacuuuuuuuuucuuuugccaagaggaguuuuaguuaggcauaaagaauuuucaauuuugagagaaaauaucagaaaacuaacuugaauagaagagaugcuucagcauucaaaauaccugacuccagcuugguucucagcagcgccaucggagccacaguggaaaagcagaucguggugagaaggucuuuguggagguaaagccagaggggaguuccuguucccggucagugcugugggucgcucuacaaacauuguaauccucccacuuagcaucucgauuguuuugcugcaagagccaaacacucugaagaaggcuugaguauuuugguuuaggaaauggaccuccaugacagcagaucuugauuggagcaggaauuggcuuaagagaucaacaagagaaucaaguucauagaaaagagccucucucugaagccuaugauggucugcaaaguccgaggguaacagaagcucaugauuucucaaaaaaucuaaaaugaaacuaaauaaagcaccaucucuguccacaaaaaucuggccaucaacugucuugaacucuuggucucugccaucuaacaugccugccaagcgagaggcagggaacugcuugaggguagagggccuuguugugaauauccucccucccacauucaaagugacgagguccugaccacucauccugccuagcuucacacuaguggcuacagaccaauaacagacuccuaaaaacucucuaacucaaccugcuaccauccauguuauauaggauuaggaaacaggggaguggagauagaaaacuagacauaaauuccaagguaacuaucgucaagacaaauaguguauccauagcuguguuugcaagugaguugcuugggaacuugcaguauguaaaguggaaagagcagcaagugaaacacaaugucaguauaucucauguuuccaaauagaucccucuccugucuccugcugccuccagcacugaagaaaucauucuccauugaaacccgaaaguaaaccugcauuucagugucaucaggagcagaaaaccacucucucugcagacauuuaccacgcccuuguggccaagauaaaauuuauagaaaacacuaucugguuuuagaacccccuuaguaauuuaauagcuagaucaugacucauguuaagaaugcacagcaccaucucauggcugguuggguacagaagacacuuuucugggccagcuucuaaucccuguucauguuaccucuucucaaccaaaaauugaagguugaggucaagauuuggcuaucuaaaauccauuucacucugugggccuucaagagccuauucuauucaugacaaaaauaaggcugacuaaaagcaguuaaggguggguuauuuuguuuuaacuucuaagcaaggagagaggagucaguacuucuguccugugcgcaucauucucuuaaugagcagaggggauagcaucagccucaccugguggcuaacaacugucucuucuauuaacagauugucaggggagucuuacuacaccugaguuucugcaggaaaagugaacuggguugcuuauacaguuaaugugacacuuugcaacacaaucccaacauuagguaccaguuaaaagauggcuuucccaacuccugcccuucccacaugugccacuuaugcacauuaaguguacuuuagugaaaaauucacaaggacaaaggucacugugauuccaauacuugugaggcucuacuagaugaggcuugucaaaaauagaagagggagagaugcaagauacuaucacgagaaauuaauaaacuccucuaaaaccaacuugggaauccaauguuuuauggucuuuccuuguuuuagaauuuucaguuagaagagcaucuuugccuucacaguacacuugcugacucagcacuccauuaccugcauccacgacuugguguuagcucaugugugcucuaacucacagauggagugugaacuuacauacucuguguuacagagguggugucagcucaugugugcucuaacucacagauguagugugaacuuacauacucuguguuacagagguggugucagcucaugugugcucuaacucacagauguagugugaacuuacauacucuguguuacagagguggugucagcucaugugucguaguugguuucaaaguuccagacuuggggaucaccaaugagauacagauagacccgcuuccgcuaucacagcacaaacucaggcaauuuagagaaacaguauuuauuuuaaaacugucuuuaagaaggaagggaagguuuaggacuacuaaacuucaaaugacauugaagaaauacuuuaaaaagaaacagacugaaaucuugaucagaucugaauuauuccuguguucuccaacaaucccaucaagaagcagaacuguguaauugaaagacuuuauaauaguuuguauuugcauauaaacucugccacauuguucagugccaccaaacuaacauuuuuuacucuuucaccaaaaaugaaaaacccaucugucaucuguucccaguaaaaaacagauuguucuauaaaaucagcagacuuagucagguaagaauugaagcuugaaagauagucuuuccaaguugccaauucaucaaguggagaccauuccaggaauacaguggggccaaagaauaugaggagacccagcagaacuaccaucaugagcagcagauagggguaccagggaaucuugcuagugaacacaccugugucuugcggcaaagacaguuuauccacaucaacuaguuuaaugucuccccacugacugguaucaaaguucuucauuaaagggcuugugggcaaauuagaguguggcaaaggaguuuccuugauuacuuugauuuucucccugaacucuugcaucuguugcaaaaauauaauagguucugagacaucuuugaaagccucagcaauguugaaggccauccgcugcuccuguaaaauaguguugauuuuguugaucuccgggucauagguuugcauaacugcaagcuucauaguuucaaagucagacaggauuucauucuucuuuugauccaaggugugcuguaacuucucaaaaaacuccuuuacuuuaucugaauccuucgugaguaacuggagggcuuuccucuuguuuguuuccaaaguauccaagcgggaaagagcaucuccccggcgccaagucucgaaacucugaaagagggacucaaaggcauucuuuucucgagcguaggcaucuucaauagaagagaagacaugcuuggugugcucgccucgaguagcacagaucccacaaaucagcugcauaucaguuacgcagaagauguugagaggcugccccaaauguccuuugcacacuggcaucuugggagaaaucuugauuuuguuguauuucuccacgauacccuuuagggaguaauugaccugcagacuguugacuccaguagcugagguuuccuuacggcagguaggacacuugaagggagauggucuccacagggaauuccgcacauuccccucuaagagcccuucuaagcauuuuuugcagaaguugugugagcagggcaacacucgggggucaucaaacaaacugcagcaaauugggcaugugaggucuucuucaagcagcuccauuacauccugccacagagaaagaaaacauuuaguucuggugagccacucuggaauaaguagaaaacauccucuuucccaauaagaugaucuccuacugaaauaaccaaagaauauaugggagacacuugggaaaggccuggaugcuaaggcacauuuaacucacugggacaagaacacuccugcacacaaggccuuugugacagccucccaacaacagccuuugcugaaacaggguuaggacugggacaaccgcaaacugagccaacaggacccaacauuguuuuaaaacaagagcugacuucuagaagucagaaacaaagagucucacugucugugacagaauaggcucuuuacuucgggcccacaaauaugaaaugguaugcuacuuaaagacagaagcacauauauaaauccaagcaugcucucuucuagcuuuuacuggaaacgggcauauuuucuauuucaaagacaagauuacaauuuauccacaucaacuaguuuaauguccucccacaaacugguaucaaagggcuugugggcaaaucagaggguggaaaggaguggccuugaucacuuugauucauaguguaagaagcacaagaguuguaggucaaccuugacuagaggauuaaaugagguagauuuucacuguugcugccugggagaauuuuuauauuucuguugguuggcuguaacaaucaaacucauccuaucucuucuacuuuacagcauuaauucucucucucgggcagaaaccuacguguuccucuuccagagagcuggugaagccaaaggcauucucauaaugaugcgcuacaccgacugacauuuaccaacugugucaaagcuacaggagccagguagacacugcuggaacuuuaacgggaaucaaacaagucuauaagaagcacugagcugugccacuacccaaucaguguucuuccagagcacacaaacgaaagugggaggagccuuccaaugagaacuguugugugauuaaucaaugaggcugacuaaagcacacacuuauaaucccaauacucagaaagacagaggaagaaggauaucagcgcaaggccaacaaggcuucaaagcaaguaccaacccaguauggaccaugagacccuauuucagaaacaaauaauaaaagcuugaugaagcugcaaaaauuacucauuuuaucaaucccuauucuuguauacugaacuauacacaaaggcacuuguguggccagugggugcggucagaaaggaguacaggcucacgugacucagcuacaagcugagacagcugcugcuauuaggaaaacaauggaagccagcaguauguagauuuagggagcugacaaauccugaaaaugaauaaaaugagcuggguacuuccagaaacacgauacuucuugaccaugaaaaggaaaaaggcuggguuuuuauguuaaaauuugaauuuuugcaaaauguacuuauaaucuucccauuaaagaugcugauaaauaguaaaguuaacaaaugugaggguuauuggggaauuauauaaugaaauaugucaauguuuggaggucucuguaauaauguuauaaaucauagaagacuuguuuaaaauauaagaaaggguuggaguguggcucagugggagagcacuugccaagacccugaguucaauucccaauacugcagaaauaaaaaauaaguaugaucucau

SEQ ID NO: 7512 - RNA, 5476 nt, Mus musculus
agagaguuuuuaggagucuguuauuggucuguagccacuagugugaagcuaggcaggaugaguggucaggaccucgucacuuugaaugugggagggaggauauucacaacaaggcccucuacccucaagcaguucccugccucucgcuuggcaggcauguuagauggcagagaccaagaguucaagacaguugauggccagauuuuuguggacagagauggugcuuuauuuaguuucauuuuagauuuuuugagaaaucaugagcuucuguuacccucggacuuugcagaccaucauaggcuucagagagaggcucuuuucuaugaacuugauucucuuguugaucucuuaagccaauuccugcuccaaucaagaucugcugucauggagguccauuuccuaaaccaaaauacucaagccuucuucagaguguuuggcucuugcagcaaaacaaucgagaugcuaagugggaggauuacaauguuuguagagcgacccacagcacugaccgggaacaggaacuccccucuggcuuuaccuccacaaagaccuucucaccacgaucugcuuuuccacuguggcuccgauggcgcugcugagaaccaagcuggagucagguauuuugaaugcugaagcaucucuucuauucaaguuaguuuucugauauuuucucucaaaauugaaaauucuuuaugccuaacuaaaacuccucuuggcaaaagaaaaaaaaaguuuagacuaauguucaauagaacaaguagucauuuucuaaacguggacacuuacagacuaagguacuguugaacagguaauaaaccaacacugcccagggaaacuagaaacugcucugugugguuacaacagcaacugguucuguggauuauauuccauugcuaaggaaugauuuagaaugauccaguuugcugcuuuucuucaguggagaagaauauuuuuaaagcugguuucaggcaaaucucauggcaaauuuaguguccugcuauagcuuuggcucuaucacuguuaaaaauacuggaauaggcugucaguaucucaagaauggcugccuuguucugauuuacuugagauaagaucuuacucuguaacucuggcuggccuggaagucucagggccucugucccccagugcuggcauugcaggugaguaccacugccacaccugccucugcuggaaucaaaggcugauuucugcccuguagucagagacacacuaccucacccccuguuaaaaaugucuuagugcugugugucauuauuaucaacugugaaaacuaguuuuaacuuuuaggaggaaaauaguuuucaugcauucauuauuuagaguauuuaaaagcaagucacguuuggaagagagacauauuuuagccuguacaguagccaucagguagaagccuucaaugcuucuugcacagcauacuccuuugucucagcuaccaacuagaggacaguuggcagugcaacuaagugucuacacuuccuuauuucuuggucuuccaaauaaauuauuuccuuauuucuuggucucccaaauaacucuguagaccaggcuggucuggaacucagaaauccgccucccucugccugggauuaaaggcgugcgccaccacgcccgguuugacuccuaacuuuuuguuacauguuuggaacagcgcggacuuauuuuuuuucaauucaaucuuaaaaagacauuaaauuuucauaacagauaauuauaagaccagaaaaaaauauauauauauauuuuagaugggucucauagcccugguuagccuugacugucucauccuccugcaucugccuucugaguacuaagauuauagaccucacccagcuuguggugggauuuuugguuguuuuaaguuuggaguuucuucugguguuuaauuuacagagugccaguuucaggcuagauauagaaucuauaaaaugacaugaacaagccaggcagugguggugcacuccuuuaaucccaucacuugggaggcagagacaugcggauuucugaguucgaggccagccuggucuacagagugaguuccaggacagccagggcuacacagagaaacccugucucaacaccccccucccaaaaaugauaugaacauaaauggugauugaguauauggcuaguuggcaauuacuuauuuuagcuaguuuuuggucuuaauuugucuguucagauguuuuuagaugguggauaugauagaauaagucuggcuggcuucaauguguuuguaguucucucucagguucuugguuuguaucuuuagauguccauccaugugacaauauacuuuaguucaaguuauggccucaggauucuagagucucuucuguagccauuuucugaucucuccuuuuuuaaacuagaugaaaaagcauaguugcccuuaaauuaaaaaaaaaaaaaaaaaggugugggggagaggcggggggguggggggggggagguguggugauggugcuuagugggagagucccugccuggggugcacugcgaggcccugggcucuaucugcagcacuagaaaugcaagcucacauucuccuuuucuuuaguucauccacuuuuuauauguaugaaauccuuuucaauuugaucucagagggaaucagauacaauaguuuuagcucaaugaguuauuguaagaacauucuacuuuuuguaaguaccuacuacuugcuauuuguauccuaguacuuuuaugauauucugugacuuucugacaaauaauuuagaucugaacuuggaagaugaagugcuuuacuacuguuaaaauuuuguaccaaacacaauaaaccuuucuugaaauguguuuuguagcuugauaauuuuuagcugguuguuguuuucuuugccaguaaaaaguuucugaacuuggcauccaguagucaccauuucagccaugcccucaguucaugacuagggcugugcucaaacauuguuuuacccccaagaaacuauagagugucuaccugacacuaaccuaagccucaugucacaguuuuagaacaaugggaagucacaaaaauauccuuguugacagauauuuucugugcuauaaugccaucauuaaagcaaacauggguauaugugcugacauuguagaauacuuaguggguggguaaaggguuuugcauuuucaaucagauuuugacuacuauauuuucucuucaauaacagguagcuauugaugaaaagauagcaauaaauuggagucuuagcauuuuguaccuucaaauuuuaaccugaaaaggcugguugacaggaauaaaucucaacuuacaauggcaguacuaaugauuagagcuaguggaaaauuguaaaaauacaguguuaguagaaacaaaucaauuuagucaaauuggguuaaagaaaaaugaaaaaacuggaaauguguuacucuauauuaacaacaacagcaaaaaaguuuaauucuuugaccaaguugaccaaucccuaaaauaauuucacugaaaagccaacauuuucaacuauauucuuaaauguaauugggaugaguuggaagcauggucucuuuuaauauucaguuacugauuuaaaauugaaaaugaagacucaaaagaaaaucuguuuuuaaaaaaagaucaugagccaggcaagguacgauggccuaagucuuuaauccuagcacuugggaaguagaggcaggcaaaucucugacuuugaagccagcaugggcacgccuuuaaucccagcacuuggugaggcagagguagacggauuucugaguucgaggccagccuggucuacagagugaguuccaggauggccagggcuacacagagaaacccugucucaaaaaaaaccaaaaaaaaaaaaaaaaaaaaaaaaaaaagaagccaguauggucuaugaaaugaaguccacccugggauacaaaguaagacuguauaauaaaaacaaacaaaaacaagcuguugccaagccuggggugcacaucuguaauacuagcauuuuguuugaggcagaaggaucaugaauuugaggcaaucaugguacacaguauaacucucucaaacaaaacgaaauuaaaaacaacaacaaaaacagaagagaaagguacaaugccuuuauuugaggguaugaauaauuucuauguguaguuuuguuauuaaaggaaugcuuuguaauugauuacuucuuuguaugccucagguacauuuccauaaagccugauaaucgaaaauuggccaacggaacaaaugucuugggccuacugguggacacuuuauuaaaggaaggcuuucaucuggucagcacuagaacaccagccucuggagaaaaaagugaaugcuaugucuuugaaaggauaacaaccccucaaguccuugggaugaguaaaacacccaaaucagaaacuaccaccaugccagcgccgucucagaagugacacuguucuuuggacauuccauaucggggacugucugucagaucuguacuguguaacuuuggguuccucgagcagugcuuaaagccacacugccucuucucucaaaucagcauuggacuuugugcucuggcccuugcuucuuucgccaugaacucucauaguuuuuagaaaugggcccuggacuuggacugugucuaauccuaguuuagucauuuauuagcuaugugacuuaauugagacauuuaacauuucuguguuuuaauuuuuaucuauuaacuagggacaaaaaaaaaguaacuccucaaaggagacaaaguucucauuauguugcccggcaugugguaggcauucaguaacuguuauuaaugauaaugaucaugggucacuugcuuucaaacccaucucuucuccagggccuuguuuucucccuugccuuuugcuucucugcagugucagugccuuagcguucuauuguuauaagaagacaccuugaccauggcgaugucauguucuuaucaggaaaacauuuaauuguggcuggcuuacaguuccagagguuuaguucauuaucaucacagugguaagcauggcaguauccagauagacaaggugcuggaagagccaagaguucuacaucuugauccuuagacaacagaaggaaacugugucacccugagcauagcuugaacauaggagaccucaaagcccgccuccauagggacaugcuuccucaaacaaggccacaccuccuaguagucccuacucccuaugggccaagcguucagacacaugaguccauugggagccacaccuauugaaaccacgagucagugacugaacccucaggcauacaaagcccucuaugacuaugauuguaccccucagcagaugauccuucuguauagacacauauuaucauaaaaccagguuucccucaaaaaaccaauaaaacaaaaaacaaacaaaaaauccaaaaacaaaaauccccaaaccagguuuucuucacuuaaagauaaguucuaugaaaaguuucuaauacuacuau

SEQ ID NO: 7513 - RNA, 2171 nt, Mus musculus
ugcuaguaguucuuucuguuggauuuuucuucuccagcauuuugauuuagaucauuuaaagguuuucuguucccuuaacauuuuaugcaugagguauauuuuuaugccguuuucauuugguuccauauaauacaaaucucuuuuguaauaauugaccuuuuccccaccuuucaucgugggucauacuuguccacauuuuuuaauaucuagucauauuugauuaagugccaggcaugaauuuaccuuuuacagugaugaauguuuuuguauuauuaauuauuuuggacuucaaaaauaaguuacuugguaaacugaguuggauccuuuagcuguugcuuuuaaauuagugugacaagaucuuagcagcugucaguuaggaguaacuguugcuuccuuccagggaaguaccuguugaguguucuaccauuucaugcccugggaucaugaagaaugaaugggaguugggaucucugcuuuucauggagagucucaugugcauguggaagggaagugcaguuucccaaugauuccccagagaggcccugcugcacacacuugggaugggacuuuuuuaucagccuucuuccacauggaugccaucacccuccugucuuuggagcucucugcucuaucaugucagcucuaagucagccaggcuuugccuuguuccucugccccagggccuggaaacccucucaaggaaguaugccagggcagugagcccacugcuguuagcucaagaaaaaguuguguucuuuuuauggcuaagccaguguuugaacccgcuugcaauaucucuguguguaugggaugcacagagcacggagaagaagcucaguuccucaccaagaccucucuggcugcucuuaccuagaugggcugugugcagccuuggccaccuuccuggggugcucuuguguagaugaggugugcuccuuggcccaucuuccuggggugcucuuguguagauggguuguguuccuuggcugccugguuucuuuggugucuguguugaguuuugacuguggugcucagucuauggaaggugucauccaucuugguuuccauguuuuaaucuaugcaguugaaacuuugacagucccguccuguggaggaaacagugcagguacuugcuuucugcagaauaagguuauucuauuauaauuaaaguccugaggucugacucuaugacagaugcagaugaguggaucaaagaagaaugucugcagacagaccacaguguauuuaagcgguuacuuugaagauuccacccaguggguuuugaagcagaugaccaacucauugaaaauuagauuuauuaacaguaucuuaacccaggguauauucugaaucaccuaaauauaaauuuaacauauccauagaaaauauaaaaaauacauguguuuuugaggaagaagacuuucuaaaguaugacacaaaagauacaaacauaaugaaaaauaggguuauaugaagauucucuaugcuuaauauggcaaaagagaguuauaaaaauagagcuaaaauacaguuacugucuuuuuuauauaaaggcuguucauaagauuuuuuuuuaaaugacaaccccacugagaaaaugacaaggguugugauuaauuggugucagaaaugaaaccuagagaggucuaguaacuaguguuuuuuaaaugaccuucauaaauauauuuaggacuuauuuuguauuucaguuugauuauggcgagugccuuugacuccuuagcuuaagguuuuuugguuuuuugguuuugguuuuguuuuuaaauaccgccauuagcaucuucuaaaaggaggcuaagacugaggagaugaucaagcccuggccaagguggcaaagcuuaagacaucugacucuaaagccugccccgcaucccugccccuagaagcaaauuaaacacacuucaagucucacuguagcuuacauugaaaauaguugcuuacugagggucacauggcucacaaaugauaaagcaaaguuuuuagaaagaaaaaucgaauaaguggaacaguggaaaacagggugaagcgaggcacagcagagaaagugccuuuaauuucccacucaccuuuuccuuucagaacauuuaaaagaugccucgaagaagaagaagaagagcagccuccuguucguaaagcuggccaacccgcacuca

SEQ ID NO: 7514 - RNA, 1240 nt, Mus musculus
uuuaaugcucuauguauuuauuaucuauaguuaauacaauaagaggggucaaaaagcuugcaaguacacaauuucacaagaagcauuguaggggaagagaagggcugagauuuaucaacuguaucuuagggucuuggugggcacauucuugguggcccucugauuccugguggagggggucucauuccuggaggaggcaugccuauaugugucccucgagcagggggaagcccaaugggugggcccauggguggucucauaccagguggaggagccauaaugccuggaggugggguugcucugccuauagguggagguggagguccccguccuggcggguacuggguuggggcuccugcagugcuagcaguagcagcaacagcagcagcugcaacagugccucuucccuguggggucaugaccugcugggaugagccuccaacuccucuggcaaggccugcuaauccagcaggagcuuggggaauagguagaccugcuggcacuccuccugcugguacacagcugcuuuuccaaccccagggccaccugcagugccagcaagaggcacacgagcaaugccaguaucuuuaggagaugggcccuccacagucauggaaaccaaguucuccccacguagcaagaccagacccaaaacccauuuuucuucacguucuggcuguuuugcauucuuuggcuugaucuucccaaacucaucacaaucacagaggaucaaauucauaugcuugucaaaaaccuaaaaggugccaaugaagauucucccaucuugcaggauacaucucauuccauagucaaugugcugcagcaucuugcuacucguacccacagucaugauugcuguuccacaauagccguugucaacacuaaaauuucaagauccuuaauacucagggaagggcuauaaauaaagguucgauacaagcuauuaacaaacaauguaagcuugaccaaaguuucacaaacaguggauggguccuguuuuccuugaauuccaccaccuugaaguugcaauacuguuuuaaccaccucuuggugucucagcuaagaaugccugucuuaguucugccuggaaauccaccacaggagcuugcuguugcugagaacgucguggguacaagugacacucuugguugcucagugaggcuguccuucgauguuugaccuggaccucgaccucuggcaugugcuguucaguaguucuucucaaguguaagcgauucca

SEQ ID NO: 7515 - RNA, 1416 nt, Mus musculus
uggaaauacauuuucaacacacuuagcucacaaaaucuauuuuugaaugcucaauuauacaguauaaugccucauauaauuauuugaacugaaaaagaagacauagccagagcugacuugacaauuguucacacucagaaaguaaaauaacuaaggccaaaguguugaagggggaaagaacacccagggacuggccccacgucagugugcaguacagaaugcaugccuuccuagugcccacugucacacagggacccaggaccguagaauccagaagugcugcuuccggugggugcuucauagaacagccagcaaccuacagcagacagcagaaagccuugcuuugaaaccauucagcacuugaaaaucugggucuacacacaacuggcuagcaagccuuauaaagacuuagcaugaguacccaaugccuugcacacuuacaaaauacucugaguaugaaagcuaccuuugcacacucuuccucagccgacucauguugguaagcaagccugcagaccgucccuucuggacugauuuguauaaggggauucauggccugcaguuacaaauaacagguuaugagguaugcuggggaagcaggcaggagaaucucugacuuuaaaaagcacacguuucgaaagggcuacauauaucucuccauaaaugaccagagccaucuuuuguaauuuguagcacugugcccaguaaacaguuaaaaugcuuggaacauuuuuggcuguccuuuugauuguccaugugagccagugccccaugccccaaaguaggaaaguguguggugcugucccacagggccagccuccagcuagugcgcaggagccuuggggagagcggacacuacagucacccagcuuccccaucuguuguccguugcugccaccgugugaauggugaccagaccucccagugaggcuauguuuacaaccccaccucaccaaaugccaacuucuggcauugggaucaaugccaaacuauccccagauucuguuuaaucgugggaaagaaaagcaugggcguguucuguucccugccagcguggugcuucuugccuccucucuggaagggccuacaccagcucagaugcacucucggagccuuuccagcaggaccuucaagcucucuuacgcaucacuguccaucagccucggguccaccauccucacaaggaaagccugggccucucucuuuggacuuugcaggacucugaggucaucucgguguaaauaaauaaaaacguggacuguccugauucuggaucaaccucugaaaaagccaaccucuggaaagggcuaaaugauaaguauuuuaaaguuugucacaucauguuuuaaacuuuauccaaauguguugcuaucgcuucuauugcagcaugaaaaauaaaagauaugugaaugggag

SEQ ID NO: 7516 - RNA, 30013 nt, Mus musculus
acagguuuaagaaacgaaugcuaauagaacaacuggagaacuucuuggaugaaauucaucgaagagccaaucaaaucaaccauauuaauagcaauuaaaagaaaauagaaugaggccacuuauuucauugucuucuccaaauacaaaguaaauacaagacuguuguaaucuuguauucauucuuugacaugcauuguuggcuauuugagauacuaaaaacauucuacaguuccuuuccaucauuuuacagugcccuuuucauuuuagcuuacuuuuguaaagugaaaaguaucacaaauuuuuuuucuuucuucccuuuuuucuuuuucuuucuuucuuuuuuuuaaccaacuaaaacuauucuucaaauccucugcuugucauuggcucuugcgugucaguuucccucagguuauauuuucuuaaaccaaccuuuaaaauugucagcucuguuaagguugaacuuugccaaaaaaagaaaaaaaaagaaaaaaaauuaaaaacaaguuacuuuguaauuuuuggggaaaaaaagcacauacauuaaaaacuagguaauguuuuguauauacaguuauuuuggauauauuauuguaaguuguacaaauguauuuugaagaauauuuaagaaaagcacuuuuguuauuccaucaauaaaugcucuauuuuacucuugugugguuuaggaaauaaucacauuuaaaguaacuacuuaaaaacauucuaaaacaauggaauuuuaaaggccuugcuuuuuagcauuaaaaaauacacaacuuaauauuuguuaaacuaauguaauuauauguuacauagccugcauugucuuuuuaacuauuauauguucuuaguuuuuguuggccaugccaauauacuccacucuugccuggauaaugguaauacuuacuaggucuguggcagauagacagaugggcaguuuuuuuuaaaaacaguuuuaaaaguagaugaguuggggcauuauuggcuucuuaacaccuuucaaccuuucuuacaggauuuagauggcacucuagcuguuaguuaaggugugauagcuuuaggguauaucauauuuggagaaggcuaguaugccgacauuugguccccucccucccccgaugcuuaggugaguuuauaauaugauaauucagaguggaucucuugguucugcucccugauucucagaaucuaacuggagaggaaacagacuuagacggcuguacucauuucuuucccccuuauuugcacaggaugaggauaucuggcacuccauucuccauccucacagggcugcacaucuuuacuaaggaugugaccauguguccugacucaugcacauauucauagaucacugccgugccuuuuagugguuuggagggaaccaguagaaaagguuagaguuuuuagauuuggaauaaccaaggugaaaaaaaauacccuuuaaauuauuuuuuuaauugaauuauuuuuagauuaauaauauuuggaaaucacauacucuuaaaagaaauuguaaauauuuaugaaggaaagcauacauagagaaaacauucuugaggucugcuauuuuagucaaggggauuugaaacucuuccgauacugaagacaaacccuguaaagaaaaagaaacauuucaugugacuugugguauuuucauaaaacaauucauuaaacauuucuaacgucuucacaauuucuggaaguaaaugaagauauaauuuagagauggaauuauuaaaauaauugccuguaaucacacugcuaaauuuauaccaaacuauacaaaauccagauuaacuuugugguugugaauuauguguauuaagagugagaucagugggaacacuggagucauuuagauaggaauuauauuuagucagcacaugggggcuguccuuggaagggucuuuaugucauaagcaugguggaauaauucucagaucuucuuccuuuacuacaauuuccaaaaugaacccccaaggaguguaaaauaacaggaucuucugugucuguguucuacccuucucccuuuccccacuccuccucucuguuccuuucucugucuggcauaauacuguuuacauuucuaauacuaaaacuuagucugaaaauuugcagccuaucaaaaacuaaagcuuaagauuccauccaccucaggcuuuugccuuucaaagauggugggcaaguuagucaagcuagugaaguuucuacagaauccuuguuagccaaggcaagggaggauauauuuggggauggguauuuuauucuuugagaucguggaaugauguuguguuggacaagugcucuccaaaggguuaauguuagaguucuaauuuuccuuaauguuccccuauguguccuauuuguuaguugauucauucaucaguauaagacuuguaagcuuuuaacagugaaggccgagacuuuuuuuagguuauuuuuauuuuaagaguuuugucuacauguauguaagugcacuacaugcgggccuagugcuuguagaagcccaaagagaagagagugugagauucccuggaacuggagcugcagacuccuaggaguuuccaugugggugcugggaagcaaaugcucuuaaccauggccaucuucuagccccagcugaagggucuaagggauuuaaaaaucccuuaagugauaucagaaaauuauccacuuugccuuggguaaugugaacaaccaucauccagaaaacuaaaaagcuacaaggacggagacuggugaguuagggaacugguuuuuuuauuagacuuguauuuucauuuugauacuugagcgguaaaaauuauauuguugaaaguguggugugucuuuucuagucuaacagcuuuacaugguuuuuaauacaguugaauuuuaaggaucuguuauuugucuucuaacuguccucuuuacuggauaugagcuuuaggcaguggcccuucuguucaagguuaguccucccucuuugagaguuuaauuuaaaacuugcuuuuuguuguuacaauuauuauuuuuauuauuuuuuacauaaucucugcugucuguucuuagugaccagugccguuuuguguagucacagucacuguggggucgggauaaucauggugaaguuauguuaugaacuccuucuucccaaauaaucuccaaguagauaauuuuccaggaaaugauuaccuacauccuuuugucaagaaauguucuuuugauuucuagcacaaauaugacaguauacaaaugauucucagauaaaaugauguugacaguauuuucuuuuaacagucuguguuaaacuaugcuaauuuucauucuaacuuucgauauucuuuccacaaauaaaagugaugccugauguuuaguuaaaguagguccaccuuggcuugauuuuuuuaaucuuguuccauacuguuguuuugaacacuacugagaauugccaacagcucuuuacugagaaucucuuccuuuugaggccaauaauuguuacagggagacuaagaaaagaaaagaauucaaggauuauuuucaauacugcugaauucguagaaacauuuguuucuuauauugugcuagcuaggcuaaccugugucugccaucuuuucauugagacacuguucuguugugugcaaaaguacuaggaguacuaaguagcuuuugagaaagacaacaaacaggacagaaaucugugcauuacuaaaauacuagagccugggucuugaucaucuuggucugaagaaaccaucuuuucuaaaacaauaggacagcagcaagaaaugcaagauuugauagaaguguguuuucauggcuuuuuaaaaucucucuagaagcagaagccugcugaacuaaaaagaaucagcauuagcuacaaauaaacagaugcaaaaguaaaagacauggaggaaaaguuuccuuuguacuaugaaacaauuccccuuuauuugagauuauaauagauuaauaaacguaaauuguuagagauggacauaaaugucugaauccaguuuuuuuuuuaaaaagucaguaccugugcuguguucucucagaagaaagaugaagggccgaucugcuuuaaaagcagagguccgagaccuccucagcagcagcaccgcugugagaaagaacaggcccugucagcauugaaaagcaugcagauaacauaaaugcagaacauaggggcagaacuugauuugucuuuaaggaaucaucagcaucuuaaugacauucuaccguguaguguuacaggagugcaaauugggaaauuaaagaggaaagcuacuacuuaaucauuccugugucuuuuuuuuuuuuuaaauaguauuccaugacauagcucccccuuugaaggugggauacuguaugauuccacuccuuguugauggggcaaugauacuuguuaaaaauuaguaucauugauuuucauaagauuuuguuuucuuucauuucuuuuaaaaugcuacaucacacucagguuugggcuuaagugguaugguuuauaacugaagagucacugggcagacauaacaagggucgaucuuggugagcagcuccacggggcuaagcgcugaauguaccuguggcugcagaggaccugguacccuccucugaaagcuccaucuuggccuuguggguuaguugagaaacguaaaagccaucuuggccuaauucacaaaugacaaaaauggaaagugauuuguuuacauuuuugugcacauaguguauguuugaagacucuugaguaaaacuugagcauucagugccacaaguauauagggagugauuguacagaaaauugccaaguuuuauuuuucuacaacucaaaggcuuuuuucacuaguaagaccucccccaaauuaguagagacugaaucucauaguuuuaaauauuaauauuaaaaucuuuauccuauauuucuaaaacuuagguaaggcauuaagguucccaaggguguauguuacaaaguauaaccuaaauauaauuucaaugagcuuuugagauaauucuuguugggcugcaguuuuuaggaagacacugguaagucagagguuaguauuaggaggauaaucugguguuaaagugccugcuguuccaugacuagauucuguggagcugguuggcuaguuagcucaccuuaagggcuggaaccugcagagaaaugugagguuguagcuagaugugugugcugacaguuucaaagacaagcuuaguaaauaggaaugagagaacuuagaaagcuugacagauuucugucauugaacaguucucuacagaugaaaugacauguguugcaguaaagagugaacuucagcauguagaacuaagauuugaaacugcucggcccuucuguuucagagggauugcaaagucaucugguaugacacacaccccaucugaacugagaauauccagguuugacccagagccuguuucuacccagcccuccuuuuaagaagcugcugucuagucagcuggagcacaccaucagagagaccugcauauuaggaaccauuuugauguacuuuagggauauggccccugacagucauguaagacuaaaauccaacccaggauacuaaaacaaugggauaucaggagaugguugucccacuuuucacuggcaguagagaaugggcaagagccaggaagaagucagucagcauucacuuggugcuagcggagaaucagauuaacaguggucuuucguugcuugucuuugagaaaagcaagauuaucuguuaaugcuuagccccuucuagcucauugagcagagugccaaagucaaaaaggaguuuauaaagagauguuugccagucgaggguuuacugucuuugacuuuaugacuuucacauugucugaacauuuccauaugauuaaaugagugcagcuucacugugaaaccccuggucagcuaacauacagcaaauccuguaucuggaucauuguaagaagugggauugcuacaaauucaucuucaguaggcuagguagggcuguuucagugucuuuguaaggcaugugaaaagcuuaaauauccuuccuaccccauucuaagaauggcccaaugucuguugucugugcauaacccuuagacuacucauugccuguaugccaccaacugucacaucucugaagguuuuaucuuugguuaagacuugacauuuuuguagacuaggcuguguucuuccuuuaucuucuauucugacgguaguuggccuccuuuuguuauguggcuauugaaauguuauaccauuaaugaaauaacuggaaaaggugagguuuuuccuggcuguuguuuuucugaauuguuagcauuguaaaagguuauacaaccugucgccccaaaauuugcccuuagaauccuuuauaaaugcuguucuguaggcaggcuccuuaauuaguuagaugugagagaugcagguuaauagauccugugucuaggaaacuuuguuggagcugcugauuugcuaauauuugcugugcaggacugcaguacauggcucucaucccugaagccacuuccaccucucuuuaaccucaguuuacuaacuaaacuuucuggaaggcacaucauagucaacuauaaacaucugugccuacauuacauguuugugucagcauauuugggauuaccccucccacccccuaccuagacuauuagcuguagcaaguaggaauuauggcaugcucacuuuaccaugcccagcuuucagcuuuuacaugugucaaagaaauaguuaauguguacauccaaaggaugaagcacacaagguucuuuaagcaaggauuuaauucccaccacugguugguagguagcuuuuauguacuguuggccacacauuuauaaauugucugcauuuggaccucagcuucuuccucaucaggacagaguggacaucaguugccuccuuuugucccugacaaugauuuucuuuggaaagagcuaguugcuuaucuucuuccaucguuucaguuagcuaagaaaugaagaguggguguauauacgcauugcagcuagccuaguguaaggaaacuggaggaaucuuagauggcucacaaacuaacuguaguugguugcuuucuccaccuuucucuacuacuuacaucuuucugugcaguguugacuuauuguggcucaaguuaauucaugcacuuuagacaguuggcuuauucaagucccguaggauauagcuugcacuauggacagaaauugaaguugacugcuacuuaugaaagcaaagacuuaaauaguuucuaaaaaguguugaguuuauauacaacaccugaccuggaggcacaaguuuaugucaaaacuuggugguggucuuucaggaaagggauuacccagaacaggugccuaccugcucuucucagugagagggagauuggaacaauucauuagcuauguguucuguaggaauaaaagaggauugggaggaagggugagcuacaugggggcucaguugagcuuugaaauacuucuuaaauaaaauuaugccaagaaggagcagacaugcuuuguagccugggaaggugaauugugauucuggcuuugaacugaauuggaagguuuucuuagguuuccucuguauuguaaaacuugguaaccccuuguucauugaggagaggguggcucuguuuaugaucauuucucuaauuaaaaaacaagcaaacacaaaacuacucugcagauggggguggugagauggcucagcagguaauguagcuugccucauaaaucugaugaccuuaauucaauccauggaauccaccuacaaguggaaggagaaccugacuucccaagaguuccccucaccuccacaugugugcugagagcaugugcaccccacuccagcaugcacacacaauaaauauguuuuuaaaccaauauacugugucauugaguggugguucuccacuuuaggaaugaugacacuguucagugauccugucuguagaguaggcagaaauguacuuggguacaggcaugaguggucuugcuacuggaaagaauuuguuggcaagccaucaauaaaaauauuaauuuuagcaaucaccaauccccugauguccaucucagugacacaacuucacuacuguagcaagaaaacagccuuagauuaauuuuaauaaauguaaguagcugcuuuuuuaauaaaaucaggugacaggucuuaauuuguugacagugggagaagaucauuggguugcaucaauaagcaugaaugcaagcuccacauuuagcacauggcuggauuauuaaggaagucagaucugugagcuuaugauuauuuugguuugaacaaacauaaguaaaauaauugcauuauauguagaccauguagguauucauaagacuuggugauaggcuggugugauggcucaaucgguaaaguucaugcuguacaagcaugagcacccauguuugauuccuuuaacccauguaaaaaaccaaggacaagggugcaugcuuguuugcgcacuugaggggugggguaagggaaaaaggcagggaaguuucauagcuuaauaccccagacaguguaacccaacgccagugagagauucugucucaaaaacaguggaucacaagguaucuuugcuuauagucguucugcaagauacagaugaagaccacuacuguuuaaggacacgagauuggcauuugaguauguuuuuuuuuuuuuuuuuuuucagauucugggguuuggggaguaagguagggaauuaaaaaugaagaagaguaaaacauuaaauacaauggcauggaagaaagggccaaaaauagcuucaaaguuacuucccccacccccuucuguaacuggcuacucaauccagcacccucauauuuuuaauuugaaugacuaaaagagcaauagaauuuccauuagccacagggauaccaaagcugaacucugaagccuugagaagacauaauugcccguuacugaaaguagaaugugguaacuuccccugcuucugaucauuaugcuguuuguucuacuguuccuuuccugcagugucaaagcaugccugucaauaaggaaaaauuccaacgaggccaccaguauugccuugugucuaauuguauaccaagcauugugaacacugccaaaacuugacuauugucuuaccuaucccuguacauuuagacaauaagaagugguagauguuuguuuguuuguuuuugggggggugauguuggcgauggaacccagaacuuucugcacacuuggcaagcacucuacuaugaaggcccacagccccgagauggcaaguuguuaguacccugauuagauacucccuguuacucuuacuuaauaaguagcuuguggugguucugucugcucacaucuaaagcacaagccaggacuugaagaucaaacuccuguuauuuucugugauuaagaggguggauucugacuaaaguuuuaguaccauauguuccaguggucugauguuuaaaaugguaacuuucaaauucaucaaguaaaggcagucucaagaccagugagauagucugcaaaguagaaacaauccaaggcuuccuagcuuggcagaaguugagccagugguucccucuaagguucccaaaguagauguuagcauucguuuuccuuccggugugcgauggaagcucagaucacaggcaaacaugguuccuguugaucagcaguagcauguuaacuauggaaaauauggagcauggaugccaggaaagagaacaucuuagugcaaggucaugaaagcauggguaaucugaggacugggcuagggaaagguguguguuuauuaguccauuacaaaaggcaguaagcguuaaaggcaaccaggaaaggaaaggguagaaacgggauggcccugacgcuggcgugauagcagggggcauaaugaaggugcuggugcugccuacagucuccaugagagucuggucacggcaaagggaggcucuguauugcauccuauggccacuugacgcacugugaagugguuuccaaaaaccaugcuccucaaggagcaccccucacccaacaauucuaaucaaaaugugacuguuacuagaagcuccacauucuuacacaagguuaaccccuuuauuuuaggcaguguuuucuguccaaaacucugaaauaauaaggaucccuuagaguauggcaaaacccccaaacauaauacucugcaaagauaggaagaauugaauaauuauuaccugaaauuccuuucaaguuagcuuugagugggucaaaaagaucagugauaccccacgaucuuaaaaugcuuuuuacgucaaauugauuuuggaucuuaaaccugcaaaacaguggcagaugaucaguugccauuuagaauucacacucuucucauacauaccacacgaaguauaagguucuaaccggagaucaaugcacacugggcccccuccccacuguccuuuucauuguuccuucccuugaaucauaccugggacgaaccugaccccucugggcuuucccccagcuuuguccauacuacucauuugggacggcucuguuucccugauugccuuuagauaacgccauuccucagcuguuaccuuccuacucagcuguuuucucacuuuuucaaaaugguacuagagauaagauccaggaccuccuacaugcuagagaaauauucucuuacuggagcuucaccuccagccccgugacuccugguucugaaagcccaauguguauaguugaacucaaggugcacagaaaagucugcuuccuauugauacucuuuaugacaccauaaauaaccuagaagcuaccucagcucauuuuuauuaauauuaauaaaauaaauauaaauuaauuaaaauaaaugaauauugcugacaugguguuagacauuaugagagcuuuguagaaauugcuucauuuucauauaauggcuauuauuaucucuuaggugaaaaauucagagcauaaaguaagaaaccugcccaagaugaccuaaugaguaugugguguaccucauuccaaaucugggcucugggaauguggagccaugccagccaguaucacucucacuuggcuccucacauuuggguagaaucucacacacaguggaugugaauaaauaucuauaguuccuuguauagccccuuguguagcuuucucuacuauguaacacauuuucauguuuacugugugcaguaugugcccuugauaugcagcagaaaaagaacucagccuuuguuugcccaguaaacaacugagaucagaaagaaucagcacaccaacaugaccccaggacaaagcacuuuacauuagccauccaagaagcaaaccuucaaagaggaugcugcugcuauuugucuuugaaaauuaaaaaagaaagaaagaaauauaauuugucuuuuguauaaaccaugcauaacuuuagaaaaagagguauguugacauuuuucaaaauauuuggcucacuuagaaauugucuuaaguacagaaaacauccuuuucaaaaaacauaaaugcuaaauguaaugauuaaugcuauggaccuggcuuuuuagucugauuccucucaccagggacgucuuacuuuacagauucaguggcaagcuacuuuacccuauauucuuauugucugucuuugagaaauaaacacgauggcaguagaauuuaaauaauauugugauaauuaaaugaaaauucuuguaguguucagcacaaugcuugguguagccugugcacuuagcauugcguuuugacugugguuucucaguaauauugagaaaguuaaaaucuguuugaagcugaccauguggugggugauaagcuaaauaauauccuguuuaagugcaguaaaagcgacaggugaggugugauuacaugucccugcacagcuauggaagcagaacuagaaggaaugaggcggcacauuaacucaaggaaacaacaaccagaaagcugccugcccuuuacagaaacuaucaagggcaucacaagaaaagaaagccauaguccauaugcuacauaguagggaucgacuggaaaugaguuagguucaaacugaguucauaaauccugccaugaccaagcagagcuuaacgcaagaaugcaagaugugcucuacauggcaauaagaugacacauuuguuaacaaaguaaaggauuaagaucauguggucaucucaacagauguagagaaggcuuugacaaaaucuagcaucuuuucgugauuaagaaaacaagaggacuuggagguauguucagugauagagcacuugccuagcuugcuugaaccucacuccugaaaacaacaaaauccaaugcccaaacaaauaaaaagcccaaagacucagccaacuugggacaugagguaacuuucaauaugaugaagaaagccuacaaccccacaccuugaauauuuccuucaaguuuuucaucuaagauuaagaacaagacaaggauggccacucucuaucacuucuguuuggccuugugcaggaugauaggaaagacaaaagauagauaaaagcauccauauuauaaaggauguaauggcuagggauauagcuaagugguauaacacuugccuaccaugcaaggacccugaauuuaauccccagcaccaugaagaauuugugaaauaaaauaugguuuaaaaaaaaggaaagaaguaacuuucuguauucacagaugacuuggucucguguauagaaaauauugaugaacaauaaaaaacccuauucgagcucauuugagauacgcuuucuuauaaaaagcaaugauauuucuaauacaaugugaagaaguucagaaaauauuuuauuucuaauuuaucagaaauaagccaaauacuuagaaauaaauucagcuuuaaguauaacauaaacaccuagaagcacaaaacacugucaaagaaacagugagcugaaugguagacacacaaagcucaaagcacucccuggcugacacacaagacauacccaugucuaaugccaaccugcuuguuuuggagagaaacugguaagcuggucuuauaagacacucuuuaggaagaagagaaugaaguuagacucacuuccugauuucuagccugacuagaguucuaagagccagaaugauacaacacuacaaaaauacuagaaucucuauguauggaaucaaacagaguuagaaauaaaccugugcauuuggcaauuaauuuugggagugacgugaugucaagaaauaugauggaggaaaaaaaugauccuuuaggcaaauguuauaggacacugggccaauccccacauacaaacacaugaagacuuggccuccauuuacaccaaaugcaguugacucucaaauaacaugggcuucaucugccuagguccacuuaacauagauuuuucuuuuucucuugugaaaguuugcaacaauuugaaaaccuccaaaguauagccuauuaaguuuuucuagccuaugcagacgagaaaaauaauacuaaagguagacacaaaauguauggucuaauuugucauuuacugcgagaagauauguacaaaccuguuagaacaaguuaagcuuaacauacacuuaaaaacugccacaugcagcaccuuucacucuugaaaaugugagcagaugcaaagaugcuguguugaaucauaacugcaugagugugugaucaccuuacagcugcuucuguuaagcaucugcagugccccuacuaugcuauguugaucaucucuguaaagugacauggccuccugugggccucauuuauuuuuagccaugcauaauacagaucacacacaaaauacauguuguauaacuacuuacuauugggaucagagcagucaagaacaggcuaguaauaguuuugugggaguaaaaguuacauguagguuuccuacaguaagggagguugguguccccuagcacucaaguugucaagguuacaguaauucacaguagaucaaaaauccaaagagugaacaaaacucgugaaaaauaagcauagauuuuugagagaaaguuuaaguaggcaaucacaugacagucuuuucuagauuggcugcauaagcaagaccacaauaauaacgauaucaauggaccucuuaacauggaaggggaaaauuuccacuauuagggggucacacccguagauaaagaacuauaggugugcuagagggugguagcagaugccuuuaaucccaacacucaggaggcagagguagccagaucucugugaguucaaggccagccuggucuauaaacagagugaguuccaggacagccaggacugcauagagaaaaccuuccuggaaaaacaaaacaaaacaugaacuacaagcaguuaaugguugcuauauguaacaguaacaauuugaagaggaucucaggagaggcucaaaagagggucgcuggaaagaggggguguuauuccauaucaauuaaaaacauuuaaaaagaaugcuuaaauaaaauauaguauauccacacacuagaauauuauucagucauuaaaaagagaugaaauauuaaaacuuugugcuuagugggaaaaaguccaauaaaaaggcuaacauuguauuuguugauuugcaugaaaaaucccuaagagauaauccagagagagagagagagagagagagagagagagaaauagugguugccuagcacugaguagugaugaccaaugaauguguguuucuuuuuaaguuaauaaacauuuuuuugcuuuuuuuuuuuuuuugagacaggguuucucaguguuauaaguucuggcuguccuggacucaauuuguagacuaaguuggccucaaacucacagagauccaccugccucugccuccugagugcugagauuaaaggugugcaccaccaugguuggcugauggucaauaucuuuuagaauuuggaguuggggguagagcucaguugauagaaugcuugucuagugggcaugaaacugugcguuugauucccagcacuauauaaaucaaaggccuagugcacaucuaugagcccauuauucgggauccagaggcagaaggaucagaguucaagguuauccuuggcuauaugaaacauuuucucaaacaaaaaaaaucaaaauuauuauuuauggcugcaaaaugcuguaaauauauguuauccauccaucuauccaucucuaucuaucuaucuaucuaucuaucuaucuaucaucuaucuaucuaucuaucuaucuaucuaucuaucuaucuaucuaucuaucuaucuaccuaccuaccuaccuacguagacauuugccaccuuacccagugcaaugugcacuuuaaaaguaacuuuuauaaggaauauauauauauauauauauauauauauauauauauauauauuucaggauuuuuaauagucaaauacagaggucugguucaugucagcuccuucacugcuaaaccaguggguaggacugcuucaaguucucugccuucuccuugucuguggugaccaggguguaaagguaccugcugcagcuaaccuugaacuucacauuauccuuguucuucuugaucuugacagauugggcauccuuccacuggccugugagcagaaagcccugauuuccuccguuuuccgaggcuggugacaggcacuuggcuuggacgaccacacccaaaacacucacggaggagagaaccgaagagaauggggagaaaaagcuauaucccauauuuuaaaaagaaagugaggaaauauccuuggggaaacugcugcacuuuaugauaaccaggaggcucuccaaggaggagcaagacucacuuuggaugugugaguuacauaguugggguauuacuugaguguuuccacaaagcuucuucuuguguuggaagcuuggcucccuggguaagugguauugaguggguggggccuuuggaaaguugggccuaauagaaggugaccaaucuggacagcccuugggagguuuaaacauaguucugcuguugguucucaugagagugggucucuaugcagacccuaaauucugucacaucccuucuugcucuguggcugcuucugccacugugaugccaccaucuguguccugauacagagcagagagacuuucagaacugugagcugaauaaaauguguauauuauauaauguguguguguguguguauauacuauauucuaacauauuagggaauaaacugaaaagcaaauugauuuauaucuggauugauaccuuggaccauguuagacacagccaggguuuuguuguuugucuuuuagacagggucucacuaugcagccuuggcuagcuuggguuguucuauauuucuaaacauacugcuuucuaacuucaaacauuguuuuuccaaccaauaaaaugcaggcuaguacaauaucauaaucuaauuuugugaauguuuucagcuuucuccuuucucuacccagaagcaagcauuuuauucauugaguauauuacuugacaguguuaaucuucccuggacuauggcugugauuguaggauuauggauacaaauguccuauaaacacccauucuugauuauuuaacagauuacauguucuuaaugaaaacuaacuauccuugugcauuuaauuuuauaaaaaauaauuacucuggaagauggcuucauaggucaccucagaauacugcuuggugguguucaaacucaagcucacccucugggcucgugccaaguaacauguaacauugcauuggucucuacauugggcugccacucacugagaccuguaugaugagcacagagcacggaaaaugaauaauuugagagagcuagagguaaguucuuacucaaaagcuggcuguggagugggauguaguaacccccacuuuuaauccugccacaaaaggcagaggcaggaggaucucugugaguuugaggccagccuagucuacauagcaaguuacaggcuagccagggcuacauagugagccucugucuaaggagcaaacaagcaagugaacgaacaaacucuugaucauaucuacugugguucaagcuauaugucuaaauccaaaccuaaagcaguauuagcuuuucagauuagucccucaaacuuccuaaugcugugacccuuuaacacaguucuucacguuauggugaccuccaaccauaaaauuauuuuuguugcuacuucaaaacuguaauuuugcuacuauuaugaaucauaauguaaauaucugcuaugcgaucccuaagcagucaugacccacaaauugauaaccacugcuuaaagaauuuauaucuuggcuuuuuguuugauuggguuuuuuucucuuuggucuggucuggagugacugagugaguguguguuucuguuuguguaagauucguuuugcuuaugaaauaaauggcuuuauuuuccuaaaaacaaaacuuugauuauucuuugucuuaguuagaguuuccaucuucuuuaggguuuccauugcugugaaaagacaccaugaccaaggcagcucuuaaaaggacaacauuuaauuggggcuggcuuacacuuccagagguucauuccauuaucaucauggcaggaagcauggcaauauccaggcaggcguggccauggaggaacugagaguucuauaucuucauccaaagguagccaggagcagacuaucucucaggcagcuaagaagagggucucaaagcccaacuccacagugacacacuuccuccaacaaggccacaccuguuccaacaaggccacaccuucuaauagugccacucccugggccaagcauauuuaaaacaccacagucuugaauuagaggcuugauacuuuugaggugauuguauuaaucagaacaagguuguuuaagucauugcuaagguccucagaucuucuuuguuucucuuccucuuccuucucuuccucuaccuccuccuucuccucuguccugugguuuuuuuuuggggggggggggucacugcuaaggguuugggagaacaucugacauucuccucucucuguggaguugaucauuuccuugggagucuuccuuacaucagcuacuucaggccaagcuacucaucuucacaugagauagcaaguucuucacuugcacuacacuuuccauacugcaagagcucccuucccuccugcacuaauuauacccaagagcaacuagacuagagagaggcuuugauagaggcugagcacuuacuuugagagaugggguuuugucuuggguuugaguucaccuuuggcaugaccucauuuuagaccuaggcccugacaccuuggguuuauccuuguauguuuuuauucuacgagaugggcuuauuuuuaacugccugagggagcacuaccaaggccuuugucuuuauucacugagagcccuggccuuagagugugccaacgucucaaguggacagguagguaaagaauucauaugcugcaaacaagcuccuuagugccaaucuacaaagcuaugcugauuccaaguugccugacaagcucauuaucuagaaaaguuuagacagaaccauucuguaaacaaugaauuuaacuaacaucuuugcuuuggaaaacaagaucuagcacugucauuagauuuaaaaaaaauuuuauauuuaugccuauugcauuuucuucaacagaggaauaucuccacccagaacaaauguaucuucaacacagauacccaaagucuugaauuuacgagcgaauagagacaaggucuuacuaaguugcucaggcuggucagaaugacucgguagcccaggcuggcuuugaauuugccaucauccugauuaucuguacuuacagcuguaccaccccaugccuaggaaaguuuugaauuguugugucuucuuuuggcuucugacuagaauuccauaaacauuuucucaguuacauaagccgucuugucucugcuuugguggaaugacagcuguacauaaggguuccuccuugcauuucuucauccuaccauggcauugcaucuggagcaagggggugggaacaugagucagcccagugcgagccgaaguucaucuugggaagacccaggaauucaacugugcauguguagugaacuagucuuuagugauuuuagaauagacucaaacuccagggaaccucuccuugguuaaagcucauuugacaagguaguccaguggaaggauggacuuugagucugaccacuuggcucuaagugcaagccucacuggauaacaugguaauuguuccauaaggaagaugucuccacucaccuggggagaaacacauccauucuggcucucuucagccuugugguccagagguggaggacucuggcagugaggugugguucaaugugguccagaggagugcccuugucuuggggaagcaccaggagcaaacuggccacccuucccagguacaacagcucuagaacagcuaucucauggccugcagcauccuggaacuggccuagggauuuaguggguuaggaauuagcuuuguccuaggagccagagaaacucaacaguacuacaacuuggagaaagcagacuuacaugacagcaacaguaagaggguguccuccucagccucaggaagcaaucugagacugggaacuauugggugacauggcugcuuuaguguuccuaaagcucucugagaucucccacagagucuuagucagggauccacagcugcugaaccugcugggguccgugucuuagggagccauccagucugagcuuuuuaggguucaggcucuuuguguuacaucuuauuuuucaagcuaagccuuuaaaucuacauuucaugugagaaaugcccaacucuugaaauccucugcagacccaacagaacacacauucuggcuggauuugacuugaagacugaucauuccugugaccuaaaccggucuuaggaugggcagcuggaagucugugggcagagacaaguccaggcuaccagguggaguaugguuauagaaggauaugaugggacaagugacagauagcagcagaacacacugagcuggaaaaggguuggugcuggugggggaauguagaaagguggagaccaguuuuaggugaacccacugcacguuguagcucauacuuaguacagagucugcuggcauccauagcacacauaaggccacuaggcaucugcuggcacugggaaccuccccugcugacugggacaaauaaccauaggcaagagggccauauggagcaaugacauuucaggaccagggacccuuuagucuggaggccuuuuagcccuuauaugguccuggcuggguguugugucguaaaggugucuucuaggagaauuauuugguccaaguauuuuugauucuacaugaacauguucuuaaucagugugaaggccaauaccugcauuguguccuuagcauccagaugggcauaucauucaaggccccucuagaagccuucugauaccuugagucuacccacagcccagagaauggaccccuauagaaacauguguccauccaauccuguaaaacagagcccaccuccccucucuugccuauguugcugaguuuccuccaacuguaugaauuuggagaagagaccuuaccauagcugaccucugccacuuggugcaucgcugggacuugaaguacaagaccaugggcaugggugaaaggcaggggcugcaggaccacagagaaucucuucugccagguacuuuggaaagucauggugcucaugauggagagcugaguagacagggcaucggcccggccccacaacgggcuaucugggccuucaccuauagacagaagaguuucacuccagccucauguuguuuuuaguuuauuacaaaagcuuuaauuccuuaugcugccaaggccaugcuaaauggcuuuuaauuuauugucauggaaauggaaaguaagcacgcaggauucagacuaggucccuaaugaccgagcuucugcucuggggcagggagucaccuuguaauuugaauuauaaccuucuuguuagcaugcauucaguguggccucccucccuguuucuccuagugcccaggauggccccugguuauguugagucauuucccagagaucauuaggcauugucuccccaggcaaaugcuugcacggaugaggcucugacuggagaagacugcucugucaccucaccuugggacuugcuaacugcugagcugcaucccucuccacaccuuuguggagauaacuaugaucagaacacacuuaggggagggcugugguuaggauuucauguaagaacaggaagaagcaagcagaucauuccuacagagacagcuucugccccaggccuucaaucguuuaauaaauauacucugugcuaggcucugccuuaaaugcuugaagaaaucuccacaacuuuuggcucaauuucccagaugugagcagugaggcucggggaaguuggucacacaccacuaucuaccuagucacccaacaaaagagccuugcacuugaaucugagcagauguguuccauacucaugccucugggguugagaaagaccaagucuuucuuuuucuuaaagaccaggcugggaguugagcauaccuauguugguuuuugaguggauccuuugacaacucaaggaggauauagugaaucacuccuuaccuaauaaaauauuuuaacuaugugucuguguguuugcuguguguggguauaugcacaugaaagcuggcaaccuuggcugcuggaaacaagcaucggauacuccagagcuggggcuaaaggcagguguaugcuuaccucauccauccucuuuuaacagcugaaccauuuuucuggccccaagguucaauccuuuaaaagucaauugccaaagcuagcauagaacacuugaaaaugucggagaguacagccuucaauccacacacaucaaagcuguuuguuuguuuguuuguuuguuuguuuuuagcaacucuggaucuugaacauucuccauuuaucugagucuuuuuugugcuuaccaagaacagugcagccagacuacguggaucagaaugugacccuggcuuuguggcccaugggcaagcaggaaacucaacccugguguuucaguuccuccagauguaaaaugaagaaacagcacccauguucuaggagcaaugggcgagugaaauggaaucagagauuccuaguggcaacuaacuaacuaaaaaggccggcagguguuagccacuccugcccauuucauaacagccacaaccugugguggcuaccacugaugauugcguuacgcauagcaagcuuccaacagaaccaagggagacauggaguguaacuugucccuuuugugugucuuucuuuaaccugacuuucccagaaacuacuuuuccugcccccugcuacauuuugcugucacaugggguuagugaaaaauggccuagggacaguggccugggacaaauccugccggguauguccauaggugguaggcucugaggaguaccuuucugugugugcucaaggauaggugugugugugugcauguacauguguucuugugcuaaggcgcaaaaagggaggaauagagaggacacacaucaugcaugacauucaaggguaggucugcuaucucaacgucugcugcaauucagggcaccccgaacuuaccauggcuucugacaaaugauggcuggcacuauuucuuugagcccuuagccuugcugaggagggugguuuuccuuuaccugugcucugucuggaugugacuuuggaggccuccgugguagugcuguuaggcucgcugaagucagcugccuccagacugcuguuggcccaccgggagaccugcuccacaaagcagggagacagggauguuccgguuugcaugaacagggugcaggccagcuccauuccgacaccuugacuggaguugugccgugugguauaaacagcaugcaggaauucuuucacucuugggucugugagaaaggaguguucauaagggccugcacagcucccaacagguugucucauaagauguguccaugcaaaagucccucacuggaaaugacauagccgcucuagucaaaauccaccuaacucuacagcuuaaaaguuggacagaaaacauguagaucacaaacaaaucuagcuggaggagagucugccagugccuuggaaauggcaaagcaguguaaagcuuuguguagcccuagaauucacucuguagaccaggcaggccuugaacucagaaauccaccugccucugccucccaagugcugggauuaaaggugugcgccaccacugccuggcaugcuuugacuucuuaauucagggacauugcugaguucuggaggagaggcuagaccuggggaugugacacagaggaauuucuaaugggaagccagagaguucugugcaguauuguagcaaggacaggcacuggucaaggugcugcucuccuaguuagaauucugugcugugauaaagaucaugaccagaagcaagucagguggaaaggguuuaugcugccuucuaguuuauaguccacuaccgacagagguaagggcacaaacucaaggcaggagccuagaggcaggaacugaagcagaaaccaugggaggacuggcuuguccccugugucuugcucagccugcuuucuuacauccugagacuaccugcugagguggcagcacccacagugggcuggguccucucacaucagucauuaaugaaggaaaugccacacagacuugccuacgggccaaucugaugcaggcauuuucucaacuaaggcuccucuucccagaucagucuaucaggugucagagagcugccuugccaguaugucucauccgaggucucacauccaggguuuuacugagcugacccuggauucucuuaagcugcuuuucucagauguuucaucacagcaaagagaaaagcaacacuacagcccgagacgaauguucucagagucagaaauauugaagaggcagagcaaugggcuggaaguggauuucugagccagauuuguccccguccaaucugcacacagagaagaguucuuauguauguuccagaaugugcaguguuagaauaaaauuuuaaggcuuuauggugucuacaaacguuacacagggcacuccagacauccaguuuacaaugacugcucucagugaugcuuugaaguaagggcuauaguccuuccacuauaggaaggaggcagaugaggcacaggcccacucaucacaugcugagaggcaccauguuggagguaaaacuguauccucaucccguugcccauagcgugaggaauggcugggugugagaaaacccugcucgggagagcuuuguucuccagauaaacggaacuguagagcacaucaguuugguggggggaguuggggggcuauauugccugcauucuagagcaucgguuucaaccugugauauuuaauacagugccucaugcuauagugacuccugaccauaaaauuauuuuucuugcgacuucauaauuguaauuuuauuacucuuaggaaucguaauauaaauaucuguguuuucugacagucuuaggugaccccugggaaaggaucacuugacccucaaagaggcugugaccaaaauauugagaacugcuguucuaaaggugucuagaagggcagaggugaguggccugagaacaaggcucuccaagaggaagcugucacugcugguuucugcucagccuccugcugccagaguaaaaagauggagggugagggccuauaauugggugguuuuaacagggugcugagagaagaaaggaagaagaagaaaauaaacccgcagcggcuaaaagaaaaucacccuguuagcuguuagcucaucugagaggugacucccaggcuggugggucugggcucuggaagguucugaacuuuggaaaguucuagacucuggaaucuuccugcccauaaaacuucaaacuaugagacccgguuuuuguuuuuguuuccugcaugguuugucuccucagucaucauccacgggacucugagaagcuguagaauaugcagguggagaccuguccucugaacacagauauuuuaauuuucaagaacuuugagaggggccaacgggggugcuucccagcaggugugguuggacucggaggcugaagcugccucugauaugugugugugugugugugugugugugugugugugugugugugugugugagagagagagagagagagagagagagagauugagagagagagagagcuagcuuauaaauguauacaucugcuucuuggcccuaguggggcuugggaggucuggagaagcgcaggauuuggaaucaacaaucuggaacuugaacccuggcuuugucacuugccccugggccggcugaguuuugcugagccauuuaccucuuguguuagucugugggacucaaaugacauggucauaaaaggaaacucuguaugccuuccaaagcagaacucuuuuccugggacaggaccaccuuccuuucuggggccuaugugcuauaauguuuucauuaauuuaccuauaaggauaaugaaaauucuuagccauugaaguaaccagaaauuguguguuccccauggacacaagacccagagaaccagagcuggaucugacuucaaagccugcucccugaggccuagccuucagugcuagcaguugcuaugcaaguuuccaagggaagagaacaaccaguaaguaguccuacccagcagaaccacgaagaugaccaguagggcacaaacccccaagggucagaaguggcacuugugcuuaucuugucaguaaccaggagcucucugauugaacuuaaggcccacucagcaagagggacaucauccuugguauaggaagcacauaacggggaaaggggcugaaagaguguaagagccugaggaccaagacaucuaauguugagauugugucuucuacaaaugacaggaaaguuuuacccaucaagucucagcaauacggcagccuaaauaagaccagaacaagcaaaacuccaauagacgcacuaauagagaagggaaagcucuauuauaaagcucuauagaggacuacaggcaaccgaggaaugcugagaaagcuuucuggggaagacagagccuuccccaggcaagauccucucccuaacugguuauccaauaccaaguggccaagcccggaaaucauacauguacaaauaacauuaaauguacugaacagguuauaucuaucuaucuaucuaucuauccauccuucucucucucucucucucucucucucucucucucucucucucucucucucucuguguguguguguguguguguaaaacaauaacaaagagaagccaugauuucaagaaggagcaagggggcaggggaaggauuugcgggaagaaaaggaagagaaaaaaaugaggaaauuauauuaaauuaaaaauaaagaauauaucaaaauuuaaguuuuauguauaugugugucugggcauauuagugcaauguccacagaggcuagaagacaguauuggauuuccuagagcuggaguuacaaguguucgugagcugucugacauuggugcugagaaccaaauuugggacuuccgaaagagaaguaugagcuccuaacugcuaugcuaugaacaucuuuccagcccuguguuaccuuuuaaaagaaaggcuggguugcggcaggcagcuggcccugcuauauaauuuuaagcaggcacagugcaccugagauggagaacaugauaaagaggagucugaggauggccugcuccugcuauuacuagcugaugguggaugcauacaauggcaaagcagcgugcguuucagaaacuuaggggaaucacuguccugcauagaauuccugucaucuggacaauaucuaaugggcucuguggaagcccugaucuugucaucaugcaugaucaaccaguuaaccagauaccaugaugggaucuggucucagaucugacccucuuguccaaccaagacccuucguccugacuugugugagacucuguugaaggcagaagugccugccuuuucuauauuaaucacauuucuucuuccugaccagcuuggauguauucucuucuggggaggcuccaaccugcucuguggaaucacagaaccaggcggcacucacccccaugucuacauguauugcucucccagacagaguugcugccuucagaguucuccucaugugcauaagacaaguuucugaccagccgugaucuauauugcaagagcaccacacuugaugaaucguaguguccugacucuaagugagccuguggacguguaugcugcuguggucuaauugcugagaacaacugaguucuaaaaacuaucuuugguuucaguugucccuagagagaacagccuauugguuguccagcaggauuguaagacuuguuuuagcaguggucaggguauacauugaggaggacagguaguucagggggcaccuggugccagacauguugaauucuaacuuugauuugcuagcucaaggguccacccccagaggacaccguggcuaggcugaguuggcauuauuucuugugccuucugacaaaucuuaauucauccaaagacgacuccugccaguuuuagugauguucauugcuuuguuuguuuugagaugggguuccugcuacauaacagacuggcuuggaauuaagaaauccugccucagccaccaacacuauguuuuauauugacaucuuauucugagauugagaagggaaggcuguguuagcuuuagcuuauagcugcucacguauugagcugcaucacccauguaggucaaugcaggcugugcuguguucuaaagacuuucucugcuguuagcagagcuguuucgagaaacaauauguagauauaagcuggcagaaaccucagaaucaugaaaauagguuggucaagagcauaguccuggaucuaaagagugcauuuaagagccgggcgugguggcgcacgccuuuaaucccagcacuugggaggcagaggcagguggauuucugaguuugaggccaaccuggucuacaaagugaguuccaggacagccagggcuauacagagaaacccugucucaaaaaaacaaacaaacaaacaaacaaaacaaaacaaaaaaaagugcauuuaagcccagccugccuuuuauugacugugugacuuccagcaaguugucuccacccucugccuaucuacuuccccaaauaggggugccaaugaaaccaccaacuucaaaaggcaaucagugacuguuuagaagguguuccccaccucucccagccacagcaagcauucuaaaagggacagugacucaaaacugugguauugccaugaggcuagaaggaaguccccacaaucaagaacagccaugguaaaagucugagugcuucacgaauggccaugccucucucccugugcacacugggaucugcgcuccccgcccagagcacuugagcaggguggagcagggagcagggcugagagaagcaggagagaggagccucuuaccuugcacuguauagccgagggccccagccagcugccagccgguguugccccuggcuccaaacugcaggaucuccagggagagggacacacuggccggugagaugacgaaguuugucccguuucucucugcugcugcacuccgguaaagguggagggcaaacucagucuucagcagccacaggccuucacugagggggcugcccccuccugcugagaagcaggaggagagaagaaagaaggugaccugcaggagaggcagcauggagacuggacaccugcaguucagagggaggggaaguacagagagaaugcuggugacaaggaagacaaggugacaaggcucaucaucugggaacuggggcaccuggcucuguuuucaguggccagguauggcccaaaggacagucucgcuucacuuucuugcuuacccaccaugcuccuacaugucuaggaugcuugguugggcugggaucuuuuugaaaacucaaccccgugcuggaagaucugcuccucuuacuguacgugaggccuuggaaaaguccugguuauagugaaacaagucauuauguuaagaaaugucaaagugcauccuaugguuuccuaguacuuagccugcuuauagcugagccauguuucuuaugagucauuauaauauuaaccauacucaaaguuuaucuuuuaggcuaaaaagauuauauauucuugguugauauucucacauccauacuagguaucguaacuauagucaugggggcugugcucuagagaacucagugacucacugguagggggagaauaacagaguuaugacagauccuggccuuuaagaguacuacauaaaauauuaagaacauauauguauguucuaagagugaugaaugggauagcugggccuagaauauuagauuucaugcuacguaguagauuauuccacagaguagaacaauaauaauagaaagcuccuccucagaacuguguccucccaggaagaggggcuaccaugaguagcaaaggaauccagaagggagcaagaagagcagagcagagcacuuucacuacaguagcaaucuuugcuaauugcuucaacuguggaaucagacuaggccaaugggagagaaauacccaguccaaagcacuuccuauacaagcuuauaagcaaaggccugggcucaguggaauucccuuuaaauaaagaucuaagagaaaaagccauguuucccagcucuucccuucagggcugaacacaaauacacgugaccucggaacccacggagugggaauuugcaugggugcguaugucuagagagaaaguaggcuuuacucuaaggucauuagugaaagcuucaaguccuacuuugagaguucgugcagcuucuaucagcuuccgagacaagagcacuugcaacccuuagcaaauagacuuugaugcccagacuccuggugacccagguccugccaugacuaccagggauguguuguauacucaccgacucuuuaaucaaaugguaguuuccuuguuugauucuguucuugugccu

SEQ ID NO: 7517 - RNA, 3928 nt, Mus musculus
uuacaugauuuuguuggauuuccugggucaacagaauauccauucauuuucgcgaucaccucaggcugcuuacaagaagaggcacuauggggaccucugaaguuggacuaaaugaauuuuccaucaugaagauggccaugcgcuuaugugcuuuccaagcaguggaaaguugugguuugaaugagaaaugacaccauagcacauguauuugagcacuguuuguggaaguuauagaacuuuuuagaacuggagccugguuggaggaccugugacacuggggguggacacugaggguuuagagucucaccucacuucucccuugcaugcugucucucugucucuucuguauguggauggaaugugguuaacuccugcuccugacuccaugucuucucugcucacugucauaccuuccauggcaagauggacuccauucuccuugauccauuagccaaaauaaaccauuucuuccauaaacugcugugguuauaguauuucaucacggcaacauaaaagugggaauagagaaaaauaugcuuggugucauaaaaauuacggaagucaaucacaggcaacaagggauagaauacaacugugagagggggaguuggaaagaggucaggaaaggacugucuggauggccaagggauuuguagcaaaguagguaaaacuugacgcgugaauuuuacuucaaauccuuccucaugagugaguaagcucgacuucaaaagcaaagggaauaauggucaauguugauaugggccucuggguuagaacagcacacgugcugacuuaggggacagcagggagcuugagcuguuguggugaagcaauuagaagcaguguuugacuuuuugagacaggguccuacuuucuagcccagcaugaccucuaauucuguauccuccugccucagccuccugagugcagggacuacaggugcgaaccacaaugcuuggcuuaaauaaaauaauuuaaagaaggucaaagguuaucuuuaaaagguuuaacaauagaugauggagucaauguaggccaagggaauuuaagcaagaacagcuaaaaagaaaaaaaaaaauucuccugacucucuagcgguacugaggucucuaaagcuaaaguuugaauauauauauauaauugcauucaugcaauuugaauguacacaguuauauccacuggcugaugacucaaguguuuuucauuauuguagagaaaaaugauaagccauauuuaaauugaaaaaugugggauugaacuuuguaaacugaaaucaccaauuuuuccuucauauuuauauugacuggauugucuugggaaagcaaaugucaaucaaaaucauaucgcagagaucagaacacuaaaauuacaauguuucuacuggcagcaccaaaggcccgaacugcugcaggaaacgcuaagaggccagccaguuucaccauacaguaugagucacagcucuggagcccuuguguggaacacagcuuuucugacugcauccuuucugugagcuucccuuuauuggguugcuaccgaugcaguaaagauuaagcauaaugauuucuguguagaauauuuuucaauauuuagcuucuuuugcugcaugcaugcacgugugcaugcgugcgugugugcgcgcacacacacauacuccuuuuauacugaguuuacuugaaagacuauucuuuuaacaguaauuucugauuauauucuaggguaaagauguuaggccuuuuguuucaucauaaggcugacucgcguuuguaucacuucuuugaggcagaugcuaagcucuagauguguuuuccuauugaucuuuggauaccaagcagguaucucuagguguguuagaaaggucuucuuccacugagucacauagcuaaccauagaugcuuuuaaaaaaaucaugaucagaauauauuguaugaaaacaaauuuguuucaauacaaagauuuuauuuauguauauauaaaugugugucucugggugcacauguguguggaugucccuggaggguagaagagggcaccagguccucuggagcuggcuaucaugggugcugggaacugaagagcucucaacgcagagccaccauggcagcccccauagguaauuuuagauccaugaaagaaaauguuuuauuucuauaaaguaguucaaaaugguuaauuuucucacaaaaauaucugucccuucacauauuuuauaacaucaaguauauuuuuauaaaauuucuggcacugucauacuaaguagugacacaucacaaauugcuuuuuacucacaaaaacccagggucccuacagggacauucuuugaaguuuagggucuuuauuuaacagcauacaaagaauagaaauaaaugucaccaaacugaauauacacuacuuagaauaaaauacacaauucagugacaauuaaaacaacaaauauuaucuaauagugguggugcacuccuuuaauccuagcacuuggaaggccaaggccaaaucucuaaauucaaggccauccugguuuacauagugagcucugggaaaaucagagcugcauaauaagacccuguccccaaaacaaaaaucacaaauauuuuuugaaaucauagagaaguaggcaauuuguaucauaaaaauuugagacuacauucuuucucccauucuuucuuuuggagauuggcucucauauaucucauguuggucuccaacucacuguguagcugaaaaugaucuucaaguccugagccucccaccaugacauaggcauaaugauuuugugcacuguguaaagauuauccuugcauuauucaaaugcugauuucucugcccccacaucugguugcaaucuggacauggcauuguaaugcuuauucuaagaaucuccugccucaauguuacuuaaacauuucuccccauuuagucuccaauuugucaauaaaagcugaccagccaaugacuagcaagggagagaauaaggcuggacuuccuccuagccgaggagugguggugggggaguggggauuggugaggaagagacaguaaaggagacuccauaagaaaacagagccuagagagccagaucaguacuaaaaugcaaguaccacugggauuuugacugggagguagccagauuaguuucaaggauuaacauagaguaauauugcucaguuguugugcccuuaaagcuuguuaaauaacagaucugucucaauuauucaguagcugucuugauuaagaggaaaacugcaacaaaaauuuauuaaaaagccacuaacacaaccuucugagugguaaguuauaaguguguaacgcuacauaugguucuauggcucaggggauccaaaccagagcuuuguguaugcucggcaagcacaagaucaacuaaguuacaguccuagcuccaauaccccucucuuuauuguuauccaaauacuaguguucaauaagaugaggguuuuggggggcugaagaaauagcucagcgguuaagagcacugacuuuucuuccugagguucucaguucaauucccagcaaccacaugguggcucacaaccaucuguaauggaaucugauacccucuucugucugaagacagccacaguguacucauauaauaaaauaaauaaaacuuuuuuuuaauaugaggguuuuuuaaaaaaaguucuguaucaguaauuuaaaaccaauuuuuccuaaguuauuuuacuaccaaauugaauucauuauauguaugaaaacauuucuuuguaguuauuagaaaagaaauccuggguuggugagaugguuccaugagcauagguccacacugcuaguccugauaaccuuaauuuguucucugagaucaacaugguagaaagagagaauuggcuugcaagcuaucuucugaccuccaugugugcaugcucacaaaccccuauaguuaaauacuaagugg

SEQ ID NO: 7518 - RNA, 1309 nt, Mus musculus
cuuagguucaagugugaguccuuuauucauaauacaaagagaagauugauaccaugaucucuaaacucccucaaagaagcuuguaugagagucucuucuuccucuacccucauaucucacuaaaaccgguggcagugugaccccgagagaagucuugcucagcagggcuugcucuuuaguucucccucuuagauacuacacuauuucugccucugacuugggcaauaacccacagaaggcgcagaguuucguuugcccacaucucuccugggcugagaagugggcguuacugcuuucuagaacaaggacgucgaggauggaggaaacuacaacccccaagaguccacgcggugcuggcaagagccguuucucuacggccgacagcacagcgcccucuccgguguguuauuguuaaaacuuagcggugagucaucugcgcgcaugcacacucacgucccaacuaguuuagccucuauccuuccugcaggcgcuuuuccggugcggcugacguaggcuuuuccccgcccccagagucuggagaggguggggcucugggcacgcgcauucacagauuuuuuuuuuuaugagggaggggacaaagcuuuggguguggaagggaaaguaaaggacugcggggcgcaugcguccugacagcacugcgggccucgguuacuuacgggcggcggggcggaaguggcuccuggacugacgcacgcgcauuggcugcuagugcccauccuccggaaguggguuggccgccuugcgacagggccccgccccgccccgcccccugcuccccgcccccuacucucuuagguggcgccggcuugcggcuaguguggcggcgguguugguuuuggaagccagagcgggcacauucccuggacaggcggcagggcuauggucgcuggcucccaaaggcccgcuccgcuucgcagcccgauccugagcgcaagccugagcguucucuucagccaagucccccggcgcguucggcugcuccccgggcgcgcccccuccgauggcggcggagauccagccccagccacugacccgcaagccgauccugcugcagcgggucgaggggucgcaggagguggucaacauggcggugauuguaccuaaagaagagggugucaucagcgucucggaggacagguacugacugcuuguccccgugccgcgcggagguccggcccuggcuuggugggaggguagaccgcaccuacugguucaguucccagcgcgguggccuuggccucagcaacuggucccuggcggaguccgaguggcccuuggguuaacagug

SEQ ID NO: 7519 - RNA, 288 nt, Mus musculus
cacugcugggguuuuccacugagauuuuuuuguuuuuuuguuuuuugguuuuuuuguuuuguuuuguuuuuauugguuugauguuuuucaguuccagcaucaauucagaauucaguuuggguugucuucauuucauccaucucuuuguuuuuuuaucuucuuuuaacugugaauuuuuaaaaaucuuuugucuggauagucuucugggucauuuucauuagggcacaucacuaugggauuuguguuuuucuggaggugauaaauucuguguguguuugugugugguuu

SEQ ID NO: 7520 - RNA, 23592 nt, Mus musculus
aauggaaagagagcagacaaaccaccaguuucuuuuggguuuaacacagcuugcagagucccgggaugaagggggaggggccggcaggggcgggggcgcggucaagcaucacgugacgaaucagcccccagcggagggcggagcugcgcggguacuuaggagugcacgggagaggccaggagcggcuccguuuggcuugguggcugcaggcccaggcugucgcgcugcgcucggugaguuugcccggggcacaguggcuccauggcggaagucacuuuggcuggggucgggggagcgggcugagcagcggugguggagacaggcccuucacuugcccagggcgcaggcgcgguuccuccgcggcccuagaugcugcucgcccuggcggaucgcggucuuaggcucccgcaggcuagaccggcagagcuccagcuuucacgcuuuagggccgagccuggugaccccgcggugaucggcuucuuuccaguggccuuggcgcacuucaagggcggagguggggacuucggggagcuccgagggaggagcuuaaagggaaggguucagcucuggcccuuccagcucgcagauugcaagucucaggggugcucagggcgaguaucgaccugcaucuagugcagguuuguggcuuauucuaaagaaucugccccgggaacuuuuccacacacaaacccacgcagugccuggcacccuaaaagaccuguucuauugagaaugggaaccugguaguggguggcugggguggaaccugcacgaagaguuaaaccgagaaacaggaagagaagcagagcuaaaggauaggggcucucccagaaccuuucucuggaggggaauggccaaugugauggaggaaagguacuugcaggacagccuccuucagucagggcccugcuagccgggagagauagcauccucucccagagugcugggcgugcggaccaagagauagguaaauuggacuugguccccuagggcccaagaguaaaggacuaaaacccauccgcaccuuaccuccaccuaaccagauccccucacguguuugggaagggagauaaauugugggauugaaagggaaguuuaacuccuuuuagugucucgggaagacugaucuccaggugcuuccugugagggacugcuguggagguauggucugcaguccccggauucagaguagcauuugcaaaauguuggugaaggugucaucuuuguucgaagccguucaggggacaguuguuucccauaggcucuggccauggugaccuaaaacuccagaguccccagagccauaccagagcaaggcaaucacggcacuuggaaggcugaggcaggagaaucgcugugcauuggaaaccagccugggcuauguaauggauuccacaacagugggacuacagagggaaacgguuucauuucuuaaucccuccuuccuuccuuaaaaaaaaaaaaaacucaugcuuaaaagaagguggaggaaaaugaccucugcuccuuuaaagccacgugacccaggccuacgggacugcuagugggguggggcgagccgggcccacgccugugcuucaccagcccaggugccagcagagauuuccagcauuccccuugacguuggccuaaauguuuucagacuagucaggcaguggaggguuggcgcucuuggcuccagguugaaacuguucccuggaggugcuggcucagcauucuaggcuacggcccuuuuaugguauggguagaaaccuuuagauauaggagucuccgguuggccacugacuuuugauguacugauguaaggaaaauauuagcuaugugugagguggaacucuaugcaguagaacuuuugaaaaucaaaagggaaaccaggaacuugaguaugauuggugugaaggguugugguggggccucuagguaaggugagguguacaaaggucucuauugccuuugcuuaguuaacauaucccugcucugguacucugcaggagcugccuacggaagggugggagaaggaucaaucuggaguccuuuuguugcuuauuuuccacccagcacugaacaugguggaaguucuagggguggaguucugccucccucgcacugauauccaacccagagccucgugcauccuaaucaugcagucugccacucuaucauacccagccagcuuuaaccagucuccucccuccgcuagcccucucaguuuuuugaggcagguuuuacccuacuguaggacaguuuugccucaaccuccugaaugcuaggguuacaaacaauagcuaaugcuccuggguuaggccauauuuuuauuuuauuuuauuuauuuauuuauuuauuuauuuguuuauuuauuuauuuugagaacagggguguguaguaguuguggcuagccuggaacuaacuggcuauguagaccaggauggccggggcaugaugggguacacaaacucagagauaaaucugccucugccucccccgugcugggauuaacugggauuaaaaccgugggccaccaccuagcaauccuuucauuuuuaccuucaagccugaaccccccuuccugcagaccugaggccuuccaggcucagguuugggguagaaguggguggcuccucuuuggugggucuugcuugguuggggucgguuuggcuccaggacuugcuuugucugucacagggacuuugacagcuguugcuuuccuuauucuuuccuacuucugcacuugagauaccaugucuaaguauugguuuauguaacuuauaguguguucacuuauuguucacucaguugauaagauuuguugguguugacugauaccuguagauuuaacaguuauuuuaauuuguuggggacagguggcagugugacaggggcuucauguaucccagcuaacucaccacauaggagaggauggcuuugaacuccugaucuuccugcccacuucccaagugcugagauuacaggugugcacccugucaggccagcgagcuuaguuuauuagucuucuuuuucuucauuuauuugagacagggcuauguaaaccaggcuggccuugagcucacagagauucacccgccuuugccgccugagugcugggauugaaggugugugccaccaccacccuuuuuuuuuuuuuuuuuuuuuuuuaauguuaggguuuaguuuagcaggguagugaacaaguuaaucccagcacucugaguucaaggccagcuuggucugucuaaugaauccuagguuagccagggcuacaucgugauccugucucaaaaacaaaacaaaacaagaaccaaaaaacaaguuuggguuuagguuugggauuugguuauugagacaggaucucauauagcccagguugguuucaaacuugauauguagccaaggagaacucaagaucucuccugccugagugccuuuuaagugcugagcuuaaaacauguauaccaccacacaucuacaacuauuggguucuuuagguccuaagccuggguaucuaaguuuagguguaguuggauguaguuucuaaauauuuuuguguguauguguguuuuguguguaccaggggucuaugggcgucuuucacaaucaaucucugcuucgagaggccaggccacuuaugcccagagcuuaugcauuugguuggucuggcuggccagcuugccucuggaaccccuuugucugacucccaaauccugggauucccaaugcaggccaccaaguccucucagcauuucccuacugggaaaugacugcacagcaaugccuuccucacugggccaucuccugcaagcccuacuuucucauuuuuaaaauucaggagguuugugacauugggagacuuuaugagaaagugaagucaccugcaagucugugacuuggucauagucacuuagguaacugugauggaaugugaccuagaauucaaucuccuggaggugacugauccucagggccuacccauggucuugucucaugccucaguuucccucgccugugaaauagaaagaauucuucuacaagacuggagggcucuuuccagaaccaguguuuuauaaaagcugagugcugggaaggaccuauggucugugaucucaacuguuaaccuguuuuaauuggguuaguaccuggccaagauacugcucuucuuucucuagcuggcaggguggaagagaauaagguugauaaaugcuaaguuaguauccacagagcaccacagaacucuuagauacucugcucucagaucagagguggcugcccucuaaccuccugacucucugaccugcugaucuggcccaggugagugaugcucacccacagggaucacaugucuuuccaacuugcauaaggugcuggccagcuugugccagucaaagguauauaaaaccauaucagaauucaaguagccuggcacucauucucagcaugaucccucuggguuuggggcuaugcuguguuuugauaucaaauaguagaauccacauacaaggcuuuauuucaaauaguaugauagucauaauucuuuauaccaaguaggauaccuggagaggauauguuuugagacacagucuuauauuucagccuggccucaaauucacaguguagccaaggauggcauugaacucuauccugccucuccaugagguguguuauagcauauaccacuuacugugucugguuuaaugugaugcuggggacugaacccaggaugcuagucaggcaugccaucugaaguauauccuuggucucaaacugggauacuuucuaagacaaagauaauuacucagggauaauaaauguugacugcugugcacauagagaacuauauagucaguuaaccgugaccggagguuguaccugguggcucugccugcugguggcugucccaagccuggaacagggaggcacuuucccaaagaguagcucugcuugucauuucugugagccuugagagggccccaagaaagaagaagguacccaguucacaaacaaaauguuucuguugucugccuuguccucuggcugaccagccuggagcuuaauuuagccugcaaucgaauuaggaagcaagcagagaagcauaaaucacuaaucucauuuuacaucucaaggucuuuaaaagccuuguacucuuauauauuuuaggagcagacuuugggacuagacuacccccugcaucucggaagcaucucugcaggucuuagucaaauugucuugaucucuacaaacaauuaaauguguuuccucuuaaaugagggccuauccuaguuaggguuacuauugcuauggugaaacaccaugaccaaaagcaaguuagggaaagaagaguuuauuugaauuauacuucuacauuguaguucaucauugaaagaagucaggaagggaacucaaacagggcaggauccugaaggaaggaacugaugcauaggugauggggugcucagccugcuuucuuauagaaccuaggaccaccaacccaaggggccccaugcauaaugggcuggguccuuccccauuaaucacuaguuaagaaaaugccauauaguccugcccacagucugaucuuauggaggcauuuucucaauugagcagguaagugcccugcccuugaauugcaucucuagcuucuccagaugugccguggguagacagguaguaccugugggcagccccagaugugccguggguagacagagaguagcugugggcagccccaagcuguuuguucuuuaggaucaccaugaaucaaucauacaguuuuuacuaggaacaaggauguacaaucuggaaacccacaucugggcuaugauucagacuuggcaaaagggggagucucuggccuccuucaggucagcucugcacaccuuugaaauuagcgugucugcuuccacuauaguuaccccagcauugggggcaacugggcaaaccaguccaaaggaaauacaguucccacuguccuguccugugguuggacuggaguggguaaugcuugaggagcaggugcccguaaugacaggcagagccuagacaaguuuguuuuuauggaagagacgcucauaaaguguaacaucaaggccccagccagucuccccauccucuucccaccucccuaggguagagucccucagcacaucugugauggacagccacagucguggcugcacaguuagagcuggugugugagagguccgccccauguaccgcagucagggagagauggaugaagacugcugugugugugugugugugugugugugugugugugugugugugcgcgcgcacuuauccugugccaggacguggcagguggccuguggcacguucagucuacacauucugucuccuuacagcauuuagaauguagacuuagacucuagucugagacugugugacuacucaggaaagcuuucuaaggucaggcuuguggguggcccccccggcccccccauguuugguguguucauuacguuaugcuuccuucacccuggccucaucuucccuuuggaugucugccauuuucuucuagagucccaggaguguguuugucugaggaaggacauccagcuaguuugggaaaugguuuugcuguugaugggaucgccaguccacucacuggccauucuguucaugugacagugacaguaauagcaggacucugagacacugauugcuacaaagguuugaaacggaagaggguaguggaacccaggaccagcugacuugagcuagaaauaaauggugcccgcaacaacugcccucuacuuguacaccuggaaggggaggcugguuggcucuggguguacuuguguguuccggccccccucuuuugugaaauaaagacuuucuguuaacuaaagugaaaaucacagaauugggaaauacaaggaagugcuuauuaaacuaggggaagugaaagcccuuggcuauuuaaggcaaagggauggaacccgugacagguugacaaguuuauggacagcuuagcuugucauugucacuauuggcugugucaccaaagugcuugugugugugaugucuaagaagacuggcuaccgguguccuggauagagacagcaggcuucauacacuccugucucaggacucaagccuuuugacaaugcuuguggauuuuacugaggguagaagcuuguuuuaacucagaguccugccaaguggaggcuuugagaguggguuuggaucaaacucgaguuagccaucacaagcugaaagacaggaguucagggggaagaagggaugagccuucuuuagcuagcagcaauuucuuucuguguccacugaugcaggguuucccuacccuccucuucuccucacaucaccuggagaccugcugcucauuaccgccucagaagugcaggaucugagccucagagaagggcagugaccauggaugacagggacaaaccaagaucuggauguugguauccagucuccaguggagccuggccuccucuugcagccuugguggcuggcggccaagugaaucccuuuugauucuaccccucaccccaaccucuuaaggaggaguggggaaucuagguauuuaggggugaagucuucccccaccccaggguucaucuugguaugagcaggguuagacauugggucagggguaggcugcagaaccaauggagacccagcuucuccugugucugcagcggcaguggccagggucugcuccugugucugcagcggcaguggccagggucuguaggcuacagaaccugggaacccuuguggcgauggccgugggagugcaugugcucuuugccauggcagaaaccaaagacaucuuguuuaaaauuuaaaauuuguuuaacuuguuuaaaauuucaaguuuccauggaaacgaaccuuucuacccagcuuauauuuaacagcucagcagaugccaagucucuauggggcaucucagggcacucuuauucucuaacauaauguuauguaugacauaacauuacauauguauguugugaacccaaagguuuucguccuucaacauaggagauccuaacagacuuaucagccccuuccuucaucuagaugcccacccuagggaguggauacuccaggguuucugcaucagugucuuggaggaaucaguuucuggacauaggaaauggcuuagcugaacaagaguuuguauaaggaucugaguuugauucccagagcccauggcaaaaagccaggcauguuggugcacacuuuguaguuccagcacuggggaagcagaggcaggcucacuggguagccagcucuggcuguuugauaagguccaggccuuguuuggaaauaagcuggguuacaccugagccccaccacccgugguuguccuggucuccagagguacacgcauauauuguacuugcuggcacacaacacaaaagauaagacccaguccaaggcacagagugcugcuaaaaagaagaaaggagacacaauuaccaaacuguaugauuggaggccaugugauggcugacacauggucaugugaccaugagucacuggaaacgcagcaguaagugugcuggauaggaaccccgggggagaggaagcuuuauauugguggcaggagauagaugguggguaacccauucaagggccauuuucaaaggucuuguucugcgaggcugugauucuuggucacacaguggauucuuugguaggugugcuggggugcacuuggcaguuacagccuuucaaaaggcagaaaccugaaagucacuguaaguucaagguuggcuuggucuaugcagcaaguuccaggccaguuggggcuauacccaaggcccaaucuuagagcaauggggcaaggagaggagagagaauacuuugaaauacaagaacauguauauuugaagguuuacauagucuauguguggccgcccauuucccacuguuaauguauuacaagucguuguauccauuuucccacuguggucuuccuguguuucugaugugagaguguguggugcugggguggcaaccagagucucagguaugcuaagcccacgauuucagaugcauuucagccccaagugcucugcucuccaagucuuguguuauagaagacacggcgccuuuuaauggaagcucuggcuuuguuuuuucccauauaccuaggccacuguaagagucaguuuucuccuuuaucaagcagaggaucaaacuugggucauuuggcucgacagccagcaccuuuaccugcagagccaccucgcuggcagagacuuaauuuuaaugugaugccuaaaggguuauguuuuaugccagcuuuaggcuuucuagggagucaguuuccuuugggacuuuuugcuuguuucauucuguguaucacaguguagccaaggcuagccauggacccuugccccccaggcuccauccuccugagcccuaagguuacaagcaugccccacagggagcccagacuugcauguuucucaggucugucugccuucuguguagcacucuuguuuuggggagccagguguacagaguuagccccuccuuguuuucccaggacaggcaaccagcuguguaagcacaacuggaggagugugucacuuccucuuucccuagcccacacacacucuucucacacccaagugaguuuugaguggccugacuuuuuuuaaauagaacuuuccugaggcacugucaccaggcauuuuauaauauauugugggauuguucuggaaggcggccuccuuuggaucuucuccagaauauucuuucuguccauacacauuuauucuuacagaugaguuguuguucagacucccuccuguguaccuaccacauacaccagacuauuguucugacucuuuggggacacaacucugcugcuugaacuuaaucaagaauuuuuaguuuucuuucaauacaauuuccugucugugauccagcacccagaaagaguaagucuguguucugguguccuuuugaccuuugacccugauguagcacauucacucuguaagcccuggagucagggcagggucccagccuacccacaucuacuguugcucccaccagacucaaaccacaugucagcauccaggaaaggccugcucuuaauuagcuacuugcucaagagggugacucacaggucgagcuggaaaugacuggucuccugauucuugagucaguucacaaggucuaagggcuaagguauugauguaauaguuuucuuucucuggagcuggaagcaaagcccuugagcgacaggaaaaaccagaggggcuucugggagccuggugucccuggcauagccagugugguuccuuaguuaccagcaacugacaccagcccagcuggggagauggcuuaagccugaaaugaaaggaaagaggcagcuccuagauagagcuuguccuccaaccugcacacagucacacguacaggcgaacagaaggaauuuaacauggcccuuuacgugucuuuaagugagggacuuguaaaccaggcuuuuuaguuuccuuauggauugacucuccuuaggacucacacuguuugaugguuuuggguauuuuuguuuuguuuuuuaaauuuaaugacuuuuauuuuuucacuuauuuacuuuacaucuggcucacuguucccccucccagucacacccccuccccccauacacacauauaaucuuuuuuuguguuguuuuguuuuguugaggcaggcuguagcuacauggcccaggcugaacucugucuuaauaccuuagaauucccaguacagaguuuauacuacauccaccuuaacgcugacucuucuucuagaacacuggagagaaucucuuaaacuuaguucaucaauuuaaaaauagccaggaggggacauacauauauuguugugugugauaucugcucccauccaaccaggcuucacagugaggccagaaaggcugcaagaggcccgagucaugcccguguguagaaaucauuuugauguugccuguguccuuucuaggugagugcaggauccagcauccaggauguggugguccuugauccuucuuucuugccugcuggcacugaccagugcccaugacaagccuuccuuccacccgcugucggaugaccugauuaacuauaucaacaaacagaauacaacauggcagguaggccacgcugcuuuuuccggucugucugugugucugucuuugcaggucccuugugcacacugccucugaggugacuaacgggcuguaaggcauucuuuucugcaaguugaagcucauagaccacaccauggauugcucuccagucuccauguugugugcaugggagugcacacacaugugaauccuuguacauggaggcguaugggggggauaagugagcuuuggagcgaguuggacccugggaaaacuccuaugggagaugaggaaauuccaaacuacuuccugccgucauuuccuccagaucuggggcagguguccagcuaacaacugaaaggagauuagagaagacacuguggucugagagcugagcucugacccugaaucccucugccuguucccuagcucccugaauuggacagaaccccugauccacucaucccaucaugggaaacccugugguagguaggugacuguccuggugugacucucuuucaggcuggacgcaacuucuacaauguugacauaagcuaucugaagaagcuguguggcacuguccuggguggacccaaacugccaggaaggugagugacacagccuggaguggacacugcccccacauacuggcuugugaacaguggugcuaguguuggaguguagggagagguagaagaagcccucucuggauucccuagguguguccuucagagacucaaaugcuggauuuacgacaagguggauuuacucuggauugucucuaaggugucacauccuaugugaggccccagacuuggcaguugaggcauggcuacacuuagcugugaauaauacaaggagaguccauagaaguuauuuuucuggaagacugacugccuugaacauuuuuaugcagaaguuguucuuaaccaggauuaaggauggccauccaaagauggugauaauguugucuaaucaaaucaggcaaggcauaguuuaauaauuuagaaauuccaagaaaggugggagaagauugcuuuagaaucagggcagaauccacaugggagcagugacucauacugcaggucuuuucuuggcucccccuucugguaauagccacacagauacacagugcccugaagggguuuccuguggccuugaacucaugaucuuccugccagacaugcuccucugcauccaguccccauaucacuccuggacaucaaacugaggacucccacgugcuugaugggugcucagcuguuguuacuucugcagaucuaaugagggaauuugaauguucccuguagacagcuguaacaccuaggggaggcacauugacccgagugcauugcaggaauguacuaggaaaacaaaauaaagcccagggcuggagagauggcuaagugguuaagacaccuguuguucuugcgaggauccggguucaauuccaagcaccuauccauagcuccaguuccaggggaucuaauaaucccucugaccuccgagggcaccaggcacacguauaaugcagagacauacaugcaggcaaacaaagcaaaacaaagcagacaaacaaccccaaacccacucguacacaaaguaaauaaaucuaagagaaggaugagucacugaugcuuuccuugcauagccacuacaccaaccuaaaaauaagccugaagaauuauuauuuaaaguaguuugaaugagacgcaaugagaugugcucauaauucugacauucacuaaggaguuggucaagguaggaugaagaauuccaggcuagcuugggcuacauagccagacccuaucuugaaagaaaggaaggaaggaaggaaggaaggaaggaacgaacgaacgaacgggguugaaacaacaacaacaacaccuugaaguaccaggacagauaucugugaugggggcaaaaaaaccauaucuguacccgacauaggcuagacagaugaaaaaugcccauuaaaugagcauagagccagugcacaugaugcugagucacucugaacagugaaaagugguaacaggacacugucugugucucaucacuucucugggagauacagcccaggcuggggacagccacacucuacugagucuuucaggggcagggagcgaauuguuguaguuuguaaucguccuucuuuugccuaggguugcguucggugaggacauagaucuaccugaaaccuuugaugcacgggaacaaugguccaacugcccgaccauuggacagauuagagaccagggcuccugcggcucuuguuggguaagacccugcugguggggagggcuccuggaagagacugguuggggugugauuggcauaucuagggagggaccagcugugacaaggcaagugaggagggguuugcaguccauuucuucccaucacugugguuugugguccucguggucggaaauuauugcaggaauggaguggaugaugggcgugaggugggucugugugcaccggcugugaagcuacuugcccucaguaaacaaggcggcucugauccagcagagcuucacgaguguccugugucugucagcaagcugauuucugaauuggggcgaaacacacacaacagaaaacggaacccucuucacgaagcacguaguugagugcauuaaauguguucccaguguugagugguuaucucuguggaucauccauaguccuuacauuuccccaaaugaaccaguucaguuauacugacuucuuuguggcccuccugcgcccaugugggcucccaucugccaucugccuuggaauuugcuccaugugagccaagucuucaggcagaaggccuggauuugccucuuuaaugauaagugugagcccaggggacucuccugacauugaaagggucuaaccacucagaagguugaaggcucucucugcuucaggcaagacgggcuucuuaccaggcaggacuuaauauuaccacaggcauuuggggcaguggaagccauuucugaccgaaccugcauucacaccaauggccgagucaacguggaggugucugcugaagaccugcuuacuugcugugguauccaguguggggacgggugaguguugggcaccuauucccggagacccuaaccccuuccuccccugugcuaaguaacucggggguccccggggaggggagagccauugucauggcugaaacagagggagacuugagggucugcaggcagacucuauuguagcugcuacuguugagcuucucggagccagucuugccucagcucggugggcacagagcccuggcagaaagaacugucgucuccaaaaguugugcuugcuuucuguccccugucugacuuucaucccuacuuggcccucaucaucccucacugccaagccgcagcucagggaaacacacgggucugguccauaaggaugacagacuccagauggagggugggcuuacuggucauaacucgggugcucaccaguguuguguggcccuuauucuauaacaguggugcaggugagacauuccugcgaguuccaaaaugugugugucuaggccucacaccgguagccuaggagcggcaggcgggagagagaaagggcaaugcccaucucuugccaggcugagccucaugcaucucuauucugccuaaugcuuuggagcugcaagggacaccacaccuuguuuugcaagggguucuccuaaguacaacccccaaccccaguggaugccuugaaccagggccauauucacuguggcugucguuuuuagaguccaacagguggcagugaaggcaacgugaaucuuccugccugcgugauuuaaggcacagaacaugacaugucugagcugccagcaucaccgagcuuacaguuggccguuaaggauucuuugaacccaugcugcauggguuccauaaccaagauggcccucgauugaguagagagaguaguauacagcauggauauuuuagacagagaugcucauguuccauacugaauggaccaagggagugugagauuuuaucaugccacucaguguguaauuuaaaacucuguuaauucuggaauuuuccacuuaauguguuuggaccuuaguugaugguauaacuaaaaccuuggaaaucaaacuagccugggccugguguugcgugccuuuagugucaauacuuaggaggcagaacaugaggaucucaguuugaucuacauaacaaguucuagagagaaccugccuuggaaauaaaauaaaauaaagaaaaccauaaggggguugagcuacuauaccccaagggauugugcaguugagaaccauugcuccagaaaggggggaauguugaaauuagcucaguuuguuguggacaugaaaaaaaaaaaaagagagagagagagagaguccuuguggccagagauggagcuugguugagucccuggugggacgccaguggagagaggaugaauugggauguuggacugugggaggauucuugugaggacaguauauucccaggggaccuuggcauuuguaccguguagugaugcauucuggggacagcugggacuuccuguaucuugccauugacaaaagcucuuuuucagcuguaaugguggcuaucccucuggagcauggagcuucuggacaaaaaaaggccugguuucagguggagucuacaauucucauguaggugaguguguuugcccacaacuccugucucucagaugcauuucagaggcaaguguuaguggcuuccuuuucuaugguaaggggaagguuaaggauagagggccagcugauggcuaguuagccaggccauccucaauacaggagcugacccacaggauguagacauggucuaaucugggggccucgacguggggguugcaagcugacauuaucuuguccccuccaucugucaggcugcuuaccauacaccaucccucccugcgagcaccaugucaauggcucccgucccccaugcacuggagaaggagauacucccaggugcaacaagagcugugaagcuggcuacuccccauccuacaaagaggauaagcacuuugguaagcuggggccugggcuggggccugguaaaggaggaagaagccaaagacauugaguguuaagaguccagagaugggcggugcuacacaccuuuaauccuaacaacugguaggcauaggcagguggcuuucugaguucaaugccagauuggucuacagagauauccaagacagccagggcuacaccaacaaaaaacaggagcaguaaggaggagggaagcugagguaauucauaaccugucucugaacagagaugcacacugcauacuuuguuugguccacacucugucuugucucaguccauuugagcuccaagggaucaggcagauggucguuuugcaagggguuagaaccugguuuuaaaccuugggguucucuuagccucuucuaggacugucuagcucuacuuaacuucuuacguaggaagccuuccuugaccucuucuggaggccuggaggggcuggaggcacuuucucacccugaccagcuuuguuucuuuuacaggguacacuuccuacagcgugucuaacagugugaaggagaucauggcagaaaucuacaaaaauggcccaguggagggugccuucacuguguuuucugacuucuugacuuacaaaucagguaccagucagcuccaacagagccagggguggaaggaagucagagcucauugagucagggucuacauaagccagcaggucucacagugagaaaggcaggagcuuugggaggggacuggggauucagucucccuucugcucucuucucugggcagguggugguggugguggugguggugguggugguggugguggugguggugguggugguaguggugguggcggcggcggcauagccucccaccugcuguacucacuggcucugucuccauagagccucucuggggucccuuuccaaccuugccacccuggcucuguuccauacuuugcuguugcuucuuccuucuacagcaaucacuccugccuuugucucauccacauuugacaguggucauuucucuuugcaaaagccuagaucaccuuagcuguccacauagcugggaugacaacucagaaucaggguucucuagagcagugguauucaaccugccggucucaaccccuuugugucaguuugucacaaugaaaauacauccuguauaccaaauaucuacguuacuauucauaacaguagcaaaauuacaguuaugaaguagaaacaaaaauaauuuuauaguuggggucacugcaacauaaggaaguauugcagcauuaggaaggcugaaagccacugcucuagaggaacaacauaaauaaugagucuguuugauggaucugccugucuauguauguaucuauccuuuuaucuggaggggauuuauuacaguggcuuacaggcugugguccaguuaguccaacaaugacugccuacuaacagaagguccaaaaauccaguaguucagugcaugaggcuagauguugcagcuggucuucagcauaugcuggagucucaagaaguaggcucuaaugccagugaaggaauagcuugcaagagcaagcuggcaaacagaguuucuuucucacugcagcagacaaauguggcccagaguaaagcugggucugcucaccugcaaagaucagaauuaaagguggaucuucccaccucagauccacauuagaagugggucuuccuacuucaaaugguuuaauuaagaaaacaauuccucacaggugugcucagucauuuggcuuuuaguuaauuccagauguagucaaguugacaaccaaggacagccaucacagcaccuguaccuaagcaaguagaaagccugguugaccagaucucuaaacacccaagcuucgaucagccgacaguggccugcgcccuuaccuuaccccuccagugaaccccagcaaagcaggaacucugaaagcuaucuaaagcuucacagaugaacccagacauggaaucucaggguguaaaacaaauaauuggccuuuggauuuuaaguuugcuucauaacuuaaaaguuuaucagaaccuuuauuuucaagccaaccuaauaauauuuuuguaggaucccgcuuuuuaaaauuugcauucuuaaguguauugggcuuccagaaauauuuuuggaagugcuaggaaugguagaguacaucuuugauuuugucacucagaagguaggggcaggcagaucugagauuaccuugguuacacagugaguugcaggccagcuagggauauuuaauaagacacugucuuaaaaaaaaaaaaguauauacacacacauuuaagucagauauaguggcacccauauguaaucccagcauucaggaagcagaggcagaauuuugagguuugaggccaacuugggcuuuuuagaccauaucucaaacacacacacacacacacacacacacaaccuccauacauacauacauacauauauacauacacacacacacacacacauauauauauguuuguauauauauauguguguguguguguauauauauauauauauaugcaugcauaauacauacauacauacauacauacauacauacacacaaucuauguaaucuccuaauaccguggauacccuugucauagauucuguucuauugcugugaagaggcacuucuuuucuuacucacuguucugaugcucugcagagacccauaaccaaggaacucuuaaaaaagaaagcauuuaauaugggcuugcuuacaucuucagaggguuaguccacugucaucauggcagggaguguagcuccccagacaugcuguagcugagaacuacaccuuggugcacaggugugugcauguaucagggccgagggguaccacagagacagauagaggaaccccacgcccgcagugacacaccaggcaacuuccccuccaccccccuucugccacuucuaauccuuccauauggugccauucccugguaacaaaugauucaaacaugagccugugggagccacucuuguucaaaccacacaccgaagcucccugauaaagacuaugggugcuggagacccaacccaggaccuugacaugcuagcaagugcucaucuugaggcccuccuccagcuuucuagagauuucaguguaggagaccaguugguuccugucagccuauucugacuagguggcuagcugucuugggaaucugugagcaggcagugagcuguguucagugauaacugccuuuuucuucuucaggaguauacaagcaugaagccggugauaugauggguggccacgccauccgcauccugggcuggggaguagagaauggaguucccuacuggcuggcagccaacucuuggaaccuugacuggggugauaauggugaguggcagucccccuccucaaacuacauaagcagcuaagggccagagcaucauagccccuuugcuccucuguggccugagguguggaccugacuaccuaaauguauagauccuuuggucuagaaccaucugugagucccagagcuccaucacaugagcagcaugugacgagaacugauaguuucagaugaugcugggugucagguagcucacccuggcuccuguggucccagcacuuaggaugcugaggcuaaggguggaguguguggccaaccuggguuacagaguggggcauccuaugaacauaguaaggguuaggccaagcucagagcauacuuugaaagcaucuacuuuuucuccaucccaggcuucuuuaaaauccucagaggagagaaccacuguggcauugaaucagaaauuguggcuggaaucccacgcacugaccaguacuggggaagauucuaaucugcuuugacuucauuguccaguccuuaggggcuuuuuccaaaauuuagcggcccuggcagggaaugagguagacaggggagucuuugauucuuugaguucaucuaacaugcaugaagcuuuuggcaagauuuggacgacuggaccagagcugccugccaucagagcuacccuccaaacacuguccuuaccuggccuccuccuagcccaucccacgacagugaucacagucugcauccuagccucucccuagacuagugcgguuuguagugccugcuguuguggcucugccugccauaccucccacccccauccccaucccagcauccgaggacccaagggcuuugacugcaggacuuccaaaagaacgaacacuucacgagaggacaaaugccaccucucagcugcaucuugaagcuggucacuucugggucuguggcaggcauucgucaauggcccagugcaguucucuggagaaagcuaccuuuucccaaggcaucugcauccaucgacauugguaauguggccagcucuccuugguccuguccucagccgaugcuuuuucaauaggauuuuuaugcuuuguguaccucaaccaaguaugaagagcuguacugguuuuauagaucacccccaauuguauggcuuaaaacaagcuacauggucaugguuugcugugugaccgacagauaaccacaaugaaacuagucuggaaaaaaaaacuugcuuuuuguuguaguuaccacuuaacccuguaguuuaacaaggaaugucugugccaauaaaccaauucucccucugcuugacauuggcagggugcacgguucugugcugcaguuucaaggcuuuugucucucccccugguuuccugucacccucagaaaugguucucaaaaccguaccuguaacugcucacaccucggagcacuuccuccugcuuagagauaagggagcuacacuuguuuaauuaaccaaggcgggcacucacauacauaugacccggacugccaucuucuuagaggucauuucccuggagugggggccaaagcuugcgcaccauguuuaaguuuucuggguuacuggauuucauggauuuuacaaaaaucauagugaaguacaguucaaagggaacagggagccucacucaucagcguuguccuauggaucuguuacuuccugcuaagugagagggaggggcugguuucucuggaagcccgccuucccaugucggcaaucagaacuauaucaaagaagcucuggaugccuggcgagugcuagaaguguaacucgguuugaggcaaccuggcuuggguacuggggcuuuaguacugcaagacaguuccaccggucucaacuacacccaauaguucccuccuacacuuccuuucuugccucaccacaugcccaccugcaacucccucccuaccucgcauagccagugaagaugagcuaaauuaagagaagaggacccugaacauccucugauggagcccaggaaacccguuuuguuaucguaugcuuggggguggcucuagaugucuuccauaaccagauucuccugugggugguuuccugugcucaagucaagagcugucuuccuuggguacaugaaauggauacucaggagacagaggcaagccgaucucugggaguuugaggccagacuggucuacaauagaccuugaagcuaggagcauuuccuuuucagccugcccacagggccuuuugaugauucuguguuuacacaucccuaccuuucuacacauuagacuagaacacgccguuguguguucuuugugugguccucaaaccugagccaguaugagugccaggccuuugaauagucguuuguagcccgacuaggucauuucagauagauuugggcgauggccuucaaacagggccuaugacagacagcauucaugcugcccaggaacucauuagguaacaugccagaucaacuuggucagaagucuuguuccagauccauuagaauacagaacuagccuuagcgcucucacuuccacuaccacagagccugggaaacucaacagcagggggaacgccuucaaagggcugucccagacaggauuugcaaauaaccagaggaagguagcaagcacaucuuucuaauaauuaugucuggauaugggugggccucugagaaagcacacagaugguguaaauuauauugagagucaaaagcaggcuagggaugucuccaugguagaguguuuguccagcauauuguccaagcaagacccuugguucagugcccagcaacacaauaacaggagaaagaggugugucauauguagacaguauguauaauguccgacuaaauguauuucuagauaauggcuuuauagaaaugcaccaugcuaaauaucugaauauaaagaaaacuaucugaaauucaaguggaacuuggggucuuauuugcuaagggaaauaaguuucaggggguuagagucuguccccccuaccccuuuauauuuauucaugcaguuuaugaguacucugucuucaugcacaucagaaggaaucagaucucauuauagaugguagugagccacuaugggguugcugggaauugaacuuaggaccucuggaagaacacucaggugcugagccaucucuccagccuccagguuuugauguuagagacagugucuuauguaguccaggcccaccuccacaacugaggaggaucuuaaaauccaacuccucccuuccucccucccucccuccaccucccacaugcugggauuacugguaagaguuguagcuuccagaaaggaugaacauuaaaaccuucgguuucagcggggugguauuuguucaaggcuuagagcaagugaccaaugaagucuccaugccccaguaauccagcaaggaaucugugcuuacaaaguugaauggaccacugaacuggccgaggcaccucagugaugaagucaacauacgcagcaggcuuaagaggggagcagacuaugcucuacaugucucuguggucugagcguaccccaaagggucauauacagguucacaaaaugacagguagcugaggcacuguucucaaaagggcucaaugcuagucuuccagaguuagggcuccagagaccaagcucuguggacaacagugggguggcucgugccuauaacucguacauucagaaggcugaggcagugggaucaccauuaaauucaaggcuacauagacuugcaggccaaccugagcuacaguuacaguguacaagugucagcaugccagggcgucgacuccugcuuccugucacgugcucucuccugcauguccucucucuacuguagugucauuucucacaaggccguccaagggcuaaagauggggccccccucaucuuguacuuucauccuccuaagcuguuacauaaacaauccucuuuccuugguaaagcaguuggccucagguaucuuguccuacagucagagugguugccuagagccucuccaccgcucaaacacugguuuucagauacacagggugucagaggccaccaugacaauguagccaacuaaccacgcugcaauuaaaaaccuaccaauauagaac

SEQ ID NO: 7521 - RNA, 23592 nt, Mus musculus
guucuauauugguagguuuuuaauugcagcgugguuaguuggcuacauugucaugguggccucugacacccuguguaucugaaaaccaguguuugagcgguggagaggcucuaggcaaccacucugacuguaggacaagauaccugaggccaacugcuuuaccaaggaaagaggauuguuuauguaacagcuuaggaggaugaaaguacaagaugaggggggccccaucuuuagcccuuggacggccuugugagaaaugacacuacaguagagagaggacaugcaggagagagcacgugacaggaagcaggagucgacgcccuggcaugcugacacuuguacacuguaacuguagcucagguuggccugcaagucuauguagccuugaauuuaauggugaucccacugccucagccuucugaauguacgaguuauaggcacgagccaccccacuguuguccacagagcuuggucucuggagcccuaacucuggaagacuagcauugagcccuuuugagaacagugccucagcuaccugucauuuugugaaccuguauaugacccuuugggguacgcucagaccacagagacauguagagcauagucugcuccccucuuaagccugcugcguauguugacuucaucacugaggugccucggccaguucagugguccauucaacuuuguaagcacagauuccuugcuggauuacuggggcauggagacuucauuggucacuugcucuaagccuugaacaaauaccaccccgcugaaaccgaagguuuuaauguucauccuuucuggaagcuacaacucuuaccaguaaucccagcaugugggagguggagggagggagggaggaagggaggaguuggauuuuaagauccuccucaguuguggaggugggccuggacuacauaagacacugucucuaacaucaaaaccuggaggcuggagagauggcucagcaccugaguguucuuccagagguccuaaguucaauucccagcaaccccauaguggcucacuaccaucuauaaugagaucugauuccuucugaugugcaugaagacagaguacucauaaacugcaugaauaaauauaaagggguaggggggacagacucuaacccccugaaacuuauuucccuuagcaaauaagaccccaaguuccacuugaauuucagauaguuuucuuuauauucagauauuuagcauggugcauuucuauaaagccauuaucuagaaauacauuuagucggacauuauacauacugucuacauaugacacaccucuuucuccuguuauuguguugcugggcacugaaccaagggucuugcuuggacaauaugcuggacaaacacucuaccauggagacaucccuagccugcuuuugacucucaauauaauuuacaccaucugugugcuuucucagaggcccacccauauccagacauaauuauuagaaagaugugcuugcuaccuuccucugguuauuugcaaauccugucugggacagcccuuugaaggcguucccccugcuguugaguuucccaggcucugugguaguggaagugagagcgcuaaggcuaguucuguauucuaauggaucuggaacaagacuucugaccaaguugaucuggcauguuaccuaaugaguuccugggcagcaugaaugcugucugucauaggcccuguuugaaggccaucgcccaaaucuaucugaaaugaccuagucgggcuacaaacgacuauucaaaggccuggcacucauacuggcucagguuugaggaccacacaaagaacacacaacggcguguucuagucuaauguguagaaagguagggauguguaaacacagaaucaucaaaaggcccugugggcaggcugaaaaggaaaugcuccuagcuucaaggucuauuguagaccagucuggccucaaacucccagagaucggcuugccucugucuccugaguauccauuucauguacccaaggaagacagcucuugacuugagcacaggaaaccacccacaggagaaucugguuauggaagacaucuagagccacccccaagcauacgauaacaaaacggguuuccugggcuccaucagaggauguucaggguccucuucucuuaauuuagcucaucuucacuggcuaugcgagguagggagggaguugcaggugggcauguggugaggcaagaaaggaaguguaggagggaacuauuggguguaguugagaccgguggaacugucuugcaguacuaaagccccaguacccaagccagguugccucaaaccgaguuacacuucuagcacucgccaggcauccagagcuucuuugauauaguucugauugccgacaugggaaggcgggcuuccagagaaaccagccccucccucucacuuagcaggaaguaacagauccauaggacaacgcugaugagugaggcucccuguucccuuugaacuguacuucacuaugauuuuuguaaaauccaugaaauccaguaacccagaaaacuuaaacauggugcgcaagcuuuggcccccacuccagggaaaugaccucuaagaagauggcaguccgggucauauguaugugagugcccgccuugguuaauuaaacaaguguagcucccuuaucucuaagcaggaggaagugcuccgaggugugagcaguuacagguacgguuuugagaaccauuucugagggugacaggaaaccagggggagagacaaaagccuugaaacugcagcacagaaccgugcacccugccaaugucaagcagagggagaauugguuuauuggcacagacauuccuuguuaaacuacaggguuaagugguaacuacaacaaaaagcaaguuuuuuuuuccagacuaguuucauugugguuaucugucggucacacagcaaaccaugaccauguagcuuguuuuaagccauacaauugggggugaucuauaaaaccaguacagcucuucauacuugguugagguacacaaagcauaaaaauccuauugaaaaagcaucggcugaggacaggaccaaggagagcuggccacauuaccaaugucgauggaugcagaugccuugggaaaagguagcuuucuccagagaacugcacugggccauugacgaaugccugccacagacccagaagugaccagcuucaagaugcagcugagagguggcauuuguccucucgugaaguguucguucuuuuggaaguccugcagucaaagcccuuggguccucggaugcugggauggggaugggggugggagguauggcaggcagagccacaacagcaggcacuacaaaccgcacuagucuagggagaggcuaggaugcagacugugaucacugucgugggaugggcuaggaggaggccagguaaggacaguguuuggaggguagcucugauggcaggcagcucugguccagucguccaaaucuugccaaaagcuucaugcauguuagaugaacucaaagaaucaaagacuccccugucuaccucauucccugccagggccgcuaaauuuuggaaaaagccccuaaggacuggacaaugaagucaaagcagauuagaaucuuccccaguacuggucagugcgugggauuccagccacaauuucugauucaaugccacagugguucucuccucugaggauuuuaaagaagccugggauggagaaaaaguagaugcuuucaaaguaugcucugagcuuggccuaacccuuacuauguucauaggaugccccacucuguaacccagguuggccacacacuccacccuuagccucagcauccuaagugcugggaccacaggagccagggugagcuaccugacacccagcaucaucugaaacuaucaguucucgucacaugcugcucaugugauggagcucugggacucacagaugguucuagaccaaaggaucuauacauuuagguagucagguccacaccucaggccacagaggagcaaaggggcuaugaugcucuggcccuuagcugcuuauguaguuugaggagggggacugccacucaccauuaucaccccagucaagguuccaagaguuggcugccagccaguagggaacuccauucucuacuccccagcccaggaugcggauggcguggccacccaucauaucaccggcuucaugcuuguauacuccugaagaagaaaaaggcaguuaucacugaacacagcucacugccugcucacagauucccaagacagcuagccaccuagucagaauaggcugacaggaaccaacuggucuccuacacugaaaucucuagaaagcuggaggagggccucaagaugagcacuugcuagcaugucaagguccuggguugggucuccagcacccauagucuuuaucagggagcuucggugugugguuugaacaagaguggcucccacaggcucauguuugaaucauuuguuaccagggaauggcaccauauggaaggauuagaaguggcagaagggggguggaggggaaguugccuggugugucacugcgggcgugggguuccucuaucugucucugugguaccccucggcccugauacaugcacacaccugugcaccaagguguaguucucagcuacagcaugucuggggagcuacacucccugccaugaugacaguggacuaacccucugaagauguaagcaagcccauauuaaaugcuuucuuuuuuaagaguuccuugguuaugggucucugcagagcaucagaacagugaguaagaaaagaagugccucuucacagcaauagaacagaaucuaugacaaggguauccacgguauuaggagauuacauagauuguguguauguauguauguauguauguauguauguauuaugcaugcauauauauauauauauauacacacacacacacauauauauauacaaacauauauauauguguguguguguguguguauguauauauguauguauguauguauggagguuguguguguguguguguguguguguguuugagauauggucuaaaaagcccaaguuggccucaaaccucaaaauucugccucugcuuccugaaugcugggauuacauaugggugccacuauaucugacuuaaauguguguguauauacuuuuuuuuuuuuaagacagugucuuauuaaauaucccuagcuggccugcaacucacuguguaaccaagguaaucucagaucugccugccccuaccuucugagugacaaaaucaaagauguacucuaccauuccuagcacuuccaaaaauauuucuggaagcccaauacacuuaagaaugcaaauuuuaaaaagcgggauccuacaaaaauauuauuagguuggcuugaaaauaaagguucugauaaacuuuuaaguuaugaagcaaacuuaaaauccaaaggccaauuauuuguuuuacacccugagauuccaugucuggguucaucugugaagcuuuagauagcuuucagaguuccugcuuugcugggguucacuggagggguaagguaagggcgcaggccacugucggcugaucgaagcuuggguguuuagagaucuggucaaccaggcuuucuacuugcuuagguacaggugcugugauggcuguccuugguugucaacuugacuacaucuggaauuaacuaaaagccaaaugacugagcacaccugugaggaauuguuuucuuaauuaaaccauuugaaguaggaagacccacuucuaauguggaucugaggugggaagauccaccuuuaauucugaucuuugcaggugagcagacccagcuuuacucugggccacauuugucugcugcagugagaaagaaacucuguuugccagcuugcucuugcaagcuauuccuucacuggcauuagagccuacuucuugagacuccagcauaugcugaagaccagcugcaacaucuagccucaugcacugaacuacuggauuuuuggaccuucuguuaguaggcagucauuguuggacuaacuggaccacagccuguaagccacuguaauaaauccccuccagauaaaaggauagauacauacauagacaggcagauccaucaaacagacucauuauuuauguuguuccucuagagcaguggcuuucagccuuccuaaugcugcaauacuuccuuauguugcagugaccccaacuauaaaauuauuuuuguuucuacuucauaacuguaauuuugcuacuguuaugaauaguaacguagauauuugguauacaggauguauuuucauugugacaaacugacacaaagggguugagaccggcagguugaauaccacugcucuagagaacccugauucugaguugucaucccagcuauguggacagcuaaggugaucuaggcuuuugcaaagagaaaugaccacugucaaauguggaugagacaaaggcaggagugauugcuguagaaggaagaagcaacagcaaaguauggaacagagccaggguggcaagguuggaaagggaccccagagaggcucuauggagacagagccagugaguacagcaggugggaggcuaugccgccgccgccaccaccacuaccaccaccaccaccaccaccaccaccaccaccaccaccaccaccaccaccaccaccugcccagagaagagagcagaagggagacugaauccccaguccccucccaaagcuccugccuuucucacugugagaccugcuggcuuauguagacccugacucaaugagcucugacuuccuuccaccccuggcucuguuggagcugacugguaccugauuuguaagucaagaagucagaaaacacagugaaggcacccuccacugggccauuuuuguagauuucugccaugaucuccuucacacuguuagacacgcuguaggaaguguacccuguaaaagaaacaaagcuggucagggugagaaagugccuccagccccuccaggccuccagaagaggucaaggaaggcuuccuacguaagaaguuaaguagagcuagacaguccuagaagaggcuaagagaaccccaagguuuaaaaccagguucuaaccccuugcaaaacgaccaucugccugaucccuuggagcucaaauggacugagacaagacagaguguggaccaaacaaaguaugcagugugcaucucuguucagagacagguuaugaauuaccucagcuucccuccuccuuacugcuccuguuuuuuguugguguagcccuggcugucuuggauaucucuguagaccaaucuggcauugaacucagaaagccaccugccuaugccuaccaguuguuaggauuaaagguguguagcaccgcccaucucuggacucuuaacacucaaugucuuuggcuucuuccuccuuuaccaggccccagcccaggccccagcuuaccaaagugcuuauccucuuuguaggauggggaguagccagcuucacagcucuuguugcaccugggaguaucuccuucuccagugcaugggggacgggagccauugacauggugcucgcagggagggaugguguaugguaagcagccugacagauggaggggacaagauaaugucagcuugcaacccccacgucgaggcccccagauuagaccaugucuacauccugugggucagcuccuguauugaggauggccuggcuaacuagccaucagcuggcccucuauccuuaaccuuccccuuaccauagaaaaggaagccacuaacacuugccucugaaaugcaucugagagacaggaguugugggcaaacacacucaccuacaugagaauuguagacuccaccugaaaccaggccuuuuuuuguccagaagcuccaugcuccagagggauagccaccauuacagcugaaaaagagcuuuugucaauggcaagauacaggaagucccagcuguccccagaaugcaucacuacacgguacaaaugccaagguccccugggaauauacuguccucacaagaauccucccacaguccaacaucccaauucauccucucuccacuggcgucccaccagggacucaaccaagcuccaucucuggccacaaggacucucucucucucucucuuuuuuuuuuuuucauguccacaacaaacugagcuaauuucaacauuccccccuuucuggagcaaugguucucaacugcacaaucccuugggguauaguagcucaacccccuuaugguuuucuuuauuuuauuuuauuuccaaggcagguucucucuagaacuuguuauguagaucaaacugagauccucauguucugccuccuaaguauugacacuaaaggcacgcaacaccaggcccaggcuaguuugauuuccaagguuuuaguuauaccaucaacuaagguccaaacacauuaaguggaaaauuccagaauuaacagaguuuuaaauuacacacugaguggcaugauaaaaucucacacucccuugguccauucaguauggaacaugagcaucucugucuaaaauauccaugcuguauacuacucucucuacucaaucgagggccaucuugguuauggaacccaugcagcauggguucaaagaauccuuaacggccaacuguaagcucggugaugcuggcagcucagacaugucauguucugugccuuaaaucacgcaggcaggaagauucacguugccuucacugccaccuguuggacucuaaaaacgacagccacagugaauauggcccugguucaaggcauccacugggguuggggguuguacuuaggagaaccccuugcaaaacaagguguggugucccuugcagcuccaaagcauuaggcagaauagagaugcaugaggcucagccuggcaagagaugggcauugcccuuucucucucccgccugccgcuccuaggcuaccggugugaggccuagacacacacauuuuggaacucgcaggaaugucucaccugcaccacuguuauagaauaagggccacacaacacuggugagcacccgaguuaugaccaguaagcccacccuccaucuggagucugucauccuuauggaccagacccguguguuucccugagcugcggcuuggcagugagggaugaugagggccaaguagggaugaaagucagacaggggacagaaagcaagcacaacuuuuggagacgacaguucuuucugccagggcucugugcccaccgagcugaggcaagacuggcuccgagaagcucaacaguagcagcuacaauagagucugccugcagacccucaagucucccucuguuucagccaugacaauggcucuccccuccccggggacccccgaguuacuuagcacaggggaggaagggguuagggucuccgggaauaggugcccaacacucacccguccccacacuggauaccacagcaaguaagcaggucuucagcagacaccuccacguugacucggccauuggugugaaugcagguucggucagaaauggcuuccacugccccaaaugccugugguaauauuaaguccugccugguaagaagcccgucuugccugaagcagagagagccuucaaccuucugagugguuagacccuuucaaugucaggagaguccccugggcucacacuuaucauuaaagaggcaaauccaggccuucugccugaagacuuggcucacauggagcaaauuccaaggcagauggcagaugggagcccacaugggcgcaggagggccacaaagaagucaguauaacugaacugguucauuuggggaaauguaaggacuauggaugauccacagagauaaccacucaacacugggaacacauuuaaugcacucaacuacgugcuucgugaagaggguuccguuuucuguuguguguguuucgccccaauucagaaaucagcuugcugacagacacaggacacucgugaagcucugcuggaucagagccgccuuguuuacugagggcaaguagcuucacagccggugcacacagacccaccucacgcccaucauccacuccauuccugcaauaauuuccgaccacgaggaccacaaaccacagugaugggaagaaauggacugcaaaccccuccucacuugccuugucacagcuggucccucccuagauaugccaaucacaccccaaccagucucuuccaggagcccuccccaccagcagggucuuacccaacaagagccgcaggagcccuggucucuaaucuguccaauggucgggcaguuggaccauuguucccgugcaucaaagguuucagguagaucuauguccucaccgaacgcaacccuaggcaaaagaaggacgauuacaaacuacaacaauucgcucccugccccugaaagacucaguagaguguggcuguccccagccugggcuguaucucccagagaagugaugagacacagacaguguccuguuaccacuuuucacuguucagagugacucagcaucaugugcacuggcucuaugcucauuuaaugggcauuuuucaucugucuagccuaugucggguacagauaugguuuuuuugcccccaucacagauaucuguccugguacuucaagguguuguuguuguuguuucaaccccguucguucguucguuccuuccuuccuuccuuccuuccuuccuuucuuucaagauagggucuggcuauguagcccaagcuagccuggaauucuucauccuaccuugaccaacuccuuagugaaugucagaauuaugagcacaucucauugcgucucauucaaacuacuuuaaauaauaauucuucaggcuuauuuuuagguugguguaguggcuaugcaaggaaagcaucagugacucauccuucucuuagauuuauuuacuuuguguacgaguggguuugggguuguuugucugcuuuguuuugcuuuguuugccugcauguaugucucugcauuauacgugugccuggugcccucggaggucagagggauuauuagauccccuggaacuggagcuauggauaggugcuuggaauugaacccggauccucgcaagaacaacaggugucuuaaccacuuagccaucucuccagcccugggcuuuauuuuguuuuccuaguacauuccugcaaugcacucgggucaaugugccuccccuagguguuacagcugucuacagggaacauucaaauucccucauuagaucugcagaaguaacaacagcugagcacccaucaagcacgugggaguccucaguuugauguccaggagugauauggggacuggaugcagaggagcaugucuggcaggaagaucaugaguucaaggccacaggaaaccccuucagggcacuguguaucuguguggcuauuaccagaagggggagccaagaaaagaccugcaguaugagucacugcucccauguggauucugcccugauucuaaagcaaucuucucccaccuuucuuggaauuucuaaauuauuaaacuaugccuugccugauuugauuagacaacauuaucaccaucuuuggauggccauccuuaauccugguuaagaacaacuucugcauaaaaauguucaaggcagucagucuuccagaaaaauaacuucuauggacucuccuuguauuauucacagcuaaguguagccaugccucaacugccaagucuggggccucacauaggaugugacaccuuagagacaauccagaguaaauccaccuugucguaaauccagcauuugagucucugaaggacacaccuagggaauccagagagggcuucuucuaccucucccuacacuccaacacuagcaccacuguucacaagccaguaugugggggcaguguccacuccaggcugugucacucaccuuccuggcaguuuggguccacccaggacagugccacacagcuucuucagauagcuuaugucaacauuguagaaguugcguccagccugaaagagagucacaccaggacagucaccuaccuaccacaggguuucccaugaugggaugaguggaucagggguucuguccaauucagggagcuagggaacaggcagagggauucagggucagagcucagcucucagaccacagugucuucucuaaucuccuuucaguuguuagcuggacaccugccccagaucuggaggaaaugacggcaggaaguaguuuggaauuuccucaucucccauaggaguuuucccaggguccaacucgcuccaaagcucacuuaucccccccauacgccuccauguacaaggauucacaugugugugcacucccaugcacacaacauggagacuggagagcaauccaugguguggucuaugagcuucaacuugcagaaaagaaugccuuacagcccguuagucaccucagaggcagugugcacaagggaccugcaaagacagacacacagacagaccggaaaaagcagcguggccuaccugccauguuguauucuguuuguugauauaguuaaucaggucauccgacagcggguggaaggaaggcuugucaugggcacuggucagugccagcaggcaagaaagaaggaucaaggaccaccacauccuggaugcuggauccugcacucaccuagaaaggacacaggcaacaucaaaaugauuucuacacacgggcaugacucgggccucuugcagccuuucuggccucacugugaagccugguuggaugggagcagauaucacacacaacaauauauguauguccccuccuggcuauuuuuaaauugaugaacuaaguuuaagagauucucuccaguguucuagaagaagagucagcguuaagguggauguaguauaaacucuguacugggaauucuaagguauuaagacagaguucagccugggccauguagcuacagccugccucaacaaaacaaaacaacacaaaaaaagauuauauguguguauggggggagggggugugacugggagggggaacagugagccagauguaaaguaaauaagugaaaaaauaaaagucauuaaauuuaaaaaacaaaacaaaaauacccaaaaccaucaaacagugugaguccuaaggagagucaauccauaaggaaacuaaaaagccugguuuacaagucccucacuuaaagacacguaaagggccauguuaaauuccuucuguucgccuguacgugugacugugugcagguuggaggacaagcucuaucuaggagcugccucuuuccuuucauuucaggcuuaagccaucuccccagcugggcuggugucaguugcugguaacuaaggaaccacacuggcuaugccagggacaccaggcucccagaagccccucugguuuuuccugucgcucaagggcuuugcuuccagcuccagagaaagaaaacuauuacaucaauaccuuagcccuuagaccuugugaacugacucaagaaucaggagaccagucauuuccagcucgaccugugagucacccucuugagcaaguagcuaauuaagagcaggccuuuccuggaugcugacaugugguuugagucuggugggagcaacaguagauguggguaggcugggacccugcccugacuccagggcuuacagagugaaugugcuacaucagggucaaaggucaaaaggacaccagaacacagacuuacucuuucugggugcuggaucacagacaggaaauuguauugaaagaaaacuaaaaauucuugauuaaguucaagcagcagaguuguguccccaaagagucagaacaauagucugguguaugugguagguacacaggagggagucugaacaacaacucaucuguaagaauaaauguguauggacagaaagaauauucuggagaagauccaaaggaggccgccuuccagaacaaucccacaauauauuauaaaaugccuggugacagugccucaggaaaguucuauuuaaaaaaagucaggccacucaaaacucacuugggugugagaagagugugugugggcuagggaaagaggaagugacacacuccuccaguugugcuuacacagcugguugccuguccugggaaaacaaggaggggcuaacucuguacaccuggcuccccaaaacaagagugcuacacagaaggcagacagaccugagaaacaugcaagucugggcucccuguggggcaugcuuguaaccuuagggcucaggaggauggagccuggggggcaaggguccauggcuagccuuggcuacacugugauacacagaaugaaacaagcaaaaagucccaaaggaaacugacucccuagaaagccuaaagcuggcauaaaacauaacccuuuaggcaucacauuaaaauuaagucucugccagcgagguggcucugcagguaaaggugcuggcugucgagccaaaugacccaaguuugauccucugcuugauaaaggagaaaacugacucuuacaguggccuagguauaugggaaaaaacaaagccagagcuuccauuaaaaggcgccgugucuucuauaacacaagacuuggagagcagagcacuuggggcugaaaugcaucugaaaucgugggcuuagcauaccugagacucugguugccaccccagcaccacacacucucacaucagaaacacaggaagaccacagugggaaaauggauacaacgacuuguaauacauuaacagugggaaaugggcggccacacauagacuauguaaaccuucaaauauacauguucuuguauuucaaaguauucucucuccucuccuugccccauugcucuaagauugggccuuggguauagccccaacuggccuggaacuugcugcauagaccaagccaaccuugaacuuacagugacuuucagguuucugccuuuugaaaggcuguaacugccaagugcaccccagcacaccuaccaaagaauccacugugugaccaagaaucacagccucgcagaacaagaccuuugaaaauggcccuugaauggguuacccaccaucuaucuccugccaccaauauaaagcuuccucucccccgggguuccuauccagcacacuuacugcugcguuuccagugacucauggucacaugaccaugugucagccaucacauggccuccaaucauacaguuugguaauugugucuccuuucuucuuuuuagcagcacucugugccuuggacugggucuuaucuuuuguguugugugccagcaaguacaauauaugcguguaccucuggagaccaggacaaccacgggugguggggcucagguguaacccagcuuauuuccaaacaaggccuggaccuuaucaaacagccagagcuggcuacccagugagccugccucugcuuccccagugcuggaacuacaaagugugcaccaacaugccuggcuuuuugccaugggcucugggaaucaaacucagauccuuauacaaacucuuguucagcuaagccauuuccuauguccagaaacugauuccuccaagacacugaugcagaaacccuggaguauccacucccuagggugggcaucuagaugaaggaaggggcugauaagucuguuaggaucuccuauguugaaggacgaaaaccuuuggguucacaacauacauauguaauguuaugucauacauaacauuauguuagagaauaagagugcccugagaugccccauagagacuuggcaucugcugagcuguuaaauauaagcuggguagaaagguucguuuccauggaaacuugaaauuuuaaacaaguuaaacaaauuuuaaauuuuaaacaagaugucuuugguuucugccauggcaaagagcacaugcacucccacggccaucgccacaaggguucccagguucuguagccuacagacccuggccacugccgcugcagacacaggagcagacccuggccacugccgcugcagacacaggagaagcugggucuccauugguucugcagccuaccccugacccaaugucuaacccugcucauaccaagaugaacccuggggugggggaagacuucaccccuaaauaccuagauuccccacuccuccuuaagagguuggggugagggguagaaucaaaagggauucacuuggccgccagccaccaaggcugcaagaggaggccaggcuccacuggagacuggauaccaacauccagaucuugguuugucccugucauccauggucacugcccuucucugaggcucagauccugcacuucugaggcgguaaugagcagcaggucuccaggugaugugaggagaagaggaggguagggaaacccugcaucaguggacacagaaagaaauugcugcuagcuaaagaaggcucaucccuucuucccccugaacuccugucuuucagcuugugauggcuaacucgaguuugauccaaacccacucucaaagccuccacuuggcaggacucugaguuaaaacaagcuucuacccucaguaaaauccacaagcauugucaaaaggcuugaguccugagacaggaguguaugaagccugcugucucuauccaggacaccgguagccagucuucuuagacaucacacacacaagcacuuuggugacacagccaauagugacaaugacaagcuaagcuguccauaaacuugucaaccugucacggguuccaucccuuugccuuaaauagccaagggcuuucacuuccccuaguuuaauaagcacuuccuuguauuucccaauucugugauuuucacuuuaguuaacagaaagucuuuauuucacaaaagaggggggccggaacacacaaguacacccagagccaaccagccuccccuuccagguguacaaguagagggcaguuguugcgggcaccauuuauuucuagcucaagucagcugguccuggguuccacuacccucuuccguuucaaaccuuuguagcaaucagugucucagaguccugcuauuacugucacugucacaugaacagaauggccagugaguggacuggcgaucccaucaacagcaaaaccauuucccaaacuagcuggauguccuuccucagacaaacacacuccugggacucuagaagaaaauggcagacauccaaagggaagaugaggccagggugaaggaagcauaacguaaugaacacaccaaacaugggggggccgggggggccacccacaagccugaccuuagaaagcuuuccugaguagucacacagucucagacuagagucuaagucuacauucuaaaugcuguaaggagacagaauguguagacugaacgugccacaggccaccugccacguccuggcacaggauaagugcgcgcgcacacacacacacacacacacacacacacacacacacacacagcagucuucauccaucucucccugacugcgguacauggggcggaccucucacacaccagcucuaacugugcagccacgacuguggcuguccaucacagaugugcugagggacucuacccuagggaggugggaagaggauggggagacuggcuggggccuugauguuacacuuuaugagcgucucuuccauaaaaacaaacuugucuaggcucugccugucauuacgggcaccugcuccucaagcauuacccacuccaguccaaccacaggacaggacagugggaacuguauuuccuuuggacugguuugcccaguugcccccaaugcugggguaacuauaguggaagcagacacgcuaauuucaaaggugugcagagcugaccugaaggaggccagagacucccccuuuugccaagucugaaucauagcccagauguggguuuccagauuguacauccuuguuccuaguaaaaacuguaugauugauucauggugauccuaaagaacaaacagcuuggggcugcccacagcuacucucugucuacccacggcacaucuggggcugcccacagguacuaccugucuacccacggcacaucuggagaagcuagagaugcaauucaagggcagggcacuuaccugcucaauugagaaaaugccuccauaagaucagacugugggcaggacuauauggcauuuucuuaacuagugauuaauggggaaggacccagcccauuaugcauggggccccuuggguuggugguccuagguucuauaagaaagcaggcugagcaccccaucaccuaugcaucaguuccuuccuucaggauccugcccuguuugaguucccuuccugacuucuuucaaugaugaacuacaauguagaaguauaauucaaauaaacucuucuuucccuaacuugcuuuuggucaugguguuucaccauagcaauaguaacccuaacuaggauaggcccucauuuaagaggaaacacauuuaauuguuuguagagaucaagacaauuugacuaagaccugcagagaugcuuccgagaugcaggggguagucuagucccaaagucugcuccuaaaauauauaagaguacaaggcuuuuaaagaccuugagauguaaaaugagauuagugauuuaugcuucucugcuugcuuccuaauucgauugcaggcuaaauuaagcuccaggcuggucagccagaggacaaggcagacaacagaaacauuuuguuugugaacuggguaccuucuucuuucuuggggcccucucaaggcucacagaaaugacaagcagagcuacucuuugggaaagugccucccuguuccaggcuugggacagccaccagcaggcagagccaccagguacaaccuccggucacgguuaacugacuauauaguucucuaugugcacagcagucaacauuuauuaucccugaguaauuaucuuugucuuagaaaguaucccaguuugagaccaaggauauacuucagauggcaugccugacuagcauccuggguucaguccccagcaucacauuaaaccagacacaguaagugguauaugcuauaacacaccucauggagaggcaggauagaguucaaugccauccuuggcuacacugugaauuugaggccaggcugaaauauaagacugugucucaaaacauauccucuccagguauccuacuugguauaaagaauuaugacuaucauacuauuugaaauaaagccuuguauguggauucuacuauuugauaucaaaacacagcauagccccaaacccagagggaucaugcugagaaugagugccaggcuacuugaauucugauaugguuuuauauaccuuugacuggcacaagcuggccagcaccuuaugcaaguuggaaagacaugugaucccugugggugagcaucacucaccugggccagaucagcaggucagagagucaggagguuagagggcagccaccucugaucugagagcagaguaucuaagaguucuguggugcucuguggauacuaacuuagcauuuaucaaccuuauucucuuccacccugccagcuagagaaagaagagcaguaucuuggccagguacuaacccaauuaaaacagguuaacaguugagaucacagaccauagguccuucccagcacucagcuuuuauaaaacacugguucuggaaagagcccuccagucuuguagaagaauucuuucuauuucacaggcgagggaaacugaggcaugagacaagaccauggguaggcccugaggaucagucaccuccaggagauugaauucuaggucacauuccaucacaguuaccuaagugacuaugaccaagucacagacuugcaggugacuucacuuucucauaaagucucccaaugucacaaaccuccugaauuuuaaaaaugagaaaguagggcuugcaggagauggcccagugaggaaggcauugcugugcagucauuucccaguagggaaaugcugagaggacuugguggccugcauugggaaucccaggauuugggagucagacaaagggguuccagaggcaagcuggccagccagaccaaccaaaugcauaagcucugggcauaaguggccuggccucucgaagcagagauugauugugaaagacgcccauagaccccugguacacacaaaacacacauacacacaaaaauauuuagaaacuacauccaacuacaccuaaacuuagauacccaggcuuaggaccuaaagaacccaauaguuguagauguguggugguauacauguuuuaagcucagcacuuaaaaggcacucaggcaggagagaucuugaguucuccuuggcuacauaucaaguuugaaaccaaccugggcuauaugagauccugucucaauaaccaaaucccaaaccuaaacccaaacuuguuuuuugguucuuguuuuguuuuguuuuugagacaggaucacgauguagcccuggcuaaccuaggauucauuagacagaccaagcuggccuugaacucagagugcugggauuaacuuguucacuacccugcuaaacuaaacccuaacauuaaaaaaaaaaaaaaaaaaaaaaaaggguggugguggcacacaccuucaaucccagcacucaggcggcaaaggcgggugaaucucugugagcucaaggccagccugguuuacauagcccugucucaaauaaaugaagaaaaagaagacuaauaaacuaagcucgcuggccugacagggugcacaccuguaaucucagcacuugggaagugggcaggaagaucaggaguucaaagccauccucuccuauguggugaguuagcugggauacaugaagccccugucacacugccaccuguccccaacaaauuaaaauaacuguuaaaucuacagguaucagucaacaccaacaaaucuuaucaacugagugaacaauaagugaacacacuauaaguuacauaaaccaauacuuagacaugguaucucaagugcagaaguaggaaagaauaaggaaagcaacagcugucaaagucccugugacagacaaagcaaguccuggagccaaaccgaccccaaccaagcaagacccaccaaagaggagccacccacuucuaccccaaaccugagccuggaaggccucaggucugcaggaagggggguucaggcuugaagguaaaaaugaaaggauugcuaggugguggcccacgguuuuaaucccaguuaaucccagcacgggggaggcagaggcagauuuaucucugaguuuguguaccccaucaugccccggccauccuggucuacauagccaguuaguuccaggcuagccacaacuacuacacaccccuguucucaaaauaaauaaauaaacaaauaaauaaauaaauaaauaaauaaaauaaaauaaaaauauggccuaacccaggagcauuagcuauuguuuguaacccuagcauucaggagguugaggcaaaacuguccuacaguaggguaaaaccugccucaaaaaacugagagggcuagcggagggaggagacugguuaaagcuggcuggguaugauagaguggcagacugcaugauuaggaugcacgaggcucuggguuggauaucagugcgagggaggcagaacuccaccccuagaacuuccaccauguucagugcuggguggaaaauaagcaacaaaaggacuccagauugauccuucucccacccuuccguaggcagcuccugcagaguaccagagcagggauauguuaacuaagcaaaggcaauagagaccuuuguacaccucaccuuaccuagaggccccaccacaacccuucacaccaaucauacucaaguuccugguuucccuuuugauuuucaaaaguucuacugcauagaguuccaccucacacauagcuaauauuuuccuuacaucaguacaucaaaagucaguggccaaccggagacuccuauaucuaaagguuucuacccauaccauaaaagggccguagccuagaaugcugagccagcaccuccagggaacaguuucaaccuggagccaagagcgccaacccuccacugccugacuagucugaaaacauuuaggccaacgucaaggggaaugcuggaaaucucugcuggcaccugggcuggugaagcacaggcgugggcccggcucgccccaccccacuagcagucccguaggccugggucacguggcuuuaaaggagcagaggucauuuuccuccaccuucuuuuaagcaugaguuuuuuuuuuuuuuaaggaaggaaggagggauuaagaaaugaaaccguuucccucuguagucccacuguuguggaauccauuacauagcccaggcugguuuccaaugcacagcgauucuccugccucagccuuccaagugccgugauugccuugcucugguauggcucuggggacucuggaguuuuaggucaccauggccagagccuaugggaaacaacuguccccugaacggcuucgaacaaagaugacaccuucaccaacauuuugcaaaugcuacucugaauccggggacugcagaccauaccuccacagcagucccucacaggaagcaccuggagaucagucuucccgagacacuaaaaggaguuaaacuucccuuucaaucccacaauuuaucucccuucccaaacacgugaggggaucugguuagguggagguaaggugcggauggguuuuaguccuuuacucuugggcccuaggggaccaaguccaauuuaccuaucucuugguccgcacgcccagcacucugggagaggaugcuaucucucccggcuagcagggcccugacugaaggaggcuguccugcaaguaccuuuccuccaucacauuggccauuccccuccagagaaagguucugggagagccccuauccuuuagcucugcuucucuuccuguuucucgguuuaacucuucgugcagguuccaccccagccacccacuaccagguucccauucucaauagaacaggucuuuuagggugccaggcacugcguggguuuguguguggaaaaguucccggggcagauucuuuagaauaagccacaaaccugcacuagaugcaggucgauacucgcccugagcaccccugagacuugcaaucugcgagcuggaagggccagagcugaacccuucccuuuaagcuccucccucggagcuccccgaaguccccaccuccgcccuugaagugcgccaaggccacuggaaagaagccgaucaccgcggggucaccaggcucggcccuaaagcgugaaagcuggagcucugccggucuagccugcgggagccuaagaccgcgauccgccagggcgagcagcaucuagggccgcggaggaaccgcgccugcgcccugggcaagugaagggccugucuccaccaccgcugcucagcccgcucccccgaccccagccaaagugacuuccgccauggagccacugugccccgggcaaacucaccgagcgcagcgcgacagccugggccugcagccaccaagccaaacggagccgcuccuggccucucccgugcacuccuaaguacccgcgcagcuccgcccuccgcugggggcugauucgucacgugaugcuugaccgcgcccccgccccugccggccccucccccuucaucccgggacucugcaagcuguguuaaacccaaaagaaacuggugguuugucugcucucuuuccauu

SEQ ID NO: 7522 - RNA, 34510 nt, Mus musculus
gaacugaugggaccaagucugacuuuccagcuguuucuaauaaacugauauuuugaauggaaauuagaaucaaagacugagugguuagguaauccuucacuccucacagaucuucaagauggaagucuaagaguaagacauauucaguugucucugcccuggaauacaccuucuagaacacugugacuucacuguguguggugguggugguggugguggggcuuuuuugauauuuucuucuuguaguuaaggacaccaauuccauuggaauuaauuuuaaggccugcccuuguggccuuguuuauauauaaucccuaugaaauucccaucucuaaaauuccccauuuuagacuaaagcuccaacacagaaguuuucuauagaaggacucaagcauugaggaccaaacuggcacauuuuaauaauuuuaauauguuuuuacuagcauauucaccauauauaacaaugggcuguauuaugacauuuuauaacguauauaauauauucugaucauauucaaccccuauuauucucucgucuucccgcccccacucuucuugaacuugucuuuaaaacuagucauuuuucuucuugaucugucaguagguuuaauuaggguuacuaacagaaguaugggcaacuuacuagcagacauaccacuuaaaaucuuugucuaucuuuaggugauacaaaggcaccaccgaacuugaugaccugaguucuaucuccaggagucaaauggaagaagagaaaugacuuccacacaugguaugugugugauaacacuuaugcucacaucaaaauauaauaaaaagguguaaguagaaaugaaggcuaauuggaacaguaagaauuaugacuguaaaggggaauguaauaaaaauacauuauauaaguguaugaagacuucauaauaaaacuuauguaucauuuaugcuaguaacuuuuuaagucauuccaccagcaaccaucaacuaccaauagaacugggagggagcccuuccucgcuccuugcaauccuuaacuggggagagcaggagguauuuguucccaucacaucccugggaggcccaaucucgggcagauuuugcaagcacuacauaaguccugguucacgucaacuagaacaucgagagguauuaagagcucaguucccuuuguuuuugcagcuuugaaaaugggauccaagaaucaucgccaugucgucucacaaaagacggguggagaagucugagaaauacugugcgcugucccgcuuggaguuucccggggcucagcaaagccccgguaaacucgagccccuguaaacuccucggaggaaagcaagacuguuuuaucuguucucaagccgcgaggcgcguuuccagucccugcuacccuuucacucugacucggcuuugccagccaaccccuuagguauaucaagaggugaacucagacuggaggccgaggucccuaggaucgugcaaagcucucaagccuuucgcggaacuccagaacguccacgcaugcgccucgcucgcugccagccuacgacacgcaggaacaaaggcucucugcuggguaccaaucguguucgcuggcugcuuuccagcucuccaaucaaauucuaggguguggucaucgcgccaggcuccuccggcuuccgauugguuaacguuuuccuggugcgagcagcucuggccaaucaacguccgucaguccacuccgcgcguccuagccuggaggcgcgagcggcgcggccgguugaggagggcgggaggugggcgggacguccggcgcuggccccgccuccucgcccugcccacuccccggcgucuaaacacaggugggagcgggagaucccgacaggugagccccgcgcccagcagucgcaaggauggaguucgucaagugucuaggccacccggaggaguucuauaaccugcugcgauuccgcaugggaggccggcggaauuuuauacccaagauggaccagguaagucgagcaucccugcucccucgcaggccuguggcggcuucccgcacaagaggucucuagaggauggauggucucugacacccuggucuucacggaaggcgggaucccugccugggucgcgcacccccacuagggccauguccccccccccccccccccgccuuucaagguuucugucuguucaagccauugcuuuucuugguaguuuggcugcguauuuuguucuucuaagcuuggaguuauuuuuaccuaaaugggugcguuccagaauugagauuaaagagaacacgguugagaacaauuuugagaacauaaggaacccuggaggaguuaucgugccuauuuucacuggaaugaaacuuacuucgccccacccacuccuuccaguuuucagacaucaccucccgcauaagcuuacucaccuuucugcagccacuauuuuauuccugggugcuuccuacgguuuuuguuguguccaaguuccuacuaguuauuggcugccagaggccagaacauguuuguuuuuuugguuuuuuucguauuucauuggucuguucccuuucuuaaacgcgugcuuuuaugauaauacuuacucugacaaaaguauguaacuguugcaugaugacacauccaguuaacaucaaaaacuuaaacguuuccccuucacuggaaacaucaggcacuguauuuuauuuaaagguauucuuaauuggugcccuugcuuuucucauucagaauccucccuuuuuuaagauuuagcucuaacaagugcucucagccauucagcagacccuggacaccugucagugaugggcacucugugggguaaaacauggauagcaguguaauuaagggcauagacaggguccacaaggaaaugaacgccaagaguagguuucaggggagaagaagguacaguugccagauucuugcacggauaaguaaucagagcaagagcaagaaucugcuuuauaauccaacuugagcuccugacagcuccagugacagguaguucauucugaccugcaaggucuccuuaccugccuucucuagcacccuuuaacuuagacccgugaucccagagccacuuucagaugcaagauucuuuauuucagucucgcaacaacuucaggguucucuuaacucgguucugaauuuuauuuuuucaagacagggucucacuguguaagcccuggcugucuuggaacucacuuuguagaucaggccagccuugugacucagagauccacuugccucugauccccaucucagccuccuggcaaaucugaauuagaagcggcuugaaaauaaucuuuucuucauguacaggccuuuacugccuugagcaaaguagcuugucagaaauguguggggguuggggauuuagcucagugguagagcgcuugcuaggcaagugcaaggcccuggguuugguccucagcucugcgggggugggggggggagacaaaauaacaaaaagacaaaaaacaaacaaacaaacaaacacccaagguaacugguacacagagcggggcaugguggcacacgccuuuaaucccagcacuugggaggcagaggcagguggauuucugaguucaaggccagccuggucuacagaguuugaguuccaggacagccaaggcuacacagagaaacccugucucagaaaaauaaaaacaaaacagaaaugugugaagaugaauuagugaacagacugcuuuggggaagcuuguauguagccuucuaaggcagguaggugccuuugccugaguauagcagaauagugacuuuuccuaaggggauuuacaagaguaggagggaaaaucacugcuaguuaggaugcaaguuuaaccuuuguaggguugccugaaggaaauagagcuuucaaaugccucuguggcuuuugugcauaaauacuugcuuggcucaguauuaguaagauuucuuuugagugcugacaugaugccguagguggacacuuccacaccacacuugaccuuguacauguauuugacaugucguuuucaauauguuaaaaagcauuguagaaaauucccugucagcuguguguauaaggcauaugugaaacacaaacaauugcauguuuggacaugggucccacugccaagauaucucauugcucauuuacaaaucuuaagaaaucuaaauacuucuauccuggagaagauguacauuugagcuuuuacggggugaacccaagauaaagaauuucugcuuacagucuagguuguaagucuuggucaggagaccaagugacaccugacaccuggugauggcaguucaccaccucuggggagguauucgcugucuucucucgguccaugaugcucagguuuuaggaugcuuuggacugaauguccacccuuuccuuccucuuuuagagccaaggggagauuuagucuuuguuuuggaguacagacccugaaguauuaagacagcucucagucuuucagaaugcugaugaaagagccuggcguagcgccacacacgcuuuuaaucccagcauaaggagaggagaggaagguggcucucugaaaguuuguggucagccuggucuacauauugaguuaagggcuagccauagauauguaaugagacccuguuuucaaacaacagaccaaaaaaaaaaaaaaaaaaaguauugcucugacgcugugccuuuucuuuugauuuuauuuuguauuuuuuugagacaggguuucucuguguagcccuggcuguccuggaacucacucuguagaccagacuggccucgaacucagaaaucugccugccucugccucccaagugcugggauuaaaggcgccugccuuugccuuccaagugcugggauuaaagaugugugccaccaccgcccggcuguaccuuuccuuugguuauuuuccugugguacucuuccaagccgugugccugcuccuccuuuuucuuuaaagguugguuucuguaauugcacaauacuuggcaauuuuagccugguuacuucagaaauuuacauuucuuauugaugucuuuauuucuaauucccauacuuuaagaugggcauuaacuuaaaacgcucuuugggcguuuugguuucuggaacucgauuugugauucagacuggcuuugaaugcugagccuccuggcugcugggauugcaggugugagccuccaagcccaauuaaaaugcauuuucauuacaaaauacuuuaugcagacaaguaucgaaaguuacauauaacaggccacugcaucaguaaucugucauauuuacuucauucucuucauauauauuuaagaaguuaaauauucauaaacaccuaaaacaguagacucccugcaucugacauuggccugccugccccauucucuuguucaccuggcuuuuucaggcugucuccucacacugugggcuuagaacuguggacaccugucugggaucuuuuucuccgucuuuaugucuugcugaaagccucuagaaacugggauugugugccuucccuuagcuaauguuuauuaguucuuggugugugccaagcacuauuuuacauaccucccaucuguuauguaaacacccaguaacccuuugaggaucuguuuuccuguuuuguagcuagggcuuagagguuagugaguuacuuaacaucccauagcuaugguguggcgcccuggaauuugacucucacaaucugacuacagagcuuguucagucuaucuuuuuuaaaaagauucaauuuuuuaaaauuuuuuuaaaaaauuuucuaaguguguuauguguuacaguugucugugaguuuguggcagugagugcaguaccuuguugaggccagaagaggccaucagaugccccuggagcuggaguuauaggugauugugaacugcagacgcugggaacugaacuccaguccucaguaagagcaguacuugcucuuaagcacugagccaucuccccggccccuccugagcucucuaucccaguaugcuguccauccuuaagguagugagccacagaaguacauuaagcaggcuguccaagcgagcuaagagggggacacaucuaggccuggugcacacaaaugccuguccuaacuaggacuaccaaacauccugacuggcacgguggcacagcagguaaagacacugccaacaagcuugacaaccugaguuuaauucccaggacccacgugguucuacauagcuguggcacauacuacccucuauaaaaaauaaauacauaaaaagucauauauuuuacauauauguauauguguguguguguguauauauauauauauauauauuuuuuuuuucaaacugagugugguagcacaggccauuaaucccagcacuugggcggcagaggcagguggaucucuauuaguucuaggcugugaguuccaggccagaugcugucuuauagcuguuuauuaucuaaguguaucacuuagaguuuuuaaauuaaauuuuuuagaaaauguauuauugugucuguguaugccacuacacacaugccacugcacacacgcgacaguccuaggacagauuugugcaguuuguucucuccaccaucuuuauguagguuccaggaguugaacucgggucaccagucauguuuagccagugucuuaagcugcugcggcaccugacuaagcuucccccuuagcuuuuacugaggacaaacugucgaaagcuucgggcugcacuuacggaguuugguuguaugugcugcuuccuaauacgugugagcugccaaacaauggccaagcggugcaguaguauauuuuauccuacuuuuaggaagccagaguuagugguuuaagguauaacuguuagcuuaguucacaguugucugggacagcuggggcuucugaucugggacagcuggaccuauuucuccguggccugcucagcccgcaggcagcuuguagcuaaugaagggaugguuagagcagguuauagccagaaccggggagagacacucaucaggcuuguccugggacucauagacagugggagggagcaacucuauguacacacuuuucagacuucugcaugagucacaucuguuacuguccaauuggaccccagauuuuuaccaggggagccagguaugagggaggagagaaagccgccuuccugaugagaagucauaaaauuuuguggccauguuuacagcuuacuauacuuuaucacucuuaguaaucugaugggacaaguauuuuugcugucgcuuaugugaauuacaagucugguuuuccucacaacucuuggauaugcuuccgggaugcccagucaggccuggccaccucuguacauuuguuacaucuacaagauguaacauuuucaaaaauuaaauugaaauaacuucuauuaaaaauucgcaugcuuuuuagcuuggagguuguuuggcucagaaagcucagguauugcaugaacccugcuagcaggcccaaacuggcuuuugucaaacuuguguucuauugggagagaaaggcaagacaaguacacagacuuacagacagaagucagcagucagaagaggcuggaguggcgagguuaggggaaggcagacuuuuaggguugugaucuagagcuggggacuguucaccgcuguccucuauaaaagaggacauuggcccgacgagacccuuggagacugaaggcuuugguuuccucuuugaaggggaguggguggccgugauaaggggcagagaaagugaggcuugggcuauuucuucucccugggggauuugauaauccaguguuugcugagcacuugccagcccccgugaggcccccacccccagucuugagaacugaacccaaggccucaugcaugcuagccacgugccaugaaguacgguaccugcuguuccagaggaggcucuugugagcccagggguuuaagagcagccuagaugcaugacaaaacuucagcuaaacaagcaaucaagaguagucucaaguaccucuaauuaguggaaacaaacuggaaaauucauuucccuucauuuaauauuuaaauaacaacaauaauaauaaaaaggaaaccgagagauauguacccugaacuuuguggguuuucaagacaggguuucucuguguggcccuggcuguccuggaacucacucuguagaccaggcuggccucgaacucagaaauccgccugccccugccucccaagugcugggauuaaaggcgugcgccgccaagcccagcaagagcugauuauuuuuguaacaaaaaauaaauauggguuuaggccagguaugguagugcaaggcuuuuuuuuuuuuuuuuuuuuuuuuuuuuuuuuugauguaaaaacaugagguaguuuuaauggcagagcuccgucugggucgaaauguaucucaugcaggagacaguggauucgaccacgaggcuuggaagcuagggguuuuuauagaaaaggggcuggggcuggggcugggggaggaauuggugaaguuucacaugauugguucauuuacacaucagcagacuguacaugcagauaacauuuaacuuaggucagaagggugggagauagggaggcgccgggcuagucuggacaugucauucuccuuucuguaccaccugcaagucuuuuaacuuagcauacagauuauuauuacaacaacauguagguuuaaacacaucauuuaagacagugaugggcaugggagccccauaaaggaucuuaaagaguaaggcugaaucaaaagggaguauuucuaguucuaaauagggcaaggggaaggagcaccaagucugcaccagucucuuuuagaauucuauucaucuuuuuuaccuguccuuagcuuuggagccuguaugcacaauguaauuucuaaucaauccccaauaucuuggccagucccugauuuaccugggcaacaaaggcagguccauuauugcccugauuaccuuggguaucucaaaccucgggaagauuucuucuaggauccucuuggcuaucacauuggccgucucaguccuucaaccgcaaggcuacugccauccguguaccagcucgaacucucaggccaaggcugaucugauccuuuagaucauuucgaguaccaguuucuucugccagaaugucagcacaaugaugaguaggugaagucucgggcaguaggguagugggagugaggacagcaggagugaaagucacucguucaaucauccaucggucagggggcugucggauaaugcuuuuaagagcguggggugccacuacaguuauuugcugucccagagugagcuuaucagcauccuugacaagcagaguuauggcagcaauagcuuucaggcaagaaaaccacaggguguaacuucuuggauagguaagccacuggccuuuuuuuuuuuuuaaagauuuuuauuuauuauuauauguaaguacacuguagcugucuucagacacuccagaagagggcgucagaucuuguuacagaugguugugagccaccaugugguugcugggauuugaauucuggaccuuuggaaaagcagucgggugcucuuacccacugagccaucucaccagcccagccacuggccuuuuuuaaggucccaaagucugagcaaggacuccucuggcgaccccugcucucucuuccacauaaagagugaagggcuugguugggucaggcaaagaccaagacuggccgucaguagggccuuuuuaauuucuucaaaggcuuucuggugaucugggguccacacaaacaccuucccuuccuugguuaggggguacaacagggcagcuaaggucaccaacccagguaucuagagucuguagaagccagaggugcccaagaauucuuuuacuugccuugguguaguuggguuggggaucugaguuacagucuuuuuucuggcuuucuuuagccacugcuucccaucucgaaggguauaucccaaauaaguaacuucagucugacacagcugagccucuuuagcugaggcucggucuucaguugcccagguuuccugucuagauccugucuuuucuuucucuccuaccacuguggccaaguuucuagucaaauuucuuucuugucuacgaucccuccggcuuucucuuuauucugccucuugccccccccccucucucuucucuuguaauacgccuucucugccucuuacucguucuacucuaaauauuucucauucgggguaucaucucggaccucucuaaucucuuucaucucuacuuucacugucaucuaucucuccugagucugcugaagcuuugcucuuccuuacagucuaagcucaccuuuuucuggaccucuauacacauuugucagagccuggugauuauacucguaggugcuccuuaccugggacagaaguuuuaagugggcagaugucucccucgcugguuagcagcuuagggcggggcugcccuagaagagaaaacacguggggcagggaagggaaggcagcucucacagcugccaacuggggggggggaggcgacagaggacgccagugucuccccccccaaccccccacggucucacauagugccgcgccagugcacacccggcggaaguucucaguccggcccugcggcugcaugcggccagggaugugcgcugaguuguuuuucuuaacuaucacugacaaauucuguccuaacaucagucuaaguccagucagaaacgaaggguugacacacacacacagucugucccaugacgaaaaccacaacagaacaagacaguaacugagaaaaacaaacacacaaacaaacaaacaaaaacaccaguaucuaagcacacucguuccuugaacccacagucucagaacuguaaaaccaagacaugaggugggacucgaauccacgaucucagaacuguaaaaccaagacaugagguaggacuugaacccacgaucuuggaaccauaaaaccaaggcacugaggugggacucgaacccacgaucucagaaccguaaaagcaaggcacgaggugggacuugaacccacaaucucacaacuguaaaaccaagacacaaauccacaaucucagaacagaaaaaccaagacacaaauucgcaaucucagaacugaaaaaccaaggcauaaauucagcagugccauacuuagacaacagacaacauguaagaugcacacaaacaaacguaccuccaaggagucuuuugggguuccugggugucauguaggucuugguagaaccuccaaaugaaagaaccuaguggggaaauccccacucauuucccgauccagcgugcacccaagaaucaugaacagaugaccaaaaacacgagguaguuuaauggcggagcuccggguugaaacguaucucacgcaggagacagugguuucgaccuagugcaaggcuuuuaaucuuugaacaggcaggcagauauuugacuaggcagugagacuuuuuuuuuuaaaguucaaauaguuugucuuuuacugagcguauuagcacaucucagugcauugccccucaugcaaguuguguggcauuacucaggucaccaaauggaagaagccgaccuuuucugaggagaucugacuugugucaguacugacucuuacuacuuagcuaugcauguucuggucagcaacuuaguaucuguguuucuugaucaucuguaagauaguacagagcuacggggccuuagucaaaaccugccagcuccaggcugggaaugaaagggguuuuguuucuuuuuguugguuuccuuuaugcuagaaggccuuggaguuuagccuagaucgcuucucuaacuucuucaucuuucaccucagcuucccaaguauugguagcuaacugaacauuauuuggcagcagagccugauuugauugagagcgaggcuucauuugccucauuugguuuauauauucauucggcuguguugcuuaagaauaguugcuaaggaauccugggguccuaauccaggcuugugguuuuuguuuucuaaaacacuaaaaaguaugaucccugcucccugugugacagcauggacuguagccuguauaccauccuuaaacauuuagaaaagguuaaagguaauguuuguguuguguuuggcaugcagugccuaauacguuaauaguuauuaacguuaaccuucucaauguccaagucugagguucauggguucugagguucugaguuacccaucuuaaacaaaccuggcuuauuaagaacaagggcaggacuggcagggguggaccugguagcugucagcuggagccuggagccccagucugggugggagucgucuguacccuugcccugaauucagcccuuugagcccuguugcccucacuggagaguuaaggguguguacauagcuucaggcagcagugaaaagcugggagacucuagggacaguagcugugacauacugggaguccccggccaugagaacuuuccacucagagagcaguccuguccucauuaggauucuucuuggucauucuagggaccuguuguuuaaggugacaugcugaaacagaaacgaaacagaagugcugcggacaagaccugcugcuugucuguuucggguguugggguggagagugcuccccuaagccuguucuucaaacccagggccauugucccuuugcauaccuugagagcagacgcuagaccagugggucccgaccuuccuaauguugugacccuuuaauacagcuccucauguugugcugacccccaaccauaacauuauuucgcuauuucauaacuguaauuuuucuacgguuaggaauuguaaauguaaaucucugcuuuuucaacgguguucagcaacuccugugaaagggucauugacucccaaaggggucaggacccauaaguugagaaaugcugcgaagcaauuuguggggcaugguaacagugagcuuugcaaagagcugcucaccuugggugugguagaucacagcuguaacuugagcagugaggaggcugagacaggagaauugccgugaguucuaggacugucugggcuacaagaggaagacugucucaaaagagaacagcuguucagcuuuuuuuccugugaaaucuugucuuuccacauuuuaaaggagauggugacuuuuaaauuaucuuugaauguauugcuuuaucucauugaaacucuacagguuguuaaugugcuagacugaauuuuacguauaugcugaucaguaaauaguaguuuucacuaauauauuuuauuagaaauggcaguaaaaugaaacugagaauuccuuuuuuuuuucuuuuaaaagaaagucuuacucuuuagacaaaagacuguguccauauuaggaaauguaggaaguccaaauaaaccagcucacaggacccucgggguccaagguccuguuaacauugcagcgcggcuguggauugccuacuagcagaaacaacucccucguuagauaauuguguucccugguccuugaaaugaguggagacaguguguaggaucgugcagggggcaggugggaacuguaccuucagcucaguuuuccugaacauaaaaguucuuacaaagcgcauacagucucaaaauaccaaaaaaaaggucucaaaacaaaacacacacacacacacacacacacacacacacacacacacacacaaacacagaaaggaguuuuguguugccguuuguaauaagacaccuuccaaaccugcuccuugcaaaguuuuccuuugcggagagcaguuuacugcacaucccugguggugugcuccugugaacagggauuguaaggcuuccagcaacaggaaaccuaaagggacuagggauggcagagcaguacagcaguagucaaaagccagauucucuucagucuagaacugagcucaguccucauuaugcacaagagcuggagauuaacaaaaagaagcuucagagggucaagggucagcgggguugguugugguugggcagugcaaagacagauugcugcguguguguccauauccagcacucagaagguagagguaaaaggguugcaucagcaaguucgaggcuagccagagcuacauaguaagauugaccacauacaaaaagcacuuagguuugcugacaggacccugauauagcugucucuugugaggcuaaugccagugccuggcaaauacagaaguggaugcucacagucaucuguuggauggagcacagggcccccaauggaggagcuagagaaaauacccaaagggcuaaagaggccugcagcccuauaggaggaacaauaauaugaacuaaccaguacccccagagcucaugucucuaguugcauauguagcaggagauggccuagucagccauccuugggaggagaggcccaugguaugccccaauacaggggaaugccagggccaggaagugggaguggguggguucgggagcaggguaggggguuggggggagguauuggggacuuucauuugaaauguaaaugaacaaaauauguaauaaaacaaacaaaaagcacucugguaaaaggagucaggacagauaguuuagucuaggaaagacugucacagggaggggaagccagcuucucagagcugcgccugggcacucuuuucuccccccacagcuugucgggacgugggacaggcuccagaguaaauauaagcugggguucgugcugcagggcguggccagaggcagcagggggcguggcccgggccugcacguguugcagagugaggcuuucucuacucugaccaggguuagcccuaucagaucccugcccugcggugggcgccuugcagcucaguggggccuauggaggaagggcucugugcugcgcucccauggcagccgccagcagcaccaaggccauggcccuggucaagcggaccuuggugcugagcccggucgccgcgcccaagacuccggggucacccccacggggcugcuccuggccccccaccgccuggccuuucaaggacuggucccgggcacggagcccggcugccagcugccugccccagccucacuccugcuccacgucugccaccgcggugugucuucucugcccacaggacucacucagcagcagcuugaagaccugcuacaaguaucucaaucagaccagucgcagcuuugccgcgguuauccaggcgcuggauggggacauacgguuaguggagagccugacucggggaggaccgcuuuuccaggaacuuuugagucacugcaguaccguugacacaccacuuagaauuaugggcuccuuguuguagcuuaggcaggacuaccucccccacaccucccccacuccgcccauguguuuacuugcaaaugcccuuccaggcaccuggccaucuaccagcacccuuuuaggccagcccuuucagagaaggggguggggcagccauguugauuuuaccuucuuuuaauccuggcaccugcaccugccugagagcaggccagacauuuuucuuggcauuugucugucaccuuacauuucaagcauacugagucuuaaaaaguuuagagcaguuacugugcccaccacagcauucgugcuggaaaguguuccaucugcaaaaauccuagugcccucuaaacauuugccucuuggccccugccaugcauugauaagguacaaagcauucuuagcugcguggcauccaccugcuuagguuuccauuuuacucuauaaauaagcgggagaguucauuacucccacuuaagacagaaaaacaaucauuaagugcuaaguaugacagacucugaugucacuucuaaucccuuaaaacaacuuuagagaaugaccugccaaaaauuacuaaguuaagucucacuuuauggucccagucauccugaacucaggaucuucccgccuuagccuccugaguugagaugacaggcaugaaguaccacccugguuuacaugcuauucagagguacauauuuaagaaacaggcugaugaaauggguuagcccacaaaagugcucacugccaagcccaacaacuugaguuuaggucuaagaacccacagguggaaagggaggucagauuuccugaagcuguccgucuucugaccucccacaugcgcuggggcacacucaugcucucucacacaccacacacauugauucucacacacacaaaauaaguagauguuaaaaaacaauaguagaugcuuggcguccuguuguagccuuuccgucuuuuuacaggcacgccauauguguguucuaccugguucuccgagcccuggauacaguggaggaugacaugagcaucaguguggagaagaagaucccacugcuguguaacuuccacacuuuccucuaugacccagaguggcgguucacugagagcaaggagaaggaccgacaagugcuggaggacuuccccacgguacugggcucucugggcauaggcugucgauaauugccagugcaguugucgguacugggcucugggcauaggcuguugauaauuggcagugcaguugucggccccugagcugagagaaaggugaugugaacacucugagggcagcugagaguccaaagccagacuuuuucugcuuggaauccuaacuugguaauugguggugaggcauauagccccuuccuaccucgguuucccucuguaugguagagacgauaacagcuccccaguucuggugguggugauacucugagggcagcauggcugugacccuugcuucaggcuguuauugagaagucccagguccauucuuacagaaggaucugaaauucacacuucaggucugaagaacuaucagaacauuaaaagacaaaaagguagaucuccagaccggaucacaugggccuggugacuguaguguagcccgcagugagggucgcugcucaauguagcucacagcuuugggcggggcgugggcuucuguagcagcugaggugagaucuuuggcccuuucuuaaauagguucugacucaguguuccaacuacuugaguuggauaauuucuuauguauaaaguucuuagcgcagugccuggugcgcgcuaaguauucuguagguaucagcucuugagauggagucuagguggagccccaagcuuuagggcccugaaguucaaggugcacguggaccucacuucuagaauuugcauguucagcaaagucacguguuugcugauacccuagagaggacauuuaucuugugcauaguguucuagaguguuggagaacaguuuuuauguaauuuuuacaauaaaggaauguagucuguacuucuguguaggagggaguugauugaagagaggggagcccagcaagguuugagaaagaugggcuguuuccaacuugcugagaucauguuuucaggguaaagacuaaaauauaguaugcugugcccugaaaguuccuaggacgucugcagguuacugaggacccugaggcucuagggcaggcacuggugcagugguguccuggggugccugauggccagcgaauucaguuacucugaggaccauacagaagcucacuggugagccuuugaguccuccgaauguagaugaagggcugggacccacuugguuaaguucuuaggaacagaaguggguuuuguuuuaguuguuuuucucuucagcacuaggugcgaaacccagggcccucugaucacuggguacucuguuacugcucuuuauccucagccugccuaguuuuuccuuuggagacaguuucucaguaauuugcccaagcugaccaugaacucacuuuauuuuaggcugcccuugaacuuauaacccuccuaccccaacuuccugaguaauuagauuugucuccaacaauacauuuuccuuuguuuuuuuguuuuuuguuuuuuuguuuuugaagcaggguuuuacuauguugcccuagcuggucuggagcugacaguguauagacuaggcuggucucgaacucauagagcucuaccugccucuguuucuccugaugcuggaauugaaggugugugcuaccaaacuacuuuucauguagggacauuauacccuuuaaagacuuucuggucaugggauaauuuuauuauauguaucauaaaaauucaagguagugucaucuacccaccagaaagaacacaaacauguaaaaaugcuagucauuugggggagcuagauaaauuucagauccccaucuaguaaguuuguaccgcccaccugccuuugccuguggcaauccagugggaagagaauacccugcuuuggaagguuucaaaggugggcagugaauugaucuugaucucuuccuguuugaccgagaguuuggaaguagugaaccgucccgggggagagaaagggagcuggagguacaggccagaugccgcuggguaaucguucauguccugaugagugggaagcauuguaaagucguguuuuguaccuggaugggagacccucuggcucuggggaucaucuuaacacaggaggacauggaaaaguguguucagagagguuguagaggaagacuggcucugggauagcucuaggaguaaagggucgcucagugcuacacacagagcugcaguaggaggggaaggggacuaagugugcugguuuggaacaaaacuguaagguaccaggcaucuuaaacucaaaccuagaggguccagguucuugcaaaauaugcuuguccauucuggguagauagaguguacuuuagaggacaauuuuauuagcgcucucgcuugcucacuaaauauugcauguacucuuguuugaacucuguuuauuugaugcacgucugugcccagagagcccaugaaugagccugugcugccucuuguuugucugccucagccuuugaaaugugccagcaccccuggcuuauacuuacagugcgugugguaagccuauacuuugugcauuuuuugcauaugagggaaauggagguaugagaaaaaaguucuuugccuaaauagggagucaggauuggaacccagggugcucagaaaccucgugcuugacccuugugucucuuuauuuaaagauuggcagcagaguaagcuggagcaguggaggcaggaggaauaggaguucgaggcuagccucggcugggcguguuuuaggccaggauauauguaaacuugucuggaaaacaaacaaaaaagcucaaaggacgggaaaagguuaaaaccugccaggcauguuggcaucaggcauguuggcaugcaucagggaguccagagaagcaaagguaggaggaccguuugucaguauccaguauggaaugaaagccugucucgagggggagggguuagaacaacaaaauggcuuuaaucauaacuuuccccagaccuucucuaaggggaggaguuugcuuugagagucaauggaagugccauaaaccucuugccuuguuugggauuuggucuuuauugucccaggagacuuaucaccauaaugugccugcauguucuuggaauggccagcaagugauacagggagugugccuuucuuguggcuugaucccccaagggugggagaagcccuuguggucugugucccacugcagagccugaaggaaaaagucguuucccucaggguuccagcaggacagaguuccuguuucacuggguacuucuuguucucauuugcuucaguucuauaauuauauuuaaaauuuugaaauucuaaaggccacuaaggauaaucaggugcccuguuugagguguuuguuuuccuguccucacugaccuguccccuuauaaacagaacugcccuugccacagcaguguggcuagaaacauuuuugaggaggcacagggacuugacucccgggagaguguuaaaugguuccagucuuuggcuccaacuuggaucagcuguccuagaaagaagagaguucugaaagaccaggcugauuuuuauguaauuugaggagggaggaguuaguagucgauguuuaucagagaugacauggcugcucuguggccagcugguaugcccuugucccuuccugagaagugugucuggcuucucuuacacagcucucucacaugaggucuuaacaucaccuguucacaguucagcuucgugauaacagcucagcuguucuuuauaaacuuucauggaggggccagcugugguggagcacaccugaagagagccugaggcaggggcauugugaguuggaugucaacuggggcaacauagugagacuuugccucaaaaauaaauaaaguuuugcuguguuuauguuguauguugauaacuuuuaaaugcucuucugagcuugagauaauuguguaguaguaauguauuuccaaaccagucaguacugcguuuuucuauggaucucgggcuuacaaggaagacggcgcugggcagcagacauagaguuaaacugaccuucuuggagugagaaagacacuggcuucauggguccuuggggaaccugacuauccagggaagcggcuguccaucccuggccugugaguucuauagggucaugcauuucucucuggaaccaugaagugugucauccggugugucugguugauuguuuuuguggucucauuucagaucucccuggaguuuagaaauuuggcugagaaauaucaaacagugaucgaugacaucugccaccggauggggugugggauggcagaauuuguagacaaggaugugaccuccaaacaggacugggacaagguuaguaucugaguccacaucugcuguguagauggccagcugucuccauggugaagcucagaacaaggacagaguaguccucaaaaccacuuagcuuacaguugaacgcucugucagugacaauacacgccccacagggcauacucuugccaagugaauuguaagcuuguccccaaguugcuaugaaaaguuagguaauugggcaaauacuuuucuguaacacagaaaaagcagugcuuuucaaaauuuaaaaacaauacuuuguuauuggcauuuuccuuuccauuguagaauacuggauaugcaccugcuuuggugugugagucaucagaggagugauuuuuuucuuuuguuuuuggaguaguacagugguugagugcuuucccagcaugccuacagcccuggguuugaccccuagcacugccaaaagagaaggauacaugagauguauccaaguuuuucacaccuuccaucucaacugucugggaaguuuauccauauuggggggggggggagaaagaaagaaaagaaaagaaaaaaaaaagagauggacguccucccagccugaggcucauuuaugacuuucacuaguccauuuguaaggauggagcuuucauggccucuaucucccaugaggcaucccuaccuuagcacuguugcacuggaagucuccagucccagcaacccugaaaccauagcaacugcugacgaauggugagcugagcugucucugugggccugguccaucuucccucugugggcagguccauauuccugggagaguuggggaagagggcaugaagccaacacaguaauagcuugucuucccagaacuuguuccuuaccagcagugugggguacaagccaggcuaggaguugguaggcugcaauagauuguuuaucgggacaaagaagccgacauaggaguggcuugcucacuuaugugcuggccucuuaaaggccuagagaguuaauguguuuuguuuuucuuaccaugcuuagguucagaucugacauucaagucagugugggucuaggggauguagucagacccugggcucucacacagcacugaacugaacaaaacaaaaacaaaaccccaaacauagccagguaugguggcacaugccuuuaaccccuacacucaggagacagagaucucugugagcuugcggcuagccuggucuacauaucaaguuccaggaagugaagggcugguuacauaaugagacuuugacuaacaaaacaagaaccucagacucagagggaugucucuggaacuguggcuggcuauacugucugaguuagucaccguuugaugggagcuagaacaguuaccaguccuagccagcucucagcaugcucauucaguaccuaccccgcccaucugcacagagcugguuaggaaacauuguacuuguggaaggaaguuccaaccagauauaagugaauguaauugaauuauuuucccuucagcauuaaaagacagaugaauuaugggucucuucucuagaaguguuccuacccaagaacuguuaccuugaaaugcacuucucucagcauuauagaugcagguguauuuuucaauaucuggucuauagauugcauuugacugucagcagcaugucccucuuggaggacggggccagggugcuuuucucaggaaggaaacuucuuuggcaguuaagcauuauauuugucaaauaucuuagugagaccuuuucagaacuguugguaaggcuggauccauaguucuaacaccuuuuucgccaccuaugacugccuuccccuauaaccucagcuauucuaggugccuagguggaagggucacaagguugaggcuuggcugggcuguagaguaugacaggaguaaagugaagugggaucugccuuuaaaaaaaacaaagcucuauacuuuaaacccuaauauggaaaggcaaggaaagggaagacagacagacagacagacaccugugggucauaccccuaggcccugcagaugagugcuccuggacaaggucacuggccaggguuucucagguuccuccugugcaaugaaggugauggcaguaguccucuggguguuggccucagacugcucacauggacuacaauguugcaacaucuugcuugugugugugcuuguguuuucaucaaaaguagaacucagacacucuucucucaacuuacuguuuuguagcuaaagaugccuagcaagaauguuucugugucauuauuaaagugcuuuacauaauaaucuuuugcaguacugccacuacguugcugggcuggugggaauuggccuuucucgucuauucucugccucagaguuugaagaccccauaguuggugaagacauagagugugccaacucaaugggucuguuccugcagaaaacaaauaucauucgugauuaucuggaagaccaacaggaaggaaggaaguuuuggccucaggagguaacugauaaugggguacuuggggaaaaacaguuuuagacucugaaaaagcaaucaccuaacccagugguuucaagugacuaagucauuugcuuugaguagacugacugcaucuagggauucagggucuuugaauggcuuugacccauuucucuucucuggucagacuuccuccaagccacagauauaucucaggcaaaccaaccuaacacccuacucuuggggcucagguauuucccugaguguauuccuguagccagccacagccugaguccucugacuucagaccugcaucauaggugugccaacacaaacgggauggauuggaccaagucccugacagugaggggcagaaggugcugcaguugugacucauggaauccuucaugcuaagagaguguaugcaaggcuguggguucaaaucucuagcucuuggggcagggguggagacagaaggggugcuagguagaaaaaacuacagauauccauuauauaagaagacgauuuaauaauuaaaccaugagcgucgaaaaauuuuuuuacuguguucaugccaggauuuccuccugcuuuuuauaaaauccucuccuaaagccaaguacuuuuagauuagaaaaaaaaagucacagagugaugaaauuugcaauguauauaauggaugcaaaauuuauauucugaggcuugagcucaagauucuccagccucagcuuuguagcugcucagauugcgagaagagauaagccaugucacagaaaaaacgaguggcguguugacacgucccaggugacgugggcagacagauugagaaaggcuccugccuggcucucuccuugugaugccuccaugguggaaaguggaaaagaccuugucagaugacgcccagguauuuauggucaccuaggaagaggagucuaauggcccaggcucacagacacagcgugaaucacauggcugugacucgugagcgccaguucaucagccuguggagugaaguagaagaccccaccugcacgacaggcuggaggugugacauaagugagacaaauguccaguccucaguguucgugucagcucagacagccugaaaaggaagaccaccaagaagccuggucuuauuaggcaagaccacaggcacugugcugccugagaggccauuuauuguagcauuauguauaaagguaaacuuucucaacauuucaaaugucagaggagaguaaggauagaaagggccacacuacuguggcguccucccaagugagaaaaccaaagugcaggaacugcugugcuguaguuuaaauggaagguuuucuacagccuuucuguaaccagguuguggcuuuagggauacagcucagggauacagcucagggauggugcuucugagcauccaugaggcugugcuuuagauccuuaacaccaccugugggcugggcagggggaagaggguaagacaaaagcaaguagagaagaaaacguaaccccguuauaaaaugguuuuauagcauagcagagcuggguacggugaugccaucuugcaaucccacaacccucaagguugaagcuggaaauuuuuugcuuaaaaguuggcccgaguaaacacucaagaaaaccuaaacaaauugguauugaaauacugaaauugggcaggaccuggggaucugcuuccgaggcagagcgcuugcuaguccaugggagacacuggcuuguugauaccugguacuguaaaagugaacaaaagcuccugcgauuacauaagcccgacagcaugaagcugcuggguuuauaggcaagagccugugcuccugugaucuuugauuuauaguaagcgugugugcucagugcguguuuucuagcacaaaccuccuaaaaccugagauguuuuacuuuacauuuuuggagcaagcucucacuguauagcuagcccagacugaccuaagcucaggcucacccugccuuggccuccucacaccaagauuggaggcuuuugaagaccuaaaggaguuuugcaaucagauugcuaauggcugugugccccuagcaguuugugaguauagagaauuggggcucucagggugcccucugugacugcagucgguuccuccaaggcagacugacagagagagggcugcugcagagcacagaaggacuggagaugaaucuaugccaccauggcauagguuucauuuauaguguuuccaugaugaggucuccauccaaaccccagauggacagggauucaguuuuaauagcugaggaaguagaggugccagcacgguuuagauggcauagaggagagggcagggaggcgccaugccccuucucccacugccucacucucuaucucuagccuguggucugcauccuucaugauggguacugaacagguggcaacuugggacuuggcagcggacauccgagcuaggagagcuuucuuguagacugagcccucagccugcuggcucugaugcuugauggcugucaggaauccauaugagcugcgauuuuccuaggaggcacagcuuaggcaaaugacacaaaucauuagggaagugcuuuugccagacuuaccauuuacaagaaaagcagggugagugaacacuauugggauuaagucggagagacagaaaaguugagaaggcuuccaggaugugacacacccuuuucaucuucccuucgauaaauucacagcuaugguacucggugguacccagcauauguuggauguggaucuuguuuaaauuugagcaaacuggggggugacgggguaaauuugaagaguguuuuauauuauuaaucauguuuagauaugaccugauauguauacaagaaagguuuuagguagggaauauaguucagugauagaauacuugccuagcaugcaugaggcccuaggguucaaccuuugggaauucaugauauauuuauaaaacaauaaaccuaccucuacuugaaaauaauuucacgacuaggauauagaaugaauagacuuguccugugucauguugguaauuguugaagcagguucauucauacauugauucauuaaguuuuuguuugguuuuguuuucuggguucugcaaaacaucuggcaccuuuugucuggguagauuugggugcauauuaaggauggauaacacggugcuggagcaacggcucaacaguucagagcaucugaugugcucucacaggaccugagcuuguuucccaccacucacacacauagacacauaaaguuuauauaaaaauagaucuuuaauaaaauagucauguuucaugauuacacauuaaaacacaugaaaccaggucagguaggguggccacauaccuauaaucucaguauuacagacauugggagacugggaguuugaggcuacuuaaugagguucugguuucaagcaaacaauaacaagucaaaacaaugcacucccuaugcuaaaacaaacaacugaacucuucacauuuuggaagugagggcucugagaacccuguucuaaguucagguuucuacagcuuagggaggugauggcccugcccuguaguugcuuauuuuucuacacauucuugcucaacagcguuguuaguggaauuggcagucuuggguuuggaagucugcuuguauugcuggaguugauuuguaguagcuggggguguucaguaauagacucacacccucccugcuagcaggagaccuaugcugcggucauuacaguaugcuugugcaugcugcauuaucuagaagagaaccuucccacgggccacccugccucucuugucauucauuggacuuugacugggcacugugaauggcugcuaccugaagccuaaaacagcuggaucucagugaacagugaaaugauuucacuguacauagcacagcucauucauguuucgcugcuggguuuugguguugaggcuggaacccaggcccccacacauguuaagcgugccuucuaaauggucuacagugaaccccuccggcccccacaggagaucucucaauccauguaaacucucccuccaccuguugacuuguucuguauuuguugacuggccagguguggggcagauacauuaagaaguuggaagacuuugcuaagccagagaacguagauguggccgugcagugcuugaaugaacucauaaccaacacccuacagcacaucccugacguccucaccuaccugucaaggcuccggaaccagaguguguuuaacuucugugcuauuccacagguaugcaguggggugcuaaaggaguggggugcuugggcugguagaguauagcuucugucuugcucuguuguguugaggggcaugguuucuuggcagcacucacugccuaucucaggaguagguagggagccacagcagaguccuugugucacauucaggacaagguugacuguuccagaacguuccuucugggguuuacccaucaacuauucuaaacuagcuagaucauuaggcuaauaagccugggcuucagccuagaugaccagcuggcuaaacugaguaaggcuguuaacaggagaaaauggcccagcaggccagggcucuugccaggaguggccuccugaguuagauugcugguaucccgcauugucuacacacgugaaugaauagauaaaugcaauaacgucuucacuaaccuaaguucugugauccuuuuuuuguacucaggauagcaaugucugguccuggagacccagcagcuauauauucugagacuuauuaauuuccuuuaccaguuauuucuaaauuaacucacucagaagcuuggcuugcucuuguccugacaguucuaaacggucucagcuaaaccuguauggcuguccuagguuuccaucagcccaagagccguuuauugugagcacaggaagccaggacccucucccuccauuguucucaucucacaccaucuuuaauguauaaugacuauauccauaagaggagaaaguucacaauucucuccagauuauuauuuugaaaugaauauucagucuacuaagugcucuaguauggaaaauguuggauuuccuuguguuuguaaauaagacggaaucuuuguggcuaaaugacagaauaacccuguuggugagugugggggagcugaaaaggucgagccuuacuggccuacuccuggguacugcugcuugccuuggugcacauuggcucuuuggcacagaaaggcuucacuauuuaauuugugagcucugucuucaugaccugagauucuccucucuccuguugcuuguagguaauggccauugccacacuggcugccuguuacaauaaccagcagguauucaaaggaguagugaagauucggaaggggcaagcagucacccucaugauggaugccaccaacaugccugccgucaaagcuaucauauaccaguacauagaagagguggguuuuauuuaauuuucuggugauuuauagcuguuuuuaugcauuaaaucaugucgcuguuuaaccagaccauguuuggguaguaguuaguccucacuacuucguguuauagcuuaaagacaguaguugguauccccuauuggaaaacacauacagagagcccugcaggacgcuagugaugacaugaaacaaggcugcaugccaaaaccucuaggaagaaucaugucuucugggcugugagaggauguucgaggccagccaagcgugcgugcugggugaaggaugugccgugggggcuuuuggaagcuaagucagagcauggcugagggaaucucacuguaaaugcucguguccugacagucagucugguguguucuagcauaucacagaccucacuuggaaaccccuguggggaacauagacaaagugagacuaugaaguugcaguuagcucuuaagugguuuggguuuuguuguuguuuuauuuuccugcaacucuuacucaaaugccaaaaccacuguauaaagcaaaacguagcuccuggaguggugccagcacgcguaggugguggcagugugugacuggaacguagucugcucaggcugcucuuaaacacacuguaauccugccuccucaacccccaagugcuggggcugcaggcgagauuugggaauucccuggcuuacugaucccuaauuuuagacagucguuuuugaagaguucaugggcacuagaguucacguucuguuuugugucuuccuuggcugucaggaguaagugcugcugcugguggcugagcuugggggcagagguggcacgguguuuguuguaacucagccacuguguccccuccuuagcuggcugcuuuugcaacuucagggcagaguugaguaguuacaacagaguagcccagauagcuaaaaauagcuugcaacccuuuaaaagaaagcuugccgcccucugaccccaggauucuaaucuucuuuagcuacuucagugaaacgcaggguaaagguuguauuaaugauuaaagaagaagaaaaucaaaauuguaaaguucaagcauuacaagcuuuccugacagccuuguggagacuuuccuagugaugccuuauaaugaagacuugcugccuggaaucuaacuuagcugggagaguauuggccuagcaugcacgaagcuguagguuugauucccuagcacccaccauguaaaccggccagggugggauacggcuauaaucccacuguuggggagguaggaucaguucaaggucacccuugccugugcagcagcagaucugaggccagccauagcuacguggcacugccucaaggucagucaaccagucaagacuuagaucagcauaggcugaucuguaggugucuagaugcagcuagaucugaucucguuucuccucacagaucaaguccguacuuauaggaaaggagguuauaucuuuucuguaguagucucugucuccucaguuguucugagagaaggcaccaggaagaggcuucugagaggccccuaaugccuacggagaggugcaguguguguaggcuugugcccucccauaggcggacaguccuuucagcaguagcuagagcagcuugcauaucugucagccaaggagcucucccugcucucuugggcaaacaccaggaaaccugcauccccuacucugucaaacugaucuccuuggcaagggcuguuguuuuuauguuccugugccuuuuuuucuuuuuucuucucuuggggcauccuuaacuguacuuggguguguauagcccagcagaggaagaaauauuuugauggucuuucugaugauaagcccaacaaccaguuuguuuuaaaucgcaaucugcccgucccccacccccaagucguuugacuccgcggcucucuccuccuuggagcccugugcuuuccugccuuuggcagugacuuuggugcuacuuaagcucucccgucccugcuccugggccuuccugccucuuccacuacuccuuuaggugcuggguugcucugcguucagucuucaucugcuuuccuaucacggagauguuucauggcuguuacccaagugacguuguccucuuccuuaaucauggaacccugagauacccuggaguacucacauagccagaccggccuaucugugcuuucauaacugcguuagccucugacccagucacgcaggacuugcauucugcagaagggagggaggacauguauaggaggaaaugcagguucuauagcauuuuauucugaucucauuggccuuccaucacuagaauggacuacccaaguuacuuagcuuacaaagagaauguguuauuuuggcugaguguugggaguuccagccugugacuaaucaccccacuauuuggagccuguggcaggcagcacauuaugcaagugcacagugaaguaauagccucccaccccccacccccaguaugcagagggaaggaagagaccaggccccauccccuucaaggcauguccuggccuuuaugggcagggagagagcuggaaggacuggccccagccuguggguaagagguggagugugagggguuuucacuccuguuuauagugcugauauaagcagagcuuuaaauuauuuuauuuguuuuugcauauguguguauagcuguaugagugucacaugugaguguggguuccuguagaggcuggaagugagugucugagucccuagagucccuagagcuggaaucgcagguguuggugccagaaacugagcccagguucucuucacaagccacaaauacucuuaaccacugagccaucucuccaccccccuacacuuaacuuuaaaaaauaauagggccuagagggauggcucagcaguuaauaaguacacucacuuuuguggguucaguuccuagcaccuagcucacaacuguuccaagggauucaaaaugcccccuucagacuaccgcaggcaccacacacacacacaugaugcacauacauacauacauacauacauacaggcaaaacacuuacagacauuaaaaauaacaucuuuacacacacacacacacacaccccaccuauuuuguacauguaaucucaacaugugggagguugagguagaaagaucagccaggcaucaaggccagccugggcaguauauaagcaaagcccuggcuuuaacaaaauuaaagaagaaaauuuaguaugauguguguggacaaaacauccauuguauagugaaaauuugauaucaucauccuugcugcuuuguguauuagauaauuaugcgugugagcacuugcacaccauuacacaaguacaggcuggaggaguuugcagaguugauuaucuuuccgucagauuuuacccacugagcuaucucuggucucgcucuugcuuacuuauuucuuuuuauuguuaacuuuuuuuuagauuuauuuugcuuuauguguauguuuugccucuauguauguauguauguauguauguauguauguauguauguguaccauguaugccucauagaacugguguuacagaugguuuugagccaccaucuaggugcugggaaucaaaucuggaaucgagccccaguccuauuuacaaagauggacuuauuuuuuccuuuaugcacauggguguuuugcuuacauguauaucuguguacuaugugugagcagugccuguagagacaggaagugggugguggauccucugggacuggaguuucagaugugagccuccauaugggugaugugaacagauucuuaacugcugagcucuuucuccauuggaggcuggagucuuuccccaucuaacacaugcuuuuuggucaaccugacuaaaucaugccaacacacacagggcaccacuucaugcccgccacugugaaguaccuggcaucugaagccgugcgggggcggcugcucuccaggcacuuaguggcuccuuggugaggcuugugcagugcacuguucuuccuugcucgcugggccuagguggugcuucagccuuauccuagaguagcaagugacucccguucuuagaaccuguuuuguccuuggugacaugaccuaaagccaccuaccuguugagaauuguuagaggaaaccaugagaaaugucuauaaaguacuggaggcagcgcuaaguagccuuucuucuuuccuuaacagauuuaucaccggauccccaacucagacccaucaucaagcaaaaccaagcaggucaucuccaagaucaggacacagaaccuucccaacugccagcucaucucccgaagccacuacucccccauuuaccugucauuuaucaugcucuuggcugcccugagcuggcaguaccugagcacccugucccaggucacagaagacuauguccagagagaacacugauuuuguuuagccggaaguggaaguucccguggaguggguuuuuccuuuuccuccagcuggauuuugacuucccuuguuuuuccuccuacucuaaaaucuuugggagaacugagugugggaccuuuaggaacugggcagaggaaaggaugccuugcccucagcagccuggugcuggcugggacuugguuccucugccucuuguagccacuggcagcgugccgacugcugcacuugugaggccacgugugauggucacaagagccuagugaaccuggcuagaaugcugauuggauuuauuuaauuugaaacagccuuugaauaccuaugacaauagaaaaugaaagcaacugguccuugucuuucucaugaguuugacaguggaaguguuaauccguguuguucugcgcgaugcugugagcucccgagacugcaggcuuggccuucucacccagggggagcuuaagcccccaucggugccguuggccacuugucagcgcguccuccaggaaaggcuuuugauguugagauuuuuuuguaauagcauagaaugaaugcacacaguaacaugcucacaucccuuguaaggacugaguuuguccggugcagcucaccugaaagcccagaaagauggccuagugaucucaggacuggguccuccaucaccacagcaagaguguugcugaugaggguaaggaaagcaggcagugcggucaccucucugcuuuagccugccacugcuguuugccccucccuccagucuccucuacagucauuugcuuugguuuuucuugaagucucaaaagacaaaugaugacaggaaaaccaguucuauauugguagguuuuuaauugcagcgugguuaguuggcuacauugucaugguggccucugacacccuguguaucugaaaaccaguguuugagcgguggagaggcucuaggcaaccacucugacuguaggacaagauaccugaggccaacugcuuuaccaaggaaagaggauuguuuauguaacagcuuaggaggaugaaaguacaagaugaggggggccccaucuuuagcccuuggacggccuugugagaaaugacacuacaguagagagaggacaugcaggagagagcacgugacaggaagcaggagucgacgcccuggcaugcugacacuuguacacuguaacuguagcucagguuggccugcaagucuauguagccuugaauuuaauggugaucccacugccucagccuucugaauguacgaguuauaggcacgagccaccccacuguuguccacagagcuuggucucuggagcccuaacucuggaagacuagcauugagcccuuuugagaacagugccucagcuaccugucauuuugugaaccuguauaugacccuuugggguacgcucagaccacagagacauguagagcauagucugcuccccucuuaagccugcugcguauguugacuucaucacugaggugccucggccaguucagugguccauucaacuuuguaagcacagauuccuugcuggauuacuggggcauggagacuucauuggucacuugcucuaagccuugaacaaauaccaccccgcugaaac

SEQ ID NO: 7523 - RNA, 11416 nt, Mus musculus
cggaaccccagcuaccgggcuacggaccccgugcgcuccaauggcugaacucguccuccccgcccuggucuggaaggcgcagguggauggugacuccugcugcgacugcugggagcguacaucuucccgggacccaccuggggcugcgucagccuccucccugcccucuguagcccacacgugcacguaguuaacacuuguuuucacagaaaaauuaagcagugucucuucuggacaugcgcagccugguuguaaguuuguuuuuguugaucacguugccuuccgacucccugagcccucgugacccucauguguucccucccccuucggaaggguuaggaaacgcuguggccuaagacuuucuccuggcuccuggagaaaagggaccacguccugcgcagccuggccaccucacccuagcgacgaagcccaagguucucucucaucagcucuucccauucuuuuccuguccaucaaaccauaccuaggggcggagaguuguuugucuguuuugagacagggccucuguguaguuguguggcuggccuugagggauuaaaggcuugccggagagauuuaagauuagggcugcaugcugcaucauacuggcgguauuuuccagaacuuucucugccgguagccaggaagacugaacuuagaggugguuaggguaccagugccuggcaagcuggcuuccagcccggcagcuuucccugaaggucagaguaggugaacuguuaccacauuuccgagugugugaaugggaaucuaagcgcaaaugaauuuaguuaagcaucguugaggccguagcccaguugguaaagggaugcuugcaagaugcccuggguuugagcauaaaccagggguugugaugugcuggagaccacucauacacaguggccucuaggccagcuuggcauuugaaauauaggcaaaccugucucaagauagaaagaaaaaucgcauaauugauuguguuauuuaugaagcuacgagaauuuucaggaugucuggggcauccugauucuucgauuaaaguauauuuuaaaugucuuaguagggaggaaguuguauauggcucacacuugggagacugaggcagaaggauuguucagaguucaagaccagccugggcuacagagugaggcuuaacagccacccuggcuuuuagaaacacugcaauaauaacuacccgcuguaugccuuuguugauuuuuaccucaauuuaugagcgugguguugguaaguggcgggugagguuagguagagcuuugagugggggaugggaggacaacgccugcucaguaaagucuggguguaggcuacccaggcgaucucauccugguggcucccggugacuuuggaugguugaggacagagaggggaggggugacguguagaccugccuggcugcugucuacuugucaugcuuccgaguucugccagcacugugguuacagauagagaaccauuucuagagaucacauaacuaguuccgaucuccuuuaccugagguggucccgagagagccagauccaaguauggaucagucagaagagaguuggaaugaacguuugaggacagcuaggacuacguaguuucagcucaccuagagcuauggaguagcaagacucugucuuaaccaaccaaacaaggaguggcugaccacugagguggcagcaccuucgaaguagacaguaccugcuacgugacaucuagcacacuauagugauuaguauuugcugugugguuaaggcugaggggccaggaagagaaaccauugcugagaagcccuuaucccuuucccagcucagucuucucugagguuugacccuccccccccauacacacacacacacaccacaccucaguucagcugguuuuuggcaucuauauucuuaaaguggguggcccaaacucacuccuuggggugccacacuggucaucagacaugcugggcuaagggaaggccaggcuaagucaggggucuccuuuguagcuuucuaccggcagagaugccagaagggccaucugugaggaaguuucaccaucuugucucccccuuugugggccagaagguggucaagacggggggcagcaguaagaagcuccacccugccgccuuucagucucuguggcuccaggaugcucaggugagucuugcuuccccaggucucacacagcugugcugguucaccccaccuccccuggagacauguagccuugaagauggcuagugguauccuuucuuuaagcauuggacagccacgcuaggacugcauguggccuugcucuuggugugacauauccugucacaauggacugggggcugugaagaaugucugaaaaggauggaccugaugaccccacgcaggaucagaagaacucuuuugacuuaugugcgucuucgaugcggugccccggguccccguaagccagcugugacguaagggcuggacacugucaaggaucugaauucagaccucgucccgagugggagaauuccuccagggcacucagggacucccguggaccgaccccugccccaaguuguucuuugcucgcacuaguugccugcagccuaguuaaugcuuacccaggguguggccauguuuccccugcuugggcacauuguucuguuguucuucaauucuguuaccacucccaucucuucaguuuaccaugguaauuuuagucucucuucagaugccacugugccauccuguccugccuugccugcuuuacacuggcugagagaugaguccucuguccuucugggauaaccucuacuuccuccuguugcauccuuauugcuaagcccgucuuucacguugaguggggagacaggaaccgggcaggacuggcuguacucugguauuccugcuuagcuaugaggaucugcauggaggagauguggggugaauucuggacagugauguguggucucugcugcugcugcugcuucugcuuagcugugugaucugacuguagauggguaaaggcgugcaccaccacugcccggccaacccuuacuuucuuauucauccccaagaucuaaaugacuuuaaaagucccacagucuuuacaaauucuuacauauuaaaauuucaaucccuuuaaaauauccaauauuuuuuaaaauucaaagccucuuaagugugggcuccaauaaaauccuuucuuccuucaagagagaaaaauaucagggcacagucacaaucaaaaucaaaaucaaacuguccaaugucugggaaccacucacaaucuucugggcuccuccaaggacuugggucacuucuccagcucuggcccuuguagcacacagcuugucuuguaggcuccagcugccugcacuccacugcugcugcuguucuuaguggucaucucaugguacuggcaucuccaaaauaacugcugucuuccacugaaaccagacuucaucaauagccucucauaagcucucuucauggugccaagccucaacuccuuuuuaugacccuuucaaguccugagccaucauuguaacugagguugcaccuguaccaauggccuuccguggccucucacagugccgagccucggcugcucagcaggaccccuucaugccuucaaaacuaguaccaccugggugacuuuuacacauuaccaaguccucgugcugcagcacgagguacaaccuuggcuaucucuggaacacagucucuguccucucagaaaacacuucccagaagauuucaccucgaugaugcuagucuccucucucucucucucucucucucucucucucucucucucucucucucucucucucuuucuuuauuuugagacaggguuucucuguauagcccuggcuguccuagaacucacuuuguagacuaggcuggccuugaacucagauauccgccugccucugccuccagagugcugggacuaaaggcgugcgucaccacgcccggcuaagcuagucucuucuuaaucaccaguaauuucuuagcuccagcuacccagcgucaguagucccagcaaugcaaagguuucacuuuaguaguucugguaucuuguuaaucacagcugauucuucagccccagcuaacccgaaccacagaaucuucacaaucaaaauagcaacagcucugauaagagucuuuaaucuucccucugaaauuucacaagccaggccuccaucaucuguacuguucucaacauugucuucuaagcuccuacagaacaucccacagaguucuuagcaucccaguagcucuucuagcucaaaguuccaaaguccuuccacaguccuccccaaaacauggucagguugucacagggauacaccacuaugcugguuccaauuugucuuagucaggguuucuauucuugcacaaacaucaugaccaagaagcaaguuggggaggaaaggguuuauucagcuuacauuuccacauugcuuuuaaucacuaaaggaaguuaggacuggaacgcaagcaggucaggaagcaggagcugaugcagaggccauggagggauguuacuuaauggcuuguuuccccugccuugcucagcuuguucucuuauagaacccaggacuaccagcccagggauggcaccaccagcaaugggcccucccauccuugauccaacuaauugagaaaaugccuggcagcuggaucucauggaggcauuuccucaagggaggcuccuuucucugugauaacuccagcuugugucaaguugacccacaaaaccaguacagguguguuccugaaaucuuugggaacaucucuccuagguuguucuggguggccuugcugucuggccuagcucaucauuaauccaucuccugcggcugcauucaggcauuugcaaggccaugcaccugcugcucacaccucugggacuuuugucccagcaaaggaugaaggggggcaaaggauacagagaaacccucugucccagggaagcucugggagagggaaaggaacagacuguuggcagcuagcaguuugugaaguuuugccccugugaaggucucuuagggucaauauguguucuguuuguuucuguuuuuguuuuucacaggugcauggaaaaaaauuauuccuucgguuugauccagaugaggagauggagccacucaacagcagcccacagccuauacagggaauguggcagaaagaggcuguggaccgagagcuggccuugggucccagugcucaggaacccucugcaggucccucuggaucuggggagccuguucccaguagaucugcugaaacauauaaucuugggaagauccccucagcagaugcccagagguggcuggaggucagguuugguuuauuuggcaguaucugggugaaugacuucuccagagcaaagaaagcuaacaaaaaaggugacuggagagacccagugcccagguaauggugugacaugugcagggguccuaguggggucuaucacguuuaugaggcccccucuguggcaaggcauggcugagcagccacacuuggggauguccaggucuugcuaggcaaaaagggugcacauucaccccuaagaaccggaccuguauccagaugauugcaucugcuuagguccuggagaggagaggauggguucccagccaacgugguacuaggggaugagcucucucggaagaaaggcaucucuagacuccagugcucugaauuuaggguuauaguuuucccaguuauuuaauuugugaacauugagggaaauaauuuggugcauaaagcucugcguguguguaguauuccuuccuuaaaggacaguucccaaucgccccggaagauuaugccuuuuuuuuuuuuucuuuucaaauuugaaucaagcuuuaauuacauaccaaccagcauggaguuuggucagguucacucugggauccuggggaguuagcagcaaugcacauucuaaugacuggcuuugcccaguggcuggcauugggcuguuuacguacaugccagcagugaacauguucuauuuuguuaucauugcaugaguguguguaccucagugugcauguggagcucagaggacaacuuucgggaguugauucucuucucuuacuguggauuguggagaucaaacucagguuaagguuucauggcaaacuuaggacgucuggacagccucacgcugcagucuuuaagcuuugggcuauuaaguuugauaaugugcguugucagaauugucuccaggccaguguguaucccugaguguguuuguaaagcauuuugacauucggaguuacuaaguuuuguguagucaguggucacuucugaauuucccuuguagcaaaggauccaccuucuacugagacacacaguauguauaagugugauggguucuucugugguauugugcgagaccucugagccucaccuccaguccuugaaagagaaauuuuuauuacauguauuuauguauuuauugacuuauuuauuuauacugugugugugugugagugugugugugagagagagagagcacgcgaguacucucccuuauacugugugugugugagugugugagagagagcgcgcgugcguacccucccaugcauucaugcacaugcugcauaugccccagcacacguguugagauuuagaggacgacuuucagcaguugguucuauggguccuggagaucacagucaaguugucaaaguugauggcaagugccugcuuccucugagccaucuugccaacucugacaauuaaaaacaaaaagaaaagaaagcaagaaacauugcugcauuauucuugacuagccuaagcuagucucaaauucauaagccuccugucagccucucugcacacugggauuacgggcauguaccuaccuccuagcuucccgagguugucucugcccuucccgagaacacuaacuaggucagacacggacuccgguuuugcagcuuccaguguagggguagcucugguuggauaagcuaucccuagaaugaaucccauuauuuucuuacugaaguguguuauaugucuuuucuuugcuuaggggcacauacaugcaggaguuaguuaaucuggcuugaaacuggaaaugaugcucuuugccgccauuucuucaucuucuccauaaugagcuccuccccuccccccaacucccagcucuggucccacuaaccuucuggauucagauuuucagcuuuucauuaucagcauggauugcugcaauguauuagaaagcaauguauauucauauuuuacuuacuaccucuuggcccugagguauuuaugauucugaucauaggaccuuaauuucucaguuugauccagacuaguauagaaacauaaugugcagcugaccugacggcauaugggacaaguaacuguguguaaaugugacccacauagcagucacuauacacacaugugacaugguuauauagcaauaauuauauggugauguacauugauaguugcaugugugaguagauuauguugugguaacuauauauacuuauggacugacucuacagaggacuguuuaugaauauaugcguugaccacacaguggugguuguaauguaugaucucauuaugugugagaacacuauauguaugaucucuucugucuccucaggcugguacuccauuuuaguggugguggcuuccugguauuuuauaacugccagaugucauggagcccucccccagugauugagcccaccugugacauauugucugaaaaguuccaucgaggacaagccuuggaagcucuaagccaggcucagccugugugcuacacacucuuggaccagagauacuucucaggauuagguaugaccugugugaugggaggagccccacggaguugauuaaugguauagugacucaucuguagggcaggcaagacuuaaggacuacuaucccaguugugccaacacuguugguuuuaagguugguuuaucccuugaucuuagacucggguuaguuuaagaagauccucacuucuuucugugguguaauauucacaacaagauaguguuuucugcucuagaggcagugggaccugggaaauggaccugauaaaugaggaagaugaaaguuucaugcaauagccaacuuuauucaaagcaucagacaauuuauacucugagaguuaagagaauggucaccugaauaaagcucucaugaguucagucuguauacaaucauaaggacaagcuacauguggcaaaacacguuuuuccauaaagauauuguauuagucagaguucucuagagucacagaaauuauggaaugucucuacauauuaaggggaauuuauuguaaugauuuacagucuguagucuaacuaacccaacaaugggcagcugugaaugggaaguccaaaaaucuaguaguuucucagucucacagacuaguugcuucagcuggucuucuagaauccugaaacaguagguuccaacagaugugcuggcaaauaagugcaagcaggugaaaaagagugaaucuuccuucuuccaauguccuuuauaggccuccagcagaagguguggcccagauuaaagauguguaucaccaugccugaaucuggaauuuacuuuguuccuggcugaccuugaucucagagaucuguuauuccuaaaucuccuggguuuaaagauguguacuaccuugcuaccuugcuuaagcuuuuuaauggccacuaugccuuaagaucuccauguugagauccaggucagaaaccuguaucuuccaggcucaagaucacaagugugcccuccauuucuggauuguaguaaucccagauguggucaaguugauaacuaggaauagccaucacagaucuauauauacagccugguggugguggagcacgccuuuaaucucagcacuugggaggcagaagcagguggauuucugaguucaaggccagccuggucuaagggagugaguuccaggauagcuagggcuacacagagaaacccugucucgaaaaaaccaaaaccaaaaccaaaaauaaaaaaaaaacccacaaaucuauuaauacauaacagccaguugugugaacaacaaaguaaacucuccccuaucugauauaccugggaagagcaugaaaacauauuccaagaauaauaccacguuuugaagaaacugaggucacaagacucuugucugguuuucuuggaguuuucucacaagcacucagaauuguccucgaaugauuccauucuuggaccauguucugacaugauaggacugucacaggccuucugaugugauaucaguaugaccuccugacagagggaucacguuguguaccuggcacacucuaaagccuacagagcaucuagaagguucuggguuaagucaugcugggaaugguuguccugcaggccauuggaagagagggaggagaaugcccacuaauagguacugcucuugggcacuggggcuucugauaucgaagcagagucagguaucaggucagcuccaggcucuuagaagccaagagaaagaagcaggucucugcucuggagaauagauuagugaaacugugagcauuuccagcugagacagggaaugcuauaguucuuaguacggggaggguuauuuucugcccacaggagagcaauaaggggcaccacaacuggcuguuaaagcaguugcuauuggcaaagcugugugcauauacaaagugugacuugccugccgugaguauaguucaugcugaaaagaugugaaagugcugugcucucaugggagaaccaguggagucuguuucugugccagaaggaugaacaagguuuccagcaguggcuuuuggaugugcgcagagaccugacuacacaaugauacuggugagagccagugugagucaauaacuccagggacucgggcacaguccugcccuuaugcuguuccaugggauaaucacuuguuagcuuucccuuuucuucagaugaggaaacuaaagcaaagggcaccucgcuggugagcagcgaagcugagaugaguccagguaggccucagcuguaaccgcagugagauuaugaaacucuuggggaaacgucaacuguuuagacuguggcccccauguaccauugaacuuacucuccuccgcuuagcaaggccauugcucaguaaccagcaagauggacugaacucaucaucaccugagacagauugugagcuagugagcucaacacuuagaagacaagguggggggggggggcucagcaguuuagccuaggcuacauagcaaguuugaggcuuuccuccccucacgucucccuuuguuuucagggaacaucauaaagaaugaagccuuguacagagcaaggauccauccccucucucucgguucaugccugaguucuuccucucgggaggcccucguggaucacgugguggaguucaguaaggacuggcuucgggacaaauuccaaggcaaggaacggcacacacagaucuaccagaaggaacaauguccuucuggucaccaggucaugaaggagacauuugggcccccagaugggcuccagaggcucaccugguggugcccucaaugccagccccagcuguccuccaaggggccccagaaucucccguccuccuaaaacauguggccuuugccguggggcuuguagccuuggagauccaggugcuguguguccugaaagaaggguguaggcagggauagcauuacagaucaggguaaggaaguucaggagagucaguauugcugacauucauccguaggauuaugccucaacugcagcuuucauagugguugauaggugcuuuccuuuucuaguuaauucuauguaaucccaccaugcugucaaaacccugacaguggacuggggaaaaacugcccggagcagccgugagucugaaaagagcaugacugguggugugcagcuucugggggggggggggaacagcuggaggagacagcuggggguggggccagcagagugaacagcuggaggagacagcugggggugggguggggguggggccagcagagugaacagcugggggauacuauaaucccaggcuagguugcuuaugcaguguuuugagaacugguugauuuugaggcccucuaauuucuuucuucuuuuauauagagggaucaaggaugagggcaaagcuucaggaagguagugcuaaucagccuaccuggugcccucccaguggcuggagaccccaggauggacagggagguguguccagggucugagaaaagcuggcuauuauuuuaccccucaaguugggcauuuguugacuguugauguuugaagaauuugcgugucuggggauguaaagaagcaaucuuucagguuguuaguaacagcuuuauggaacuggaguagcaaaugaaaauaaaacggugugguauuuucuguggucuucguuaggc

SEQ ID NO: 7524 - RNA, 16748 nt, Mus musculus
guugcaagcgaucguuuuuuuaauuaguauuccaggcuuaaacaugaagaacagcuuugaaaacccuaacauguaaucuuuggucucugggcaagagaauaagucucaggagugauacuuaaauugaauuuaauuaaauacaaaugcugcagaucccgagagauagccaccaccacucaggacuucauuucucuggccuuugugcuuggaccaauuuaggcacaggacaaaggcaguguguaaaggaacuccaaccccacgcaagcuguccccugggagaggcuagaauucagucuggcucuccaacuuagagacugccgugcgcccugcacuuugaggacacaggggccgcuccucuucuuuaguucacuugggcaacucuggugcugacgccguggaaguugagcaucguagccaccaacucuggaagaucaaagucaugcuuccagccccaguccuuccgagcauugcugucaucuagaaucaugggccagcucuccgcuggggaaagacaugggggagaacacuggcuuauccagacucuggauuugugaauggguaggcaaauuuuaugugaagggagagagggacuucucucgucuuggacuggagcagaacuaguacacacaaggccaccucuucugaagacacggggugaaggaacucuggccuggugagcauggcucuggcaggccuugcccuucucucuauguuacuaaagcuagucaccaagaucuauucccuuauuuggccaauuccuccuuguuaaggcugauuaccgagguccagcuaucaaaguucagaaguccagcaaucagaagccacccuuagcucacccaauuaaaguuaaacacgucaacccuaauacggaguuucccguuuuacccuuauaaaccgccaucuuccaaugugccaugugugucuccucuuuauccagaggcaaaccuuuguccucuggagcaaacaccuuuuauaacucucccuugcucauuuucucucuucucccuuguuccauucaccuucuccuucuaucuccugucucugucccuuaucccugcccucuguccuucuagggcaaaucuccuuugugcggagaacuuggucuuggggguccugagcugauucuuucccuuucacugggcaccugcacugggguuauuaaccccccucccccaccccagagcuuugaaaagggacauucuuuauccagaaggguguugcagaccauagguaauggugaaaugggucggacucucuccugagcuggaaccuuucucccgaggaccuguuucccacacggaagcauccgcggauggaccaccgcagcuccucagccuuaaagccuccccacuaggcuggcgauuuggagcuggaguggacuggcgugcgggcucaccuauggccugucggaggggauccacgcaguaggugaucuggaagucaggcgcgugcuugcggagcgccugggccagcucuucgggggugaagcucauggcgcugauguuguagguucucauggacaggcgcucggcaggggcuuccaugaccuccaggguggcccugaggcagucacugauguacaucauugggagccuggugccagccucgagguugcacucgaaugugccguucuuugcugcagcguggaaaaucuggacggcguagucuaaaagagaaucccggcccguggguuuucucagcaggagggaggugggucaggacugagaugccaguucucccguccucuuaauacagaaccucuuuagacuacuaaaaauguuaaguucccaagaaagaucugaauagauaggcuacauuaagauuuacuguuauguacagguaaaugagaaaauuuuuuaguugcugcauuuuggggggcagggagauaaaaacacucccaacuuucccgucucucuugaaauacaaggaagcuaagccaguuuguggacuaagcagggccucccugaaacaagagaaauuaaagaugaaggagacuggagauuucaccuaccaguuguuccuccuccaggcugggaaucugcagaaaugauuccaggauaacgcaggcaccgaaaaucuaacccguaccgguaauaauaguacuaagaaaaaagaaagagcugacuaaagaaacgauaaccccguagaccagauaaaacaaaaauagcuuuuuccuaaaauaauaucucaugcaguuuaaguguuccucaagagaauaagcauuuggggcccggaagguggaucaguggauaaaggcaccugccacacagccuggugacuaaguuggguccucagaaucaacauaaaaguggaaugagacuccauaguuauccucugaccuccacacacgcuguggcacaucuguguauagauauauacacauaaagggcacaaacacgauuuaaaaaaaaagaaaauggaauuuuucagaauuucuacguuuuucacuuuuguuuaauaacacucaauuuuuuaucguuuaagaaucaccaucuuagugcugcauuaacauugcaaaugauggagcagccugcagguggcgcuccugcucccugccaugaguaugacaggcuugcuugcuucccugcaagaagggaguuugaugugcagugccuacaagaccccgcacugauuacuacagugugcuaaagucagaguaaaagcgugguugaaguuuuccacaguagaaaguuucuggacuggagagaugacucaguugguaaagugcuucuggcacaagcaugaagaacaguuagauucucuagaacccauuuaagaaaguagggcacagaguguggcuguuaucuagcacuaaggaagugagacaggaccccaaaggcucgaugccuguaauccuagccuacuuguuccaaguuccaguaagagacccugucucaaaauuugaggugaagaggaauugagaaagauacccaacuucuggcccccacacacaugaauucauacacuuguuuauuccccacauauauucccucccucccucccucccuuccucccuccuaacuccucucagucucugucucucucucucucucacauacagaaaguuuuaacauucccaccaguaaccccaguguugagagccuuacaaaugagauagauagcaagcagacagcaguuucaaggccagaguguccauaagugcugugcgacuaccauggcuguggacaaggagcaaccuauagcuaagcaguucuucaguaucuccaagcgucuuaccacuugacaaacacaccagugagguaaacaucucuggggugcaaauguucccucaaaaugaagcaggaagugccugaggcagaaagaauggggcaggacacacagaaccuugagcaaucuugccaagaaacacuuacuucucccaugagcucuguguggaccuuggauaccccauagaugguccuaggccuuugaauacagagaucgggugcaggguuccggggagagguagguccaaaggcuccaaucgugcugggcacaaacaaucucacguuguauucagcugcaacaucuagaacguuaugcaauccugaaauaaauagacacuaugaaaaucugaaagaaaaaaaaaaccuuaccaagagccggaacaacuggcccccacugagccagggccaaccacucaccaguuauauucacaucucuggcuaaggacacauuugccucucccacggcacucagcagggcacuguagugaaacagccagcugauacggugguucaccacgaucucacggaggcucuuguaauccaagauguuggcauaaacaaacgggccuguuaaucacagagugacagaggcuucgugcaacgaagagcugaauggauccccugucgccagccucugacuugagaaaaucucauacucauuuucucucacccccccccaaccuuccuggagcagaaccugguuagguagccuaggcuggauugcaacuuugugguccuucugugcuagccuucugagcacuggguuaacagccaugcuccaucucccaugucugcuuucuuggaauucauuauuguuguuguuguuguuguuguuaauggugaugguugugguggugugugaaucccacccauagguggugcccauaggagccagaagaagaugcugaaguuauugguggugaguguuugugagugcauguaccuguggagccuuaaagagaguuuugaauccucuaggcuggaguuacaggugcuugagacccacuugaugugagugcugggaaccaaacuugaguccucugaaugagcuuugaaccacugagccagcuccccuauccauauuccucaagcucuuucccucaucagauuacuuaauuuuuguuugugggcucuuugagucagucagccaaaaacucaaaagauauggaaucaaaaauuuuaguucaaagacauuauuuuaaguaguaucaaaauauauuacuacaaacuucguugaauauagcagcauugaaaauacaccuuuaagccaggauccugcccaagucccucuuuggguugcaaguggacucugugcacuuccccuuugacaguauuuugaauaguaaaacaucaaggaccaucuauaucuuaccacuguggaagacaugagcagggggcuuccuuaugucugauaggaucacauuguccuucccaaaucguuuccuguagggaaagaaagcccgcccacccccaacaagucagcaaugucaaggauacagucuuagguaacugauuguuucaaauaaacacuguaacuucuggguaccauuccuuccucaguaccauugucacaugccccucagcuuuaccucccuggguucacaucuccuuuucuucccacacccuguucucucccucuguccccuccccuacuguaccaccaccaaugcuaucucuaccuccucggcagcuccuccucugcuuuauucucucacccagcugucuucaaccccagaguacucccuuccagcuccuaucagcacuggccccugcccucugcucccaaacaacugaaggguaagugguucaucuggggcgaugacuaucccagugccuaagucaggaccaagagcaaaagagcugguuugugcuaaggaggcaggauaaaauguguuuuacaaagcuaauuaggugugauguuuuagauggaagcagaaagaggccagaggcaaaagaaaagacaacuguacacucuuaagaagagacaacuguacacucuuaagaauuugauuuugaaacucuuaccucaggagguuagcaaguccuacucccagcuggccaagacccccuaggugaagaagaaaacggugagaccagacuguaaaucuauccugagcaucacaguggaauaugacuccuucugucugagugaguugaaguggggugggguuggggaggcuggggagcugaugcagauguugcagacugcucucugcagcacugcacuauacucagaacauagauaggcuagccacugcucaugauggaguugcuuuccaugcaggugagaguuuuggaguugcccaagaggaagagggaagcaaggacacaagaaaguagcauucaugcagggcccagcuccaaagacgagaaugcaagaaaccaugugacaaaaggagccgggcgugguggcgcaugccuuuaaucccagcacuugggaggcagaggcaggcggauuucugaguucgaggccagccuggucuacagagugaguuccaggaucggccaggacuauacagagaaacccuguauaaaacaagacaagacaaaaggacagguggugacaagcugguguaguaguacacacccuuuagucucagcccuugggaggcagaggaagguggaucucuugaguucaaggcuagucugggacagccaaagcuucauaguagacagauccugcccccaaaauaaaauaaaaucagugaggagccauuuauaaagaaaugauacuaguaucauuccuuccuaauuuagaggcuggaaccaggggcuaggaacacauuuggaggaggacaacuguaaaauucagguaagacacuuacauggcagaaagauagagccaguaagacucccugccaguuaacacagggcugaaacccaggggccccaguggagacagagaaugaaagaaaccugcagaaagcagguuaggaaaggagugaaaacauggcagagaagggagaaauagaaugugucaaucaaaugagagguugccuugggcugcuuggaagcacggucagugacaacacgaaguuuguagugaagagggggugggccaggcacucgaugcaacaagaagcuugggcagugcuuauauccaguuuuguuuccaaaaguacaguagcaguuugugauggguaauucugagcuuaggcuggggacucuggccaaggaaagaugugccuacaugaaagauguguacccuuccuguccagucagcuuugcugcccugaccuacuauguacaauauggaaggaaaccaaguuccagggcagcuauuuggcccuuaugcauauucagaaaacacgauuuuguuagggaaagcaaacacagaggaagggaagcuaaagauggaagaugucagcuagagccacaccauugugcaggacggucagcuagauccuccaguuuaguugaacuguuaauuccugaagcugggagacuagguguuagacuggcucccugguauccagacagagagggagaaaagauguaagcagguaacaaagauggugaauuuccaagaugacugccuucuuccuccccuuccugacccccgacaaaagccuagaggcuuaaaacaaaggccuugugggcuuuucuuccaccaauagggcccuugaagauggcucaacaagcucaaggccagaucaggacauaguuauacaacaguugugggccagccaagcugucuuucuuuaaacuggcaaaccccaaauuagggaaggaaacucuugagagucuuuaaaauccccaguccucgcgcuaagagacuagccuuuuggcuucgagucccccuccuggucucccccugcuuugcaggcaaguccuucucugugugccugaccuauauguaucuccucaccccuaacaaaagccugucuucagcuguugcuucuaucugcugguugagauuucucugcugcuaccuguagagcucgagaauuuuccugccuuuuaauucuuuaacuggaugagaaagcuaaccccaucaagaccccuagaugguaacaaaacuacaauaauuugguuucaggacuaaaguaacuuguuuuucuguuugguuccugcccuccucauccucauagguaaugaagagacaucucaacugaggacuuacuacaggcuacucaucaaguacauggcauagacucaaucccauccccugagaccuggaggaagacucccacugugccauuuaugucugaacuuucuuggguggcccuucuaugcugcugucucccccucuacaguguuaauaauuccucugauaaaucucuuaccccaaaagaacaaacccuuugaauccaaacccaggacuuuuuuagaaaggcugugucugaucagaaaaggguugccaccccaguuuaaaguucuuuaugaugauaugccucacucagagacccuuucugcagugcaaacaucaaauccagcuccaguguucaucguagccugcucugauauagcacagcacacucccugucaccaagaagcagcucagagaaagcaaggcucaccccacuaacgaggaggagagaaaccaaccugugaucaagacccgaggaggcucagcuuccgagaucgagguggaguggaaguuggcaucggcugggauccggugcugggaggugccuagaaacuucaagggcaagacaagcuuccggcagcuagaggcuuugcucugugcagucccauugaccaccuguuuuagcaucccaaggaauagcaucuguucuucugauacccugggagcaaggaaggguggagcccauuacuaacuuuacaucccuuuggucccuggaaacaagcuacccccggaaaacauucuuaccaccaguucaggagcaacaccuucuuuugugauucaggaaugcaucggacuuaaccacugacuuccccauaggaagccagucaugugccagcuuugagccagggccaguaacaaaggauaaaaguucccacaaagccuaagcugggaguauuacugaagccaagucagaugcaaauccauggugggggucaauaaugcacaaccaacaagcaccaaauaacaauaacaacaaauccaaaaaccaaaagaaacaacaaacccaaaaccagucaccagaccugucgagggcuugcaaucucgacuacaguugcuaucgaccugugcacuacaccaucuggaggggcaggucccagacuaaauagccaagcauugaugaucugugcuaacucuucagauguuauguuuggaaugaagcagaguaggaaagcagauggcuaaaagaaaaaggccuggcaauauuuaguaagcugugaacagccuugguuugacucccacagccuuugaaaggcucauuuugaaagccauuuuccaaauacuuccaagaccacaaaugugcaaauacuugcccuccuccccuuccucuucccuucacuaccagcugacagugguaccauuucuugccucaagaaguucauacaagcaggacauguguccaagcugugaacugaaaguucccaggagaaaaaaggagguagggguggggcagauacaucuauguuaccaacugcauaguuggaagaucacuuagaacggggaauuguggagaacugagaccuuuacauucaccuuggguuaacauuggucucugaaacugccaccuguugccagccacugugucagccuauugugacuucucagguaaauccuuucagacuauaacuuagcagaccaccgacucccaccaacccuaaggcuaaugcugucaucaggucauaucugacacauggcaaagagauuucucugcuuugcucuaacccaccaccugagguucccgucaaugccuucaaaaugugccuugauuuaggacauuuuguccuguacugaugaaacuguuucccuccgaauaugagugucuuugacccaagaacacagguggagguaccccuaaauaguguuucacggcuaugggcaauaaaagguuaccaacuugagaaaauauuuuaaaaccuuaugagucauaaggaggggauuuuuuuuuaagcaugaaaaguucaggugguuagaacuccaguagcugcugguggggcagaggaugcucugcagagcagcugaggcccugcaucucagccggcucauaagggagccuggaagacagccucccagucaugggcacaccacuggcuucacaguuccagauuagcaccagauaagagacuaccaggguuggccccaguacaugcaauacagggaacaucugagacuuucuucaaucacucucagagggaugcuguuggaaaaauccuccccgcagccaaguccaggaaagaacucagaucuuuucagucacuaaucagcaaauucaaaaggagacagaggaagccuuugaaccacuggauuccccaagguguugaaagucaaggacaaacuccaaucauuccccaaagcacaagaauaacaacucccccacccacguugcugaccuaccucauuaucccccucaaaggagacacaaggaggugccugauggguucuuagccaaaggccaaauguuuuacccuggcaacauggacgacaaacaccugugcuggcccuucuuuauccacuacuagccaauauugauccucccugcaugccacaggcuagcagaacugcccugaucugcuagguuauaagucugcugccccacuuuccagcaggaggauccauuagcuuuaacguggagacaccaccaagucagagcaacagaaacuucuacccacagugcagcuuuuccaaguaaagacaacugucucacuucugcccagucaucucaacacagccacaugcugcacaaagccaucuugcuccacaguaggccacacaauaauugcauaauaugaagagauaugauaaucaacuaagugagugguguuauuuccuacagauguguuuccacuguugugugagcaugaccagacgcacaguagcagcccucaaaaauuucaauuucaaguuuuauuuacacuuuuuuguuguuguuaaagacaggacucaccaugugcucgggcuauccuggaacucacagagaucugccaacuucccaaauguguguacuaccacacccagccuccuuuacacucuuaacgacuaugggcugaaagucagguauugaucguggcacaccaaccuguaaucucaguacuccagagacagaagcaagcagaucucugucagggacagccuggucuacaaguuucaggacagccagagcuacacagagaaacucugucuuggaaaacaaacaaaaaacuguggacugaaaaguuuaugugaauaaaccuaucuauuuacuguauuaagcauuguuaacguuauuuuuuaauauuuuauguauuuuauuuauaugaguauacuguagcugucuucagacacaccagaagagugugucagaucccauuacagaugguugugagccaccaugugguuguugggaauugaacucacaaccucuggaagagucucuuaaccgcggagacaucucuccacccuguuaaaguuauuuaacaagauguuuauuuuuauuaauucauuuagugauguuaacauagacacuuuuaugaaagaaacuauguuucccaaagcaaacacagaaacccuguaauaagaggaguguaaggucaagacucucacgucugcuuccaugcucaaucuggcuugaguuuucacugaagucucuggagagaaugcaaacuucugcagaaaggggagggagacguggauguuucuaaauaugugucucugauacuucucuaaaagccaaaggucagcuaaccuuuaacuuugugugugugcuguguguaacuguuagaaccagcacacccacacauguguauguaaccuguauguaacccacacauguguguguaaccuguauguaacccacacauguguguguaaccuguauguaacccacacauguguguguaaccuguauguaacccacacauguguguguaaccuguguguggaggccagagagcaaggcugggcaucuuuccuccacucuucucuccaccuuacauuguugagaaggaaucucucacugacccugaagcucaucaguucugcuaggccggcuaauggauuucaggguucuuccccucccccaucccgcuccgcccaccuuucuccccagcaucaugcucgguuguuccuauagaucugauuuagauugguccucacgcaugcccgacaagcaauucacaauaaaguggagccaccucucauccuuuaauccuccucaaaggcggcugcaugagggaucagacacgcagucacugugcaccuugcuguucugccuccuacugggaucugagacgggcaugaaccacuauacccauuucuauuuaagacuuuuguggaaucucuucacccaucguuuagcuccaugcacuggacuuuugguugguuuggcaaguuaugaacuucuuccaaguaaacguuaguauacuucccucuucucugcgaggucaaagucacacuggcaaaugucacaaaacuccuaggcguugggaaugagcaccuuuccuuguuccuuggcagcagcagacuacuuucuucaucuguuagacuccaucuuucagauucccgaguaugaauaaccgugguuuuaguucuuucaagcagaacuaauguucugucagcaagaguugaggguccagcucacaucuccguccuacaaaugcuuuaccacaagacagcaucacauuugauaguaagaggagagcuuuaugggugcuuucagucaccauccagcauccuguaaagaccugaauuuagaagccaaggcuucaggaaaucaaagguucuuaaggaagcaguaaaagugauuacagccagcaauuuacacuuguuuaaaccagcuaggcaagugcuauaucauaggccugguccuucaauucuuucuuuuaaagacuuauuaauuuauagugugugugugugugugugugugugugugugugugugugugagagagagagagagagagagagagagagagagagagagagacagagagagcauugacugguagagacuuggccacacaugcuaagacugagugucaugcagugugucugugcucacaaguggaugacuuugcaguggcggcugcauucaccaugcugcuugugugcuuaugaauccaugccagaccaggcacaggacucguaguggacgguuggaaacaaaacaguccaagugcugagcugccuguucacacucuguggagcuggggugagcauguacuggugauucggaggaaucgggccugcuggugcuuuuguaucacucaagcccaugcaacacaucaccaggggccauuguauuccugguggccauacgcugccaauggggaguuggagagauggcucagcaguuaagaccauugggaguagaagcacugagauuccguacaguuugauaaucuguccuguuugaugcuuacuuagccuggugacccauccagcuugauacuucaaccgcaguuuacucuaguuucuagucugaaaaaucuaauaauuugggacuuuugaugaguuucuacuaucuaguuaaaaccuucaagucacacuugucagaggacucucaauaucacugcauuauuuagaauggugggcuggcaggggauccacaggggagcaggaagcugaggggcacuuuuuucaguuaugaccuuuucucuggauaaacucccuuucacgagucuaggaacuggcucggaguugaugcucaugucagccuucgcugaccucaugggcacagaugacauugccagcuguggguugaaaagucaaguuuucuguuauccccugacaagccaaucauucauucuucagcauaaaaauauaugaaugggggcuagagggauggcucagugauuaagagcacugacugcucuuucauugguccugaguucaauuccuagaaaccacacgguggcccacaaccauccguaaugcaauccuaugcccucuucuggcaugcaggugugcauggagauagagcacucauccaaaaauaaauaaauaaauaaauaaauaaauaaauaaauaaaucuuuuuuuaaaauguaugaauggauauccuuauauugugguauuauuacauuuccaguuacaaguaaguacacuugccuuuugauggcucuccaugaggaugcaggagaccucgaauccaaagccagagagauaaaaacaggcuugaaaguguagugcaaagagcuuucaucucuagaaacacauugauagcucuccucuaagccuagaguuuacaagacucuagaaacacaagacuacucaaacacaccucucauuagcuaccacaggccaaacccagaucugagaaaccccuagugcacugaggagaaaacaccaagagcaguuauucuuccuccagcgguuugaccuuguggacucuacaaaaggucucggggauccccaggguuccccagaucauacucugagaacagcuuuugccaggccagaaaguaaauuugcaaagagcaaacagcuauccuuggccccucuuuguuaaagucaaauaauaaguaggcagggggcucgcucccaagcaccuuagcaaacuuuaacugcagagaauaaaauggagaggaaaaugcacucuuccccucaagcaacaggaugauuuauuccauccagaacaaggagggaccuucaggaaaaccggcaccagugaccugaguaacggagaugggucggugcuccacuggacuuguguguauuugcaccuggguacaaaggucucucauaagcaccuguaagcccaggcuuccuugagaaauggcucagcugagaagaguucggucaggguuagucacacuggcuucaggugucaggaggcaguguuugcguccccagagggcauuuccagcagcccugccagcucgagaagcacaaagaacagaagccaccaggacuucaucugugcucuuaacugacaauguucucagacugaaacaacuccgagauaccucugggaagagggauuccaucacuacuguccuggggaugaacgguugugcuucaggaguccugaaguuccuuagaaauagccuuuuccacgaggaaaggcuucagugcgccaaccaccacaagaccacccuaaacuucuaacugcaaucauucuuagucucagagacuaacuaaaucaagaccuuguaagucucaagccugucacaguaagcauagaauaaaaaguauccaccuugcaggacuggauaaaggaguggucuacacacacagcagaauuucagccuuucaaacaagagaaaacaaaaacaacaaaaaauaagaaauacugacccaugcuacaguauggaugggccuggagcacauggggcuaaaugaaauaaggacacacaccccagcuuccaccccuguaagcuaaggucaauauuccccgaaacaaaguaggacauugucuuggggagagaggagcagcccagacaucuacugcaugacagugcacauaggucacacucccaacaauaaagauuuauuuauuuguguauuuuaugaguaugggugcuuugucugcacacaugccugcacaccagaagagggcaucagaucccauuauagacaguggugagcugccauguggaugcugggaauugaauccagggccucuggaagaacagccaaugcucuaaagcuguaagccaucucuccagccacacauuacugaccuuaaaaaaaaaaagucuuaauauaauucuguuguuagcugcccauagccacgguagaacagaaagguaaggucugcacaaaugcacacacacacaccauggaggauccaggacaccaggcaaaccaccccaaucccuucuguaccucuuccccaagggcacagccuccuguuucucaaaccugacuaaguucuuaucuuucuuugcugucucuacaggaaauuuucugcuguguuuaauccugcaaggcugauuucugcuccaugcccagaaaccugucuaggaaaggucagcacuagcugaguggcagcaucuuauugcuaauguccucucaugcuaauugguacugccagccacacccaccuucaauggaaaugggcuuaaacaccucaaucauaggccuucugcaacuaguaaggaccaaaugucaaggcaaccaccacuaccagcacuacccuccaaaagaaaaaagauggggggcgggguaguaaaguuccagguucaauggcaccucccacucggccccagagccagagcucugagcagcaauuccucuaccccccacagaggccuccugggcaucaggccaggguagucucuugucuccauuuuuuguuguuguuguuuuguuuguuuguuuguuuguuucgagacaggauuucucuguagccuuggcuguccuggaacucacuuuguagaccaggcuggccucgaacucagaaauccgccugccucugccucccaagugcugggauuaaaggcgugcgcaucagaagcagacaaaagugucaccauguuaagagacuuuaauauaagcagacaaccuagaaaaggcaucuggcaaaaaaaaaaaaagucucuguccauguuaaccucauucaugucacuuaaaaaaauuauaucgggaaaggcuggaauuuacauacuggccaccgaaagcaagaaagcguccaggagggagcuacuuacugucucggagagaaauucuacccaccuggugucuugcuuucaccugcugagguugggaaaccacgggaggaacccaggacagccagccucagcuugcucccugaugaaaagggugugggggcccucccaagccauccuucgggacgaucacaucccaaauuacuagacaaaccaguuuucugggugccggguucccacuccuauuccugagagguugagcauugcuaagagcaggagggagcgggaggcgucuugccacccggggcuacucaggggcccaucucuccccucgcgacccacaaagcaguggcgcccugcggucguuccggaccccaacccagacagcagauuucgcuggucgucccgugcccggaaagagguccaauucccgggcacaggcgcagcaggggaccaucuccuacacugaccugcagacacagaagacuggaugcugagaacgccacgcgggagccggagcagcacgugcggagucaagaguuugguucugccuuuuaucuucagucugcucuggacccgccucgccgccgcgggagccgugccucccuccuaccucaccucaccucaccuccgccccaggacgcuugugggaagcccacaccuacaucucggacggagcugaccuuguggcugcaccaagacgagaccacaccccuuccacaauugacugggguuagaauuugggacuugcaagccacagcuggaaagaucugcuauggaccugugucugguggcaccuccgccaagaacuaggaacuuagucguuucugguuccugggaacacugauguuaaa

SEQ ID NO: 7525 - RNA, 6172 nt, Mus musculus
aggcuggcgauuuggagcuggaguggacuggcgugcgggcucaccuauggccugucggaggggauccacgcaguaggugaucuggaagucaggcgcgugcuugcggagcgccugggccagcucuucgggggugaagcucauggcgcugauguuguagguucucauggacaggcgcucggcaggggcuuccaugaccuccaggguggcccugaggcagucacugauguacaucauugggagccuggugccagccucgagguugcacucgaaugugccguucuuugcugcagcguggaaaaucuggacggcguagucuaaaagagaaucccggcccguggguuuucucagcaggagggaggugggucaggacugagaugccaguucucccguccucuuaauacagaaccucuuuagacuacuaaaaauguuaaguucccaagaaagaucugaauagauaggcuacauuaagauuuacuguuauguacagguaaaugagaaaauuuuuuaguugcugcauuuuggggggcagggagauaaaaacacucccaacuuucccgucucucuugaaauacaaggaagcuaagccaguuuguggacuaagcagggccucccugaaacaagagaaauuaaagaugaaggagacuggagauuucaccuaccaguuguuccuccuccaggcugggaaucugcagaaaugauuccaggauaacgcaggcaccgaaaaucuaacccguaccgguaauaauaguacuaagaaaaaagaaagagcugacuaaagaaacgauaaccccguagaccagauaaaacaaaaauagcuuuuuccuaaaauaauaucucaugcaguuuaaguguuccucaagagaauaagcauuuggggcccggaagguggaucaguggauaaaggcaccugccacacagccuggugacuaaguuggguccucagaaucaacauaaaaguggaaugagacuccauaguuauccucugaccuccacacacgcuguggcacaucuguguauagauauauacacauaaagggcacaaacacgauuuaaaaaaaaagaaaauggaauuuuucagaauuucuacguuuuucacuuuuguuuaauaacacucaauuuuuuaucguuuaagaaucaccaucuuagugcugcauuaacauugcaaaugauggagcagccugcagguggcgcuccugcucccugccaugaguaugacaggcuugcuugcuucccugcaagaagggaguuugaugugcagugccuacaagaccccgcacugauuacuacagugugcuaaagucagaguaaaagcgugguugaaguuuuccacaguagaaaguuucuggacuggagagaugacucaguugguaaagugcuucuggcacaagcaugaagaacaguuagauucucuagaacccauuuaagaaaguagggcacagaguguggcuguuaucuagcacuaaggaagugagacaggaccccaaaggcucgaugccuguaauccuagccuacuuguuccaaguuccaguaagagacccugucucaaaauuugaggugaagaggaauugagaaagauacccaacuucuggcccccacacacaugaauucauacacuuguuuauuccccacauauauucccucccucccucccucccuuccucccuccuaacuccucucagucucugucucucucucucucucacauacagaaaguuuuaacauucccaccaguaaccccaguguugagagccuuacaaaugagauagauagcaagcagacagcaguuucaaggccagaguguccauaagugcugugcgacuaccauggcuguggacaaggagcaaccuauagcuaagcaguucuucaguaucuccaagcgucuuaccacuugacaaacacaccagugagguaaacaucucuggggugcaaauguucccucaaaaugaagcaggaagugccugaggcagaaagaauggggcaggacacacagaaccuugagcaaucuugccaagaaacacuuacuucucccaugagcucuguguggaccuuggauaccccauagaugguccuaggccuuugaauacagagaucgggugcaggguuccggggagagguagguccaaaggcuccaaucgugcugggcacaaacaaucucacguuguauucagcugcaacaucuagaacguuaugcaauccugaaauaaauagacacuaugaaaaucugaaagaaaaaaaaaaccuuaccaagagccggaacaacuggcccccacugagccagggccaaccacucaccaguuauauucacaucucuggcuaaggacacauuugccucucccacggcacucagcagggcacuguagugaaacagccagcugauacggugguucaccacgaucucacggaggcucuuguaauccaagauguuggcauaaacaaacgggccuguuaaucacagagugacagaggcuucgugcaacgaagagcugaauggauccccugucgccagccucugacuugagaaaaucucauacucauuuucucucacccccccccaaccuuccuggagcagaaccugguuagguagccuaggcuggauugcaacuuugugguccuucugugcuagccuucugagcacuggguuaacagccaugcuccaucucccaugucugcuuucuuggaauucauuauuguuguuguuguuguuguuguuaauggugaugguugugguggugugugaaucccacccauagguggugcccauaggagccagaagaagaugcugaaguuauugguggugaguguuugugagugcauguaccuguggagccuuaaagagaguuuugaauccucuaggcuggaguuacaggugcuugagacccacuugaugugagugcugggaaccaaacuugaguccucugaaugagcuuugaaccacugagccagcuccccuauccauauuccucaagcucuuucccucaucagauuacuuaauuuuuguuugugggcucuuugagucagucagccaaaaacucaaaagauauggaaucaaaaauuuuaguucaaagacauuauuuuaaguaguaucaaaauauauuacuacaaacuucguugaauauagcagcauugaaaauacaccuuuaagccaggauccugcccaagucccucuuuggguugcaaguggacucugugcacuuccccuuugacaguauuuugaauaguaaaacaucaaggaccaucuauaucuuaccacuguggaagacaugagcagggggcuuccuuaugucugauaggaucacauuguccuucccaaaucguuuccuguagggaaagaaagcccgcccacccccaacaagucagcaaugucaaggauacagucuuagguaacugauuguuucaaauaaacacuguaacuucuggguaccauuccuuccucaguaccauugucacaugccccucagcuuuaccucccuggguucacaucuccuuuucuucccacacccuguucucucccucuguccccuccccuacuguaccaccaccaaugcuaucucuaccuccucggcagcuccuccucugcuuuauucucucacccagcugucuucaaccccagaguacucccuuccagcuccuaucagcacuggccccugcccucugcucccaaacaacugaaggguaagugguucaucuggggcgaugacuaucccagugccuaagucaggaccaagagcaaaagagcugguuugugcuaaggaggcaggauaaaauguguuuuacaaagcuaauuaggugugauguuuuagauggaagcagaaagaggccagaggcaaaagaaaagacaacuguacacucuuaagaagagacaacuguacacucuuaagaauuugauuuugaaacucuuaccucaggagguuagcaaguccuacucccagcuggccaagacccccuaggugaagaagaaaacggugagaccagacuguaaaucuauccugagcaucacaguggaauaugacuccuucugucugagugaguugaaguggggugggguuggggaggcuggggagcugaugcagauguugcagacugcucucugcagcacugcacuauacucagaacauagauaggcuagccacugcucaugauggaguugcuuuccaugcaggugagaguuuuggaguugcccaagaggaagagggaagcaaggacacaagaaaguagcauucaugcagggcccagcuccaaagacgagaaugcaagaaaccaugugacaaaaggagccgggcgugguggcgcaugccuuuaaucccagcacuugggaggcagaggcaggcggauuucugaguucgaggccagccuggucuacagagugaguuccaggaucggccaggacuauacagagaaacccuguauaaaacaagacaagacaaaaggacagguggugacaagcugguguaguaguacacacccuuuagucucagcccuugggaggcagaggaagguggaucucuugaguucaaggcuagucugggacagccaaagcuucauaguagacagauccugcccccaaaauaaaauaaaaucagugaggagccauuuauaaagaaaugauacuaguaucauuccuuccuaauuuagaggcuggaaccaggggcuaggaacacauuuggaggaggacaacuguaaaauucagguaagacacuuacauggcagaaagauagagccaguaagacucccugccaguuaacacagggcugaaacccaggggccccaguggagacagagaaugaaagaaaccugcagaaagcagguuaggaaaggagugaaaacauggcagagaagggagaaauagaaugugucaaucaaaugagagguugccuugggcugcuuggaagcacggucagugacaacacgaaguuuguagugaagagggggugggccaggcacucgaugcaacaagaagcuugggcagugcuuauauccaguuuuguuuccaaaaguacaguagcaguuugugauggguaauucugagcuuaggcuggggacucuggccaaggaaagaugugccuacaugaaagauguguacccuuccuguccagucagcuuugcugcccugaccuacuauguacaauauggaaggaaaccaaguuccagggcagcuauuuggcccuuaugcauauucagaaaacacgauuuuguuagggaaagcaaacacagaggaagggaagcuaaagauggaagaugucagcuagagccacaccauugugcaggacggucagcuagauccuccaguuuaguugaacuguuaauuccugaagcugggagacuagguguuagacuggcucccugguauccagacagagagggagaaaagauguaagcagguaacaaagauggugaauuuccaagaugacugccuucuuccuccccuuccugacccccgacaaaagccuagaggcuuaaaacaaaggccuugugggcuuuucuuccaccaauagggcccuugaagauggcucaacaagcucaaggccagaucaggacauaguuauacaacaguugugggccagccaagcugucuuucuuuaaacuggcaaaccccaaauuagggaaggaaacucuugagagucuuuaaaauccccaguccucgcgcuaagagacuagccuuuuggcuucgagucccccuccuggucucccccugcuuugcaggcaaguccuucucugugugccugaccuauauguaucuccucaccccuaacaaaagccugucuucagcuguugcuucuaucugcugguugagauuucucugcugcuaccuguagagcucgagaauuuuccugccuuuuaauucuuuaacuggaugagaaagcuaaccccaucaagaccccuagaugguaacaaaacuacaauaauuugguuucaggacuaaaguaacuuguuuuucuguuugguuccugcccuccucauccucauagguaaugaagagacaucucaacugaggacuuacuacaggcuacucaucaaguacauggcauagacucaaucccauccccugagaccuggaggaagacucccacugugccauuuaugucugaacuuucuuggguggcccuucuaugcugcugucucccccucuacaguguuaauaauuccucugauaaaucucuuaccccaaaagaac

SEQ ID NO: 7526 - RNA, 6503 nt, Mus musculus
ccucuugccagagguuagccuagaagaacagguagcuguuugaggucacccuucccauagcauuaucagggucaucuccuuaguccagagcauggagaaagagaauaauaguucugcuuuccuuuaucuucugcaugucuccuucugaauagauucaaaccacaagagcucuuucccccauuccccagaggucauguggaaccucacaguuccauagcccuuauagcuauccuuccaucugcucaggggagggugcccaaucuccagccgaguguaggucuuaugguacaugcaagcaucuggccugguuuuccaggauguaugguguucaaggccacugagacagaccagcaagaugagagcuggggucuugaccuaacuucugcaugaaccuuggugcuuccaccugccacucaccagaaagggaccacaggaaacagucuggagaauagaaacugguuagguugccccaagucuuggaugagccuucuuuccauggagccucccaaagggcaagcccucugcuauuguguacuguaaacccaugcuccaggagcugagguuugcugagcuuggggaaaguagcugaggagaaagggcccccuucucaccuuuuguucaccuuugaccuggcugaauuuagcugcucuuaaccucuaguuugcuaaaguccuuauugccuuaaugaccaccuaccaaacagucagaaccaggcgagaagucccucccaugacauaucuuggaagccugccuguccccuucacgcugcugugccugaaaggagaccacacucccucuccaaaauccagggccaucucucacugauagagcaguguucccaggcuaaggacaaacccaggacugcucaggcugagagaugcccagugcccaugguggccacuguugacccugcuccauucuuuggucuccacugcuucagaucuggacuccucccuauccuccaccuccaccucccgcccagagacccuuugccccaucaugcucagugcuguuccugaagaccauguagacuuuucuguucucuggaacauucuacucaccuucggcuguagcgcauccauuccuucagccucuccaccaagcucuuuaagugaaaggcaguggcugucuucccuuggacaauaaugaauguaucuacuguaagugcagaccauguagagaaguggcuggguucagaaaaaaaaaaaaagaggguuuuuguaaagccuguuuauuuuuuuaagucaguuuugagcauuucuauuuuaucacccuucacgugguuuuggggaacccaaauuguaucaaggucucaugccaaaacaagccaaccguugcuuucuucuccuuucuccuccaugcaccaugauuucaaagauuguuuuggugucguuuuaaauguuuucuugugacauguacugacgauaaaagucaucuugacaaaaaaaaaaaaagauuuauacaugaaucagaaaguauuuauuucaauuuuguaccuuuccauuuuaauacauuauaauguauugacucaacugagauaauauaaacaguucauuuuaauaacaugugugugugccuuuuuucuuuuauauauaguuggggugggauaaacucuccugggguggaagacgucaguguuaacuggccuuagggugaccagagggaguccuccccugcaacagaagccucuggguugggggcuggaagcagcuggugcuuuugggagaggaaaagaugcuaaagcaaggaaggauggagguaaguggcagccuccugggcaacgcugaccccuaccgugcucuaccuuguacuggucuccccucuggccugcucacucuggccuugcaaaggaaauccagagacacuuaaauugagaaguuagagaggaagacuccauacuaaaaauauguguaagggaguauggacuaaaacguucuggguuguguuuucuggacauaaacuuuuccuuccuaauguuaaaaucccugcagaugacucauagaaguaaaaugccuucagaccaacccaggggccugcagcaaacaggccucuuaugcuucuauuagaaugcuuucuggagugcaucugcaugcccauauucaugcugauugacuuuggagagcaacaguggcugcuguuccucuggugacaaccucagauguuguuccucuggugucuuuuaccuuuuguuugagggagggucugucacugaccuagacccucaggaaguauguuaagcuaguggcuaguaaacucuagggauuuggcugucuccacuuucuaacuugcuguggaugggaucacaagcauguacaacuauaacccaccuuuuuauguggguucuggauguuugagcucagauccucauacuugcaaagcaaauacuuuacccucugagcuauccccuaaccccuaaucuagcauucuauugugauguagggcaaaacacaaaaugggauauaaucauacuccauuuuuaugucuuuugcuggaagguggacugaagguggguggagcuagcaaggaagcagggcaggggggaggagagaugugucuaugggacugcaacugcuuuuaaacaucugcagcaaacagacagcaguaacaggaauuauggacguaauccucuacuuucccuugcauaucugaacaugguucauuucaagccgugcagucugggggaaaggugaaagcacaugauuugagagaaauucacaucaaagucagggugucuuccuuuccuaggagaagagggagagggagcaagggauagggagaaaggugcagaaagaguacuuugaucagacucagcuguccacgacucagagcgguacacaagucucaacaauugguccauaucccuugauguccuauuuuccuagguacccacaacuuucuacacauauaaccuuuuuaaaaagcuucauuuuugauuacuuuuaguuauuuggacugagaugugaaauggagugcauaagucaggagagggugcuggauucucuggagcugaguugcaggcaauugugagcugccuuacgugagugcagggaauugaaaccgggucuucugcaggagcaaggauuguucuuaacuacugagccagcuccaguccuauccucaugucuuucuauguuccccuucccacauacccuauccaucuuucccaggagaaacacuaaaagcagcagccugccuuugcuuuugaaucucucacccaucuucucucuuaaaaaauaugugauccuagcccggggugggguggggggcugacgacuaaauuguuuuauguuucaagucaauaauuuagaaaugaaucaguugucaauaauauaaaauacauauuaguccuaugaagggcaaaucugaagauguaugcaccggaaaaaucacagggauuuccucugaaacacuuuucuaaaauucuucugcgcugguggcaauuuuugacucacaguauuuucagcuguuuaaagagaggcuggguucugaaaaaagaugugugaggcuuguacugguguuuguuaacuaagauuccuccuccaagugugagugcauucacccuccuaaauaucugcauccaaggaaaugacaggagauauuguccucaguuauugugcuuuggaaagacgggucuggaacugaagauuguugcucugugccaauguguaauuugccugucuuaguccauuugagcuguuguaacgaaauacuuaaaguggcuuauaaauaacagaaaauuauccuucaagguccuggaggcugaguccaaggucgaauggcugccagauuugguuucuaugagggcugauuccugguuaccagaggcugucaugcugcugcauucuuagagcauaugagagaagaggacaucuggcuucucauucucucucucucucucucucucucucucucucucucucucucucucugaaaagcaccaaucccauccugaggcuccuuggucaugaucaugcacacacacccuuaaaggcaccacuuccucaucccaucuccuugggggugaagguuucagcccaugaguuagucuccuuauagugggucugcucuucucucugagcuuccaugucccugccaguugugggagggacuauugcuaacaauccccgaagcuaccagggccaacugcugccaugcaccccaucccuaggagguuacugaccucuuaucagccccuggccauucuguguaguaaagaagcaagcaugagcauauuuucugacgacaagacaagcaucgauugagccauucccguuucuaaccucccucucccuuugcccaucuuucuuuuucuguuuugagcugugacaacuuuuacuuuuuaccucugauguuucaaaaaagucaccuugaaucgggaauuccacucgggaauuccacucagcacagucuuucuuccugggaacagcacaccauggcuagcucuaggaaaggauacggcgaccccuugcucagucagguucaggcuacacauggcugaauuccgagccccauuagccaauauuaauaaugaaagaggaaugacgguagaaggcacaaaugaaucaugucaaccugcucucuucccggagaaucacugaggauuuagcagagagcaggaguuucacucucacagcuacagaauauuuuuuacauaaugcaugcuaaacuucacacugacagucucaggaacuuuuccgguugccuuuuauuucuacaaugauuaaauaauuuacuagcuuacuuuuuuuuuuuuuaaucaccaagacuaguuucugcucuaggcaaagccaggauagaaacagguuccauacagugcccuaauaaacuugcuucagacuccagggcugcguggauugcauacuuuccuuucuguccucuccacacuugcuccuccaauucuucuuaaacugggguuaauggacaauagaaguuuacgaugcuccccaaagauguuuucaaacaaacaaaggacaaagacuuucaaagguagcugaugcugugauccagggacacucaccaggaauucuacucuuuggugaaucugccuuguccuguaaagaucuuuuagagaggagugaggggucauacaucaaagcugguguccucacugaaugugaggaaaugcuccugugugcccuccuucuuuaaagcucaccguuuaccugggcuugggcuugguuaucuagaacaggaacccuggcccagggaaagggaaaggauuuggggcaaagcccagauauccuaaguaggugauuuggucagacccagccccauugccacacggucacauuuacugccucuucuuucuuguuaauaauugguggucaaguacacaaucauucuuggcugggggcuaucaauguccucaucuuacagguagguaaacgugacagucaugccugauucucagguccuccagcacagcccuauuucaccagcacacugcaucauagaagaguugcccugagugcaucgggggucuacaugguaucuuguuaggucugaugaaaaauggaugugaccuuccuaaggaaagacaaaacgagggaagaagagccuuuggaagguaagggcacuggccggugcugaaggcauggcuaaacaaagaagauuugagaaaagcuaaggucuauuuggaagucgaagccuugacaaagaaagggacguugaagggagaggcuagaggaaaaaagggcaaauaaacagcgugggagauagcugaggucacaccuuuggaggagacaggacagcaaaaagagggaacagaaugugacaggacgcauugagcaaaaaugccagggagagcgauggaacugggaaaggccucugggauuuaagucugucacagcgaagaccacgaaagaguuaacauuucucggccggccguuaagcacaaaaccacgguguuucauuugacuuugccagcuagguggcuguuucugccuucucucccucccucccuccucucucagcaucccacaaugggcagagguagagugugaagagcauaggucccuuccagugccaauaccuuccucuucggccgucucuccagcucuuuaaauguacccaugguucacagaaccccggacaacucuaagguugcuugcacacccgcuuucagaguuaaacugcgaacugcgcacgaaccagcucugccccagcccuagaaagaaucugugccucagucccccaaggcggguccgccccuccgcuucaugcaguugguagcgagucgcgcguggugacgucaguaguacgcgccccagcgaagcucuccacccggcgugcuuuccgagccggcuucuuccuuaaccgcgcuucagguuccucauaaccgcugggcgucaggccagaggcagcguucgacaaacuugagacaaugucgaugcuagcagagcgugagugucugccgagcuggacgaccgggugaugggaugacgggggcgcggguguucaggcccgaguggggacagcagugacugccgggcccgcgagggaca

SEQ ID NO: 7527 - RNA, 59560 nt, Mus musculus
agcacuuaaaaaagaaucuauuuguuuauuaaaaguuauuuuauuuauugaaagacaugaucuggaacauucaaaucaguucuccuaggaaggugaccugggggaaauguggaaauguggugcguagaagcagcaaccugugggcauguuaaaagaugcugagccaccugggcuucgccgugcucucacuucaggcccugcagugugcugacaguugagugguuggaggccacaaguuaucuggaaacuuucuucuucuucuuuuucaccggugcucugucuaguguggcgucuauuucuacuccuucuggccuuugcagcuuuuucuuugcuuuccucuucuugggcuuugggacaucauccuggaugucugguguuuguacacaaucuucugcagcuucgacagaggcaucggaacacucguccucacuggggccuccaggcugcagcucugcucggucucucuucuuggccacagggccccucucugcuuccacacgcuuuuucuuuuuaugccucuuggccuuguguuggggagaguucucuacaucugugucugcugccucuuuguuuuuuuucuuucccuuuuuccuuucaacaggggucucugaaaggucagacccuggagcugaggcuuguggcuuguucuuuaauugggccauucucuuggcaaaauauuccuggauggugaaggcacuagugguggucgugguuguggucagggagguguucaccucauccgcagaggaguugcugcagccauccuggggacaagagugaaaagugauuagcaacacucauucaucccaugaaguagccaggaggagccacccgagcccgcucaugagggacuugaguugcaaaaccuacacucaagagaaccauguacagagaaccauauagggagaaggccggacagaccucaucuggcaaguggcuucacagacuuuggaagaaaccuuacccuagaaacaacagcguaaaugaggaugaaucccagacaccagggacaugcauguuccagagcuccgugauucugcugguccuucugugcugaccuagaaacucggacaucgugcguccgagcacacguggcccggcaugcucugcugcugucgcucucaacuacaaggccgcacacauuagauucuauguuuucuugacauaguagcccucaaaaacuucaauggaacuaaaauuacaucucuguuugaaauucuagcagaaucaacauucuacugaaugacaacuggguuuugaguagccacugcagcucagaguuccaucaacuccaguacagaucaaaccaacacuggcuguacauuucccagcucauggcucaaaaaacaaaaaaacaaaaaccaaaaaaccaugcagucaauuucgagauuaaaauaaaaugcagaacaagugagauaaauggggagaaauguaaauacucucaaggguggcuaggaagucaucucaguugucacacaagcaugaagaccuuaguucaguccccagggccacuuuaaagagccaggcagauccaauugagggcaucuguaauuccagauggaggagucguaacaggccaaucauucagucagggagcuccaaguucaaggagagauccugcuucaaaaagugacuguggagagcuacugagaaagacaggcaacacugaccugcuagucuccuuagagaccagugguucucaaccuuccuaaugcuuccacccuuaacacaguuccuuauguuguaauaaaacuauuuuauugcuacuucauaauugcaaauuuuccacugcuaugaauuguaauauaaauaucuguauuuucugaaggucuuaggcaacaccugucauuggacccccccucccuccaaggaaaugugaccuacaacagacugauacugaaggaauccagagagugccugugcacaugcucacacacacagacacacaaaaccucugucagucagcaaauguugcugguaucucaucaggcuauuuugaaagaaauagaaauuagcagccuuaggacuccaaaaccaggccacucaguccuuuuguuccucaaauguugagugaggacuggaauucugcaugacagauugaaauaccuucuuaaggcucucaguacuugccaaugccagacugauggacaagaaagaucuugccucccauguaagggcacacacccauagccaugcauagacacgggcacugggaagguggcccaauaauguaacagaggucucauugauggcugugugccaggucugagguugggccuuguguucagcucauauaacccuggcuccuuguucuuucacuuauuaccuucagaauuccaguucucaaucgguuaauagcaggaacuggcugcugguguuaaucacccuuagcuauuaggaaacagaccauuucugagucacuuacucaaucuccugggucucuaaucccaggaagcaugggccuaagcaauuccucugauggggaggugcugaggacucaggcucagcacucagcucagcaggggaggaggcauggcugaguaccagcacucacccucucagccuggagaguggacagagccccugcggggagagcuguccagcaggagaggcucccucccucaucauuggaaagcuaacucuuggugaggcuuuuauuucuaguaguuggcaaucugauucccgagggagcagugcucaugacucccuucuacacacugacaacuggaaaccaguuucgcuauagaguauaacccuggcucuguaaaacauaacaacauauauaccuuuauaagaaaaugaauauucucaaagcuggucuaacuucaaagcaaacaguuaccuuuugaaaaagcauuuagaaacauuuccauuaaauauaagauacaaccucaaaaaaauccaaucauacuuaaaauuuucuacucuguacauguugacaaugucuuagguucacagugguguuuuagaaacuaauauaauaaccugauacuuuuggguuuuauauaaaauaccacaauaggaggaaugacuaaucauuuugccaaacauuucaguuaaguucaagggcucaggacaucuaucucucuuaaaaaggccuguuggggucucagcuacuaauccaauagggaggugaagaugagcucccuggucccucugugugcuggcagcugcucugugcagugcuggggaccagaacagaaccaggaaguucauagcaaacuuacucugaccaccagaucaagccagggcaacaggaaggucagcuuagugcauccacagaacaaaacaaacggguccaccaccucagagaugcacuccucaugauauucuguugucagagggcugcaagagucacccacacaccaggccuuggagggaaugguacuaugcagacacucacaaaucuguuuuaaacucggugaaaaauaaucucgagguuuugucuucuaugaacaggcuagaaggugggagccuagauucccaugguuacuucugagguucccuuugaggagcgacagcuuggaagucuguaccaauccuuuguaccccugaaguuggggcaggcuguggugggaaaguaugguuucuggaaguguggucaguacucuugaguugcaaugcaagauucccauggucccacucuaacaaccugaguuuuaccagcaguaaagacaaaugcagggagauauguaggcuuucuccugggcccagggaaggaaaaggugggagagcuuucugcguggccccaggccucccuacguggcugugguugagcuucuggcaugggcacaugucauauguaacuauuauggcaguuuucuaaagaaagagcucaggggugaggggauggccacagaauuaacacugucucuccauugucccaucuucuguuucauuuacuauuaggaagaaaugcuugcagaggcacgugcagaagccugacguuuucuauccauuucugaaguggcucuugcuuuugagcuagugcaagaagcagguuccugguuaaccuggauauucagagccucugguuuccucacuuugguuagaggugcugaguacaguguguguuuaaaaacccuaauggcagguuuccuccaaagaaaacuagggccucacuucuacccaaucaacaauauacugugggucagaauggaccacucagggaggccugcuccucacuuuauugaguugaaaauuuaaggaaaaagaauucuaugagauaguuacacugagacauacaagagaaaauuguagccaaagugcccauacccagcuggacugaagagggcagccaccaucagugugccaggcacuuagcauggcuccaggaguggcucaugacacgacaagaacaaccucuguccauuacaagggccuaagagagacuuggggcacaggcaccuuaucuacaggcacggaaggagcagguccugaugccgugcuauguggugcagagcccuugcuccccaccaugguguacugacuucuaaccugcauaagacucauguaagguguuagccuuucucuucugaagauccugaugccaaaguguaccuacuguuguauaaccuacagacaaggcuucaagcucagcucugagggcagauuagcugaagcaggagcuuacuauagaaaaacaaacaaacaaacacuccucuuuaagaucaggaaaaccagauuaucaagcuuacaguucacaaauauaauaauuuuuaaaaaugccccgaagccaggcuuaagagguuuguaauuugacaaauuaauauguaaauuuccuuuauagaagcucuuuauguuuuuucccccuuuauacugggucuugcucaggcuggcuucaaaguuacuauguaggcuuggcuggccuuuaacucacaccugcccuuuagaaauccaauccucucuugggcaucugcauggcugccuauucuguguuagcaugcuuguacucuuugacuugguuuccucaucagcaaugggcaaagucaaguacuuggagggugcacagugugaggaccucaaugacaucaaucaaagaaaggacagugauguaaaaagagauaacucuaacaggaucuacggugggaacugccuguugccacugucugcagucuggagcugcaaagcacauggaccaguuuguucugucauuccuaucugaaggccugguggcuagggagccucugcagaagcccuacuaggcuauagagaacucugcucaugcaccacuuagacauguacacugagauggauugccaggaaaaugccccaaagagguuuccucuuaguacucucaaaacagucagcuuguuagggggcagggaaagcaagcaguugagagaggacuuagggagguguuuggagguggugcccuggacaaauguuagauaugugucagaggcaaaccuuucagcucaccuuagugacaggaggccagcagcuuuugaacgagguaaggcacaacauuaucuccagugagcucugcucagaagacagacucccaaaacucaaggguaacagacacucaaggguaagagguuaguaguucauugcuguugcccaugauaagccaacuccugcuuccacaacagccggucugucaccaacuugugcuggauuagucuguggaaaguuaaagaggcuuggcaagggagcaguguauaaaaucagaacacucuguacguuuuccagacucuucaacacaacagucugacaagcccaaaugagguuguaguagaucacugcaaggcagagaccgcaucugcucacugcaggcagagauaagcagguaugaagugacucugugaccgaccaggacaaagacaaggccacacugcaugucacauaggcuucacaccuuccaacagaaggggcagaauggacugauugaguuaccugcuccaaagcauagauggucucugcacuacagaacuuagaacuucccucuagaucccucacaauuauguguaucacuucagcgaugggaccuagaaucugcacagaaaccaauguccacaagcaccucugaaggauuaucuagauuggguuaauugaggugggaagagccacuuuaaauauggauaguaccauucuucgcacuggggucuccuugauaagaaggagaaauuccauuuccugaugugggggcagcgugaccagccaguuccuguucuaccacgcaucuucgcugcuacacggacugcauccgguagagaauaaaccuucccuuaagcugcucauuuuuuucugguauuuauccaagcaaugaaacacaacuauagcaacuucucugaagauccagugcaagccucaggcugaccuugcagggcuguccccuugguuacuacccacaccagcaacuagcugcuuuuauuuuccauuuuugauuacuuacuuguugauugcagaggccauuuuuauucuacuuguauucugcauacucucuaaugagaaaggcauggacaguguucaacaaaugcaucggauaaaaauguacugccgagagauagagaagagcuccuaccacuacccacccaccugucaggcaggcuggcaccgcaaggggcaugagagugcaggaaggcaaagugaccagcccuugcagagccugucuuucauccagacacagcuauccuuucagucaaaacccugcccuacgauaagcacugcuugcaaggaacaagaauucugucuggugcaguguacaaauuaccaucguaacccuuagcaauauauugaccucaguuaaaugaccugaguauuucucuccuguuaccuacuuuccaggggaacugucacaccuccugugggauuagcuggacacaucaauggccuaccuggacugaacuguuuuuaguggacuguacagcaagagauucuaaagcccaagaaagccacaaggaggacagcucuuuggacagcaaaugaaguucccuggccugagaucaaggguuggagaggcagcaguccaaagccucagcuagaaguaggcacugagccucuggggcaccucugugguuuuauccauccccuuugcgguuucaauguucuuaaaagagugcaaugacuuacaaagaauuacuuuuguacucacaaagcuuguucaagcauaaaauccuguacuuuuuuugugugacauccaucacacaaauuuagaauugggcuaaacacauaaagccucaguaguagccagccuaaggaauuugcuuaggaaacucagucauucaacauaagggaguauaugggaaucaaaacaaccugaaagccucuuauggaagauaaguuuugaugucaagcaaugaaaaaugaaaacucagggcuaccauuaauagaauggaaauugugcuaugacuuaacaggcaugauguguguacaugugugcaaagggguacagaacccagucacauguaagaugcccacugugcagagauuugaagaaggagcucccuaaaacagggacugagaaauuacugcuguggguucucauguucaccuaaguagauuuauuuucacauuucuaagaaguugggcaagagaaccaaaugaagacuauaucauagcaugugaaacuacaugaauuucaaauaacuauaaagcccaaauuuccucaguaaaauauuuguggaaauauuuucucuuuaguuacacaaguacuuguuacaggugcugggugaacaucugccuaauggauauauuuuaaaauacaaucugcuuuuaaaaccacaguacugacagcuuuuggaaauaccagcuguuuuguucucucucucucucucucucucucucucucucucucucucucucacauacacacacacacacacacacacacccauccuugguuucuuuuugguauuaagguucgaauguguucccugaaaguucacguguuggaaacuaaaccuuaauacucacagguuaagaauauuugaaggcagggccuuuggagguagugaagggccacaggcuuagaugagugacuuuccaagaagacuaagagacaugagcucauacguuuguuacugugugaugcuugcagccauaggaggaaggcccucaucagauacugguaccuugcuaucaaaauucucagccuuugagagauaaaucuuuguucuuuauaaauugccucagguauucugcuaagauggcagaauauaaacuaaguggaaaauucuaguaaauugcuugccauucugaaucagugcaaugaaaucuuguccaucugccuagaucaugaaucaucuuuugcccagugaaucuauacuauauaagcuaucugcacuuuugucauuuugauggcugccuaugcaaugagauguugugauagcauaguacuguguucagggauccuccuccucuuuuuccucccuuucucuucccuucuucuuuuuggguaagagcucauggggucuaggcuggccucacucccugugaaacagagucaccuugaacuucugauccuccugcuucuaccuucugagugcugggauuacaggcauguacuacaaugucugguuuaugugguggggaguauggaauccaggcauugcucauucuagacaagcacucuagcaaccgaguuacauucucgagcccccuuauuucucucaaugaacuuuaaagucuaaagcauaagaacagcaaugcuggcaacuugaauaugccaaaacuguaaaguauaucuuuuaggugaaaggcagaaguucuuaggggaagaagaugaaccguauacugggguugcuaaggucuauagucaaaaugaaucuucuaccaaacuuguggcuauagaggaaaacauucuugguacuguugcacuucaggcaguaggaauggcuccuuccacccaaggcugcaggcacuuccaaggucucaggaacacacccaccuugagcaaugggagacagcuggaaacccuuggaacugagggagggcuuuagcagucuuuugcuaaugacgaaggcuaaccuagcaggacugggccacugugggcuuucaaagagcagggaacaauacuccuggaaaacacaggugaucugccaugaaugagaacucugggucacccugggagcgugcagagguuuccuucgaguuaggcacuggguuuuuccuuggaauucauacacagacaaauggcccucuguguaggaauggaagcaaauagcaacucacuuucugcaggccaagcuccucacgugaaugccaauguuaacaaagcugcacauuccucucuuuacuucuuuuccacucgccugucagcugcuuaagcuaccucucauuaggaaaagccaacauaaacauguuuuagaaggaccauucuccauggcaacaacuuuucaagucaugacaucagaaucacugacaagucaugccaccucuggggaaaagagaggaaggaauagagcaguuuccggccucccugaaagguccucaggcuuagaagcugcagugacucacauggcagcaucucaucucauacuggccacaagauaaacgaggcucuuccaaagcagaagugaucaaugugacauaggcaccaacuucuuugaaugaaaucuaaaaauaauccacauugacuguuguuuauaauucuaggucaacugguucucccccagaagcaggacacauggcuuccacuaacagcuguguagggcucccaucuuccagggaguucugguuccuccauuucuccucuacaggagacugaaaaaagucacacaggaaacuuaacagcucaaauccuaaaagugcaaaguaguuuaaaaagacuuuagacuguuguaaauauuuuaaaaucacugcauaagguaucagaacucguuaaggugugaaacuuuagagagcagggucuuaagagcaaagaucuuuguagaguacaacaccuucauuagacauaauuggucagggugcuacucaaauaaacacguuuaagagaauaaaauugcaaagacccaagggacuucucacuucuuguauacuauuuaagguuacuaccuucacagacucuuuuuaacucuguaggagucagucuagacaaucauuuaaaauauauucuuaggaauaaauguggcagggaaaaaugaauuagaauucugacuacagugacucugacuaagcggaccguagcucccuucccuucuugagcuccuagagcuccuagggcagcacagagcacaaguggaaaacagcagcuaagcuugacagccuagacuauuucacaucacauccuuuagcaacaaguaacuaacaagcguucaagaauaaaaccagauuguuaauauuauguaguagaugcaacauugaaguguauacaaucucaacuuuaggcaguuguucauuaaaacuauucaagcaaucacuucuuccaaagacauuaacacauaacaacccuugauccucaacacucaagucugaaguugaaaacccauuuucugagacaccuacugggauagauagguaagcaaggaggaacucaaggcuggacugcagagaggacagggauggcuuaguuaucccuacuccuacagauggcaugccaggaacauguccucucugcuagcuuuccccaugcucuaagucaaaggaaggcuccgugucacccuauuuuuaugaugccauaggcugaaaaccuacgagagaaugucacggccaucuccauagacagagggcacaugagcuguuauucuacucuucugcucccucaaccaggccuucugggugucacuuucucauuaucacaaaggcccugaaaaacagcaguuugacuugucaacaaacccaaacucaaaucuaauccuuucagacccaacauguguccuggcaaaacgcuaagcaaacaaagcaguccuuggccuagcgcacgggcaccuggcaggccuccucaugcuugcugcuucugugugccugucuaaagcguuuugcugugcaaaagcuacaugugcccaccaggaaggcagcucacuccucaguggugcugcugaacaacuuugcagacggcggcuacaacccacuuucuccuucuaggcuacuccagacugaggccagcccaauccuguuugaaguucuggcugccaggagauggccguuuauguccccugucugaggacaggaaaaggacugagccgugugcgagggagagauaagagcugagauuucuguccucaguccuuuaucagcccuuccugcaacuuuccagagcagacagcaacaugacaggcaccgagcugaguuagcuugggaggccugggcucccauggcuucugaugaggaucaagguagggaggggugugcaaugagcuaagagaaaguuuuuccuuuaucuuaaaauaguuuggcucaaacaaaauugcccuuuucucuguuuagacacacagcuaucacaucugcuuguuaaagugcaacaacagauauggguuuucauaacuuccuucugggugaaaugaagcauugcuuuccuuguguaggucccugcccacaguucugugcuaccagcucuugggcacguagcacagggcccguccaguggggguccucaggcuggugccuguaaaguuccggcugcggagccagugucuuccacaugcaugugagacuccccaccuccagccuugcuuucucaggccagcacauacuuacagagggcugacaauuccagcccacgcugaaacagaccaaaugaggccaugggagaacacugaaggcuguuggugcucaucuguaacaugucacaucugugauacugaggauuacacucuugggaccugggccuuucugacaaaagacugaggggcaaccauagcucauggagaagaaucuacauuaagcaguaaauaugcaaaaacugaaugguucucuugauggaguuguugcuaaaucuuaaauguucccauucuguucacaggggcagguucuuacccaagaauaauacacuacacauaagaacaguagaaaagcagcagugaggaccugguguugcacacaguuggcugcagggaagcugugggguaagaacauccccaguuaucucauuaaauaaugggaacaccugugcccugccuuagcuggaaagccaauccuccacuggaacggagcgcagcaggagacagcaugucaagccgacugccucgaacucagccgccuuggaggaccacaaguggggagcaggugcaguucaugccaccaggcagacagcuacuggcaaagacaagagaucuaggggcugccuuccccuuacagccugcuauaccuccaaacuauggaacagugaggaagagacugaaaaaccaggagaaaucgagaauacaaccaggaggcaacagauacaacagauuugauuuaaacaauucuuaaaaauaaaaugaagcaaacuugauuccacaaucagcuggcugaaugcuacacauaaagauucucuaugacuuuaaauccuaaugauuuguacauacccacgugguauucucuaagaucaaggaguacccauucccccuuagacguccaccacuugccuuuucaccuuugguacucugucugugacacuguacaugggaugggggcugagggagggacgagucacauggcacuggggugugugaggaaagauaaaagauaacuaagcacaaguccuaaaguccuaaaucugaacaggcaguccggugauaaacucuuauuucagcauaaaaacaaaguuucagucauaugacaagaaguagaggcuaggcucuagaacacauggacuacccuaaucccuagacugugaucuccaaacacuuagggagccuggacaugggauggcauauguguaaacucuuaggucagaaugaaaggaagccacccaauaccacuuacugcaguaucaaaaguacucaggucacuauuuucauacagaaacaccaaagauuuccauauugauucuuccacuucacugaaaucuuucaucucaguaauuuucuagugaaaucauuggugauacauguaaugacuauguuaucuucaaagagauaauuuuauuucucuuucaguuugaagauuuccuuucauuuccuuuucuucucugaauguccuugccaguauuuccagcacuauacagaacaguuguggugacggugagcaggcacagugccugcaccagaccuuagaaagugguucucaauccguguguggcucgcauaucaaauaucuacaagaugauucauaacaguagacaaaauuacaguuaugaaguagcaacaaaaauaauauuaugguuuggggucacugcaacaagggugaugguguuauuaaacuauuaggaagaaggagagcuacuguuuguaggaaagguuuucuuugcuuccuguugacugguuugaguuuucauaaauggucuuuuucuuauguucaggaauuguucuccuauuucuaaacuauuguaucaagaaaggauguaagacuuucccaaaugccuuuuuuucuucuucuuuuucuuuuauuucuucaaaauaauccacacugauuauuuugucuauguuuaauaaauggauccugaaaacuagauuuccauaugcaaaucucccuaucuuccacaacaaauaagcaucaacucaaaacaggaaacucagaagucauaagauguagaagauacacaaaaagaggccuugucuuuaggcuugacagugauuucuugcacacuguauuucaaacucaaguuauaaaagcaaaaacacauaggacuauagcaaacuaaaaggcccuugcacaggaaagaagaccccaccccccgcccccgccaagagagaaaaacacugugcuaaacagaaaugcaguuuguaccauuugauggaaagaaagcaccacuucaucacaacaggcaaaugcaaggccaacaugcggcacccacacaaaagguaucacucaucagggaacagcaaacgcaaggcugcuguaaaaaccacagaccuaaaaaagguaggagauaacaucagagaggaggaaagaaauagcauggccauuuuggaagauaauaggaaguaacaaugacuaccauaugacucaacaaucuuuccaugaaggaaauaaaguccucgucucagaagaccugcauuccaggauuuacugcaacauuaagucuuucacugaccauaacucaaaagacaguauacuguaagaaagacgauuuucuaaaaagcuaauauggagcugaaaagaugauaagcagcuaagaauacaagcugcucugcagcucccagacccauaugacagcucacacugucuguaacuucaguucuaggagaccugaugccauuuucuggucuccaugggcaccaggcauguggugcacauacacacaugcaagcaaacauucacacauagaaauaaaagcaaaaaaaaaaaaaaaaaucuuaaaaaaacaaaacaaaacaaaacccaaaacaccuaagauucagaagcagagaaaaaaaaguauggguaccugggcuggaaaugaagauccaaagacacagacuagcagccgacugugagauacuaaagguagcggugaggacuucugcuaagugacucauagcugcuucugccauggaggagaugcauaacugcggcccuaacgagggcgcugaugauauauauguucacuugcuuuaucaccaucaguuugcuccauacaugcauuacauaacaccacagcugcgcucuucacacacauccaauaaaacuuguuuacaacacaaggaaguaccugggaacuaaccugaaagguucccauuagacaaagacagaaaguuugcucacuagcaaacaugguaguuaagaugugcugguacaaauacauguauuccaaugugcgagugaucuagaaauggaaaauuugccaguuaccuucgaggaacacuggagaaccucauuaccauucugaaagcuacuagaucaaggagcugagcaaaagauccaucuuauuuuccuacagaaaucaggcucaggccacucuaaaaguagacauaugagaaauacugauucuaagcaugaaggaggaacagaaagagauggagucagauugauguucauguacaacuauuaucuacuucuguaugguguaauaaugcuaauagacuuacagauuucugccccuuacuuuuauguguuuauguguaucgugcagguauguguugcaugacuguguccacacaggccagagaaaaccuguccaccuuuccuuuuguugagacaauguuacucacuggcaugggacuugccaagaaagccgggcuauuuggccaguaacacccaaggauccucuucccgcugccccaguacugagauuacagucauguucuacuacauccacucagcuuuucacauggcuuuagguccucauacucaggaaacaaggacuuuaucaccugaggcaucaccccugugaguccuuaucucuuaagauaauuauuuaagugcuacacuaguuauggguaaaauucuggcuucucagauggcugcuucaaagcaccacgugggagaaguagcacaguacuugccccucaauggccaugacucagacacaucuaaaugcgcuucccuaaggccccgcuuucacuggaucuacgucuuugcugguaugauauucuuuuccuccagcugcccagcuacugugaagauugcauccuuggcuucugugagucaagucuaucacuaacauaccugucaaagcccuucaacaucauacuucaggcuuuuguuccagcugaaagucugugccuuggacuuccugcccauacuguaaguggggcuaugucucacucauuucacaaucugucaccaacaggguuagugugugacaaggaaaaacauuugagugaggucauagaaagaacuggauggagggaggaagcuagcuuggaagaaaaugguuacugcaaaaguaggggaaugaagaagagagauuaaacuaagaucacagaaacugcauaaggccgcucauggcuaaggccuaucacuguggucugaaaugcaaacaauuauauaguaugcacgguuuuggcuaucugguagcaucaacacacacagcugauuuacucauuaauuuaaagagaguaccccaaaucucacccuagaaguucuaaguccacauaaggacugcuaaagugaggucugaaauaacugggacugauaauaacauggugauuaguccaauuccaaguaacuaaguccacacagaaccaaacuguuggaggcugugcuucugccccuaacaccugcuuuuccuaauagugggagugaggugcucaccuaaacuuaaagcacuaauguaacucagugaauaaaaucucuucaacuguagacauuacucauuguuuaaaagauugcaaggaaguacccuaaggcguucaggaacagaguuuuuauguuaaacuuuuuaacaauuuaggaauaagacucauacaagggucuaaaguacacacucuauuuauaaguuucagcaaugcaugggacauaaaagaaaacuaacucaugcuucccagcgucacucagccacuuccugucacuuuccuguggaaagcuugcugacauuaguacccagacugauggugaguggcuguucagcuuuccugcugauaggcagcaaucccauggcaucuaaugcauugaacucagugugacugaagcucauguaguuguuagaaagccacgggggcagcggggggagcucaaguccauaauccuugcccuggcuuggagggcuauggcaggagaaccuccagacuauagacuaagauccugucaagaauacccagacagugguuuggaguucagguucauauacugcuucaaagcccggcgugugaaacccacgcucaacuucaugaugcugucagaaggucuggacaacucagggcaggugaccacagcuggacgccacugcugcuacuuuguacaggaaaaauguucugcuggggcaaagaugaaccugucaaaaaguggcagcucaaagcaguccaagccaccuuagcccugcuauugcuccaagagacugacucagggugaacuccccagacauucggucugcccagaaaggaagaagcagaagcgucacggacggaagacccaccagcccuuuggcuccuaauaaaacaggacuuaaaucuuucagaggaagcaaguuaugugcuuccuccaaccuaaaacuuaacauuugggacaagagguuuuagguuaaagaccaaguuuuuuucauuguuauaaauugguuccaacgaagcugugcaagaucacagcuuaaagccuggaaaccaagaagcacagagucacacucaaggaggucucauuaguuuaagcuaaauuuaaccugcuccuaaacuauucuguggagggaaauuaucaagcaaguuucgcauugaaauuccuuacuuuagaauccaaaccuauuuaagauguuuagacuccaccuaacaguauccaggugauaaaucagcuaaugacuuaauuauaguuugaaucaugaagaacuccuaaggcagagggaaacauuuauuuacaucacuuaaaagaaagcuuuuaagguagcugugagcaacuuaauggcacuugcuuauguacaaacauuugcuguacuaauuacaaccuggucuuagaauagcaaucccacugggacaguuuaaacaauaagcugggguugaagcuguuuuuuccucuagagcaaagguucuuaaaccccaaacucagguuaaaagaaaagcuugaauacaaaggcuuuccacgacagugaccaacacuguugaaugaccaucuggaguaccuguuguaugugcagcccagcaugggcaggguguguguguguguguguguguguguguguguaguguguguguccagcugucucugaagcaaugaacugagaaugguuuucucuucuucaguauuuagguuugucaccaagaaaaucaaaccaaacucauuaugucaggauuggcuaccacaaguucaaggcuguauauaccauuauuacauuaauggauucucugugacuaguaagaugaaguaguaacuuuuauucugaagaugucuaccucauauauauguggucuggcucacggucugucugucugucugucucucucccucauauauauuuucauugauccaaaaagccuuguaauccuguagaauuaucuguaaacauauguuugcaccccugucaaugacuaaugauucccuaaucauuaaagguaaccuaggaagcugaguuuugaugaucuuucugaagugacuaucacuugcugagguagggugaguaguuuauuagugugugcuagggaaagagaaccuuacagcuuggguagacuucuuggggcaauuugaccugacagcugaaugucacaacccuaucugcaaugugggaccacacuccucucacauggcugguuuuugacuucugcuucuaucacacaccaaaccacucagccuucuugguuaacacagcuccugugugguaaagguuggcaacagucuaggccagaggggccagggaagugugagcaggguggucccccaagucccucggcuugccugcugccuggggucaccagccugcuucacuggccguuuacucaccagguuucacacuguccagcugccagagcuguuugcgaucagaccccugguagagggcagcugcuauuccuggggacagauuccagaugaagugaauaacugcugcagggccacacgggacagguacauuuagcuaucugggguguucugaagagcuuuguguggaaccagcuaaggacuugucuccacagcagucucuucuccuccccgcccaauuaugccuccacucuucaucuccauuaugcuuuuuuuuuaaaccaccuguacucauucugaggccaaccaagagccaucugcaacuguccaucucaauuccuuacuaaugacacccucacugacucaguguccagauucuaccccugguagcucagcaccaggacccaguaaguccuuucuacugccugaucauuuuuaagacuaugguaaagaguuaucucucauggcaacaguuauuuuauaaguguuuguggugauauguggugaaacaacacauauguauauuggugacaacacauauuuuaacucaacacuuaccaaucauuaccuaaaugcuuuuaguuaaaaaagaaaaaagaaucuaaaauauuuauuacuauuuguguguguguauggguguguguguguaugggugugcguguggaggucggaaaaagggaacuaguuuucuucuucuaucauguggguccuaucaggucauaaggcuuggcagcaagugccuuuacccacagagccaucucacuggcccuguuuauauuaucugacacuauuacuucagaagaaauccuaucaguuauuuacuaucaccagcucugauuacuuuuucaguuaauagauggcaaagggccacaugaaggaaauuaacgauaaauguauaugguaggguuguuaacuugugucauggaguucagcacaggauuucuucaaacagugaugguauuaaagagcacuaugaagauggacgcaacaaaauccagaauguggggaauuccugaagacaaagaaccuaacaaccuuccacaaucaacuccaaagagaagagaagaguaugaaaccacccucguuaaccaccuuacuccagcugaacuacaggcagauugugcccaccugucuuuacauggcuucugugaaugaaaacgucagucuuugugcuugccugugcaagggcuuugaccacugagccaucuccgccccaccccuucuugcccccaagugucuguaucuuaauagacaucaacaaggaaaggaugaggaagauuaugagacuagcaggcaggagaccggcuaagcuggggaaugugcacauugagacuuacacuuuacagagggcagauguagccguaccagcacaggggaagacagcaccauggugcccacaggaaaguugucccuggcuauuggagcugccacaguguaguggacccacaacccacccucugaggaguacagacuaguacauacacagaagaaagaaggccucuggagccaccggcacaaguggccccaucugugcgcugacucagacaggaacagcaaggccgguggaggacgacauuuccguuaugagaucaugcgcuggccacuguagcuucaacugaagccagcccagggguuuucccugaaagagucacaauuccucuccccagcaaaacaggaacugauccuaacaggaauauuauguaaugccagggaaccaggagagugggaaaagcaggguugggggagaagcaccacaggaugaaggcagagaugggguagaaaagcagagccacucugagcagcuuuuggacaugggacaggcccaguagccacucagccccuuccagcucccuggaguuacuuuccagggguaaccagguauccuucaggcaggcaucaccuccccaucugagagaggaacugcaaggaccugaauacagagaagaaagcugacacugggguagguaugcucuccugcuacaccaugugagccuuuccauccagauccauugagggguaaauacaguaaacacuuagggugaacaggacauuuugcuccauguacaugcugaaacgauggcacuacccagcuagguaguagccucacacagcaguggucuuugugugugguaaugacaggcaccaggauggacagaggcuucuagaaccuccucaucuccuaacuuugccuaagcuacccaaccugcagugggcaagggaggaacaugccuggggcagagucaaaagagcauggagcccagacuucaagggcccagagacagauguucaacaguuugucaguacugacucuacuuuuggacagacagguauccguuauuacuacuuacacaugccugguuuugcaccaaccuucuuaccauuguuuuuggcuaugggcaucaugaaaaaaguuuuuucuucuuucucaugaacucguacagcuugugacuuuucuagaguggacauuuacuguuuuaauaauaccagaauacuugauauuaaaacacauagagaaagcccagcaaguaauuagaaaccugacaaccugagcucaucucuaguaggaaagaacuccugcagguugucaucugacuuccaugcuuguggcauggugcuugagcacugucauacauaugcacacacucccacacaugaaagaaagaaaaacacuguaaguagggcuggagaauuggcucagaaguuaugagugcuggcuguuuuuccagagcaccugaaguucccagcacccaguugggugguuuagaacugccaguaacuccaaucugacacccucuucaggacuccauggauaacugcaugcauguggcauucauacacaaacacacaugccugcacacauacacagagugagacaaagagagcaacacauaaaacccuacaagccuaagagccagcccucacuccaauggcaucugccguuagguguaggagucugggcugguuaaagguggccacuccuuugccccucacacagauacugcugguauuacacuuucagaagguuccuacaccucuuucaugguuuuccccauucaacccaugucuucagggggcaacagagguuaagugaugucuuucagcauggcucaggacagaaaaacauucucaaguaagacaagguaccccaaaugcucugcaguauguuagcuagcugagguuucccccucccagagaagcccauaccuguuaugcaaucaaagcuaccagcugcuaucacucauaucuccccagggucccccaauuacuucauaugucuucaguuucucuaaagcaccauccuccucuuagagucuaaacucaccuugcaacacccaccccuauagacaaaaucaauuguaacaaccuuucucgccagguccuaaauccuauaguggauucuaguccuucucacaguguaugcaaaguguauacauacagccuucuggaugguauccagcagguucuggagguaguuacagaugaccaggcagggauaccaggugcucccagcucuagccagacauuaugcagccugagauugauauuucaacacaccuacaauucaaaucaugccugcugugccaguuggcaaacuagacccaagaauacaggugacuggugucagucaaguuacaguugggauccaggcuugaggcugaugcuggaaacaacucuucuuuuuuaaaaaauuggcgaguuauuucugcucaggaccugcuagccccacacaacucaaguguaguuucuaaaacaagggaagggugggagccaccucucgcugguaacugcccagguaaaggaucuucccugucagcucugcugcugacaucucugccuaggaccuguguaagacuucuaggcugaccaaaagaaucuagccucuggaggcccauggcucucauagacacccacccuuuccucagucacuaccacagaggacucugcaaaugcugucuggaggagaaacuagacaauccacucugauagagcaccuguccuucacuuggaaugacaaagggaguacagacacuggcuaauaucuucucuugcagguugagcuucuaaauugaggguaacuaacuuggauaccuagaaaauucggcugggcagaugcacaacugccuuucaugcccuucccuaguucuccacaccuugggugggcagaccuggccacugcagccuacucucagaugcacacacaggcccugcuucuguuggaaagcccucuagacccuuuguucuuucuagauugccugcaucaaugcuugucugcuggaggaagcaggcccugugaggagguguccacacucacucaagcaugaggaugggcuucuccauucucucauucuauuggcagcaccaugacuucuaccucuuacugcugggcaucucacauuacuguagaaagcuggcaugacccauggcauagcccagcuuggaccauccuggcagcuucaucccaauauaguugccacaugugccucaacccucaccugcaucuucugaguggccccugcaugcugacauuuugcuagggguaagauaaaagugaggaaggauaacgauagcaaggccucuucccuucagaaaccucuuagaaguacaagcuuuaguaguuccugaccucacaguaucugccugcacuguuuuaauaagcgagcacauuaucuacacacuccucuauuagcuggucuacaagaggcuuuucaaugaauuauuaucaugucaagagccaaaagguggggcuacgcucagucugcuuaaaaguuuuguccagaucauuaccuuuccuacccaaaacuucaaacaagcugguguaagggaaaggacacagguauccuuuggaguaaaggaguuuauuuucauuugaauuaugaaagaucauuaauguuagcuauaccaaaaagggccaacguuuguaaaggggaaaggaagagcagggcaauaauuaaguuacuuagccucaggcauugcccucacagaagagccaugaacacaguuaaugcugcuacaagucacagugacaggagucauauacgggcacuuuccuauacuccauauuacguauacagauaaucuuuaaacaaacauuauugcaguaaguaccuguaacagguucaaacaaaaacagguucaaaaaaacaaaaacaaaaaaaagaggcaaauaauuccccugggugcauaaagcaacacugcgugacacagagaggacaacuauagucagagauauaggaauggcuuuaaauuugggcaacuaaagauaagcuaaaaauggagacuggauaguugcuuagcaauuauuuuuaguaacaaucaauucuuaauuuuucucuuugagaaugggaaaguugggcuguggagauggcucagucaguaaaaugccuaacauaaucaaaugaaacuggauucgaaucucugauggucaucuagaaagacacacaaugucagccucuggccucuauacacagaggugcaugccccccccccaacuuaaauucacaugagguuuuuaggcagacuccuaagaacuaugaauguucagcucuugguuaugaaucacaauucacugcuugcuauuucuuuuccuaguaauuuaaauuuuaauuguaaauagauguucuguggcuaagcgcacuugcuacuaaaucugaggaccuaaguacaauccccagggcaugaugagaggagaaaaccaacuccuccaaguuguccucugagcucuacaucacaccacggcacauguacccucaccacaaacaaacaaacaaauguaauaaaaugaaaauguagagccuguaacuauccauacaaauagcuccucuaaccuacaaagaagagcgguacuauucacgaaguuagcacggcucuauauggacuuggggcaaaaacaaucagaacauaugacuaacuucuuuaguugguauaacuuuaaauuaguagcacggugcuuucgcauuagacuuggcauuacaagcuccagucuuagugcagaaacuuugugaagauggugcucaguuucuaggacaccacauaaaaggugcucugacuucuucccaacaauagagagcgucgucuacuguguugacugagaggcuuccuguccaagccgcacugaggacuucaacacaguugaggagggauggugacaaagaagggaaauaaacauggaacaugucuccagauaacucacugggaagacugaugccuguuaaaucaggaaaauaaaauucaagaguguguuggcuuccuuuuccuucuuccuucuuucuaagauuuacuuguuuauuuuagacauaugaaugcucuauuugcauuuacaccugcaugccagaggagggcauuaucccauuacagaugguugugagccaccacauaccugcugggaauugaacucaggaccucuggaagagcagccagugcucuuaaccacugagccaucucucuagcucauguguugacuuucuaaauguaaaacucuaagauuauugggcuagugagauggcucagcaguuaagagcauuggcugcucuucuagaggcccugaguucaauucccagcaaccauaugauggcucacaacuaucuauaaggagaucugaugcccucuuuuggucuguagauauauacacagcagagcacucauaaauuaaauaaauaaauauuuuuuaaaaagacaaaacaaaauaaauuauuaaaaaacucuuaagauuaauuugcuauaaaaagucauuuuggcuaggugaaauuucaauauuaaaaaaugucuauuggaucuacaagagaaaaaaacaaaacaaacaaacaaacaaacaaaaauccacaccucaagccaggccuggugguguacucaggaggcaaaggaaagcugggaguuccaggcuggccaggacuacauaggagacuugguuguugucgauguuucuuaaauauccagggcuaaagguuaucgaaccucuaucucagacaaguaagugcauagaaauuucucuugcuuagcuacaaaggcuuggcucaggucccaccccaacauucaaagaagcaaaagcacccuuuggaagcuaucaaccaaaaucuccagcaauuaaugucacuuuauggaaaaacuaagcauuuaccccagaacuucaugacuuacucacugauuauaggaaaacaaaaugaaucuccaagacuuucaaaacacagugucacugaaguuggucaguguuaaaaaucaaaguggucucacuuuuaacauacaggucuaugcuagagaguuccaaauaugacagccacuacgaaccaacaaucacaaacaugcucucacucaugaacaccacaugacccucaugguaucuaagcuuccaccccauucaucugaacaaaggauuuguacagaaaagcaaaaacagaacaauugcuuuaagugccuaaaggaggcuuacgcugaacucuuucagucacagaagcguccgucagguguuuuaauacagggagguagccagggaugcugcgaguccugugguggcaaagcuggaguguuagcgcaccaguaagaucacauggggaugugaugaagaagggauggagcuaaaacugguuacagaagcacacagugaugcacaggaaugacucaucugcugggcaugcuggguaaaaccugaacaaugggcagucuaggaagaagagcuuuaccaugaagucagagucaaggacugaaggcagaggucccccuaggccauguggaguacaaaggaauuuuaaccaggguagagauuaaugugcaaaacucugacaugggcacugugcugacugauggccuugcauuucuacccuuaccccauauccucuuggcaucagccugucuucuggaggacagacacacaaaaaccaugacaacaauucucaauuauauggauuacccagcucacuaggcaugcuuuccagacugccauucuguuuguuuaccucuaaaacuucccagauucucuacaacgguuuccaagcuuaaccacagucuaaaaauacuaagugcaaaauugcagaaaaauacaauuuaaacuucacaguucuaauaagugugauaacaucugacauaaucuugacuggaacacaaauugucuuuuuguucaguguguucaugguauauaugcugcucaccuguuagucauugauaauaauuucuguuaucugaucaacugccuagugucacagcucuuguguuuaaagaacccuaauuuuacuuaauaaugacuccuaaguauagacagaggguugcaaaaguuacuccagggcauggaaccugggacaggcuaucuccaguacuauuuggcaaugcuacaguucauagaguaaggacauaguauacaucucacagggcugaguaguauccaagguuucuaaaaugcacuggugucucaguauagucuccucagcuauggggaugacuggaccacgcaggacaugggaaacacuaugaaaacaaucagcuuacuccagacaaucuuaaucuggcaaaguugcucugccuucacuucuuuuucuugaccagugguuucuucucuuagucaugcagaacaucuuuccacaauuuaauccgaggagccuaaauaaauaaauaaauaaauaaauaaauaaguucuacauacgauaacuaagugacguuuaggaggagggcuguguucauuaacacagaaaaagcucuaagaaggcuacaauauagcuuuguuaauugaccgcaugcuuccaaauaucuauaacccacgggacacuugggaguugggugggaugaagaacuaauaugaggcacuggccacagcuucaacugaagccgaucuaguuccaaccuuccucuacccgcaaauacgugcucuucuacagcgugguccucuugccucuaccccaugggugguugcuaggcuacaucucuagcucuacaauggaaauuauuaaugaagaaaaaacauaguuacauucccuuaaucagcccagcuaguagcuaggacucuugagagcaaauaguccagcagauaauucugaagcugcaccacggauggguguguggggcagcacacugguaacaaacuggaccuagcugaucuccuuucagucaccuguugcuuuugcaacucucaaaaggggaaaccaucuuuuauuuuaaguggaggaaaaggaauuauuuugaauuugugccucugcaaucauacagcaguuuucuagaaauugguuaaaaaugucaaccuaucuacuuaaggcagagacugaguauuuaagugucuuuagccaugaacuggagacagugaacgcuacuacucaggagcuccaccuggugccagcuuuccaaaagacacccuacacugcacaaggaagaauggucuguaggaaacacagccaucacucacaaggucaaagagccauccucuagggggaagaacauguuacgucuuacguagugguuaugaucaaugaugcucagaaauguauucuguuuacauaucauuuucugcuauuuguaagaaacagaccacuggagagauggcucagcgguuaagagcacuuaccaacugcucuuccaaagguucugaguucaauucccaggaacaacaugguggcucacaaccaucuauaaugggauccgauaccucuucugguguguccaaagacagcuacagugcacucauauaauaaauaaaucuaaagaaagaaagaaagaaagaaagaaagaaagaaagaaagaaagaaagaaagaaagaaagaaagagaaagagagagagagagagagagaggaagaaagaaagacagacagaccuuuguaauaguuugaauauacuggagguguggccuuguuagggcaggugugucguugugggugugggcuuuuauacccuaguccuagcuaccuggaagccaguauuaugcuagcagccuucagaugaagaucuagaacucucagcuccuccuacaccaugccugcuuggaugcugccauguucuugcccugaugauaauggacugaaccucugaaccuguaagccagccccuauuaaauguuguccuuauaagaguugcuuuuaucauugugucuguucacagcaguaaaguucuaacuaaaacaacccuccaucacauaaacuuuaaaaaccugaguguguaccuaaaccuacuuuuacagaaaggaauuaggaaugaugaccucucuaauuucuuaaaaaccgauaagcugcagauagcuuauuuaaacuauuucaauacgcaugguaguuagagaaaaguuucuuaauguugccauuaaaaaaaucuauuuuguuauacuuagaagaaauagucacaaaaauggcaaggcaagucacuaaguuaaauguuuuacuguaagccugcaguuuuaugcuaguaguuugaaaucccauacucaugagcaguaaagcugacagcagugaagggugugugcaucagugugucagugcugggcuuuaggguacaggcuuuagagcgcagaguuucucacaggccugagagcagccaggcaggugaagacugucgccuccauuuccugccauggcuccacaacgcagcuuauucugccauuaagagacucccaugcaguucccucaacacccacuuggcuuugauagacaugagaccaggaaaaggccuccagagaaggcagaaccagguggccauauccaagggagagaacuuuacagcugucauccuaccugucucucucaacugugguuuaucagacaaaagugugacccgugcaugugacucaacacagaggccugcuaucuacagucacagcacacagccuuuugguaagagucacuuagcaggaggccaagcgaaggcacuauuuuccaagacagaugggaacaugggccauaggacauuauugggccaguaaguuuuucugguuagugugacuuucuacccauguuugcaugaggaacucaguagccaaugcugggacuguaguucuggcugaccagugaagcucagacagguugaauuccuguggaaagucaugacuagaagugcagaggacuucggugcaggucugugaaaugaugacagaccugcucucgcuacuuacuacauggucucauuucuguuuguuauuucuggacuguaagucucauuuaccuuguuuugauuugcuuaauuaacauccuucuaccucugcugucaguuccacaaagugagaucuuaugcaggacuguaaccuaguaaaagccugaaauacagauccggugcuauuucuaggguuugaugacuguagacugcaugacauagaaacaaaccugugcagcugaagagugccagugugauccaaagccaccacagggugucacccaaugccagggagcacuguuccaugguucuucuacugaaccauuuacuuaguaaacugggcuuuuuuggccacagcuaacuaaaacagaaugguguucauguacgugaucuggcugggaacaaguaggaauuuuagugcuaugcuagccucaaaagcaaagggaaccacucucaucccagccuucccacagccaagacaauggacccuggugcagggccuguacuacucagugcaggguccacagaucuggccaagguuaaauuuaguaaggcaacugcauuguauaggguccuaagaaaaguuucugcccuagauuuauuauugucuuugcuuaggacgauugagauaagacauuuaugaaaacacuuccugagaaauggaauccuagaauuaaaaacccuuaagaaggauaggcagagguguacacuuaaaaucuagcacuugggaaggggaagcggggagauuucaaguuugaggaccguuuaggguacauuaugagcucaaagcuggcaugaacugcauagggagacccugucucaacaacaacagccacagcagcagcaacagugacuucuuccuagcaucaugaagcaaucauggcucacccugcagaggaaaauagugcagacaggaagcaaggaaaucagaagguacacugaggguuugcuaagcacaaacugcaacucaccuugccucuaucagaagcaacugaucaagaccuaggcucuggcugaccagcuaaagguaauggugaaucuuuacaucuacauaggccuuaggcuccccaggugaagcagagcccagagcaauuuguauauuuuuuugugcuuccuacauuuucagguaauauuuaauuccuucucagauuucugacagguuugaaaauuaguuaagucucauuauugaacuuaaguuguuuagcauuaaagaagauguucuaaauuugaaaggaugguuuucagauuguuaaugcaaguuaaaaucaaaacauaauucagguauagaauuucaaacucuuuaaguuaggauagaugauagaguacugugucuaaguugacaaaauugauaggcuagacauuauuaguguuuaucauacuuuacaguuuacauaauuguuauaauuauuuucaauguauaccugagagaaaaggccuuuuuaacuggacaaagggggaaauguagcugcuuauauucgcaggcuaauuauguucccccaaaaacuugauugcaagaaugucugcauguaagacacugaggggcccugcccccaguugguucugauugguaaauaaagaugucaacagccaaugggugaguagggcagauagaggcgggacuuuuaggauuccugggcuagggacagggagaagggagaagaaggagauccccacaccaggagaaggagaggagagugaaggacagggaggcauagcucccagggaggagcugggagagugcaguccagcugggcaucacucuggguccaaagcagccaagauagaauguaggauuuaguaaguaauaacuugggauuaucggcggcagugggguggggauggauuaaccacacggagguuagaaaguggcccagccauugagccgauuuaggcauauaaaaauauaaaggcugugugugucuuucauucgggaacccagaauauuggggcagguagugaggacugcacuggcacugggguuuauuucauuuuuaaauucuucacacagaagcacagccuggaacucucaguccugcuucaugguagacuaagcaaguuuuuucucucuggaccucagcuuccuuuuucuggaggugaugugcaauuauaaaauugccaaucauucugaagacugagugacauaauggggacgugagccccaguccuugacuuaaaccaucuccacucaaaagacuagaccaaggucagcugggcagguuugccucugagagaagcucuauagugagaaagaguuccuggcaccacucuaccugcugggaacugcauuccaaggggcagcaagaugcuugcuaaagaaacacagcugccauaaggcaugguaccuccgcacuggccaugacugugcuggccaaagggcaacagcaacaagacuacacacacuagaaccaucuaaauguggcauacgagcagcauuccucugcagcgaaggggaaucgaagacauaccuaguaccacugcacucugcugauaaacuagugcucacaggagagaacccacaacuccaaauaaaagagcaaauagaaaagcuguugccuguacguggauaugcuccucuagcugggcuugccucaggggagaggaugugccuagccucagagacuuggugugccuggggagggggacacccaggggucccuaccugcucagaggagaaaggggagggugaaagauuugugggaggggugacugggagggaggcaacgagcaggauacaaaauaaguuuuuuguuuuuguuuuuuuuuaaaagaaaagguaagauggcacugaauccagaagccucuggggcaagucacaagccacaccuucuaggagcacauacagaugauucaaggugaggcuuuucaagcuacacacagcugguucucuggcagaggacauuccauuugucauacauauugugcuaugcagacaccaaagacaugccaccccaagcuguaggaauuuuacuuguauggggacaguaauugaacuccaauauuccaggcaaaaagaagcuuuguauuccaauccuuuguggcacaagaaaagcaccuccuuuaaaaaggccucugauuuggggacuucugccugugccagauccugaaugauagcaaaacccuuccaguuacuguaucgucuuaaguugcugcucuuccccagcaaugagaagaggugacagugggcccaggaggaaccaggaacuccauucccucaccucacuucucuccugugugcucacaugacugaaaggagggagucuuagcucucuagagacucaagggugugcaaaggaaugggcauuagauuccagagagauccagaacauuuacuuucugcuaagagccugacuucuauuaucauuaguacacuuagaaagacuaagaguaucuuaagaaugaugacauuuuaaaccugucauuaaaaccuguaaacaaacaaacaaaaacaaagucaggcaugggggcacaagcuuuuaaucccagcucucagagaggcagagacaaauggacuccuggauucgagaaaagacuguauagucuuaaguuacugagaaacccugauucaaagcaaaaccaaaaccaaacaaacaaaaaccuauaaaaaauuuuauuuuguacaauguucaaauaagcaaagaaaaaaaauuuaacaagcucccuguggugguuugaacgaaaauggccccuauagcaggcucauagggaguggcacuauuaagaaguauggccuuguuggagaaaguguuagagaaaguuggagguuucaaauauucaagccaggcccagugucacucucuuuuccaguugccugccaaucugaauguagacuucucagccacuucucuagcacuaugucugccugugcaccuccaugcuucuugccaugauaauaauggaccaaaagccaggccaacuaacuguugaccuuuauaagaguugucaugguccuagugucucuucacagcaaugaaacccuaacuaaggcauguccauacucuuuucaacaaguuuuauaauacaauagcucaguggcugaucacuuaccuaguaugcacagggcccuggguuugaugccaaccaccauaaaaaccaagcaaaccauacaugucaguaagaagccaagaaaccuccuuacacauucacaccaacaguacaccaaauaaaggaaguauuagcauuuaagacacaucaagaaccagccuuuagccaucucguguauggccaaaugaagucuggaacaagccuccauagacacaugguuauuacauugcauugggucucucuauacacagcaccguuuuguccacuaccucauuucccuccuacacccugggcucacagucaaaauugugccaguugucuugagcuauauccuucauuuuggacuucuguuucugacuuuaugagggcauuaagccuguaacuccucuauacucuauaguuucuauaacuacagacuacuuucagacuucacuggcuggcuuuaaguucaauuuucuucagggacuuggacugugucacuccaggagcacaucaacugaucugugagcuagaaggcucuugauuagcaucagaaaacaccuuuccuuccguugaaauuaggccuacuaucuaaaugacuuugauuaccucuuaguaugcauaacugugaugguuaaucuucacugucaccuggcuaaauuuaggaccacaacagagauauacuuuccuguugucucuagguucuuccagaaagcuuaguaacuggggaggacagacuugaaugggagcagcaccauccaacgggcaacaguuccaaacugaagaugccucaguggguaagggugcucguuaccaggucugagaaguggacuucaaucccugagacccacaagcuaucuuaucuucaucucuuccugacuauaggggcaaugugauuagcugccucacauucuugcuguuauauaacccuggaaccagaaggcaaaguuaacccuucuuuccucccuuaagcugcuuuugucaucaacaggaaaagaaacccauauuagcuuaacauuaaaguucaauccauugaucaauuuaauuauacaacuacuuaaauguuaccuggcuacucaguugguaacuacuaaagacacugagucagaaccaccuaugaccagcucugugcagguaccagcggaugaggggauaaucaggggcugaaugaugcaguaaggaagcaagcccugagcaggcagugacagcaccugcucccuuuaccucccuucuccacugguggucagaaucucauguccuggcuauuuuguuuuuuaaauaggaauggauuuucuugucuuuaucacagaauugaaugggugggaggggugauagcgaggaucagcuauacucuggugagaggccuggaugggaaggcugagacugccagagucuucccagaccccagccucuccucucaccuuccaucucuggaggcugugagaauuuccuguaucuuuccagguuacuaagagauguacucugggaauggaagaaacugaccugcaucaugaauaaaauuuaugaggcaaauuaaaaaaaaaaaaagaagaaauaucaauauaagauuuuauauuaaaauacaaagguaaaaggagugaagguacuguagggagcagcaggcgaguuggagcagcaggggugugggaggaaugcucuuuuucaucaugagcuacuccgugcagccuaacauuuccacaccuaugaguaguuuuaauuugauaaaaaaaaaaguagcagacauuuaaagaguccauucuaugugcuggccacugcugcaaaugccacauaggugaccucccucccccucacagccaaagcagggaaacccuuccuuggccccauuuaaagaugaaaaauauggagaggacagcaaccacuugggcuaggacuuagccucaggcagugcgaaccgcagccuggagaguuuaacuuugaaggaaggcaggcaaggagaaucucacaaauuauuauguagaaagcuguuggacuucaccucugaguaagcccagagaggagaaacccaucagccuaacagacgugaguaaguagagagcacuuauuuucuccuaucuaaaauccuauacuuuucuaucaaccacacaaacacugccuaaacagcaagggcagcagaaaagaaaaaguuggggaaaaaaauugcagucacacaaacuguaguuaaaaaaugacuaaguuuccuugauauaugaauuuguuggaaaaccauuuaucaacagccuguuucucucuagcagagucccucaagccgagagccaugucauuccccuuugacugauuaauuagccaaucaggggacauuuuucauugugaggcaugaugguuuauugcagcuaauguuuggucucuaauggcgacauauuaaagccaacucggcuauuuuagccccguggagugaccaaaaggaaaggauaggagauaaaucaagagugcccuucaguuucccuucaguccuuaacaaaacccccaaggagcaaauggcuagaagugagcccuaccaauaaaggaaaaacaaauaaaagaaaggcacaacugccuucaagccaagguaguccuucccguuucugaggaacaauaauuuauccucuaugauuaacagaccacugauagaacggacaccuaaaagucaauagcuugcucuucguccuuuuaucaaaggcugggcucgauaggaaaagcggcucugcaaugcuucuugcucacugcaaugguuucuccugcgcacugaacccagagcaagcaaguacccccauggccaauuccacccccacauucuacucuugccauacaagcuccccggagccacaagguccaggugucuccuccauccucaggccguuggcaggcacugaagcacaaggaagcaaguccaaaugcaaaagugugcagauagaguugcucauauccaggagacagcauacucaguacauugagaaauggaagaagcaucaggcuaugcaauuccacacacaaacauggaaaacuaccagccuuucugccuaccaaggaaagccaaagacacacaucuacuacagcggacagauagaugcuuugccuguuuagagaguaguuacagccauucccucagcaugcaucuuagcaucuucaucacaguuuccuuuaguccccgacuuaaagacuacucacucaguugcacuggcaaguagggaucccaguggcacaggaauuugacaucuuuugugcacuagaagcacagacuccuucaaagccugucucuauuccuaguucccuguggccuugccugccauuagcaaagucaagggcucuccauguggguguuggauuucucaguacugagcaguucaaggcagaugacugcucaccucaaggcuccaagcaaaugcucuagcucauacagcuuccagagcuccacagcauccccacagcuagucuauuggcugcaagaaaaucaaagccacccaagguuggggacgggcagguggaggagaagaggucauaaggaaccuguaagagcauguggaaugggaugcauugccuaggcccucgguggaaaacggaaucugcuaccaggacauagaauucagaguuuacagauaaacaaggaauauccaauauccgaggaauauccacccuacccuugccaucacucucuugaacaaccgcuucaagaucuucauauccaccucuuggauaaagaauacaaguggacaaagcccaguuguccacuaugagaaacaagaaaagaaaacuuaaguaauaaaugacggcugguagcucaauaaaacacgaugugccguggauuccagcagcaagucaugcaggugaccccacaggcucauccuccagaauccaaguuaaggacugaaggcucacgggccuuucagucacucuucccuaccaagacuuccuacgggaaauggaccaccgccgcaccuuuagcugcuacccaguggucagucugaguugcuucacucccagagcagcuccacuuugagcuccugcuuccucccuucacagcccaccugugaaccacacccagcucugcugccugcucagugcacagcacacaucucagaagccuuuuccaugaauauaucucugaacacacuuuaaaauauggcacccaggccugaaggcaacaagucaaucugcuggcagcagacaagcaaaaggcacagcccucuacagaaagaagcaccugccuaucucaggccaaugccaugcuacaagucucacccuugguaaauuugggaucagguuacauguccuacccucuaauguacugauucaaugagacuuuacacaucucauuaauucaccuucaagagguaaagauuggaccaaaaguuccaacuuagacuaucuuagaaucugguucuguuaucaauggcuagacagugacaaacaaaucauuaugaaaaucauuauggaugaagaaucaacuguagaauucaaguguaucacaucacauguuuaugaaaaugggcuagauuuauucuaacugaaaggaauauccaccuuuuaaaggugcuuagcagaucacaaaugccugccucucuggggccuggcucugcagugaggacagagauggagggccacauccucuaaauuacuuaccaacucaaccuaguucacuaguauagaguauuagcauggaaaucuggaaugaauggauaaaaacaagccuccaauucaaagauauuuuaaguaagaaauguuuuaacauuuugaagaaaaaaauuuuuuuucuuucacaagagauuuaagauacugcauccaaccaggaaaaggaagaauggucuaaaaugccucaugaauuaaucuaaccaaauagaaaggggucugcauggaaguaguguucagaucaaaugagcaagacauguuaaagcggauguguaacaugaaaugagaaaggugcacagacuuaaagaagccauacaaagaaagccaucauuaauuuggugucuuaaguauacacaaaacaaugcaggguucuaauucagucaggucauguggugacgacacaaacacuuacuugccaggagccuaugccagaggcuuguuguuuaaagaaacaaagugggacuguuaguaacacauuuccaagccucgauacgguuuaggaguauuuucucuagugauaaggcugagucaggaaauaagcuggauggaggaaggaaacugggaaggugggggagggaaaauaaaugagagggggagcaaacuagaaaguaucaggaaguucacccagauaggaacuaauggaauuuguuuuucagugucuucuaacuucaaucugcaaacugugggacacacacagaaacacaaaccacacacacacacacacacacacacacacacacacacacacacacacggagaaaugacacucuccaacgcagccccacccccauugagaacauauacauaauucccagaaguaacaagcuaagggccaaguaauuucaauucaguauacaagauccuuucuuugucuccauagaggaugcaggcaaauccaauuuagggagcacucugcuucacuguuuuccaacuaacguagaaccaaguugaagaacgaaagaacucaaaaacuagacagguacagccauccaugccugcacagagcaauuuacuagcaguucugaguaacugacaguuugugaugcuccuucacucauuaagcacguucuucugaauagccagaugcaggcaggagcuacgauccucuuagagccucuacagcugcaagaaaugcugagcaccaauaccgugagccgagagagaagucagagcagaggccuguggugacugacgcuuuaugucccgcagcaaugagaaacagcaacaaucuggaaaacuacucuagccugagacaaugucugaaagccaaucucugacaaaucaucuucaagaacauaaaguaguacaagcaaauauuuauccaauaaucuccccucaaaaauguacuauggacaccagaggauggugauuggcaccgaaggcagcuugaacuucuccuaaaggagaagauauucaaauaaauaccagccccaaaguuaugcaaggcaucauuuaaaaaauauuuaaaaacuaaaguccaauucguacaagaggauguacaguuaaauuucuauuuacugaacccucuaccauugccauacuggaugaugcacgaguuaggaacccagaacuggauacaaagcaaguccuuugucuuuuaagauguucacuguccugccaaaaguacuugacagaugaaaaaguccacauguacaauacaguagauggauuucuuaagacauuagauacaaugaaauuguuaggcacaauguuuggcaaugcgaaacauaaauucaagccaguguugcuaugggggucaagggaggaaacacaauaacccagcugagaagaggagccaaacaaaacaagcauuuccaaaccaaucugaucaaaggccuuuugcccugcugugcagacuguuguaaguaacaugguaagguuucuuagcaacacuacuuaaggaaggugcaucuguaccgagaacucaaaagcaaacccaauguauauccaagauaggacuacauagggagaccuuugcuugcucucagcacaguuaaacggauuguuuucugcaugcauauggcuguaauauagacucaucuccucacugugcacaugggcuaauaauacccagauaccccaaagacaggcagacuucagaaucugcaggccaacaggcuccacaggugacuguguggcaccuggaggcuugugaagcccagccacacaaugacacugaauggagcagcucucuugguacagcugggcuucagggcuucuuuggcauucucaacccagguuccuuaucacugcaguccuuaccuggaucuggaucagcaaccaagacuaaaacaguucuuucucauaugaaugggguguguguguguguguguguguguguguguguguguguucucacacauggggacagauaaauggaaaccugagguugacuuugggugucuuccucuaucgcucuucacuuuauauauugagacaaagucucucauucaguuugcuaucucugccugucuggccagccagcucacuccagagauucucuguggugucccucccccugugacccccuagcuguaauuacagaugcacuguuacauccaccuggcuuuuaugugggcucugcagaucccaacucuacuuuaucuacuguguuaucuacucugaucuaaaaccaaucacacaaacaaaacuauuuuccuccacuaucagaacacgucaucacugaggacaggccaccuuccaugugacucagcaaccaccaggcuaagcaggccacuggaagcccuaggaaacagcuuccuccauguucacccugauaaaagaaugaggcagagagggacuaggugacauaggaauccagcccuaauuuguaaaagaaauugcuugacaaagucucucaucauagacaauucuucaaguuucuaaacagugaguaacaaauaucuacuacccuggaaaaaaagauacccaucagucuggaaaaaugcuagagaucaugaaaguugucuuuuuguuccauggugaccacagaccuuggcaagaaccaacaaaauaacaaagcacaaaaagacacagccuaccagacucacagaggaauugaauuguaguaacuucagauuuucuuagcugaaaugaauuuucacucucuccaucaaucuagcuaaagucuuuaguuuucacauuaggaugacagacaggcugucucucacauuuggaaguaguacaaaaauucugugcaauauacagcucaauggaaucuaauaggcuaugaauuacagguucauugguaccuuccgggucugaaacaagccaucauguacaacggaggauguauccacuguccgucucauccccagcauccagagguuuagguaggagggaggugaguagcugucugugacauuuucauccucagagaagaggcagaauggggacacacagacagcagcacaaccacagcugguaccugagcaagcuucuuguuccuccuuuuuccaaaaaugcaguccaggucgguuucacuccgagaggacagauccuucccuagaaauaacacaaagcuuuucaguaagaccauuuguuugaaaugagaagcacagauacaugugacuccugaaagaaaggaggcaacagcagagggucaguccugacucugaccucacuuuacaacuaugauuagaacacggacuacaaugaaagguucagugacugucuuaggaucagagccauccagugcccucugagcugcaaacaaccgggaacacggacugcacagaaagcuccaucuugaaguggccuccagcuuacugugccuucaaggugggacuuaggauaucucuggguuccuaucugcaaaaugaucccauuuucuucaaggagacaaaacacagaacugaaaauaccgauaggcacauaaccucaaacccuuuaaauacucacacacugacuauuuuuuugacacacaaaaucucaauaaagcuaagugaaaauuuaaaagaauaaaagcaaauuuaaguucaauuauucuuuuuaaaaugcucuuacuuguaacagcucuaccaguuaaacagaagguuacauggugacuagagugaaauaaauggcucugguaagagcaguguccaaagaaucgacacuuccuguuuuaaaaacuaaccuaacucaauuccaaaccuccaaaccacuaauuuaaaauucacuuuggaauuuccacuucuacccaacaguacccugugagcagucagccauauccacugccauccaucaccuucaaggaaagugcaucugaaagcuuaacucuccgugugaagccuacgaaacuggggaagggaggucaggucacauacaggaaucuggguuucuagcuggaagccaagcuccacagucaccagcucaauggucuugguuuucugcagaaaacuggcuugacaaaguaaugucaugacccagaaaguucugguucacugauuagcacuggugcauucaaauauaacacugcucagugacucuacaaaauugaaaaaacaaaacacccuucaauuugaugcaaaaccaggugccagaaccaguuucagcggcagagguaccggaauggaugguacaguuggcacaaccuguucuugagggaugggaagguuuccagaguugcucuccucccacccgaagccaacacuagcaccccagacucaaaagaaucccuagucaaaaagcaaccaacccaaacaaacaaacaaaaccaaggagaaucuacauaagaacagagugaugcuuaucacaaacaguagcauaggaaauaaaaaaacagagaggcagcagagacaacuugugguugcagggcugagaggugcacagcuccuugggaggcagugaucuauccucagcugccgccaguacaauccauuuccuagugcuaagcacauucacuguggaagucagcuuaagacggcucagaaugagcaucagaaaccaagcauaacaacacaugcuguaauccaagcaccccguaagcagaggcaagaggacugggcagucgaaaccagggugugccacauagugaaagaaacaccaacucaaaaacaaacaagaacccucaaaccaauggccagcucccuuuaacccagccccuaaaaagaggagcaacccugaaagaaacauaaauuuuuauagcaauuucacugaaugcaaaaguucaaagaaaagagagaacucagggccacaguucacaauuaguaugugaagaaauaaacacauugagauucagaacaaaucucagacucaaagggaagccaguaauguucaauggaagugcuaggguuucuaggcuucuagugauggauucuugggucagaaaugucuauccucuagcaaaguucauuuaaacguagaaaccagggcuguacagaaccugcucuggauuuaaucugaaaaacaagaacacagaaaagaaaugagagucagaguccguaaggaagacaccuguaaguggguacaauggcaagacagcuaggauuuugaaauuagaagucagcuaauaguccugacugaaucguauauauguguuaugaacuuauggccacucuuggacaaaauacaccuaguaaaacucauuuuugaguggauguuagcuuuaguucugaucuaugguaaaaaucacaacaaagacugaugacaaacuuagaucuuugacaaaugacaaacagggcagaaaacauguguuaucuaccuagcuguggcuguucuagcucagcuacaacuguaucuggagaaccaggaagaaaggcuuccaggagccgcagacauaaggaaguccauucgaggcuggguguagguuuuuacagaggaaugcugcaccgaggacagcaaucaaucugucacucuuuggcuaucaaucacuguuaucagcuuuuccagaucaucacuguggucacugagaggaggcugugacucccagagugacaaaugccaacugcacccacuagucuggcaccuggagaggaaauggacuauaacagguauaagaucaaugagguauagauaguccuaacccuaaagaaauguugccuuaguaaauauguuuguuaaauuaaaaaacagguuuaucuaggauacaucaaaauucauuuacaugauucagucaagaauacauuaaguacaaaaccaauaucccuuacaacucgggucucacuguggaauguagugaguuuucguuucuuuaaaaacauaauuauguuauaugaauauguuuuuguuuuaaucccaggugugggauauggggcugcuucaguuuguccauagccauuagcuauaauuaucucaugcucugggaggggcaugaucuuuaccagcugcagaccguuuaauucugggggucgcuggagaggauauaaaugagagagcccugagaaagccugugguggcugcugcuccaccugcuucggggcuugcuggauugcuggcuugcuauugcuggauauucugaugaugaagauuagacuugccucaaggaacccgacaauccuaaucagcaggaaguaguuuaaagaggucuaagccccucuuuuccucuaaccuucuuucucuccuaccuuguguuggggguugagaaggauuaggguggaaaaaggguuggaaguaugauagacauaagaacccaaugaaaaaguaaaagaauacaccaacagugggaggagcuagauuucaaacaaauauagaugauaguaacuuaaaauuacguaauuaauuauuccaaaucaaaucaccaaguagaagcuacaaaaagaaguaauuaugcaucaggacaaagacuaauguagcuggaauuuaggcaguagcagauauuacaguaccacuugcucuagccaggcauuuuguaguuuuucauguacaugaggcuggcuuuaggugcagagaucugcaugccucucucucccacugcugggacuaaaggcguguaccaccacaaaggcuucucuugcucugggaaggucuucagcaggcuguacagaggcuguacagaggaacugccuuccuacauuuuaguuuucuggaccacauaggggcuuaugaugacucauccucauuagcaaagggaacuaggaaccuucaucaugaacaucaaauccccuauuuccacaaugcuggaagagcaugcguuccauaagaagggucaugucucaaaaaccacagaacagagccuuacugagcuucauggcagcuugcaaauaccuccucuguuacagaagaggaaacagaguuugaaggaagggaaacgguuagggaagugucugggagagcaccagccagaagccagcuuccgcagacccagacaggcuccuuuaggauaacaacaguucauguuugucauucauacccagagacaagaacaacugaaagaaacagcuuuuaggaaauuaaaagaacuguaacaccaacuugcacuggauggugcagacagugguuaucugcuguuuccuguacuaccuagauuuccacuccuuuuuccucuuccuuucuuauucccagccuuuggguccucuauuuccugacaccuccucucccuuagcacaaugcaccuucagcucuuucuucucugcacaguaaggccuccuuucuucaugagcagggcugauaaauaugcaaaccucacugugagagagaaaugaagguauaacacaccaagcagucugacagggucaccagcaagggaguggcugaaccaggaauagaaagcagacacagccaguauccagcagauuaaagcaacuuagggagguucauccuaacgucagcaaaugcuucaggugagucagguaugcagucagguucuaaaggacaaucaaaagacuacaugcauuuagaggggagggagugggggaggcugcaugucauccaaagugaauucauuugugugcucugcaacacccuucugcagugucuguagucuuccuauagugucuaaugaaaaaagaagggcuguuuacgggaccagggacuaaggggcagcaaaguaguuuucuggucuauaacggguuauggugugguaaagauaaguccugauuagaagccucaugagccgccaacaaaaaaguguuugccuaugaaaaagaaauggauagcacaaaggagccccuuaaaccacacagggaacaaaggggauugcagcucuccucccacagagccuggaagucacucuguucccuaaccccaggcucugccaugccuuucacuucuuccaaacccaguucuaucuguuggggaccugguccugaaggagagcuacuagcaacgguuuccagucagaaaugucucccacagcaauuaaggcagguccuaggaguuaaacaaccccaaaaugccaagaccaaggcaaagagauauguuuuuccuggcauagagacaggaacagacauccaauuucccaaagaacaauuaaauaguguauggauaccacagagcaguaaccaucacaccuagcgcacacgaaauacagcauguaauaaauagcuuguggccauucuacagaaacaucugagacuuguuuaaagcaaaguagaggcuucucaucuguacacgacugccaccuaauggcuauagaggaaaggugcacccaucaaugagaagcuacauggggaaggugggaaugugccaggaaggcggugaggagcaaaggaggguuuguugcccaauuuccaaccacugcauaucuugacaccacccuggccaugacuaugagaugccuacagcgauacuccaugagauggagaacuuguggagacucugugucauuacaguguagauuuugauauaauuaaugauccaaacugccaaauaacaggaacuauccuccauaaccauuaagaacugaacaaaggcuaaaagccuuuugucaagaugaagaacauaaaaucaaauuauuuucucaucuagcuacauagcauugccaucuccucuaaccagacacugacuuccacucucagccgacacaggacuuacccagucugaagcuccccugggcuguucuuggaaccacugcaccccaguuugcacuuuaauaagauuccuggcaagucagcacagggaacuugccaucacacugagcccuuggcacccagggcugcugcagaucaauccaccaggcugcccagaccucccguucagaauuucaaacaagcagccauugcucagugcuggacgagagucacagugccucaagaaacccagugccaaaauacauacuccaacaagugaaugccagcucucaccuuuugugaauuucauauaaugaacccgguuuuuggagauuuuggauuuuucuucaaggcuaaaagauuucuuuuccuuuuugucugaggaaucuuuaaaaagaaguaaaauauuaaacauuguguaauucuuucucuucaucaaagauguuacuuacauaagcuuuauagaagugucaaaaacuuauuacugaacuguuaccaaagaauuggauuuuuuuuuuuuuuaaguaaagucaggcaagguucucucuagccaauaaaacccucaaagaagagaaaugaaaguaucuucagaccagaaucuacacaugacuauuccuggucuuacacgcagcaguacaauacugagguaacacgaaagcuuuucaacauggcuaagugcacugauacagccugauacuagaauaucauuuaaucaccugcaguaaggagugguggguugacuccaucaagcccacugaggcacaccuuagguagccauaucucccuaggaguucccaguaauuucaaaacggggcaugaagcagagcaggcugggaacaccgugaagacaguacuuccgcuuucagacagugcucagcaagguuacuaagugcuccuuaagccacugcacugggucccaccagagcuacucucgguuucaaagacaccuugugaccugagccuggauugagccaggggaucacauugucucugggaguccacaggcauuccuccaaggagagggccacaaccgacauggcucuccuuucacacaugcuuuauaccaccuuaggaucccuucucugggaucaaugaggaacccagauacgguuaacaggcccccaucuuuucaucaaaacuaccuuucaacuuaacaagacacaaggccagagacuuuccugcuuuauuuaugaauacuuaccagaauuuauaauauguuuucugguuaugcuaauaguaauauacuaauuaugauaacuuaacccaaaagaaagcauuaguauuaaguguugaguucacuaggaaacaauguagcccauuauaaaaguguuuacagcuagucauagugguacaaauuuauaauugaaguacuugggagacuaaggcaagaggaucaugaaugugaggccaccacgcacuaccuaacaacccuaacucaaaacacaauuauauaaaaaaauuaagaauaaacauauuaccuuaagauacaaugguguacaugagauggaaauguuauuucagaggaaaggaauuaugaacuagagccuuccuggcaaauacagaaguaugugcuuacauacuuuaaacagaagacagugggcaucaaccucugccauucaccacaggcaucuaggguugcuguaaguguuagggcacacuuucaaagcucuuuucggggauaccugaguaaaaacuuuugaggaugcugcuucaaaccacacauuuacauuuaacaacuucucagcaacccacucuccaccccaaaauauuuaaaauaaugaaugacaaaauaucagaagguuaauaugcaguuacuauggcagaagaaagugcccucgaaaugcuaaugugaaccuguuaagcuaugccuaagcaagacaggauagcucuucccguguguacaugcacacacacacacacacacacacacacacacacacacacacauaagauuacagacuuguuuauguugaugucugcaugugugugugugugugaaagcauacgcacgcuuguggaggccagagcaugauguuaggcgucuuucuccaucuugcuauauauuauuauuuugagaaagggucuuucucugaaaccagaacugacugauuggcuaggaagguuggccagugagcuccagggauccucuuaucucuccuccccaguccugggguuacagucacuacuagucuuuuuuuggcauggcugcugaggaucugaacucacguccucacgacuguggaacaaguacuuuauugacagccccugcccuuucugcuuguauaacaugggcugaccauguacugacaauuuacacgaggcucacacugaacagacccuccugccucuuucucccuagugcugagauuuuaaacacacuaccauacccaaguaugugagaaagguaacuuuuaaaaaugaaauuuaaaagaucauucugacucuuguguucuacaagagaacaaaacaaaaggucugcuuagcuauaaaacaaacaguuugaauuuacuaagggaucuuaacaagagaaaagaaugcuagguuccuaugucaucuaccaaugaauacgaugucaagcaaugcacgaguacgguaaaaaaaaaaauucagguggaugaagacaaugcauucaaaaaggauggcaccgcagaaaaacaagcucugcaggucuguccuggggacaggcuuucccuaaaaggaaucuucugagagcacaguucuggguggcaguggagucacagacaagcuucucuaaaagcauuaucugggcagcagggcuacuggcccccucuaguggcccagacaggaaauaucuacaaguugguagcugcaugcagcuuugacaucaucuaaaauacuaccagguuugggcaccaaggaaagugaagcccaugcagacugacccuggaggaggaugaagaaggccaacuaucauuugugaggucaagcacagccuuccuuacaaacagcaaaguucccuggguccuucacaacacccacugccugccccugcuuaaacauuucugggagaggcuguugcagauccccugccagccuuggccaucagugugggacaagggaagucuguccugagugagccagggucccaacaacugaaauggcacuucucacuuagaaaauagugauuaugacaccaucagacugaggaaaauggaacuuuccagauaauuccugaaaaucugaaaaagaagccaccucuucucuauacacacagcccaucccaggucucccuucuuugugggaucuuggagaucaguucuuagaacucugugaccugacaguuacgagcacucucggaggcacuaagcacuaagcacuaagcacucagugacaguaacagugccgaauccagcacaggacaguuuucgcugacuaagaacaaggguguggacaacugugagaaaaggaucccagguucaaagguccaugaggacacuagugacaaaggcaucucaugccugaaugacguccuagucaugacacucugacgucaccagaugcucaccaaggcgcaguuucugguagucaaaggcuuagcugacuuucaucuuaguauuuacauagcauuaauuucguaugguguauuuuacuuuaugccagaaacacucaagaaauguucacaauucuuucuaucacaauguguacauagcauauagauacacuuaaaaccaguauaguugaagaauuauaaagugaaccccuucaucaccacuuccaggggcagaccaccagcacuaucaguaucuagaagcauccaagugccccuucuuaauaugcccugcuguuuccuccacaaaagcuaagcauucuuugcugugagccacagcuguuucugcugcagaaugcuuagucaugguccuggcauuacuagauacaaguaacauguccacagcugugacgacugaaaauguugcuaggacgagcaagacagaucagggagcaaaagcucacucagugacagcgccauuagacuauaaaaagaguaucggguccaucagagacccagguccgaaaggccuacagcaggaacaugacucugaugggaggagcagcaguaguaguguccuuaccugcuguuuccugaccguggcaaguguugagugcugccaaaagcugguugaagucauccuggugagcaauccaguuguccuggaagcaccagaaagugugagaggcaagccugaaaccugcucuaaugccaacacagacauggaacagaaaucugacauuaaugugaaauuguacauguuucauuaaaauauuauuuaauuggauucacaaaacaguauaaaccugaaaugagauuuaagcagauccacaucaaagaggggguauuuagggcaaagcucaguagcauaguccuugguuugcauguauaaggucccagguuuguuucccagcaccaaaaagucaacagaauauaaauacauauuuaguggaagcugcuuagaagcucccaccuguaucucaaauguggaugacccaucaacaguuaagucagagcaaacacaaaacaaugggcaacauuuagaguauuacacuagagcaauauaaaauuaguguuuucucacacagagagacuacugggagcugguuauaugacucagcagauaagcacacuggcuuacagaggaugcagauucaauuucuguuguguccucccacccccgcacccccaacgcugcaagucacaucugucuguauuuccagucccaagugaucccacacccucuucuggcauccauggguacugcaaguaugugauaccaacacacaggcacaaguaaaacacccauacccauuaaaauaaacuaaacucugggggugggaggcaggcacacaccaugaacaugaaaaacaggaaccaugagagcagaguccuccucuuugcucaacaaaaacuuggacuagucugcugaauucuaacuacugugucagcagcaacuucacagaacucuguggaaggagacccuaagucucugaaucagugagauucaacuguaagguguucacuaauaaugaccuccaaacaaugagaaccagcuggaagcaggguuucugagcaggaguuugccccgugcacuauacacaagcauuucuuauuaagaaaguuuaagcaggaugugguggcacacaccuuuuauccuagcacucaggaggcagaggcaggcagauaucugugaguucauggccagccuaaucuacaaagugaguuccaggacuauuacacagagaaacucuguuuugaaugauagaaagaaagaaagaaagaaagaaagaaagaaagaaagaaagaaagaaagaaagaaagaaagaaagaaagaaagagaaagagagagagagagagagaaagaaagacagacagacagacaguuaguugaaaaguuaagguaugcauacagauuuccaggacauaugcuuccccuaagaauguacauaaagcaugcuuuguguuucuuaaaacagcauucacagucaacauuauaaaaacucuuucuuuaguggcuaaaauuuuagcuguuauuccagagaaccguagcuguucuagccagagauaccaaauuacugaagcaauucaguuuacauaaaguaauucacccaguuuuuaacuggguucuguuagcuacaaggguucaggaagaaagcucccaggccagccucugaaugggaagcgguaggugguguugaacuuggaacucugacagccgagccggugcagagucuguguucaagagaacacgugggcuggcaagauggcucagcagguaagagcacugacugcucuuccaaagguccugaguucaaaucccagcaaccacaucguggcucacaaccacccguaaugagaucugaugcccucuucagguguaucugaagucagcuacaguguacuuauguauaaaaauaaaucuuugggcaggagcaagcagggacugagugagcgggguugaccagagcaagcagagauucuaaaaauucaauucccaacaaguacaugaagauucacaaccaucuguacagcuacaguguacucauauacauaaaauuaaaaaaaaaaaaaagaguacacacguaaccaacuguggaaaaccaacagucggaagcacgacagcuuucuucggucacuccccgcucucaaagccacccauguuaacaagacaaacuaauauuaggauguggguaaagacaaaaauugaucuuauucugaaaugaacauuucuuuaaaaagacuuuuuacaaaguucagcuauaaaaacaggagugccucucgaggccacuaaguaaaggauccaggaggaugaggcaaggugcgccgcacaggaugaggaccagcuaagccaugugcucuugugucuuucuucacccaaagcaggaaccacacucaugacuuaaaaccaucccauugcaugaaucccaauguugauguugacacaaaucaaugaugcaaaaaacacauccagaaauugcucacuucauuauuguuuguagcuccaagucccaggugguuauuuuuaacuuuaacuuuaauauguucuguggcuccuugcuccugagcucccaaacccuguggagauuaaacagaaagauuaaauauagcucucucagcuauaaagagaaauugccucuuucuucaccaucuauucaaaaaguccacagucugagguagcaguucucaaccucuggguagugaccccaauccuuucacagggucacauaucagauaugcugcaucucagauauuuaaauaacaaugcauaacaguagcaaaauuaguuaugaaguagcaaugaaaauaauuuuauggcuggggucaccgcaacaugaagagcuguaauaaaggaucgcagcgucaggaagguugagaacgagaaccacuggcccagaggguucugaaagagacugcaccaaggaugcauucuuaauugucaaugcugguucuugaacccaagagccaauaaagaguucaugaagacacugaacauacaucuuacacaugaucuggagcaggccacugcuacaguaguggcagaagcccacaggagcauguggagcacauggcauucucuguuacuuaguacugcaccaggacaucaagaaagaaggcagaguacuccagguuccuggccucacuuagcucuuacaccuaagguuguaggacauaccaagagcaaggacagagccugcaaugagaaggaaccucacagaaccuugaaaguuagagcagggauggagauuguacuccuuggaaacaauguucaacaagggagcaacccgauguaaagcucaguuugaaaggcccaccugcuuccuguaugcugaaauggacguacgaaggaagaagggcaaugggagguagcacuguuugaaugcagggauaagcaccacuuuugaaagucaggaaagccuagaaaggaaaagacuugagggcauaagaagcuuauaauaaaaauuaaucuugacauggccacucaaguaucacagccaggagguauaacccaaugccugguaacacaugagaucgccugagcagaggaagcaaaaaguggcuuuguagccacccuuuaauacaguacucaugcuguggugaccccagccauaacacuauuuuuauugcuauuucauaacuguaauuuugcuacuguuaggaaucauaauauaaauaucuguguuuuccaauagucuuauuaggugaccccugugaaagggucaccugacccugaaggagcugugacccauggguugaaaagcacuggucuagacaaagacgauggcuuugaauuagauagaggugguuaauaacauaaagaauaaggcaagaaaaagggugguaaggcuaccacaacagaguucaacagagcagacacugcucagaacgcugccgaggggugaggggacuuaaggauaccauaugcccauuggaugcaaacacaagagcccugcaacccugacagaagcaguuucacaguagaagccccacugcagaauauaagaaacuggagaaaacauguaucuacuacaaaggaaaauuaaguaccauucuuggaaaacacaaaauucugaggcuuaaguaugaauucaugugaaaugaauuaaaaaauaucuaagaaagauacuaauuacagcaauugaauugauaaaccagaggacccgguauuuauguucaagucuaauuuaccaccuggucacaauuuauuuuuccagaaucaauuaaauugaucuaaaagaaagaaaggaaaaaaaaaaaaacugaucugaaacauaaaguucucccagauucuaagacagaugucuucugaguccuaaucuccugacaugguguggacacuuuagaguuuugauaccuuuccuuuagaccaccccaucuucucaagcaucuucuggccaaacuuggaaucaucguuacuccacgcgguguuucugggauccacaguccauuucugcuuccgccgcccuacaaauaaaaaggcaucccaucagcaccuagucuugaccuggaagaacacaugugagucaagcacaugcuucauacaacaugacacauuuaguguucacggggcuuacagacagaaccuuuucccugguacucucaguaacuauauauuccugacauaaaaacuagccuuguuaaauuuaaaguaaacuauuccuucuaagagacaaagcaaaauacuuaauaggccacuauuugagccuucccuauccagucacuggcaguaaccagagccucucagugaacaccuucacagcagcagguguagucaccaugacacucacuguugcauguuauaggccaaaugcuacacauauauuaaacucagcuuccacaguaucucaaugaagggaaauauucuuaccuuuuugacaugaaaacccaagucugagaacaggcccugcaucgccuagacaugguggagcugucccugaucgcaaaggcaugggugagucagcccugagggugggagagcugucccagccccucauaggcugcagcacuuaggagaaagaguccccacaccuugacugggcagcacacucugggagugugggugugagugagccaggccuagagcuugagagcagaagagcugacucugccuccuggggauaguggcacuggaugggcuagcuggagcagugcuggagagcucgccugcucuggugcuguggauacgugaaagucagggggcugaccagcucagccacuacccuggccuggauuugaguuggagcugcaggaucuccaugacacaggacaacagcaggauaaccaggagucccaaugaggaucuaauauugauggugucacagaagccagaggucuggaaccagaccacugacucacugcaauaaacauuugcaagugaagauguguggacagcaggacauacugggaauacacugugacacacuacagcuucagugaugauagguugucuauguguggcuuguauuguuuguauguguuuuauuuuuuggggggggagagguuguauggcgaaggaggggacaaggagaugagugggacuggggugcaugaugugaaacucacaaagaaucaauaaaaaguugaaaagaaaagaaaagaaaaagcugagucuaagagaacaaaaucugccuacuguccccaaguaaggccccaaaucuuuuauacacauuucaacacuuacuauuuaagguacugguaagauggagacucauguagcacccaaguuaaccuuaaauuuuagcaggcuggagcgauggcuuagcaguuaagagcgcuggccguuauuucagaggaccaggguucaauucccagcacccauauagcagcucaaaacuggcuauaauccaguuccagagaaucugacaccucauacaggcaaaacaccaaugcacauaaaauaaaaaucuuuuuuaaaauguuuuuaauuuaaaaaauugcuauauagcuaagguaccuucaaauucugauccuacugucucuaucucccaaguccuggcauuaugagugugcaccaccaugcccagaucaacuuacauucuaaauucacaauacacaagucauuauggccuuagaaagaaucaauugaacaucaugguuaacagaugauacaucucugcuuauucaacaccaucauggauucacuuagccuccagaaccaucuguggcacuucacauaccacuugcacugugcuguuuauacccaucuucccucccuuaagugucauaaucaauccuucauccuuacaccucauuacaaggaagauaaaaaacacucuguccauaguggcaccugauaaggaugcauggauacauaaaggagucugguaggagagaaguaaaggaagaaaggaaaaaggaaugaauagcugaaauaaggggaacggcccuggguuucagguaaagcuuucuccgaaaugaauauaaauaacuggucccuaagaacucaagcuuaucacuguagcuuuauugucugcuaucugagacagucgggcucuguagccuaggguggccuugaacugguaaccauccuccaccacuuggcagggaucacaggcaugagccaucacaucuggcuucacuauuacaaauuugaggaaaaacuaugacccacuaggucaauagaacaugaaucugaaccuaaaggugaggccaaguaagaaauccggagauugaaugucauuacugcuaacccauggcauucauugaagcacacuaacaucaauggccucaaaacugaaaaagaucacaacaucuacucaaaagagcucacuguguugcacguaaaaucaguagggauccuuaucuauaaacaccccagcaaaaccaagaaacacuauaagcaugcaggccgggggugggggagggcaccacaaagcaaacugaguuguggauucaaauuugcagugcuauaccuggggagggaaagcugauccaaaaacuuguuccauagauaccagcucaacaaccugguauauaauauacucagcacaacacugucuugcucaugagcacagcaaagacagccauauuaaccagugcucugcaugugugugucagacccauguguggagaaugccugccaaggguugcugaccaagguuuguaaggagcccgccucuccccuaagaaaggcaucccugucacauacugacccaagaugcacugcccugcugcauaaagaacuggcugucaggucacuuguucauccuguauaccacugacauuccaaacuagauucauccaguuaccucacuaaaaucuuuaaagccugggugaggcagagacuaguucauuuucauggaaguagagaccaggugaacugccaggaagagggaucuaccuagaaagagcaguuuccagucuauaaccuauugagcugccuucaggaaaagcagugugcuccacuaaaacaugcuuuguucuaaaacgccacagugacuuuuuuuguuuguuuguuuuguuuuuucgagacaggguuucucuguguagcccuggcuauccuggaacucacucuguagaccagacuggccucgaacucagaaauucgccugccucugccucccgagggcugggguuaaaggaguucgccaccacugcccgauagacacgauggcaucuuuuaaaaaagaaaauaauauguuuauguucuuugauagcuacacaacuuccaggaaaaguuaaaagccaguucuuugugagcaucacacgacugccaacugguggcaagaauccauagcuacacguagucucauucaggaacaaaguagcuucuggggagggaauuaguggacuucagaggcuaaccacagcuacuaucucucagucucgauuaaaaccauucaucagccugcacuccggucaagaacuuaucacugccugacacuuguaauccuucugcuuuuuuccucuggguccaauacauuuuggacaguuggaauucagggccugaagcgaugcuaugggaccuaucuuugugaaaccccaggacacuugguucgagccuggaaaagugaaagaaucuccaggaacaacagucugagacucgguguccugaaugucggaaugcacgcgugcgcgcacgacccgagccuuuaguaccaggaacugagucugcgggacguugcuguucucugucccucgcgggcccggcagucacugcuguccccacucgggccugaacacccgcgcccccgucaucccaucacccggucguccagcucggcagacacucacgcucugcuagcaucgacauugucucaaguuugucgaacgcugccucuggccugacgcccagcgguuaugaggaaccugaagcgcgguuaaggaagaagccggcucggaaagcacgccggguggagagcuucgcuggggcgcguacua

SEQ ID NO: 7528 - RNA, 18454 nt, Mus musculus
uagaguugaaagguuuauuuagcauuuguguccuucauuacagggaaagcaugguugaggggcacaggucauggugacaacagcaugcugaaagacaaaucaggagcagggaccagauaucagguuuaaacgccuaccucuagggacauauuucugucaccuagacccugcuacccaaagguuccacaguuccucuaaauaguguuacucccuggucaacaaggguucauaacagaagccuggcaggggauguuagauucagaucauaacaauguucccaccacggguaugguggcugaaccugggacaaguagaggauucccaaccaagccugucaucuuuuaaagcaauucuccuggcuuccauuaccauggggacaagcaguaaaucgggcccaguagaugucacccgggacuguccccaacaaagcagaaucuguaaccacuccauccucggacccccacacuguuccagguuuauaccggcaucggccagcucuuuauucaggcuccucacagcuuggugugugcauguguggcucagggaagaacccucaguccacugucugcuuaguguccacccaccaugcuggaaaauccuacuuggggcugcuuccaggcagcucaggguccauugccagaaucuaacacccaagcccucuguuuguccugaucauagauccagaaagaacuugaaaggagguacagucucuccuucccugaaacccacaucacagaugcaaauccuggugccuacuuugccugugagagucagccagggaugggcaugccuguuuucccccugaguaugaaacuuauaagggugaagagcagugcagagcagugcagcuuucccugugaugaagauaauggcucaccauaggccacagugaagagcacuugccuuugagaugguucauguccuucucaaucucuagggacagagggaggagauucuuaucucaucccuucuuccuuccauccauccauauuuuugagauaggguuuucauguauccaaggcugaccucaaacuuucuagguagccaaggaugacccggaucuucugauuuccugccugcgccucucaaaugccaggauugcaggugugcacuacuaugcccaguuuacacagugcugggaaucaaacccagggucacaugcaugcugggcaagcauucuaccaauggagugauagccuccucacugcacaccauucuuuaacaccccaccuacaguguggcugaaacucuggugggaccccacucuuucugggugaggggaaggagcuccagagaguuaaaggauucugucacugcuuuguagacuugggaccacaagaacuacuuugcagcaucugcccucucuaggcuggcuugacuggugcugaguuggaugaaccugccugagcugguggucuauucaugcggagggggggguguaacugagccauugucuccugccaaaccaagcugcaaacuugugucuguauucauggaggcacagugccccagggaaagaguccagacagaacccugagcacuggcuccaggacccuuucuuaaguucuaucucuggcuggcugugagcagguccuugaccuugccugcacucucuccuagcauccucuggaagaccuucaccacuugcugaacaugcagggaaagagaaccucaggguguuauuggcucaggggaccucuaaggucccacugaaagaaaggucuggccuagcuaaucaguuaccuucuccaaucacacacugguuuccaagacagagacagcauggcagucacuuuguuccuuuuaaucacuaggagccucuggucuauauugagcaugccccaaguugcuuuucucgcguguccuugagugguagucaccagccuccuacuucuuagcuuuggcuuucuuuccuuuauuggccuuacuagccuugggagaguccucuaaggcugcugguccaguggugauacagggaagcggggguggaggagcacugagacugaguguuuucuucugcagccucagguccaggaugucaaaggcugccuggaucucguacuguagaagcuccugcaggcaugcaaucuggauauggauggcuucacugaccagacgcuccagagccugcaagauacacaccagugagcgugcuuggaggacagcuaaggcucauccuccuucuccugccagugguggcucuuccuggugguggccaucuucuguggacacaccuccuguccaucagcucucucccucacugcagcucacugcuuuccgcccuucccacugucaaguucaggguaacaaucuccuuguugugugucacucaucccucacaugcuucuggaaccauaagccggugacaacucauaauuuguguggccauaguaaacuccucccuuguaccucucaguucuagucacuacacuggaggggacagacagaguuuaagagaggagacuuaccucccgaccagccaguuauaagaacaugagcucagaccccauuuaccauucuaacaggacacacuaugaccccuuucacauuccugacccugcaguguccuggagauaugcgaaaggagaaguugugcgugauaucuggagaugaugaaggauauauuuugggggguaugcuguuguuuguaauauguacuuaaaaucugguguacuguucaucccagaguauucccugaauuuuacuucaauauaaaaauaauguucuuccccagcauuagguaaagauuggacuccgcaaagaaguguacuugucacguggugaugggcgucgaaugccucccuugggcucacugcgagggagcccaagcucugccagagagcccuaaggaaggucaaagggauuggaaaggcaugguggagcaguggaggguguguugggagcaggaguugcuaucaagcagccuuuccuuggccuagccuacagacuccaagguaucacagagaaagguccuuuaaggaccuggggacagggaccuggagacaggcuguuccugagcuuccucaacucccaccagaugucuguugguuugugacugagucaagauuggccuugaaccccugauuccccugucuucacuuccugagugcuaggaugguagaugugcacuuccaugccuggcugccuguguuggcugucuucauguacuuagaucgcauggucuuguccuguuaccauguaccaggagccuuggcccuggaugagugucauccaaccugcuguguuaucauuauuuuagcaauuucucauacauaguuuugaacuuuaaaggaauacuuacuucuuuggcuaacaaaucagaagcccaaacuaaccaaacaacaauggaacccuucacaacaaacugucuaaauccugggucuccauaaugauauacagacaaagggcacuuagauagcucccaucagcucagagagccaugcuacuuugaugauacacucagugguaucuguguccagucaacaacaaugggaaaaacucagacuucagggucagcaggccucaacccacuacgaacuccacuccacuguagcuugguggcauugggaaaaugauguucucuaacccuauuaugucaccacagagauggggacaagaguuucuacucuacaggaauguugugcaaugaugugcaugcaaagucugugggaaaugcuagaugccuauguggcuuucugucuucacuaccagugcagauagugaaggaggcuugggagugaguccugccugcugugucucagagauccuggggcagagacucaccucuuuccucaggguuggauggggcugcagcugcccuggagccuccucaaccccaaaggccuucugcagcaucugugccugcuccaugcgcagcgucuccuucagcaucagcacauuugcgcgcuucuccaccucagccgugcucagcucagcuaccugcugcucaugccuccacacaucccugucugugccauccgucaguggaaggggcugggguggugcacauauuugcucaugagcgacugucagguugaccuccugauccuggcucaggacauacugguagagucuauagugucugaugaaaguguuaugggaauagucacagagggccagcaggugggugacauuaaacugcuucugguaaucucggagcuucuuccccaguauugucacagccucugugauggagcagccuguggggaaagagcaguagaguacagagugucaauugggcugugaacccaggcuugaccucagagccugcaucuugacucugauucuccagcaccacgcacuagcucccaagggcucuggagugcagcucauuuccuaugcauuucuuccaugguaacuuguauuuauugcacuuucucuacggaacuauuucauccuuuuuguccuuaggcuccugcucugacuugcuccaacugugcuuugcacuguuucaacguccaguuccucagaaaggaaaaggcagagcaacaaggggucucugcuguuuguggagaagguggugacuggagauguguccaggucaccuugauaauggggacuugggggcagagcaggacaaauaggguucaccucaccuagagucagcucugagaacaccaacagugaagcucggagagagaucaguucucucccaucccuccccaugcccaagcccucuaggugccucggugcaaugguuggaagcagaccuccacucaggcugugccaggacuugacacaggaauugguuccugaagggccauggcagacugcugugcaugucuuaggcagagcaagcaagauauggcuuaagaacacaacccucauauaaccaggagagccaguucucauagacgccauggcuaaacacagugagcuuaguuaugugucuccuugcccucuguaugaggccaaugcagggccacacaugcuuagaaugcaggucccuuuaguggcuguggaaaucaagcccuggaugcaggagccuggcuuuuuccuaaagucggggugacucagcauaucucuucuuuaacucuucccaucaucccuuauuccccuggcuuuagaggagucuucacucugcccuuccccaccuucuauaaaggggugucuuggcucugcucauagggucguguugaaaguuugccaucuuaggucuccaccuacucugggcuccucugggcugugcuguuccaugugggaauauugaccacuaauuaucucaugaaacugaggaccaagggaagagguaguguugcuuugaaaauagcagguaggcaggggccagcuuugcugagagccucauuaggggaucuggggagauuguccgguguauuuuuacaucuguggcugggaccaaacuccacagauucaacuuaagggaagaagggcuucuuguauuuuggcucauuuucggagguuuuucagucugucacaguggggaagcuauggaaggcagaacuuugaggcuguaacugugacaguauaugugugaaguggaguuuagucaagugagaguguaccagaaagcagacagagcacagugcugagacaggcauuggaugccaccuucaaagguccaugcucaguacugcagccaguuagauccaucuccuaaaguguccaccgugacucacugggaagugaacauuccaaacacgacucuuuaggggacauuucagauuuagacuguuaaugccagggcuccacaggugagugggaagggagguggcuacaggcuggagcuggguguaggcaaaccccuucuugcagagcagagcagagcagagcagagcagagcagagcagagcagagcagagcagagcagagcagagcagagcagagcagagcagagcagagcagaacaaguucaauucuaagagcugugcucugucuuagggaaaggcccuggcuugaaugaguguccuuccaagacacucauucugacccuuccuagcuggggcaaccagcaacuuuccauugaauguaaaguuguggguuguauauauuuacuuaaaggcuuguuggagcuuccugugagcuaacauaugcauuugccucuccuagagcuacaaggcagagagccacggaugauacaggggucauuugagaaaaguuugccucccucuuuccuuccuccuuggcucccuccucccuccuucuuucauugcuucugcuaucucucuuuucuccccugacccccaccuucuguucucuccuuuccugucuuuacccuuccuaucuucaacuuccuucugagcuccuccugcccuuauuccaaggucaaucugucagcuguugacaagucuaugaacagccacugcccauccuguaagaagguacugugcugggugcugguagugcuaugauuaaaaagucacaccucuacccaugaagagugggaaguagaagccaaugccaugguauccaacaaggaaaggauugggcuggaggaacucucagaugacugcacucugagaaaaagggauuggccagcgguuuuguucuggcuaaaagaggcagggcuagggagggagguuaguccaguguggagagaaagagcugagcaaacaacagcauggcucagguugggggcaagauggguccagaacaguagagucagauagacugcagcaaguguuggcagcaaaggagguagcaagcaaauggaaggcacccaugggccaugcucaaucgcuauggcuuaaauauuaggagcggacacuuagggacaucugagcagcagauucgaggugagcagaaaugaguucuuggagguaggagugggacaucugugagcaggagcagcaggccaugauggagagaggaacggacgcuuagggauuggcuuggagcaggcgcugaucagguucaccaaccagaggcucuuggcagcugccaccuggggaacagugacugcaccaaugucuagugucccucacuacccuauucuugucugggcuggguaucugaguauagaagacuccucuacugcaaaggcagccaauggacaacagcagcauccccugggaacacagugaggcuagcauuuguguuccacggagcaguuggcgccucaccuggguacugggcuggcuccaucuugcugugccuucuuuugcggcuacuugccugagcaacucugcugugucuaucaccuguauccacugcauuucuugugguuguaaccuaaaucccugacagaggcaacuggaagguuuguuugggauuacaguuuuaguccuucacaguaggagaagcauggugaaaugggacagucggugcuguaggaguacagagcagagguuauuucauuugguggcacucaggaagugagaugagaguggaaccaaaggcagacauccccuucaaaggcacucuccuuugaagugacuaccuccacccguaaucuacuuacuccuccuaaaggcuucacagccucuaaaauagggccagagcuggggacugaguagucaaaacauaagccuguggaagacauuacauauucaaacccuaacagcauccaacuucccuggccucuuuuugcuauucuuuuguguuccucugacacacacacuuuucuuuccucuuucuuuuuaacaaucuuauauacugggcuacauaaagcaauuuucauacaagcacauaaugcucuucgaauaucucucauccuguugccuuucccccucccaccccucccucuccaucugucccgugguuuuuccuagucacuauugcuuccacuuuagugccauagugcauauacgacguugacuccacagcaaauacaugaacagugaagcaaaggaaagacaaagaacccagauaggaacccaugcagcuagggcgagggaaucuaaaagaauacacuggagaacagacugcuucuucagcacccagugcuaacaaaucuagauauccacaugcagaacgaaacuagauuccuaucucuugcauauuaguuuauuaaaacuccaaaugagucaaggggacacaccuucaaugggacaaaaaaaaaauugaucucuaacuacauucugaagcugagcucugccagcaacccugauccuuagcauuaauuuuuuuuuuccuucuggguuccuugagcaucacagacauccugguuaguggaaaggaaggacuaggcccagugggaccccuugacugugccucucaguucugcacuuuagaaucccugggaccgucuagaaugcagauaguucccuacaaacgcagcccugucucauccaugucagaaggugagcacugguucccagggcagggcugcuuuuagaauuucuucuuugcaucugggaucaaagccaggaguucucagccuccagcuaaaaggugaccagcaggaacacagagccucuccucuccaugaucgcuuccaggucaucacccuccugcugcuggggccuuuccuacaugggcgugagucuggggcugcucagacuuguaggcauauugacaaauucaguucaucuuuuggagagggugguagugguugaaaaaaugacgugaaauaggcagucuuggcuacuuugagggcacaugcaugcugcaaauugucaagagaugaggaugcaaguauaaacacuuucaguuccuucaaggcccaggaugagaaaagcaagaaguacggaagggguggcgagaggauauguguggaugccgaagauugggaggugagggguuccucgagcugaaggaacacauagaauccuuaaguuccucccaguuaagcgcuacaguguagcuccagggcccucgggguaguggagcaagaggagggcuucagacuaagaaugacagccaagucgagggaccaccagacaggugauccgaggugagugccaggaaaucauuaaagcuggccugcaggccugggugaaucacuguaaguggugaaccuucaugaggugagccaucagaacuucucgaggauccucaugaugaacuugccagaaggugcucuguucugccugcagccuggccugguacagcagugcacagcgcgggggcccugccccucuauguggguggccaugucuacugcuuuccccaaggccaucccauccucuucagccccagcagccacacacagaauucagauuugcaucaugacaucuguuaggcccagccaugucugaaucuuccugagauugauacagcuuucuugaaagguaaggaaacuguagugaagccuuugccugggucaacaagaaucccugguugacucugaacuccaccagagacacugucugggcucaguagaccuugucccucgcugcugugaggugcacaguuggcuccuuguguccuagugacucagcauggagggauuaagucgaagaagucucugguagaggcaggcagagcugggccugcacacugcucuucaauaacagggaguggccuucauuugcauuggccacugggaacuuccugaagucuguccccaaaccccuggaggcccacaccugugaggaggagcagaguggaggaggagaggaaugaugggagaagggugugggggaggaucugcagauggcaacacaagagcuggcuccagcacugggcauaaaagaccuggaaggggagcacugccgucuccauagcagcacaagagaggagcccagccugaggguggggaggaccuaggacuggugaagaggggcugaucuuucuggauggguaccggaugacuuaggugucuccgacaagauagucugguugccuuguuuuggauccaaggcagaagagucaagccaggacacagccugacaacuugacuuucccaguacuugaguagcagaggcuggccugagaggaggaaggcagagggagcucaggcucaucacccucuauccagcuccauucuguguucagcagcaucugaaauccaugcggugacuaccaaggcaguauuauccucaggguuggaggacaccacagcaucacaucauaucuacccugugucccuugggccccccaaaccccucucagcucagggaggcucacauugacccauggggcacauugaagcucagagagaggcugagagauucacucaaggacacagaguuuaggacuggcagagucagaauucaacccaagccacuugucucuuaagcggcuucaagcucuguuuguagacguuuagagguggaugcaagaaagaaaguuguucugcagugaguacuaucucagagaugcaggaucugagccaaagaccucgaaaauaaacugguccaaggaaaccgagcagucuagucaucaacaagguggagagaaugcaaugauuuucaaaucaucuaucuggaccaagggaccuuguucuauaaaguuagguccagaaaaaaagaugggacccuucucaacccagggaccagggccuagcauuggagucaguuucaacuccuaaccuggggaaggaacauauuucuucuacuucuugcuccugaccccuggggcuucuugugguuagaaaugucucugaacguagcuagccacagucucugaggaaaggaagggauaggccagggcagaagacaucauucugcuguuguccugggaguaugacugugccugcucugcugaccaauggugggagaacauauggcauuuuuagaugacaccugugagauuucuccaccuuugucuggccccauuuccaugucaucugucuaugccuaggucucuaagaugcuggcucccuuucucuuuggggcgaguaguucacugaggaaugugcccuccaccucccucccccccccaagggacaggagacuggguagucugguuccaacccccccccaccccccgagggaagaccuucaggaucccucguaggcugccaggcugaaacguucccugugcccuggccuuaggauugaggaccaaccacauaucagucaucuccacccccaugguugacagucacugugccucccccacacugagcucaggauggcuuugacguuggggagcugagcucagagucugacuucuccgcagaucggcugagugagagcccaggcugaggagucagaaagaugcggcucacaccuggucgcagcguguccucacucgcacaggugauucucuuuagaaaucagugcuuuuaucuggaaaauggagccaauaaaaaucuugccuugucaggcccaaagagagugacuugucccaggcuucccauagugauaaaucaugugcucauguguguuccuccucguccuccuccugaggucucuaccaguaccucucuggggauaaucuugaauguguaucucuagagguguggcaccagguuaggugcugaguccuggauacagagugaccuccauccggugccucagugggagaugggacauggguggcagagagaggauucuaaagugugccguuggauggguugggaauagaucagguggccuccuggaucccuuuccacacuaagaagcugugggggauuuucauggagcugacaguccccugagccauaaugggcugcagugggggcugggagccaugcucugcaguguaccgcagcuuaggaagggagucccaacucugcaacaucuuaacuaucaccccugucugagaggaaaacaaccaaauaguccuccugggucaagaacaugacuuuacccagucugccaaucagauacguuguacaccagcucuccccucgaugcuggggcuucggcuggcugaggaaagacaggaauaagacagaaaggaucacugucaagagcuggaggaccagccagcaggugaccugcacauacguccauaggugacgugcauaguuuguucuuucagucugacccgagacacagaccccucugaacuccuccugcugguggcugguaucagucccgaugcucaugcaggugacccaguuacaagcacauacccaggcaucuaacccagcccuuaugccaacuucccauuccacuugugguaggggucucucucaggcuauacugucuaccucucgggccugccauccacugcaugugcucaagguccuugacccaaaugcaacucaacagauagggcguggauucugagucagacacagaccuagauucaaaucuugaacccauuuaccccaggugcauucuuaggagaguuaaucucccugggccucaaugucuccccuugaaaacacugccuuucguaucagaccuuagggaagaugguugaugccacaaguaacgcuaggcuuuuccuagccacucuugccaggaugaauggucaggccagggagcaagaaugucuuggcagcaauccugccaacauauaguuagcagugaccccacuuugcacagugguugaguaucucacccucacccacccugaacgguucuucuuuucucuuaauauggacucuugugguauagucaagauggcuuccaccucaaaaaccuccugucucuaccucccaaguucugggauuauagacauaugucauaauauagacauaugucaccucaccuggcuuucuucuucaaauuuauacauugaauaccuaacuuccaccccaaaaagcuugaacuguuuuguuuuguuuuguuuuguuuuguuuauggaauaaggcuuuuaaaguaggugggguuaaaugacgcuauguaaucugaacgaggccuuauaugagaaggaguggacacgugcagaaggggaccaugggaggacaugggagguaauggcagcuagaggccaacaagaauagucugaggaacaggacuaccaauaccgccucucggauuugcagccuccaaaacaguaaggaaucugauguauguugcugacuuuuauggucuauggccauugcaaggguggccugaagugugcuguucacccaggggaacgucugaagugagaguugucaguuugucccaagaaacauuucacaucuccaccaaaggccuugguggaaaccuuggcaaagaaacucuaucucauaucuucaucguagucuggucugaggccccugaucagucugucccaggcagcaggaaaugacaucuauucucugcuuugcuggccuggggugcugcagaugaggguacagaacuugugccuggccaugaguagccuggguggaagagccaugcuggguagccugauaagucauugcuuacuccaggucuggguugcuggggacaggcagguggcugccuucccacccucugguggccuagugacauuuccuggagaaucaggaguggcauggguggaacuacagaugccaggaccaugagacacacucugcucugccucuaucaaccgguucucuagucugccuuccucccagccccaggauuuuguggccaggcaguagggcaggggugucuuccacuucauguguccauauuguuguggugacaaaauguggaagcagguaguuggcuggggaagaauccuccaggcaagcagagagcagggccugcagagugaaauagaggugacccaggcuaccccagcuugcuucaucucuccuucuugcccauggcuuccugaguggcccuauaucuguaguucccucuuuucuccugagccuccuaugcccuuuccugccauucucccuccaccaggaugugcccaacuggaagaacucugccacuugaccccccggguugaugaucucacccuaagcccaggaggcagcuggaggugaguuguccggccuuccuggaggcuggcccaagaaggugccaaguacagaccucuuucuucuggccuggaaucgaggccagaagauccugggagcccucugccaggauggaaucagcuuaugcuuuugaauaaagggccgcccuuucccucccagagcugggcucgauugggcaaggagauaagcugaguuggcagccauccuggcagggcucugaaucacuguugugcaaacacagccccuccuuaaacgcugccugccaaugcccucaucugucgugcaaccauccuuagccuaggcuacccacaacaaagcaccccaggaaagucaccugccaagaagagcagcagccaguguggaugucagccggaacagaaacucugauggugccggccugugguccccacugccugcauccuaugccaacaccugucauuggugugauauaccuaggagaggcuggggcaggaugcagaauggagacucgggugcccucaucaggacagugcgcacuuucuucacucaugcagguaggugguggugcuugugugcauguuugccaggcuaggucauggcccauggcaguugaauuagaaggcauuuggagauuuccugggcuuccuuugugcugacccauaaccugaacccaucugcagaugaaaggaagacaagcaacgccuugucuggcuccuuauccugagccauuagcuuuucacuuaguccagugcacuucacagaacauccagcagagugacuggccaggggugugcagagacaaagcuggaguuaacaaacacacccucugucugcguugguguuuucucugccggugagaccucaggagcuccuaauaaacgaaggcuaaguucacuugaagaagccagcaggaugacugacugcuucaaauauaauuaugugggaccggaaaaaaagacauugaugcaagagcacuacugucugauuaccgguuccaucugacccaaggaguugguaggauagaucuccaugcccaggaaacaauaccaggccgugaugcuugagggccauaauagaauggaccaugcuugucugguuuaucucaaaccauagggaaaguuuaaaagguuagcaucuguaggggaaaaagcagcuacucacuuugauaaaagacuucaaaguguggucaaugacuguccaagucagcccagcuucaagacuuuuaacagagcaaaugcugccucuggcuugcaauuuuuuccuguucauuccuuucagcuuccucccacuacuuuaaguuguugguaugguuauuuuucuguuauucgggaugcugucuacuucagcuuugcuucauguccaauaaggggugaguggcauagagacuucugaucagcuuccugcguuucauggauuuggccccugaagugcgaucaucucaagagacacugugcacgguguggaagugcagucaccuccuuacugcauagagagaugucuuuauugcauuugugaaagagaaaguguaucuaucaggcuuuuagcucuucuaagagccaaguggacagggucacaugagcacgcaugugugugugugugugugugugugugugugugugugugugcaaccuauuaaucgaacgguuucccuagcccaacuuuuaagcauuuuuauuuuuauuuuuugcaggauuaccauucgggaucauggcccaacagugagccugggugucugggucagaugugaccagaagggagagaaaagggagcccaagaucaggacuauuguugggcacaguugaggcggaacacuccaucacuccagcaacgcggcggaggcagaagucagugaaucauacagaaucacacagaaggcucagaguucugaaugggcggcugguucagggaacaggugagguugucagggugaacagcacgccagcaguggggaugaugguaacacuuggcugccaugcuugggagagucuuccggcuuacagccaagcacagcuucuggagugcuuuccaccuguaacccuuuuguacccucaccaaauuuauuuugagacugagucucaucuuguagcccuggcugcucugggacucacuguguacacugcguucaccaugcuggccacgugcuuucauagcccccacccaccucugcuucucaagugcugaggucaagguguuugacaccauccccagcuuuaugcccuccaaguuuaacacaacuccagcuauguagccaaauaaaguaggaaugcacaucaaacacccauuaugaauauuauauuuuagacauuuuucaguagauguaauuuuacaauugauuaacuauuacaccgaauuuacauauuaaugagacuaucuacuugauuauuuaaauauaaaaaagaaauuuuggaugaauauuugacacugugguauauagaauauuuucaacguuuuucagauucaauuaauauuuugacuucacagugcuguaaauacuugcuucaaauaaacacguaguccaaaaugacagaaguauacccagggcccuuucagaaacugguagaaaacuugcccuaaucucaaaccaaaaucauugaaugauauuccuaugaaacuuaagccagcaacucaaauagcgauuuaaaaaaaaaaccaaacguucuaauacagcgcaacccaaaaugcccuggugugacgcacacugaagaaugacagagggaaaugcacucuucacuuuuaguaauuaagucguuauauuuccuuaguaguccugcagugaccagcucacuucugaaaggacacccucugaggagcacagccauuguggagauggccugcugucccaggacacaaggaauaaguucaugaaaggcccuagggaggguguugauacacuugggcaaaggaaagguaaugcccugagcaucgggggggggggggggggcaguguggagugcuacuagaugugcaggcguggagaucagggguggagagcauagcccagggcuguacuguuucugagcacagcaccucuggagaggucccuggcuccugagagcuucacaugcccucggugacacucuuuaccuuugguuuccuugagcagcucuucugugaacuugaccaccuggaccaccucgacccaugggaagccuuugcccacagcaaagaugacgcugucauagaggguguccagcaguaugcucuggcgcgcaucccucagcucaucaaacuccucccaguucaggagccuccgcaggugcugucgccccugggguuucugcaggguaaaggagacaaugucaucacuggacaggacauugacacugggucacacguacauccugagacuaaccaggcaugugagggcagcugugccuccccuuuucuggggacuuguucuuuugggugugcucccauguguguugguacacgugugugugugugugugugugugugugugugugugugugugugugugugugugagugugugugugugugugugugugugcucaugugugggggagugugaggggaagccucagguugucagucaccacucauaguccacuuuggguuugggaugggucucucacuagcauggaacuugacaugcuccgugccucuuaccgcccuagcuuugggaguauaaagcuuuggcaccacccaagggugccuauaaaauacacucaaucagacucagucagguccuugugcuuguguggcaagcacuuggccaguuuagcucucuccccaaaaccauuuauucuuucuacgaacauucccuuucuuugagaguucucacgcuugccagugcagccccagauuuguauaccuccaauaagccucagguuuuugaacuaugguuuccccccuuucuguucccuaaaacauguucauuucucuccgaggcuacuuucuacuggcugaccugaugcgcucaugccagaguguaaaugacugaugaagaagagauuuaauaaggugauguuuaacuugauggaagcucaggugcucuugugugcugcgagaagacugauagauuaaacuuuucccccucaguguucuguagccuuucuagaaggauuguauaggagaagcaagagccaauucaaugacaagaaacagggagcuguagagaccugccauaugcaggaguucugcuccccgggguaaggaggcucugaguggaggaaccaaggagagcaauggcagacacuauggcagugaaccuagagcccuguucuuggcccccaguaguuucuguuuaccacuuuccucugagccaugcagcaccucccagaaguucccaucagcaagagaccuuuugccccccccccccacacacacacacauacaugugagacacugauccagagggcugcugggguccaagguagcagacggcaggcacugucucuuccucccuccccuaucccaggcugucugguucacagccuagacuucccugugggacccaaacagccuaugacucuagaauuccagccucaagcauccauugcaccagauucaggagcagcaacucuggaauuccagccuuaagcauccauugugcccucagagaugaugugcugugauguuagagguaccacucaaggagacagcauccacgagccucguuggcacaccuucccaccauauccucuggagcaaaggucucuaagaacccagaucuucaccugaaacuggaagacuuccuucacucccugggguguuaggagugccaugguccugacuccucccaguugcuaggagaccucacugggacuua

SEQ ID NO: 7529 - RNA, 9473 nt, Mus musculus
acuuggcagucucacguuuaaucaucagguuagaagaaacauuacaaaauauaggaacaagauagcccggcaagagagcaccaaagggcacgcagaguucugcucauacauauaaggccuccccgccuucgcugucugcuugcugauccaccucacauagugugacaccuugguguauacuccuggcagauucuucuugccacagcccaugccccagcugacaaugcccaccugguaccaaauggcuguguuucucuuuuuguugcaaacgagagcuccuccacugucgcccuaggaaagaaaaguuguggggaaguugagggcaauagggaaacugcucccauaaucugcucaagugugggugucugaucaaaaguacugaaggguuccuaccauggcaguuucuggcuauuguucaguuuuucagccacaggggugugacuguugcauacguagcaaaccauguaggcaaaagcaauuggguaagugaugacaugaaagacugaugucuaccaucaccaccaccaucaucaccaccgagaucguuauugauuuaauguaucauucauuuugauauaucuuguaucaaaggcuugugcuuuucccacaaauuuguuuucuaucaguucagcgcucucuauuuuacucaaaaaugcaaaaagugaacagaguaagcaaaaauccaccaugccucauaggaagccauugguuggaucuaccagguacacagauggauauauggcaaaugcaaaaagaacgguaucauguuaaaaaugguaacauguuaauacuuaaaucuucacauuuuaaaugguguagggaaauaaauaaaucagaagccacacucauaagagagaagguccuccacagacugagacagagguuagagcaaggccacacugggaucuagagagguggcuauggcuccccucuuagaccuaggaaggaacaggccuugcccccaucuugauuuagggcuuguaugauccuaagucaugguaggaucauguacauugauuaaagcccacccaccuugugguuauuugucacaguggcccuaagaaauugcugugguaucucauccacuggacagaaaagccagccacccuucccaggugagcccaaccccuuaccuggcaggcauccuucccaggaucuugagucccagcacacagcauauucuugguuaauagagacaaaauauagccacaccaaucccaucuguacagauccacuuugacugccugcagaauuguggguuggacuccuuuuucaccugagccagaggagaagcaaaagaagagagagucucagggaaaauggcccugaguugagugucaguacccauccauaucacaccaaugacaaaagaacuuuugcucacccagagaccaaucaaaugugggagagagauagguaucucgaagacugucaagaucccccaggcauccauaguucccuaguacuagaucccugcuaagucucggccugaguucagcaucuuccagcccuaaguaggcacgagccccagcuggaguccuagaaacguguuuuguuugaaugcaugaugaucaagaaaacugaggcagauagaggggcuuguaacacucuaggacccuugagacauucaccaaguaggagcucaccacccaagggguggaugcuuucuuucucuuuagguauugucaaaucuugugucuagaaugcuuccagagcagagaaaaggucaaagcauauguguugaaggaaugauaucugaggacuuugggguuaaaaacuuuguuuuguuuuguuuuucuuucuuucucuuaagcucauaaaaucaucagugacugacucccacccagacugggacuuuggaacagcauuagaacacagguccauccacauaaggacuugcauggaggaagagcaugaccugcaaaauguccccugcuaauugauuauggaacaagacaugcuguggugguuugaauaugcuuagcccacaagaagugguacuauuaggaggugugaccuuguuggaauaggugugguuuucuuggaggaaguaugucacuguguaggcaggauuugaggacuccuaguucaagccccacccugugugaaagaaaaccuccuccucuccacugccagagucuccuggcugcccuuggauuaagauguggaacucucgauuccuucuccugcaaugugucugccuggaugccaccaugcuuccuacuauggugauaauggacugaaccucugaaaccauaagacagccucaguuaaauguuugccuuuuguaagagcugccuccaucacagugucucuucacagcagugaaacccuaagacagcaugcuuaccaagaagauggacaaaugcgauuaguuggcaggaguggcugggaagggggucuagaaguggacuguugcuggcuucuguaaaggacacgucacagacuuagcugauuuuuaccccccccccccuggccugaaucuauggcuuucaaaaaguuagagaccuugacuuuacaaaagcaauacagauaucaucauguggagccgagucaguauauacugcugcccuguguccuuucauggucccucagaauucuacugaguaaccuuucagccuugguuuccccagagguucugcccagggcucauguucuauagcauaagcacacaauuuguuccagguccccaaaguuuuaugaaggcuagucagccuuggggguacugaggacauguuaugucaugggccuucagugagagcugaagucaucauauccacuaggcagaauuucaaggccagcagagcuucuagaauuuucuaauccuucugaacaccagccacaugccacccuguauauccaaucuggagucacguacuaguauuaguaaugccccauccugucacccagcaguuccuccaugccuguaugucagagauuucugaagugcagauagguauccuguugacacucaaguuuaauggggauuugagcaagagcaaagcuaugucguuguccaggagccagucaucaaacuuugggugcaagaauaacuuguccacuuucugauacuuuaugcccuuugugcugaggucuucagugccaugaaugaucuccaauuuagagcugauuuaaaauaagaagagagagaaaauguaaaugauagaaguggagaugugagauucccuaaggauucugcccccaauggcuaugaucaagaaggguuugucucauuguagagcagaaguccagaaagacucaugagacucaaggacuuguacaccagcccagagcuggugaugugugcacaaggacuagagccccaaccucacaucccagugucucaaaggucucugauuuugcacccgugcuccacucucugagucuccaacaaaagcaaacaauuaguaauaggcuuccccuuugucuguauagaguuucuuuucauuugucuuuuaagacaaguucucucucuguagccuaggcucgcccaugacaaauaauccuccaggcucacccuccagagugcuaggugacaggcaugcacuaccauaaccagcuuagaaaaagugcuuuuugagaagucagaucaugccagcagaugcuuagcagcaugaaaugccuggagcucacaagaagauacauugaaucgugggaggagaucugcuuacuucccagaggucagaaggacuacugagccaugcgggccauuuuagcaccugagagaacaagcauuccauuacacacuaguuaagaagacauuucuaacuuaaacuuguuggcacaggccugcaggaucagcuacuugggaaacguaggcaagagaaugaccgauucaaggccucuucaagcuacagaaugaguucaaggccagccuagaaacuuacuaagaugccuugagauaaaaagcaauggaugucugaguuugaggccagccugauaugcagagccaggacaaccagggcuacacagagaaacccugccucaaccuagcaugguccccuaggcucaaucccuggugccgccacccacacugaaccuguccccgaugugucuuccaggaauacucacuuguuuaguuggucgaagcaaugggaugcagauagaacccaccacucauugagaauagaucccccacagagaugacuaccaugauucauaauccccacaugccaggggaacuccaagauguuugcagguuugccucccacgauagcagaagcagguuugccuuccacgauagcagaagcauuguuaaguuguugggaucugcuacucauucgccggccacauaccccucaaagaaacggagaagaggaagaaaguuuuagggucuagaagucaagucugaagggccuggaaaaaguuuaccuuacaggccuguccuucccacacauacaggcaagaaggacucaacaaaagggcauagauagaaaacccacacuaauccaagcccccccccccccacacauauacacacauaggccucucaagagcuuggcuacacauguguggagaacacgggagguuacuuucacugccaccugcuucuugaagugguccuguagggcccagaagaagggagacucaaagccacauggugggcagcuggaucuugcuauuccccuaggacuguguagcaaugccucuuucuuuaaaccaugccucacuguccccugaaauaugcuauaggccugguguugcacugugcaucagaaaaccaaucaugggaagaagauggcuuagucccaccggcucucugguuccuguccugcuuuuccuauugugauuagggaacacacuuucaugcaacuuuaaucccaaggaucauuccaguccccccagaagugaguuuggcaguuccuauggggcagaguuguuuugacaucucuugaugucuuuucccccuccucucccuguuuccucucuuccuuucuuuuuccucauuuuucucuuccuuuucuaccuccucuuccuccuucucaguaccauggcucaacuccugggccuggggcauuguaagcaaacaugcuaccccuaagccuacucauacccuuccaguauuauuccaauuagagaagcaaaggcaauaaaaucuacaguaucgcauacucgcuguuugcaaagcacugucccauuuggccuagcaucaucacugcccuguuuuaaagagugaagccuaaggcuggacaucgggcgaaagcccaacagcuacuauacagcagagaagggucgggaacaugggugaagaucuaauggugauggcacucucacaguucuuauaggaaaauauagcaguauuucuagaccagcucucucuagucacaaucuccauccaugugucauccuaguccccacucuaccuaaugcucucucacacacuucugucccagaacuucaccacauauacccugcuaacauaucacugagaccacauaugcuaccucuguacagcacuaccacaaacccuauccacacagucucacuucacacccuguucccaucuaagucaucacuuaucaccaaagaccuacaccaccccaggauuccaccauauagcccacucccauauacaccaccaucauaaaacuccaucaccagagaacuuuaccacacaccccacugccacacaucuccaucaccaacucacacaccaacaccaccgaccccuaccacacaaucacuccacacacccaccauucaucaccaaucacugugucaccaccuaacauugccacccccacggccaaccauugcuucucugucuuuccauuucuuucccaacaucauaggccuguuuucaauucccuagaagugaccugcaguuuccugccucagggccccuccccuuucuccucccugaucugugccccuguguguccuuggcaucuuaccucaaucggaaagugaguuuugcugaucugggcaaaauugagacaggagaagcuggaguuugaggcuagcguggguuauggggguacucuguguguguguguguguguguguguguguguguguguguguguguguguguguaugugugagugugugugugugugugauguaauuuuaaauuaccuuuauugcaauaucauuuuuguaugagauauucucuucagaacaccagcaauagucagcaaauguuugcaaacucuugacaucggcuccucucauuagagucuaaucuccaugcgggcaggagccauaugugacuaauucuuauggccacaccaccuagacaagagacuaguacguugcaggagcccaguacauagugcuggaauaaauggauguauuggggaugguauaaacuggacagauggauagauggaguagguggauaaauguuuggauagguggguggaccagaugaguguguagauguacuagcaagauaguauccauccauagggcaguauuaaugguaaaacugcuuaaaccaccagugucaggaagagauggccagagacugaggagccuucauucaaaggcaucaacccuuugagcucccaaaucaggaagccaaggaagagggagagugggcgauuggcagaagugccauugcaucugagggagagugggccgucugcagaagugccauugcaucugagggagagugggccgucugcagaagugucauugcauuugagggagagugggccgucugcagaagugccauugcauuugaggaagagugggccgucugcagaagugccauugcauuugagggagagugggccgucugcagaagugccauugcaucugagggagagugggcgauuggcagaagugccauugcaucugagggagagugggccgucugcagaagugucauugcaggaaucccugccucgucuccccugcucauaucaaggaggcguauuuucccuuccugauggaccccagcauccuacaaggcaccugcaaucuaaucgcagauagagacaguuggcauuccagcaagaggaauuacaguacaguaaaacaggcguguuggccuggggugggagaaacuaaauguugauuugagauggcugcuuugaacguguacacaaaaugaugucauucgaaaucagguuggguucgcaaaaugacucguuuuaguccuccccucguuuugaaacauagugccauaugucaccuguugaggaucuucccugagucagcuacugugcugcgugcaugagcaacagacucuuaauaaucccccaaacccuccccgggauauccgcagucccacuuuacaggugaagaaagaagcugaucacucaagcucacgcaaaagcaggggcagagagggacuuccagcuaguccaacuguuucuaaacccagcuaccccuuucugcucagagcuucuguaauagcacauaccgcccaaccugcccaaccuuuaaaagccuuaauuggaccgauagcaugugguuuggauaauugcucacuggggugaaccugagagguucuagucaaacaucgauuguugggacccuauccacccagaaggcaggcuuuugaggguggaggugggagcaaggcuuccuuggagagcugggucugaugagugcuuaagugacuauugcuguccucugggaaaugcagugugauggugcaucuaggcuuagcagaacugccagaagucugggugcuggugagagguggaguccugcagccccgagaaaugucucucaggagcaaauggaaagaguccucugaagucuugggauggauggcggugcguagccuugcaggcuucagagcugaguaaugacugauagugguccacacugcccuauggauggauacuaucuugccagauuuaaagccuauaaucagcccaucaguaucacugucaagagcagacagagaggaggagauagcucaguaaagugcuugcuaugcaagugccaaggccugaguuugauccugcagaacccagguaagauucugagcacagcaguggguacccucacuggugauauggagacaacaucccugggacuuguuggcuggccagucuagaagaaccaaggagcucggcaucuugacaaagauuggcauaucugggcccugcagguuucuccacucugugcugagcccuuuuccccuugcuggccugucugccucugcaaugcauuaagcucuuucugugugcagagucuuuaccccgugcuugcaguaagugugccuccccaucagggaaagcaaauaucaugagugcagaaagacucuaccugaccagccaauuccuucggcuccacccagguuuccaacaacaccagucuguuuugucuguuuccugccauuguauaagacagacagcaagguuuacucagggguuuugcugccauacuggguguggacuuuaggguuccuugcuugcaggaaaguacccuacuugugaguggcuauccucaacccucuucacuuuuuauauugggaacagaaucucauuaaguuguccaggcuagucuugaacucacucuguagccuaggcuaggcuugaaccugagauccccuugacccaucguccucaguagcuagauuagaggcccgaaccaacagcccagcuuuuguguuuguuuaaggcccaucccuacuaccauacugaggaaaacucuguccuccucuacuauaaauacagucucuaaaacagcacacccuguggcagaggcuugaaauuuguugaccaccucauugacccaaacuguauacguucucuguacucaaacaggagcccaucacaggggauacugaugcccugccuugcuugagugauguaauauauuagacuugacauuagaucauucagaagguuuucagcaugguggaagaaggaagagucucucugcagauccugcuggacuuaagccuuccugauguagccacuaugcaccagugacccaauagcugggugccuuuucugaaauguguacugguauggccauucacucuaggaaacucuaauacaaauuucucagauacaaauuucucucucucucucucucucucccucucucucucucucucucucucucacacacacacacacacacacacacacacacacagagagagagagagagagagagagagagagagagagaggcuccccaacccccaacaauuuuaaaggacaggugguauaagaauaccagugaucauuuggucaagaaccagcugccucagaucccuaaauccugccccaccccugccccaaaguacugaaucacuaucccugggaaguuuccuuuggaacuaguucccgggugauucuaccacccuuagggacugagccacagaguccccagaaaccuacaugccagugagcuacaugccccaaacaacaggaggaccaauggcagcaacaggccuguucuucuguccuuccaucguuucaucggcuugccugcacaucagcaauggggagcuccaacacugaggcaggugauggcgggcugggccuagaugagcacug

SEQ ID NO: 7530 - RNA, 516 nt, Mus musculus
ccugcuugguuggcaucagggcagggcaguaagauaacuucugauuacugaccacguguagccuggcugacuggcaagugacuucgaugguccugagugacccugugacuggcaaaggagaagcuggugacucuggagauggaaguaggagguggaucuaacucagagaggcagcuaugcugggucuggagucauguaacucagaaaugcacccuaccagcagguucacaggacaccagagcaggaagggcuuugcucugucuacccacccaaggaugucacaucugaccuucagaagccacaaggacacugagaggagagcaauacaggcccagacugaccuacccaacccuguaaccuuguuaggacuugaggugggcuaacccuaguugagaaacaguggaaagcaaaaugguuuccacagaagcaucuguuggugaggaaagagaauugcagaaggauguuuguuugaaaagcauuaaaauucaaccuuuggagaagaaagaccaaagcccu

SEQ ID NO: 7531 - RNA, 6876 nt, Mus musculus
cagacgccagccuagggaggggugaggaggaggcugcacuggcgcucgggucgccgcaccgccccgcagccucgcgcucuccgcagugacagcaaccacaaccgcagcagcacccagcuccauccucaccagccuggcugagcuacagcccggcaauucgggcugaggacgacaagcagaaggugugcaagugcccccgagcuccccacuccauugaccgaagcucaagaaaccgggagugggcuagcggcgguauugcacggaggggacugagaaaaagaggacuggagaccaugaagcuauucaggcagggguaggauugagccccccgaguccacccagaggacuuuggcagggucuggggcggccaggguggcuucaagggaucggagggcucugaccacugcagaugcggcgcgugugggugcggugaaagcacccacuucucccaggaucuaaacggauaaacggaagcgaguguaagugugggggugcgaaucgccaccuccggccuuggcuuucccguucgugagagcacccccacuucucacuuuccccaaauccgcauuuuucuuggcacaacccucccgaacaccgagcgaggagagggaggugcccgggggcagugagagugacgugugcuggugcagagggggggggggggggcugcgggccgggcucuguggaccuacuccuaauccucuuguuuucggaacugucagcagauguggcuucucuuagcugaauaauccguuaaaggaauaauaauuuuuaaaaaggaccucggccucacccaacgaggacagugaaggagaucagcucuugguaagacuaaaagaaaaggcacuaaauucucugcgucccucucucugucuuccucucaauccccucacccccucccccucucuucucuccucaccccccccccuuucucccccauccccugcaauccgcacucgacgcgaguucacgcgcagggcuggauuuccaagcugcacugcaacuucucagcgcguuauuauuauucaucugagggugcagccucugcaaccuucgccuccugcgcuagcauccuucccccucgaccgcggccaccagcagagcgguuucuucugcacgcgugcucugguucaccagaggaggauucuggcuuuuugcuuuuuuguuuuggugguuugguucgguuugggguuuuuuuuuuuuuuuuuuuuuuuuuuuuuuugguuuugugucuuaauucuuucagggucaucgccaggaugcuuuuccuccggccagguggagccagcaucagcgccugccagcagcaauucccuucaauagccgaggaagcacuuggggcuuggccagggaggccgcuccuugcuugcggggcugacuuuagccuccacuacucucccgcauccaucugcguguauauuauccccaucccuuuuuauuccaauagauccgccuuugguuuggacuggcugaaacgcggcggacugcaaccaggauccuuuaaaggagaacaaaaagaugaggauauugugcggggguuccgggacaaagcgucuugggacgcgcggaacucuggcuccccgauuggagagaucaacgcugcccaacaguacccggccggaccugcggaccucugagguuauucggacucaauuuuauugauuuuuguggcaugcuuuaaaagggucaguguuagguaaagacugugucccccaacccuguggggugggugggaagcugaacggaaccgauccaguuagauuuaacuuguccucuaugcccucuaccuggcuuuuuugagccauugggaaggagaauggggaaggcuuagaaaagagaaaggggggggggggacgacugccugaaaggauaaggcacuaguagggagugggauggaccaggugagggaggucuguggguuaggaagcaccuuccucacucuggugcacuggguggguuuguucagggaauggcaacgugggugucuguugaaagcagucuugugaaauugacauguacaugcauaaggugacuggacuuguguguaaacagagugauggagagcagagagggaggggucuuaaaauaauauuuuauugucccuauggauuuggggaucucucccccaccccacccagcuacauucuauaggggugaccuuuuaaaaucuacacccacccuuuaccucuguaaaaccgguugacggguggggugggggaacauguaggggugcgcgcucucucucucucucuuuucccccuccccccucccagucucccuccucccucugucucccccucccucucccuucacuccucccucucucgcucucccuucgcucccccuccuucucugucccucccugcugcauuuugcaugagcuaucuaggucauuagcauuuuagcguaugcaagacuugacaaggcugaugaggggccagaugggccucgcucuuauuuauuuauuuuuuuuuucuuuuccuuuuucccauccaccacuugggaccuaagcgagaggaccgcagcaggagaguuccggaaggcugauucccacagauccugguaagggaccgcagcagcucugcccugcggcacgcccggccaggcuacacccggacccuacacucaagguaaaggcggcggucacaagcccugcccaggcagcaguagcugggccccugcuucccaucccuuuccucuccgucaucucccuccuccuggccccccucaguuuccuaggcgaagcugagagcgaacuggguggguaggauucgcugcgguggggcgaggugggguugauguuuuuucauugucuggaacugcaggggaggcgaagcgcgaggagaggagugagggagucgggguaauuaacacgggggaggcaccccuccgucucccacuuccacccacaucccgaacccuccaccccccuccccuuugcaggaaaaagcuuggaaacgaaaggaugcgggagaacaaagagccuacggaggacguggcuguuaucucauugucugugacugggggagcugcgguaggaaggaugcggugguccuuagcucaucgcguuccccaaccccacacccucccugcugucagugcgcacgcacacgcacgcgucgccagcuuuuucuuucucaucucucauuuuuuucaucucaucuucuccccauccccucccuuucuuuccaccuuuccuuccuuucuuccucccuuccuuucucccauccucccucucuuccauccuuccuuccuuuccauccuuccuucuuucuuuccuuccuuccuucuuucuuuccuuccuuccuucuuccuuccucaggagaaaggccucucucuccguguucacagcggaccuugauuuaaauguccauacaauuaaggcacgcggugaaugccaagaauggggcugucugagcaccuuggguccacgagggccugccacggaaggaucgacccagcacaacgcccugggcagaucucagcgcugcagcugcaggcgcccacaguacggguagcaggcuucugagugccucgcaaaguagcccuuaggguggggaggugugcagcuaccgacagagagggguuugugcagaugcaaauagaaucuaggaagcaaacaacucauucugugacagaaacacggaucuaugcaagcggggggguggugguggugguggcggcggcggcggcggcggcagaaaauagccuggggacggcuggagaguaaaaugugccccucagcucugggacccugcccauuguagaaggccgacaccuucaucccuaccugucuuaguuccggauuucaauuuauuacccuuaaacaaauaauaauaaccaaguacccaugcgacuggcagacugccccaaagccuagacugcagcuaccuuguauugugcuugggguugcugggguagucuuuaggggaagcuguuugucacccguugguggagagcugugggcauuugacaagcuuaaacagaucucuggagugagcgaaggcgaucggcaaauuuguucauggacagcgcacagacuccaucaaaacugacagcuagcccacugcucuaaagcagggccucccagccuccuuggggcuguggcugaaguuucaggcagaaauccagaagcuacaggaaaaggaggcgcagcccacccccagcccccagagugugggccucuccccaucgcucuuaaaaccccaagacagaaggaaaaucagcaugaguaagguggaggccuaaggaaagucuguuuugaagcaggcuguccaggaacagaaaggguuaauccucccucauccugaagcaccugcuucccaaaucagcccccaacagcagcagcugguccuggaggcccccgacacaguuccaucccgucuccaucucaguguuccgccaaccugcaguggauggaugauggccugguggccgaccuaaacucauuaauuuucagguggaguaaauggaggaggggcaggacccagcagcagagggagggaaaggaggccaagagcuggccuccuccccccccccacaacccacccccaggaagcaggcuguagcccuccccccugcugucaugccagaggccugccuuugcaaggccaagcccaugaaggauguuuaggaguuuaaucugauuccuaacacaguaaucagggucuaaaagagcauccguugaaguuaauggaggacucuugucucaaaaagccucagccucaucuagucuaguaaauuaguauuugaggguauaucauagaucaguaccucucuggccuaguuuccucaagaguauucauuauuucuugaguaucuacuauguguccuucuuuacgaugauuucaacuucuaaauuuccucacagaagagaauguuagagcuagccaggcugagcuucaauuuaccacauuccaccuaggcauucccagaaccuucucccgcucugcagaaauaagccaccgccugcuuacucuugcaggcagaaagcugcagugcccacacccugagggugucucuggcugaguccuaccggacaagccagacugcuuucaaggcagaaagggaaagacccagccacaauggcuguccuaagagacgccauagccauugcuucgagaaaaucuaccucccuugaaauaaaaauuggcccuuuccuggggugcucccucacuucacaaauggguuagaagagaacggcuagugugcuguaccauuuuggggguacacccauuugcccccccccccccgugcucauugagauguuauuuugccuucaagcaauggccuaagcagaugauggcccaaccccccuggaccacaaauauccccauuagcaauccucuacucaguaauugcuuccccaugauucuuucaaauguccccucguccuucaccgauauuucaucuuacguaacccccagaugcuuccccaaguaaaguccuuuuagguagaaacccaauaugcuuuugcucugagagcgcaaaccgcaggcaccauccauaaggccugccugggaucugcuacggaggaucugaguugggaggggugcauuguuauuuuauugcuuacguaaaacucuuguuccagaaaguauuauucguguguuauuggcgugugggaguguucuggacuggccagucuaugugaaccaguguucguaugugucuaccagauccccuucccagaagggguuuguauguaggacucuaaugaccugcucagccccagguauaagugcaaaccccuuuuguuuccaccaaaugaagaaucagagccaaggucagccugagccaccuccuuccucuacauucgcugcccuucucugcccaucaauaauuaugcagagaagccuucugcucucucaaggcaccuccuggauucucagcaucaucuccccugccuauuugaaccuucuaauuacaucuuauggcgaaaaugaagggaggaacuugcgaucuaacaguaggaugaggcugccauaguuugauggcuguauauguuuucuuuuuccccuuggguuuauucacacccgcuacugccuuaguccccacuggguacaaucucuuguguuucuuaaggaacccgguacuuggacuagauuuaguaauguaucaaaggacuaauuacaauugcuauguuucucuccccugucagagacagcccagaucugucucagugggagacuaauauguggggagggguguguccccagcuaauagaucuccgagcacacguauuaagccauagauuuuucucacacaaccguauccaucacuaauguggaaggcacuugaccacaaaagcaagugcacccauccacaccagcucuacaaggaaauuuucucucccacuauugaacuuacauaauacccacccccauuccaaccuuagagugccgucugggggcagcugcagaauuccugccugggacagauggagccuccccuuccucagccacucugugggugguuucugagcccaugagucaacaugggcagacuguaguguguguguguguguguguguguguguguguguguggcuuggcgggcugauucacacugaagauaucaacagcaguguugagaauuaugguaccuaauaaagaucuuuuuuuuucuuucaagacccaucuauaguucuuucauuggguauuuuugccacguccuagccaaauugauucagauuuuuaauauuuaauugcaccacaugagcaaacguggugugggggauggcaaguggaagggggagacuuuuaagcugaauuuguuggaagcagucuuugugccuagagauuuugaagucccaaauuuaggugggggcagggcagcagaccuucuggaaaacaaggaaauuuccaggucagagag

SEQ ID NO: 7532 - RNA, 3043 nt, Mus musculus
ugagacaaugugcaugaucugccuaaaaugcacuuuucacagcuaguucauucuuguuauucaagugcuaaguuaaguggcacaucauuugaaauggucuauuaaauaaccuuuauaccuuauucuacuuauuacugcuaucaaauuauaguuucuuaggcugaagaguuagcucagaacuugaaugccaguacuacucucauagaagacuaguucucuguuccugccuucaucagcccuccucacuauucucucaaaauggacuuuacuuuccuacugucauuccauuuaaaaaucacucaauagcucucuacuguaaucuguugcauguucugucuggaaggugcccuagggaagguauuccuacucuugccucacccaaguaccugagcaaccucccaguucucuaguaacagaugcuguuacauggcagggugcagaagagcuagagauuacuguggcuucuugguuugacuucugauggacuguugcucuguucuggggcccuuuaugucaacucggauugacacuaugaauccuaagugccccagaguuauggaccauacacaaacacaagauaaauaaaggaugaaaaucagggcuagagcacagcucagugguagaguacuuguccuguaaucaaucucaaucuuuacuguacacacaggagcauucaauacuacacacacacacacacacacacacacacacacacacacacacacacacauauacacacacacuaagguauauacuugcgguccaagucacccaugagaccaaagcaggaggagcacugagcagaggaauucaaaacaagccugggugacaucucaaaaacaagaaaccgacuaugucaggaagcaaaggcugaauaacagaugguaccuauaacaugagccgcaacuguuucauggaggacgacccccagauggagcaaaccaguggcaacacuguaucccuaagcucagcccccgcuacgcccaaaagcacggcugaacgggaugcuaaaggaaauaaagccaaggugaaggaugagucacagagaagaucugcaaggcugucuguuaaaucugcuucuccaaagccagagcccaagccuaaaacagccccugcaaagaagggacaaagguacccgaggggaggaaggggaaagccaauggugguaaggaugugaauaauccugcagagaacggagacaaaaaacagaugaggcacagaaagcugaaggugcuggagaugccaagugacaugugugcauuuuuauaacuauguacuucuagugacuguacaguuuagaauacuauuuuucaucaaguuuuauagaaguacugaauuuuguuuuacuuuuuuaaaggcaugugccaccacacccggcuguuuuacuucuuuaaaaaaacuauauugucagcacacaaaacacuucauugugccgggcacuggugaugcacgccuuuaaucccaguaccugggaggcagaggcaggcagauuucugaguuugaggccagccuggucuacagagugagcuccaggacagccaggagggcuacacagagaaacccuaucucaaaaaacaaaaaacaaaaaacaaacaaaaaaccuaaaaaccaaccaaacaaacaaacaacccacuucauuguuggggggaggaucgugcaucacuaacaaaauaucucccaagcuggacugaugacagaaaacaucuuucccugauaauuuugaaaggcuccuguugguuuccaggaaagacguccuggucuugacauagguggccaccauggugcaaaaugccuuguggucugggaaaauucuauauucauuuuuauauccucuucccccuacucuaucaacauagacuuaacucccuuaaaaccagaggaccuguuggaaccuggaacccaaaauugguuuuccagucuacugggaguuugaguguucucagaagagcacugguuccuuuuauaaaaagauuguggaucuucagauugauaauucugccauguuccuuuccugaaagccagggucagcuugugaaaaguuguuaaacagcauccuuaaugugagauguccacccucacucuaagccacuucccccuuuucaaagcaucgaauggagacuucaggacuuuauaguggcuuucugauuuugguagucuauacaagaagggaauuuggaaguucuuguauacuguugauugucugaccauguccuaccugaaauaccaugauuguuuaugaaaaguauccuuaauaaagcuuguuacaguuaggcuugggaggaaaaaagaccauaaaguuagauaaggagaggagagcagaacagcgcagagauccauaagugcuguaccaaagaugcucagggaggaaaaaccaagaacuaucacaggagucaacaggugaguuuggcugaaagcgaaggcuggcaugguaacaguaagggaaggauggacuucugacagcagugggagcgcuugguacccgcggacucuuaccuuuacauggucuuaguuucucacugaaacuaccucaggagaaaggacgccugagaaggcccuguguggcagcagugucuaagacaggccauucugucacuaaggcaugagggacacuuguuaggaauguuuaaccacagcuaauaagaguaccagucaaaaugguguaaggcaccacacacuuacacacacucauuaagucacagcauaaucuagccauguaccaucauguuguagcaguugcaucuauccuauuaugcuagugagaguaacaggauaaaugucaagggguuccaauuagcaugucuuugcucauauucaagagcaagaauaggauggacucaaaucagcauccuucauagagagaaaggcucaagagcucccuacuaacugacgagauacugguagcugauugauucuagagauaagucaguuuguuugacuguguggucccugguagggugacaauacucuagagaauggcuucacacccauaaguauggguagaacaaauugaaugugugguuuauuuuuuuuuuuaaagaggaaa

SEQ ID NO: 7533 - RNA, 8248 nt, Mus musculus
cuuugacuugacuaaauggcuauccguggaaaaguucucaacuccagaaaacagauggcuccgcugugccagguucucuagguuucucuuacagaugcucugcucccuucucuguccaccgccguccuuucagcuucugagugcuuucuccaggugcugcugcaugugggggccaaggcugucauggaagacaguguagggcagaaucagugucacuugaccacagcccuggaaaguacacguggaagaugaaaugguuaaaaucugcugcaguuagaggaagcccucuccccagacugcagccucuuuaaucuagacuuccaggauggaggauuuacagagcuguuaguccuuaggccuguucucauagaagauggaccucccgacucuacuucaugaggcgugggggaguguugaccuaagcugcaugguguggggcucugaacuggcucccauggaaccagagguguugcugcccagggaaucucaccaaguugguccccaggaugccauccugaagugugcagagaacagucacuuacggggcagacugugaacagggccgaggugaaggaugugaccuggcacagucagguguuggggaacugccacaguguggaacuccucacccucccuccucccacgcuugaacuucaggaagcagaccucauaacuuguguuguugauguguaaaggcuauaagcugcuucuccuacccaacuggcauugacuagcagugcuuguagaauggcaucuugcacauagguuuguuuuuaaaugaaggcagccuggcuugggggaaagcuguacaucugaggacggcacauaggcaggccugagcaccaggaccccagagcuccgagcucacugcagugugugcacaauggcugcucaggucacaguaggagacacuuguccugccauugacagacaccagauugcuagggaucaaaaaaaaaaaaaaaaaaaaaaaaaaaaaaacaacaaaacaaaaccaccagauauguaguccauuugcagugaucaccuagagaagcuacaggguuaacgcaagaaagagugaauggaucugcaccuggcgugugcugaggaauccgguagguucugagagaaccucagagacugucuggagcccaugaguguuucccggaagugggagcauucaggugcaugcacccagcagauguugccauuuucauaguggccaauguccagcacacauugacuuacagcugcccugauggucccugcugcaguacccaggagccaccagcaaagcacuuggaugaugcggcacuguccuagccaauggucuaccaccuccuucacuauccuaaccaguggucuacugccuccuccacuguccuaaccaguggucuacugccuccuccacuguccuagccaguggccuacugcccccuucacuguccuagccaguggucuaccgucuccuucacuguccuagccaauggucugccgccuccuccacuguccuagccaauggucuacagucuccuuucuucucuuuucuccuuguaucgcuguggugggcaggagaguugcagaguguauacugauugauacacugaguuaguugggcauuuuagacuacaacaguguaaguaaagcccaagaacaguaugauggccguccuuggaggccuuugccaccagggcagagaaugcuaagagccccguguuccacuaagccccgggccacucuccaccccgggccucuucccuccccugagagggagccuguguggaaacccugcauuuuacuuucagcuggcagacucccuggugcccauggaaaucaagccuggcaucuccuuggcgacugucucagcugugcugcauacgaaggauaacaaacaugugcuucagguacccagggcguggggggggcaggguguggaccccgaagaccucuucccuuaggaaagcucugcccacccagccagcucccaguucaucccaaucagacaccgaagcuugggcugauggagacuuggguguacucgaaacauagaaagcacuuuguacaaagucuuagccacacaccuccaagagaccacacaagcucucccggguaguuuccuguucccuagcucuugaaguagcagcauuaccccaacuugucaugggcacgugccuugcuggcccccaaaccugagcagcaccgggcaaggcugcaagcugcagacagcggccaucucucacgauggaauacaagcaaagcgcagagccaggaaagcaggcacacggggcaacacucaccucaggagcgccccuccacagcugugccacguugcuggugcaccccuguagcuagcuagcacuuagagcacuaggcacugugugcuugcugccgugcauuguccgggcugaucugcacagagcccugaggucuacaaguucucugaccuaaugcuuuucugccacugccugguggcaaggccaugguuuacugccagacacugcagucugguuuuagucagcacguauggcuguggcugccagugacuauuagaagggauuucaucagcaaaugaauccuggaaaugcacacuguuucuugcugaaagguagcuaugaucccaggcauaugguugcaugaacucagguggcaggaacccagcugcugagccugcuuuucacgucaggccagcaggucacggccacggagucagugaagaggcacucaccaagagccacacuuuccuucugcccuagcccccucccaagcccacccagcccaccagcaguaagaagaggaagcgggugaacgaggacauuccugacugcaaaguacugaagccucugcugaguggcuccauccccguagagcaguuugugcagacccuggagaaggugagcugguggccugcucugccccgaagggggugcuaggaugucauagaacgaggagaggcucaaaaugaacuaagccaaagaacaucuuccuuccugggcuguccccagucucugcucaccaccagcccugucuucagucuccagcucuggagcagcaggaauagcacagcacaggcugccuguccucccuggagccaggcugcccacgggaagagcaccacugucugggagggcuagcaugugagacuggaaggucagcgauuccguuagaggugggucgaagagacaggcaagaaggaagauguugugcuaucaucucaguggcugucuauccugugggccccaguggcugcuucuuucaagggagagauucuuuuguguagggcuguucugccugcauauuuaucuguguacccuguguaugccuggugcccacgguggccagauccccugaaacgaguuacaguuguagcugucgcuugggugcuaggagugaaaccguggaccucucucuggaagagcagacagugcuccugaccaugcagcagccucuccacgccuaagggagacuccugacuacaucggugcaggaggcugcggagagcacugccuuaaagaucuuuauaguuuugucucugucaauguuaaugucuccacauaaucacccuuacuaggaagagggggauagggugacguuuuuugugcguggaaccuuucauaaauaauaccuuuugguuggauucuggccccgaagauggcaugggguaugcuuugagaaaacuccaguaccugauggcaggguuggacauucuccagcuaagccgugauaaccacacugucucagcugcugacuucuuucaagguucaaaaacaaggcuucccguuccaggcucaguuuucuuuaguuuuugauuucuccaacugcucuugagaucuccccaccguucuguagaugaauaaaggaccccaucucccgugaggcuuuacgggcucccgauaggagccagggguuucaaguuucacauuuuuauuuuauuuuauuuuauuuuuuuaauuuuauuuuauuuuuugguuuuucgagacaggguuucucuguauagcccuggcuguccuggaacucacuuuguagaccaggcuggccuuaaacucagaaguccgccugccucugccucccaagugcugggauuaaaggcgugugccaccaccgccuggcaauuucacuuuugaaaauuauuugaaaguuauuucucacaauaacuugcuuuuccacagugaucuuaccuuuuucuccugccuauaacucccugucucaccuccuucgcaaggccguguggguguccugcagcaaaggacaggcagucccugccucaggcucucuacuugcugugugucucauccuggugacucuaacuuaguuguaguucucauuuaucaguaaagguggcugggagaugcugccagcccccgggugagugguaccucacugugaggagcagugcuuuuccuggggcucagaacugcagagaccaaaaguaggcaggugccaggaccagcaaccaagcucuucccugagaaccugagaggcuugauggacucagggccucagaaaggguggaggaaucugcuauuuuccugagaguuuugugcguggggccuuucauaaauaaaaccucuugguuggacucuggccccgaugucagagcugggcugaguguaaacgccauagugagugcucagucaggccuugcucucagaggcacuguccuccucuuuucucuuggaacagcauggcuucagugacauuaagguggaagacacagccaagggacauauuguccugcugcaggaagccgagacacucauccagauugaagaagacuccacucacaucaucugugacaaugacgagacacugaggguccgacugcgggaccuuguccucagguuccugcagaaguucugaguggcauccgugacauccuaggcccuucacccagagacagucuggugguguccuaugacuuccggagaggagaggugucuccagcuaggaucugccagugugacuuccucguacugcugaccccaagaacguuuagaggccuguucuuuucaguucugggcuccugagcagcuaugggugacaacaugacagacauccuuuccuaagggaaaugaaaaaaaaaaaaugccuggccuguguuuuuggggcucacagggggugacucucggacuuacccuccuacagugcuacaccguauaaaggucagcccccaaauuagaaggcaaaccuaucucgcuguucuguggcccguuuugcuaaaaauaaacauuauuuuuauaaaagugcccaguucuauugcacuacagucuaaauaaugacuuaguaucugggggaaaagucugcagcuacacucagcagugaaaacgccacagcacaucugccacaccucugcccuaaucauuaacccugucugcagaaaugcagaugcacccagugcuggaggcucauccucugacacagcaggcucguggccccccugggcucauaagacccugucucaagaagcagaaacaaccuggcaggcaguucauggccuuuuaaucccagcacuuggaggcagaggcaggcaaaucucggaguucgaggccagccuggucuacagagugaguucuacgacugucagggcuacacagagaaacccugucucaaaaaagcagcagaaacaguaaagucagcuacauuucaauucuauggaaagguacuuuguacaaaaagaacccccacucgagccuagagguugaggugacuaaagggagacugggaagcccccuuuugucaauucuuuuuuuuuuuuuuuuuuuuuuuuugguuuuuuucgagacaggguuucucuguguagcccuggcuguccuggaacucacuuuguagaccaggcuggccucaaacucagaaauccgccugccucugccucccaagugcugggaugaaaggcgugcgccaccacgcccagcgucaauucuauuuuuuguagucuuagagggugcccacuugugguucugaguucugcuuccucccucagggugcccaggugcugcuguaccccaggcagcaggauccuggagguggugcuccaaggauguccuuuacagcccuuucagucaguauuccaugaaacagcgugugcauguuuuacucgggguaaacaacggcuagcuacaccuuggagaaugagaagggguuuuucuuagcgcuaagguacaucacaaggagagacauuccaggugcucacugggcggguucuuauuggacgaaagggaguugaacgugugaauucaccaagaacugggugacauuccucggguaggggaugaaggggucaggcuuccagauaaggucaggcagagaagaagaggaagccauacugaaaaagggagccccuccguuuugcuuggagcucagggagcugucucgucaugguagacguuaauagcaggguuucccaacaccuacugagcaggugcaguucacagagaaucggacagucacugccuaccugugauccaggcccuuccaguguaaaccagugagugcuggcugcucuucuagucuucucugugccuugucacacuggacacgggaucaggagggcagggagcacaaccugggugacagguuguucgugaacuuauuggaguaaaggcugcuguuacucuugcauagccuuccguagcucguugcuugccuguuuugagagaggguccugacauacguacaucaugcugacaucaccaccaugccuguccuuuaacaagucuuuccccaaaggguuaaagcauguaucuacugcuauaacaaaugaccccacuccuagcaucuucaaaagagccgacauuucuucccuugcgguuuuggggcuuugcuagaguucccacacuggagucgucuuuccucacagcuggauguggggccugaaauacagaguuugagugaaugucccaaaaauaggcaguuuguggcuccugcccucucugcauccugugugaggcucaggccaaggagacgggacuccuagucuauuccucucaggcaagggcacauaacccccucauccccacagcuuccagcccacagccucacgguuauccuuaaaaggcaggaguugacuuuuccagauaacagugaacgaccaacagguucccucacugugauggugcacugaagagcgaagcuaccugguaauaaaacggaugacucuccuucucagauaccaggcagcaggacaggcugcuggcuugugcuuucagccaccuaacggaagguaggugguacguuuucaggcucuccccagugggguacuacaucgauguguuauuuugaaccuuagccaagggugaaagcaaccgacucuggcucuggacaaagcaacagcugaaucuggaugggccuuacagaacugagccgcagguggcuugugcccugugcaacggcuuuacauguguuucagcauuugcaccuuaggaccgugagugucugagcggugucuuuacccaggucuugucauugagcagcaguaacucugccugucucucucacacagguacuagaggcagggguggaguggagggacucaaguuacuguguucacaggacuucaccccuguacacuccaguaaccccagacugugugucaaccacaggugaauagcaaccuaaucuauuuuucuaauuuuuaauucuuugaauuucacaucaugcgucccauucccacucaucucccugucccugcauagucaccaugugcccuugcaaccuuccccacaaaagaauauaagauagauuuuaaaaaaauaaauaaaacaaaaaaucauggaagcuuuagugugucacagcaugcccuuuuguccacacuucuucaugugcaaauguucacugccaugagucuguuucaaggccucuggguccugcuacaccauuaaugcuggguccucaccuggacucugguacgucccguuguugcccugugucauggagauacuguagcguugggccuacaggacuggccccuucacaagcuccaccuagauauugugguuggccaacucggagcccugaguuggucagccuggccacucuccugccccugcaccaccagggugaacuguccagcaucgccccagcuagcaucgccccagcuagcacacccagugcugcagaugccaagagagagggucagcucuucugcucucaugcccuggggacuggcucaccagcaccuucaucacuagggucagcucuacugugcugcccaggcaaggugcagggccucucccaagugcugcagccagugaggggugggagcacacaucuc

SEQ ID NO: 7534 - RNA, 40544 nt, Mus musculus
auugagcgcccacuguguaccgccaagcaggguguguggagcgcgcgcgcgcacguccggggcuggggcugggggcgcgcgagucgugcgcgcgcguggccgggggugugucccugcgucuggcuggcucgcgggcggacuggcugcgagcggcucggcgcgcucccuucccgggcgggggaauccgggccggguuguggccgcggccgcguacgugagcgcagugucccggagagggagggcaggccggccaggugggcgcgaaggcggcggcgcgggaggcggcgcagugcaggggccgcgccgguggcgggcagggccgcggccgcugcagggagccgagcugucugggucaguggccggccgaggugagcugcgcgcgggaccucgcauggguugcagcccggguuuggggccgacagccaggggugggugggagacccgggaggcucgcgcggcccgggcaggaccggggcugcugcggcgcuggcggggugacuggguggggguggccgcucucccucucacgcgucgccuuguuuaugucgcggguccuacggcccgaucucccucccaacuuugagugguggccgggaguggccucgcggggccacacugaccuguuaaccugcucccuuuccggcugagccgucagcccugcgcuaugcgcgccccugcccucuccauaaccagagagugccgugcugcgggacuggccucgcgacacacccucucucaacccccuucuugcggccccuuucgccgcccccuuggcucuaagccuuccgggcucaccccgggucccucccgggccguggcacugugggccucuggaguggcccaugggggccugcaaagggaguuugucaugggcaaacaauuccaaggcuuccugccugggaguuaaggcucugcaccuucacuuuagggcccucuuggagaucuaaagagacccaccugccagcaaucuugcaggagcccuguuuuccaucccucccuuuccugugguucuggaggacuuccaccaggcauggguucccaugaugccaggccauggcacaggggcuaucuauaguucuucacugcuuucugcaagaucccuuaacagaaugguguaaaguggagcaguuuguuucaaacugagcaaucaacagguauuguagccugaggacauccuucuaagggggguuguguaaauagagguucuugcuuuggaagggugaaacacaaggaaauugguuagcccacagguaccucugagaagccacucugcccucuucccacugccaagcuuucuggaugaugucucugaaagcuaugagagagaaaugauuugagagcucaaaugcaaaugaacgugcaagggcugcaaaguuacugugcaggcucaggcacaggaggcaugggagauaaagguggggaagggaauacggaacucaguuugaaauaauuuccaccuguggauaauucccuggcaagacucagucagaaggaggaguucacaggugacaaguuuacaaaaggauguccaagggcuugcuugucuuggugagaaaggcaauagaagacucauagauaacacccgucggggcuuguaaucucuuggaggacauagaaagacuugagcaugugaaauaugacuccagauggggcacaguuaguugucacaaugccaggugcagaacugggugcuguuggaggucacagggagggagggagcuauggacuggaauuaccaggccugggcuauguguccuugaaagaugggauuuaugaaaaugggauacaaaguggagaugaauauggguuucucuagaguccaggagauggccuuggcccuccuggaauguuuccugaacaguaagagauagagagaggaauaguggcugagauugugaaaguccuagaaagucagacugagaauuggacuuuuauccaggguggacugggaagacaguagaccaggggaugagguaacaaggauauugguaaagaguuuugaaucugauguuaggagacagaccagugaaguagccuguugcacuuuuggagugcuguggguuuggacuugguuuuacuggaagacacugcuguugaaguaaucuguugacggggugggugaagggaagaaaugaauaggaauuaauuccuggaggaagcugaucacacaccagggccuggagcugcuguaguuguuaaccggacucuaaaauguguguuuugcagagaagaugauugccacuugggcccuagagaggucucuuuuguuuuaucuggaaguagguauguugguguuaguaacuguggcucugauagguuaugcccuggagcagaguguauggagacccgucagggaacccagggaacaagcucgcaguuguuuugguuguaggagcagcagagaauccaugcaggacugagggucugaccugcagggcuucuguuuugaccuuuuacuggacacugucuggauuuggcccuggauguggaggagcaaugccggggagugggcuucuagggaaaugaggccauuuauuguaagcagggguggggguggagggaaguggggugggcuuugcuggaggagaauguuagacucugcugcgugcugaacuuuacucuuuaccgagauguaagucuccugcacuguuugugcagagagggaugaacagcaagaccaguuaaaggaagacaggaauuuaggaccuuuugugugggucugguuuaucccagucccauccaguaacccugucucaggauucuggugagaaggcauagaagggagccggcacucuuuugaauuuuuuuuccuguccacuggagucugcucucuuuugcaagagugacuuagggugauuugcugaacaaaucccccaagugucagcgugcaacaucugaauuugaagaauaagguuacagaagguuguggcaugagcugggauuuucguuucagcugcuuacuucucugagaugcagaaucagugaauugagggggagaggagcuugagggaugggacuggaggccguaagggccauguucucuccuccuuucuccuguucuuuccuuugguuccuuccucuuuucuaccuuccucuccuuuucucuucuucccuugucguccuccccuucuuuucccuuuccucuucucccuuucuuuuccuucuuucucuucaguccuucuugcucuguaacccaggagccuugaauucacagcaauccuccugccuuggcaggccugagccgucacaggcauuuuuuccugacaguaacaguuguacagaacagacacgagugaauucuuuggcucauuguagggcagugcuuguaugcaguugugaccgugacugugcucuaagguaagaaaguugagagcggacaagauggcucagugggcaucggggcuggccguugagacagaugaucugacuuugauucucagaauucacaugguggaaggagagaaccaacuccucuaagugcagacacacacacauacacacacaugcacacacacacacacacacaugcacacacacacacacacaugcacacauacacagacacaugcacauacacccacauguacaacacccacucauaaucucuaaaaguaaaacaaugagaggaaauuuacaccauggcuuuauauaccuaauaguguauguaaaacucuauuucaguuugugaagucuuaccucuguucuuggugaaaucuuggacuuuuuuuuuuauuaucuguccuguugcuucuguuucccaccaaguugauccaaccacucucuaguggaucauaauccacucacaguuugagacgcacugggaggcuuuccacauucuugaacuaguuaugaagcugccugugugcagaccuacaccucccagggcugaagguagcuggaagcccaacaaagagguggggguuuauggucuauuuggagagauaagauauauccuguugaaggggcaaggcagaguguuaaaugccacgaugaagugggcagaggagggcggcccaguggugugugcugaugggccugggaguaaccaagucucggaggagguuuggggcaccucagagcugugugggaaagacauggaauuaguaagugagggcuggggcgaggcauggauaccaggguugugugugcgaggaaacagagauuuugugaaagaggaggacuggaaaggugguuuggggacauguguaguauagggcguaugcacuugucagugacuuauagguuagacaacaccaaacuuccaaagguuuucuuuuuccuuucuuuucuccucuucucuucucuucucuucucuucucuucucuucucuucucuucucuucucuucucuuccugucucugucucugucucugucucugucucugucucugucucguuguuauauagguacacuguaguugucuuuagacacuccagaagagggcaggcaucagaucucauuacagaugguugugagccaccaugugguugcugggauuugaacucaggaccucuggaagaacagucagugcucuuaaccgcugagccaucucuccagcucucuuucuuuucuuuuuucuuucuuccuucuuuuucuuuaucuuuucuuuucuuuucuuuuuuuuuuugagacagcuucacucuguaucucuggcuagccuguagaccaggauggucucccacucacagagaucugucugccugccugccucugccuccauagugcuaggauuaaaggugugcaucaccacaccugagcaccacaguuagaaaaaauaaaauaaaauuggagcacuucagaaaaaccucuggauuuggggcuuugaggagucaaacauggcagcucucccagguugagggaugugugccugcugaguacaaaagacaggcgucauaguccccuguuggcauggucuuaguguucccuggugcuuugaaguggucuuugcauucuuugcauauauaggcauuuggcuuugggaccucagguuucaagaccuuaaaugccaaggccaggagcuugggaucugugucacaagcguuggcuagccacuggaagauucugaaagagcaugacguggaaucugcugggauauuugugugcagugaauuuguguuaugccagucagaggcuguugcuucugaggaggaaggagccuggggauacuuuauuugaucagaacuauguauuuuuagauuuauuuuuaugugugaguguuuugucugucuguauguguguauaccacauguguagugcgaaugacagccugaagaugucccaucuccuagaauggaguuaggacugugaauuuccauguggcuccugggauuggaaccuggguccucuguaagaguggucuuaaccauugagccaucuuuacagccccagaauguuuuuuuuucuuuuuucuucuuuaaaauuuuucuuuuucuuucucuuuucuuucuuuuuucucuuuccuuuucccauuuucuuuuucuuuuuucuuuuuugagacaggguuucuuucucuguuuagcucuggcugucuuggaacccagucuauagaacacaaacauacugaccuugaauucacagaacucugccugucucuaccuccccaagaguugggaccaaagguguuugucaccaccgccugaccggaaugguauuuuuuaaagccaacuucuacuggauaagucagacugucacuuguuucuagggaugccagggucucgccagcaucuuuacuguagguuucuggcucucaugcuuaggugacuccaggcauauuguugaagggcgaugauaaccuggugagauguugaggcaggacuaucaaacgccaugaggcaguggcuucucagggccugugucuccugugagacaguucugagggaggaguaagaagggucaagccauguuucucugauuucuuuaccccuggaauggcuccacgauucagagagguugcagaacaguugguucaagucuaggugguaaauauggaaaugacuccagauaaacuagucugauuuggcgaccagcugacgugaauaaauugagguuuuuguagucuagaacauucuaguguacucugaagaauccauagucaccugugauucugagaggccuucccacaugagcuacagugagaggggcuggugaauagucaguuaccccauucuuguuuuuguauagguaggauaaaauuaaauuauuuaaaaaaauuaguuuugauagcauaaaaaaaaaaaacaaagaaguuggaagcuaggcuugguggcucauaggccuagcacuuuggaagggggaggggggauuguaaauuugaggccagccugggcuacauagauuuuuuuucuuugaaguuuaacuguauucuguuuguuuuuaaaaugugucuguaggaugcaggaguagcuagaagugagcugaauucuauuaaacuaaauccauuuucuguuuuauaugaugacuggggguuagccagcuauauuacauuuuggcuuuaguaaaccuuuuuuuuuuuaaagauuuauuuauuuuauguauaugaguccacuguugcugucuucagacacaccagaagagggcaccagagacccauuacagaugguugugagccaccaugugguugcugggaauugaacucaggaucuuuggaagagcagucagugcucuuaaccgcagagccaucucuucagccccaguaaacuuuuuuuuuuaaagcuauuuucauuuuuuaaaucagcuuacaauguauuaaauaccauugugccuuuuuugaacaagguguggcuugcucauuuuguggcuccccuuccccgaucuccucaccccagcuacacccuuccucccuguggauccucuugaggccccgagauuauucuccucuuucauaucccaugugcccucuugccucugccucugcuucuucccucauucuccaauauguuuagacucaauuaguaaaguuuuuuaacaccccucccauccagacaggguuucucuguguaguccaggcuguccucgaacucacacuguagaucaggcuggccucgaacucacagagcuccaucugcugcugucucccgagugcugggacuaaaguugugugagcagcuguauuuaacuauuuaaaaagcaagcaagcaaacaaacaaacaaacaaaaccaacacacacacaguuguucauauuaaaccauaggugguaaaguguggugggcuucguggugguauuaauuaauuuaauuugacaauuauaagcaagaacuuaauuauuggcuccaccucggccuugagggaggucugaaagcaaaagcugugugcugcggccgcugcugcugguugguucgucauuuucccggcguugggggugucgauguuuauccaguuuaagagucacagaaguggaaggguuugcuuauuuuacaguaaaccaagguucagaguccuugagaaugaggauggugaguuagaaagaaauucaguaaugcaugaaugucuagggcgacuugaaacauuuuaaacauagagguaaagacacuugcuccaacacggcaagugugaccucugagcucauguaaagguggaagguucucugaccuccaugcacaggccaccacacacgugccugaccuaccaucaugcgcauaugguauaauaaauacuacuuagaaaauuaaaacaaaauguuuugagauguuuaugcauugugaucugaaguuacucuucugagaccauaucuaaaauguagauaguguuuuacacagagauuacuuacccagaaauuggauaauauauacugaaaaauuaucucauuauauagcccgagauggccugagguucuuaccagcccuccugccuccacuuccugagcagugggguuacaggcguguguaaccguaaaugaguucugguggacgcgucuuauaaagauggacuacuacaagguuaugaaaaguaacauuuaggaauuguuuaaaaaauaacugagacgauguuucugcccaaggguuuauucauaagaugaacucaaauguuuaguaaaaagcaguggucgaggacaggggacgugaugugcucuugacacuaauccgacacacacugauucugccucgacacacacacggccucugaagccgacgggcuuccaggccucucacugcagacacuggaugagcagaccgcaguucagcaauuagaaggguuuccaguuggcaaguuguccaacaguggacaugacugccugugugcuagugagcuucccauuguugggugcauucagguuggaucuaagcuaucaaucagggauguuuagaaaagagagaaggaagucaaggugcucucuagagucuguuuugguuuucagugauucagugacuugucacgguggaacaaugacauggaaugaugguucuaccucuugaaucaauaucacaacauaaguuucaauucuguuuauucaguacuggggauggaaccuggaccucacacaaagacaagcacaggguuccugucccagccugguucuagccuuugugagauggguugggacuuguuuugugauuguuauaauugaauucgguccucaagaaagguaaggaaguggggcagauggcaggucauaaugaacacucugcuauguugauuugcuuuguuuuuuuuuuuuuuuuuuuugaguauguguggucuguguauguaugacuacauguauauggucaugugugcgugugagcauggacguagaggccagauguggcuaucaggugucuucucggcuguucuccauguuagcuaguuguugaggcagggucucuuacaggacauagagcucacugacucgucuggcuauucuagcucaugaguuugcaguagggauccucugucucucccuccugaguguuagaauuacaagugucagccaguuugcucagauuuuaugggggucugaaccccugccucaaguucuuuuauuuuuagacaaggucucauguagccuuggcuaacauggugcucucuauguggacuaggcuggucuugaacucacagcugugaucuugccucggucuuagaaguacaggucugagccacaccaccagucuggauguuuggggugacuuuugcuguuuugguauugcuuggauggccuugcaucgggcuaaccccagcuccuuagagacggcuuugguugaguuugucuuccaggacuaucacaagcugauuucugacucgaugcgauucacgcuccgauuuuggcauuugaagaaccgacauuugacaagaagcgcucugaucauauggaugaggugauucgggagcccagcaacucaaggagugguucuugggacacucggaaagugguuguguagaacugaaacaagauauuuguacgcuuguuuguuuuugacacagggucuuaguauguguuuuuugauggacuugaacuuaugacccuccugugucugucuucugaguucuaggauuacaggaguagaaugacugcugaacccggccgagauuauagaugugacugguuaagucuggcuuuugcucacgugggaugaugggccagcuccccuuuauuuccauguuguuuaugcuuugcauggugucuguacuugucuagaugcuggaaaucgguucuuugguccgccuguuguaguuaauggagaagaguuaggcuaacauguaauucuuugugugugauguugaggauggaaccuaaggccuuauaccugcuagauaagggcugaaccaguaagcaacauuuguaguguguguguguguguguguguguguguguguguguguguguguguguaaagggcaaccucagguguuauccaguuuuuuuguuuuuuuuuaaaacaggguuucacugcucugaaacuugccagagaucugccugucuacaagugcaguauguguggcaucuauaucuaucuaucuaucuaucuaucuaucuaucuaucuaucuaucuaucuaucuaucuauggaucuugccuuuguuggagacagaguauguaguaguucaagucagccagagacaccucacuuugucucucagccugccuuugaacaccccaucuuccugcuucagcuucucaaugcugggcuuacacggauagauagccacauccagauacuuuuucuuuuuuuuuuuaaauuaaaaaagcaaacugggaagaaccagcaguucucaguuuuuuauuuuguucucugaguacugggaagucauaaaacuugguuaaaaacagccagccaguggcuaaauguaggcaguaauaaaaccuuuucucuucucccaccccccucuuuucugagacaagguuucucuguguagcccuggcuauccuggaacucggcuggccuggagcucucgccagagagaguucugccucgcccucccaagugcucggauaaaaggaguuugcagccaucacugggcuugggcuuuuuuuuuuuuuuuuuaaagcuuuauuuguuuuaacguguaugagauuugccugaauguaugucugugcaccaugugugugcaccaugugugugccucaugccugagguagccaggagggaguaucagcacccagggugcuggaguuacaggauuguuuuuugagccacuagguggguucugagaaccugaguccuacgaaugcacacgugauugugaccaaugagccagcucucuagccccuugucaccuguuuuuauguaacuggcacuaagcagggugugcuccuuacaugguauagcagagguuucuagugucuaguagcucccguggcuuagcuguguuugagauuuuauuuauuuuuuaaaaaagauuggugccucuccacagagcucuggcuguccugaaacucacaauguagaccaggcuggccucaaauucagagauccauuuaacucugccucuugagugggguuaaagaugaguaccaccacuccuuuuuuuuuuuuuuuaaggcauaauuuaaauacagguaaaauuuuagauuuuugugcucuuuaaugaguuuugacagagacaauggguguguguaaauaacacugucuggggcugaggcuguugucacuggggugugauuuccuagccugcaucaggcccuggauuggauccucuuccuguauaacuagguggcccccgcuguacuguuuuuuucuuaugguucuuccucuucaguagcccaagggaucuagauugagucccagcuggaaaagucagaggaagcaugauggggcaggaacugucuuaccgcugcaugcgugcgugcgggccgugugccuaggguguguuuuagcuugucgauuuggagcccugcaguauggguuagaacuggaauggcuccaagaagaggucccuuuggauuaccaaaguccccaugacauaccccccccccaacugacauaaaauuuaaccaucugcagaguuuccacagaguuaacuugaguugugcuugggagauugaaauaagauccguguugcaaaacgagcugcuggcuugaagcacacacagucugugcacugcugaguuugcagccugcuggcaggcaggggccagauuccaguggaaaucacucuaaacuaaacacauuguuaaaauguaucgagcggggucucaaacucuucuuuaaaaaaaaaauuaaaugagugagaguuuuauugcauaaauaauauacagacauacccucuauaggggaagaaaaaugcagaauuuaagcaggcaaaacaaaacaacaaaaaaggcuuucuugacaaccacuucuauuccuaguccucccccccuccccccagagguuaaccacuguccuaggguuguugauauucuucggaugcuuugcauauuuauagcugggucucugggacuuaagaguuaaggacacuguacugcauguggguuuaccuuacuaggguaucuugucaguuugugugugaagucgccucaaucuuauuuucuccuuagauuuagaaggcugaacaauuguuucauucuuuucuaauugauggacacaggaguuaccgcucaucuuuuucuguuccaaaugcccuuagagaaaacauuguuggagccuuugcagcucuugggagggaagcuucucuuggguggguacuggggaagaggaguucuuggguagcaggguaaggaucguacaucuugaugaagacacgggcuagggggcacuucugaauuuagguuagcauggacagaaggaugccugcauuguacucugagagcagaauuuagagcuugcuaggcguguguguucucuggaucucacccgccaugcuggccaagugcggguaggugagaaagguugguguuuaagaaagcugauaucugggcccaugcccagaggacuucgguauguugauagugccugugugaagaagaguuacaggguggaugagcagugagguggacccagaaugggcaguucucagcucuucacucucauuggaggcuagacucaccugugggucuucucgagcucuucagaauaccaagcaugguuucacugcucaagcugggugaggcacuaaugguguauguuagagaaagaagcuguaugucuuucuccuguuugcacuugcagccaugggugccugcuuuuugcacaacuccuagauggcaccaacgcuaauggauggagccaaaguaguaauggagaguaaugaccacacuccugguccagggcugucugugugcugacaugaccgauugcccauacagaagguagagcccuuuaugguuuucgugcuuuccuggguguuggcuucagaucccucuguaggcagugaaggaaguuuauauucugacccuaggacacuagggccguuuguccaagccuagaagugcauuccaguuucuacaugggguggggggcucaggggcuccccuucugcucccccacagguguuugucaaggcuaccccuuuucuguccuuucaggauuugauguccagaccagcacacccccuaccuuucucccacuuggcagguuuccccagagccuucuuggcuuugaccuuuuagcuugcccuguccaccacauagcacagagauuugcaguuugucccuguuucaggggacugaccauugucccaggguggaaguuuucuaacuuuauaggauugugcccuccuuucuuuccuuccugauuuuuuaaguuaguuauguuuuuuauuugcaguguguugggcaggaugacugucuuuauaaaaaagauuuauuggggcagaggguggugggcuggagagagaguucagcaguuaaaggcacuggcugcucuuccaggggaucuggguucaauucccagcacauacuuggcagcuuagugcugucuacaacuccuguuccaggggacccuacacccucacacagacauacauucaauuagaucacaaguguacauaaaauaaaaauaaauauauuaaaaagaaaagauuuauuuauguguauguguuuuccaagugugagcauguguccauggaagacagagggauugucuccucuaaggcuucgagcuggaguuccaggcagucaugagauaccccaggugggugcugggaacugaacuuugguucucuggaagaccagcugagccaucauuccagccccugaaugccuuuuugcuuuguuuugagaugagaucucucuaugugagccaaagccauccuuaacgucuuggucuuucugcucagccucccccaugcugagauuacaggugugcgcccuaauaaaugccauuuugcuuuuggccuuugugccuacaguaggauggcauucugguccauacagauguacauguccuagucugggagcauuacuguauuacacuggcaagauucugagguuuuuuuuuuuguuuuguuuuuguuuuuguuuuuucgagacaggguuucucuguguaguccuggcuguccuggaacucacucuagaccaggcuggccuuaaacucagaaauugaccugccucugccucccaagugcugggauuaaaggcguucgccaccacgccugccugagauucugaugauguuguuguuuuggugccuuccacuguccuuaucaaugguaaauucuguuuucuucuuuuaaauguuagugauuauuuauuguguguguaggggauuugggggggggggacaugugugccacguugcauuaaguagaggucaguggacggcuuauaggaguuaauucucucacugugugaguccuuaggcaucaaacucacuuugucuggcaagugccugcugagccuccucaccagccaguauuauaauuuaguguuuucccuacuagagugccacccuauagucugccuauaaauuugacucucaccaccaccuauaguuuaauuauuauuuggucccuguacuuagaauugaguuuagggcuuuguguaugcuagccaaguacuguaucacaaaccggauacagccuuacucagccacaucucuuuuguuagaagucucuuuuggggagauguuacaagcaugaagaccugaguuugaaucuccagaacccacauauaucaggaacacacuucaguacaguacaguauagauaggacaguagguauggugcacgcuuuggucauaccagugcuucucuggugaacuggcagggguaccaggaaacucccucaagcuugugggccagcuacccugguguuuguagggcaccagcaaacaacacaguggaaggcgaagaguaacacccacacuguccuccaaccuucacaugugcccuguaccuacucugcacaggcgacaacaugcacgcgcacgcgcgcacacacacacacacacacacacacacacacccugccucuuuauuuuauucuuguacuacccaacucauugcuccauaugauauauuaaacaauuuuuuucuuucugauuuaaagaucccuguuuucuuuauuuuuaauugaccagcaaauuuauaccuauuuauagguguuggcuguguguguguguguauuuuuaauugaccagcaaauuuauaccuauuuauagguguuggcugugugugugugugugugugugagagagagagagagagagagagagagaaagagagagagagagagagacauucauugcauagcugagcucuguacuugacacgcauuuccucauuaucuucucucucaggccuggggaaucagauuguuuaggaagaagaguuuugagacugcaaaaaucaaggcacccccuccgugugugugugugugugugugugugugugugugugugugugugugcuugugucugucuuuguggagaccaagguugggagccuugauugcucucaauuguauuccucuugucaaucucacaacugaaccuagagcgaucuggcugauaauccagcuagccagcuuacucugugggacccucuagcucugcuucuaauugcuggauuuagaagugggcugccaugucuggcuaguguuuacauggguucuaggaauccagauuuugaucccuacagcucuuuauucauugaacuauuuccccagccgggaagugguggcacacaccuuuagucccagcacucaggaugcaggagcaggaggcuuuccgaguuugagucuagcuggccuacagagugagugccaggacagccagggcuauguagagaaaccuugucuugaaaaacugugugugagugugugcgcgugcguguuuuaccaugucacagguguaguaaccaaggcauaacaaagcagccuuauuuuuuuuccugaaggucacaaagucgagcagugagcucauuugcugccggggcugauaugugccuucuccucugguggcccugcuguugggggaagccccauccuggaucacugccccagggccccuuuccccuuuccugccacaaccacccaugccacuuugaccucgcugugaguuaagaucuuuaacaagaaaccucaggagucaucccgccuaggcagccuggccucugcucauuugugagugaccaucuuggcuguccugagaguucaggccucuuggaaucagaucaucugaacucccagcugagagcugucauuucugugucugugguucuggaaaauugcucaaacucacuggggcucaguuugcuuaucugggaaauggggauggccagggcacauaucuugugaauuaucuaggaggauuaaaugaaguacaaauuucgaacugcacaucgaguuacuggagcuuggguagcugaaucagcaaagcuauuggacugguccugaacauagccucugaaagacugugguuugugugucaaguuuccuauuccgugcuugucuguugauguuguaaccaaccguucuaaugaaguagccaugagcaccugugcucuuaggucauaggugugugugugugcgcgcgccugugccucuacucugggcaggguuggaaccauccuugucuucuuccuccacuuagcauugucuucaggaccuaggcccugacacagccgugucagcagauggcuagggucuggggcuuugcucagugguacugcuggccccagguuucuggugagucagugcucaagugcguccuagcgccagugugggccggaucugcuccacgaggcuggccaggccacaccccggggaaguuuggcagucagccuugaacacccugggcagggccccaagacagauguaggcacaggggagugagcaggggagcagaccguggcugaagagaggugacaggcgccuggucaugugggagacagacauucccucucucuggacucccuaaaugucuaggcuugcauugaguaugcacugaggacugaccccaggggguuugcuggccaggaggccucuaagagcaagagguuggauuucuuuuccccuagcuugcugaagucagcuugguugggauuccaguuaauuaguggcucacccaugguaggcuucuggauucccuugagaguaaguaguuguauuucagguucuggucggguaccccggugcaaugccaguuccuagauggcuguugguggacaguggcugugcagagcucagagucacuugcuauguuauuuagcacgggccucacggccaugagaggaacaugguccuucuggauuuggcgcagugugcaggcauuggcucagugaggcagaugcagucucacccucacaggugaggugcggagcuucggacuugaagguggugguugcugguggcuucuggaguggacacugauuccugagggguacuuaguuagugccuugaucuccacccucccuguugagugucugugcaggcacaguauuccuugcaugugcgcacacuguuugucauuguuaguuguaagucucacacuccagccuggugccugaaucgccggcacauuugcuggcacccggagccugguucuccgccacagggaaggugcagggcugccgggugaccuauugauuucagccaggagcgucgccagguacuuugccucuuccgccaagcccucugcuuguuuauuuggccuugucagggaaugugguaaugucagggagugacgucugaacccugcagccuccucuuccaagugggcucaccgucagcagccauucuguucauuuggcaucaccagggucugagguuaauccguucaaauggugaccacguucuaaagggcacuugcucuaagcacuucuuuggaaaaagaagaaagaaaaaagaauuauauccuaugcucugcuucucuucaaggaggaaaaugucaccugcucuccuuucgccagaggccccuucuuuccugggucacccuuccuaccccucaauuccuggagaagggagaaccaaacccaggaggagccaccaagacuguaaauguucccccaccggguuccuaaggugaucuugggcaaaugaguggcuuucuuaagggacccugcuuucuccacggcaaaaagggguacaacugucccuccaaauuaaaaaugaucuuucauucacuuacugugugccugugccuguaccucgcaugugcguguggaguucggccagaacacagccuagucugcaggaggugguucuagucuucuaccaugugagacccagggaugugguucaggucccugggcuuggugacaggcaccuuuuccccugagccauccuccauguuuuauuggguuacugggguaggaaagaacagcagcccccaaauugucuguuaaauugagaguagacagggaaccaccugaguguuugcccuuugagcuccagcaccaggcuccgaagcuugccgggaaaagccacagagcugccagcugucuggggccugucuccccggggagacucugcuccuaguccccuccccugagaccugccuggcucuggggagagugccaagucagcacuccuuuaucucccugucuccuccggggaggaguuugagcccaguuucagucagguuuaaccauaacauucccucucuguuauguauguauuuacuuucugcugguugaaacaggaucuucuuacuguguugucuaggcuguucuccccugcuucagccuccucaggacuauagggauugcaccuauacauguauuaccugcuuuuugcccguucuuuuccucuguguguguguguguguguguguguguguguguguguguguguguguguucagagcuagggguugaacccagagcuuuggugcaugcuauuucaaugcuggcuccccccccuccuuuucaucuuuuaaaaacuuugaaacugagucucacuaaguccccaggcuugccuugaacuuacuguguagcuuagucgggccuugaacuuggaauccucuugccucaacuucccgguuagcugggaucacaacccugccugcacuauaaggccugccucuuaugaaaucagucuuagagcagaguuugagugcugucuaaggcccugccuugggcgggagagauggcucaguggauaaggacacuuguugcucuugcagagauccuggguucuguuuucagucuccauauguuggcucgcgucuaucugggacgccaguucuaggugaucagauauugucugcggaccucugugggagccaggcacggacaugguacacauauaaaacacucagacacauuaaaauaugucuaacaaccaaaaaaacugcuuuacuuuuucuaaaaauguguaugaguguuuugccuauacgcauguauguuuauacaugugugcaauacccacagaggccauaagaaggcacaagaacccuuggaauugggguugugagcugccaugugggugcugggaauugaaccuggguccucugcaagagcagcaaaugcccuuaacagcaggguccucuuuccagccuucugccuugcuuugaugucuaccuucacgucaggggaagcagcagguccuuuuuagaacuauuuuuuuguuucauuugcaauuuuauuuguuuuauguguaugaguguuuugccuguaucacuugcaugcagugcucaaggaggccugcagagggcaucaaauccccuagaacuggaauuauagauggucgugcauugccauguggguucugggaacuccacaggauccucugcuggaagcaaguacucuuaaccacugagccauuuuucccggccccaaacuauucuugaaucugggcccugagaagauuugauugaaauaacaaaccuugagugacaagcaaaguaugacagucugcaaaaggcucuguagucccagcgcugcugguugaauauucuucagcagaggcuucugggaagagaagcuuaucaguuauuccacccugcccccaaacugggaacaucugcagaaauccgugucugaaccccgagucaucuguuucauagucacauaccuuaaacauaauuuuaccauuucucgcucacugugcauguuuauguauguauguauguauguauguauguaugaaugcuuacauguauguaugugucaugugcauaacuaguggccucugaggucaggagggugguuggaucuccuggaccuguugguugugagcugccacgugggugcugggagcugagugaaugaauccugaucuuaugugagagacugcucuuaacugccagguggucucuggagcuccuugcacguuauuuuuaacaugcccguguuuucacauguagucacguguggaauuuucaauguuaugacacuauacacgagcucuugguguuugagguuuucagaugagagcccuuccugggugcuaggcucugugcugaucacugucuuguucuagagagucaagccagcaggacaguuaggaacaaagggugcuguguuucugugagaacugggaggaggggcggaauggggcggugcggggcggggcggggcgccuguugcuggggagagcugugaacuccuuccuuucccucagcagcacugaaccgccucugucaccccguugaaugccagcugggccaugagacccacgggcauauuugcugaucagauucauuuguuauuugcuggaaaccggaucggaugaccugcugcucuggcccaucgcuggaguaugaaaauggcucuguuacuugagaucauuauucuucccuuccaugauccuguuacaucuguuacucacaacaguaagaggccccaugcuccauuaccggauguuguggagagggguccagcccugauucuugauuggcugauuuuuauuuaaaugucacuuuuuuuuuuaaaccuuuagaaaaauacaauaguuagaaugccccaagaauucaaacuuuacuaucuggacagcugauuugcaauuuuaaaaauucuauguuauuuauuuaaguuuugggugugggugugcaugucacaguacauguaucuaggucaacaguuugcaggacuuaguucuuucuuucuuucuaccaagugugucagacgcagguugucacucacucaccagccugaggccaguggauuuagaaauaccaaguagaccgcuaauagaugugcagugcugugcaucucaagaguaugguaugaaacucuuaaauguauaugcucccauucuauaggaguuggggagauagcuaggaagcgcucucuguacagguacgaagagcugugcccaagucccuccaacucagugaaacagugugguagcucaaaucuguucccccagcuucuacaacaagauagagugaaagagcagcagggugagcgucccuagccuaggguacacggguggguggugaggacagacgccugagguugcccuccuacccacacauguccccagaaugugcacacacaccaaagagcuggauggauggcugagaucagaggcuuuggguuaacccucacugggauuucguugucgucaucgucgucgucuucuucuucuugauuuauuuuuauuucuaauuaugugugugugugacugggugugugcacgugagugcaguuguccaaagagagagcagaacaaugccgucagagcucccaugagugacauaggugcugggaaucaaacuugagucuucuguaagacaguucauucuaugaacugcuaaguccuuuuuccagcccccuuacugggguuucuaacuuaaaccaggugggguuuucuccugucucuggggagaaaaaaacccaaguagguuaaguuuuguugcuguugguuuuuuguuuuguuuuguuuuucccucaaaggcugagaaccaccagcuaauggggaugggaugugacaaagugcaaauggcggccugugaaccacaaugguuauaugaauguauuugcucauaaucacugucaacacacagguguacacugcaccuaucagccgagauacuugcuagucauguguggaaagagaugcugguggagaucugcuggaaacaggagacacgguuuccugacaaacuucugucuucugguugaauuuagaaaauaacauugaaaagaaauucaaguuaaaacauuaaagauuuaaaggaaaaaaaaaaaaagaaaccugguaguucuccaguaaaagaugaggacgguacccaggauauuaaguacuaaaaacucaggcuacuguguaugcgcugggugugagaucucuguaaagacacgaaaacagggguuuaauaggagccucuugucuucauuucaacccucaucaucaacuuggugaacgucagggcuuuugcaguuagaaaccucgcuguaaaccucaccuccucaacucugacacaagucccaugcguuguguaauaagccgcuggcuucugaccuguguccuggaagugcugcugggugaugucauggcaugccgcaaugccccuggguggugagaggcacagccgucagaugcagcucugugcacuugcagacgugugcugagagaaagagagagagagagagagagagagagagagagagagagagagaggccguuguccaguagccaucaugugaugaauggcaguuugugauucuggaccaucgaguuuguuuuacuguucugucagguucaguuagguaacggagagcagaugucugcauuaaaggccauuagcacaucaggaugcguuugcugaggcuggucguugaccaaagcacauaagcgaucccuuuccuauggacagcauuugggacuccagaugccccuuaggacguucugagaccacuuuaugaguuuaugacccaucaagggaucuguaaguggagaacguaaaaccggaaaggcagcguuuagcuacaugcugaaauccaguccucguuacuuuacaauacagguuuccuaauuuucucugcugccacagaaaagagucacguggcaaauuagaaggcuggcugguucuggaaccaugaguauuucucaagaaagcuuccuggugggggaagaggguccugaaagaggccagcuggagggugcgugcauacuaggaggcagggugagacccgccaugccaauugaccagcuagcacuuccaaaauaggugugacuuugcuccucuacccaucuuuccggccaacuucugucauuauugccccauuacuucugaauccugaaagcauaauguguguuuuugaguggauuuuuggagaaaguagccagccuguggaagcaggccaggagcagaguugccuauuugcgcagaucucucuggcuucuggaagguacaggcuuaccaaccaacagaagagcauucuuuaaaaagaagacaggcuuccaaaaacagcgucagaguuuguugcccaaacaucucagguucuuucugaagacugggaaccaagguuuggaaacaccgccggcuucauuuucaguacuagaaaccccaaacuuccggcucagcaaagcuccuggguuucuuuugggggaagggagggcaagcaaaggacugcugguuucucuguauuaguacugccaccuguugucagucagugacauuacacguuagcuuucuuuugcucugugcuccuuuuuuuccugugccuguucuugaaccuagggccucucuuacaccagggacacucuacacugggucacacagccugaccgguggcugcaguuuaaaagccauuuaucuggggcaccuuuuauuuuuaauuuguagucacaaaguucucagagugugaaggcaccagccaccuaacuuggagauucugcaugccauauucuugcuuuguuucuuggggacuccugaucaagcugccaguauaucagauuacagacuuugagcagagaacuggcuuuuccuuucuccccucccuccccucccuuccccucccuucccuucccccuucccaccacuccauuuguuaauucauucuuuuguucuuuuugagacuggcuuucuguguagcccuggcuguccuggaacucagaccaggcaggccuugaacgcagagauccgucugccucugccugcagagagcugggcucaaaggagugcuccaccaucgccuggcugccucuuucuuauuauccuuuugcuguuauuguuuugcuuuuucuuuuuuauuauauuuuuaaaauuuaaaacagauuugaacagaucgaauugaaauguuucgaucauauucuucaguccauccaguccauccagaucuucuccccuccccucccuauccaauuuuaaguucuuucucaaagcaaacaaaaacaaacaaaaauccaacacaacaacaccccccacccacccaacaccaagaagacaaaauaaagcaacacccaacagaaagaaaaaacacaaaacuucaacaacagcaacaacaacaaaaaguagcaaaaaagccucgugcaguuauguugcuacuccuggacgugaggccugcccuggagggguugacacacccagugccauuccuucggggaagauugaugucccucucccgcaggcgcaaggaucaguucuauugaccaccuuuacccagguggcuagcuuuucauucaucguguguuuauccauuuaagaaagcaugacaaagccuggcacaggccuuaaccccaucucucgggaggcagguagaucuuugcuaguucaaggccagccuggucugcaaagcaagcucuaggacagccagggcuacacagagaaacccuguuucaaaauacauccccucccccccaccucgggggccccccaaaguguaagauaaaacacgagcuaucacauggaaguuggacaggacaaaccaacauaaggaaaagagcccaagagaagacacagcaaccggagagccucuuguuugcacauucagggacaucaugaaaacacuauguaugggcuuugcuccuguugauuuacagggccuuguucucuggguguucccauccccucuggcucacacucucuccacuucuuuuauagcuaucuuuuccgucuugguugcuaguagaacuugcuuggcuaguuggggaaagaaggggggguaugggggaggguugagucugugacaugggacccagacaaaucagcccugagguacuuuuggacuagggcagacaguaaaggcuuauagaacagcucaaagacauuugaugcugacaaguguuuaaaggguacuuagggcuaggagaugccguuugccacaguugauuauuuguguggguauggaggucagagaguaacuuucaggagucagauuugucaugggguugucaggcuuggugggaagugacuuuaccuacugaguuaucucuauggcccgaacagcauucugguuaugaauuggggaaggaagggggguggcaggaggggagagggaagaggaggagaggaggaggaggaaugugcuggaauacucuuuuuguuguuguuguuguuguuguuguuguuuuccaagauagaguuucucuuuguaacauuggcuguccuggaacucacucuggagaccaccaggcuggccuuaaucucagagauccuccugccucugucucccuaauacugaggaacuaaaggcaugcaccaccacugcccaccuuuaggauacuuuuugagauauuuagucugugaacaauuagccugaugguguucugggcuggggaagcagcaacuggaaucaggucccgaaagcccuguuggcuuuauugcccaccccagcccagccucaccacaccuggaaugugcccuaugcacauucagcuuaacagacaguccuggggcagcagagacccagaggaguggagaggcacgugauagggggggggggguuaggguggggugggguggguggggugggaacagacggacagugugcuuggcagaggcuguuuuucccucuucuauuuaaugauuuauuguuuuuacuuucugcauacaaaugcuuugccugcaugucugucugggucugugcuggugcuggcagagguuagaaauaggaauuugaguuuccauguggguacuagaaccaaaugccagucuucuggaagagcagccugugcuugugaccgcggagccacuuuccagcccuggugguguuaguuucuaggagaaaaacagcucagugcguuuccaagguugucugcagcuuugaagggaacccagccuacgagucuguguggcuaauaaaagcccucaggacugaucuggcaauagcgggggaaggacccucacuaaggaagcccugguggcuguuuuuacagaacaauacuuccugauguagaacaagguuagcuggcuuauuaagugaaaacaagcuuaccaaaaaugauuucauuuccauagaaauaaaaugugaccgagcugggugauauuaacucuuacuuagggucuuagcacuuuagggggcagaggcaggaggauugccacaagucaaggccaacuugaccuggauaguaaguuccaggccagccauggcuaucuagcaagaccuugccucauaaacaaagcaacuacagaaaguaugugaacacaguuagagaaggagaagugggauggucucaggaaaggaccugggagucggggcuggggcugggcucgguuagugaaggacuugccuagcgugcacggaguccacgguuuggucuccagcacugcauaaacuggacgugcuggugaaugcuuggguggugggguagggcaugagaaacccaaggucauccuccgcugcguaggaaauuucagccugagcuacaugaaacaggagucuuaaaaaacaaaauaaaaacuagcaaucgggggggggggcaacugggucuuuggggaggcagguucccaagugaguuuauuuaccuugaguugaucgauauuuguuacauguccuccuaggaacagggauuauuauuucuguaaaaagaaaagauagagcaggccauggcggcccaacagguaaagcagcucgccaccaaaccaccaaaccugauguccugacuuugauccuugcugucuacauggugaaagagagagcugaguccugcaggcucuucucugacugucacgaaugugccauggcauacacacacagaaaagagagagagagagagagacagacagacagacagacacugacugacugacugcccuuuuugucucagcaggcggagcagaguauccagcaugcugucccgacgccuugguaagcgcucccucuugggagcccggguguugggaccuagugccgcugaaguaccaucaggggccacccugccucuggagccacagauagaagugccggaaggagccaugucccuguccccacucaccucuaaggacccugugugccaggagcagcccaaggagcuccucaaagcucugggaaccucaggccacccacagguggccuuucagccuggacagaagguagguugagcccagcagggacacauauccagucucuugagcacugggacuggcagacuagcagagugauaggcuggaaggcuggugagcuggccaguugcggccggccugcucacggucuucuagggugaaaagcauguagagagcuguaggagggagguuugaaccuaugugacuugccugagugcuugugugggcagcaggugucugggaauaccagcucucugcuggccugauugggcuacgauaacggaaugcccaaggugggguaggguaguuaauuuggcuuaaccuuccggagacugggaaguccgugaggaggauaaggucaggagaaugagagucugcauucacuuuuguaacaguucacacccucccugccuaccccccuuucuggauaacucucuuguuaggacaggagagagagcagcaguucuugugacauucacagacaguagacuguacuuccugacacuggucuuggggauuaagugucuaacauguaagcacuggggaugucugccagaucuuaacaucguuaaagaugagugagugugucagcgccuaggcugcugcagacagaguccgauaccuggaacacagaucuccgagggcuuugguguggaaacuccugagcgcugaccacugaccauccuuccccugcaggucugugugugguauggaggucaggagugcaagggccugguggagcagcacagcugggccgaggacaaggugaccguccggcugcuggaccagaaguuacagauucgcuguaaaguggaagagguguggcuggcggagcugcaggguagcgcaucccacgugccagccuuggagcccggagcccaggugccagccuacagaccggugucuaggaacaucgacgucccgaagagguuugugggaguggugaggguuagaggucugggcugggacacggcggcggcgugggggaugugggggauguggggauguggggaugggggaugaugggauaguggagcgagguacagaagaggcauccuuuuaaggaagcuuagauagcauccucucuucuccagaacucucuuaggggugaaguguauaugcuuugcugaaaguuuaaacuucacucauaauuuuucagaagaagagacaggaacaaauggcuugaaucuggggcccgugcucauucuauauaagguggccuuguggccaaagcagacucugucaugaccacuuguuaccacagccacagacccaaaagccuguaggcacagccgugcucccaucgaugaaaacuaaucaggguccccaaacuuucucguaacucaguaccauuugcaugugucuucugccaugguguaaaaugcuuuugauuuuuuauuuuguccuaaauagcauuuaaaaagguaaagccauccuuucuuagcucaaaauugcaggcaagcaggcugugucuagagcacacugggcugauucuucccuuggaugcuagaaaccagugggugaagaaugaauauucugcuuuaggucuuagggauaugaugucgccuugggacucuagauccugauguauacccuguggucuaucuauauugaccuuuuaagauuuaaaaaggagaaucuggggccaggagauggcucaguaggucuaaagaacuugugcaagcccaacaacucaaguucaaugccugagccuauguauggguggaaggaggagccuacuccacagagcuguucucugaccuccacauaugugcuauggcaugagugcacuaacgcacagcaugcaauaauaauaauaauaauaauaauaauaauaauaauaauaauaauaauaauaauaaauuuaagccaagaaacuuugccaacugaacuauuuugcauguaagauauauaaacagcuaaacucugucccacuuauuucuguggguauaggagcuguuggcagaucagggggcuuaaaccauauuuuuuuauuacauucauuuauucauuguguuuauggaguguguaugcaugcuguggcgcacacauggaugccagaggauaacuuucaggacucaguucacgucuacucuguggguacuauauacugaacucagcuagucaggcuuggcagcaagcacuucuacccacugagccacaucacuggcccagcagaccuaguguuuuaaguccagaggaacagcauuucugaucauguauccaguggaaggccagcaaagagcuuguuuugcuauucugaggaggugaaaauacaaagaucauguaaagucauguuuacuauguuaaugacuuugguccaucuguugcaaacccaguugcacaguauagcagaccugguguauaaagaaugggugaauacaguccuuugaaauaggcaagccacuggcagcuuauuacauucugauuuuccccagauacuuuacauuucagauagugcuuauuuuacuuccaaaucauauaacuguaugaauuuagagggauagaaaagacacguaaaauucuaugcagccuguuuaaagcauggaguuuuaacagcgggagaugguuucaucugguuauuuauuuuauccuggucuguuugcucauuggcuuauguaauagguucuguugacauucaggagcuaacagaaugccguguuuauuuuggcagaagggagagagauccauuaguguaauuguuuccucuuaaauuugaauauaagacaggggaaggauguaauuucaguguuuagauuccggugggcaucauuuauuuccaccuuaucuucuugacucuucucucuccccccaaguaaacaaugcuccauuuuaagcugcaggguuagagggagcguuucgggggaguggugcugauuuaggugucagcgcaguuuaagcaggggacccgcugcucauucugagguaauagacgcacagcuggagcaggcgcucauggacugagugacuugaguccugaaaguuauccucugagcuuuaccauccacugagcgugugcugccugacugggugggggguggggugcaugucaguguaaggugaucccacaaaaugagcggaugugguagcuuaauccgugggcucuguggaccagccaggccugggaaguaagcguaugcucugcucauuugaauccaggaagucggaugcgguggagauggacgagaugauggccgccauggugcugacgucucugucuugcagucccguugugcagaguccuccuggggcugagcccaucuucucuggugagcaagcagggcugaacugguuccugguguggcagagacccacgacugaugcucucucacacuggcuucuauuugccaguaggguucugcagucucuuaaguuuccucaccugaguagaaacuuggugcuuugugacagugacugaacucagugcuaaguccaguugcccagccacucaagcaaguucuaugggagccuggacaaggccaacagaaauauuuacuuaguuuacaaaagcagaacuaugcucuguaguccccugguggcguccgauggucaacauucacugcucagugcccaaaucagccucacgaaauucucagugugggcuuacaggccaaauaccugagcugaaguucaaaucugauugcacuauacaaaccaguauuaugggccagcgaaaugauucuggguaaaggugcuugcugccaagccugccaaccuguguuugguuccugggaccuucaugguggaagaaaagaacugauacacucucacucacacacucacacacucucucacucacacacucacacacucucucucucucucucuuucucucucucucucucucucucucauacacacacacacacacacacacacacacacacacacacacacacacacagagagagacaggguaauaaaaaguucugaguuguauggccucuaauuuauagauacacaauucuuuggguuaugacccccacacacacuacccauagugggcuugaagaagguugggagcaucuuaaagacggauugcugaauaaggcuuuugacaagacuuaaauuuauuuuaauggaaauuccuuaucugccagucuugaaagcuacuucaacguuuguaggacaauguggaguuaguucuaauucauacugagagggaaguggccuuuacaaauguccuucacaagucaucuaauaucgaaagcaaauuuuaauuauuucgcccagagacggucacugcacuuggggacaucuaguggugaaucccagcagugcagccgacuuuaaugagcacaaggaagauccugaggagggacaugccacauucucaagaaguugagucagcagauugaggaaaguagcugaagggaaaaaaccaaugucuggaguucccucuuggguccguguucaugaagccauguccaguugauuuggaugcuucuuggguucuucccuaaacaucuacuguuuuaagugcuguguguagcugugguaauuucucaguuuucaggaaaagcaagugaugagagcuuugagacugggcagagcugucuggggaggaggggacuccuuacccagcauucugucugggcaggugucuccuagaaguaaaaagggccugucuggguuggaaacauggggccuuggagucggcccagccuccagaucuguccuggucuccuagggugugucugugucucuuuaaacccagggucaggagacucuguaaucuggauagggagauggggaagcugaggguauaagguuugcuuuuuccaucuuucuugcuauuuccauguauuagacuuucagauuauguuaucaauuggcuuggcaugagcuuugaagacaagauacaagagggucuagaauaagccugcagucagcccuacagaccccgucaaucuacaaaguaaaaaccuagacuugggguuccacucauuacuggaaugcuugccuaguaugagcaaggccucagguuccauccucagcauuacaaaagccaaauaacgcaguagaacgaaaaucaaggaaaaugaagcaugaaaaucccccuuguuauuugcauucuuccuucuuagacaucugaguuugaggggcagguggcuguugugugacaggugagacagggccuccugccaccuggagaucaccuggcugugugguccgagaguucagagcaguuuccuuccacucacagagguugaugcgcuuguccgaggaggagugauagaaaggcauuuucaggaaacucaccaagaagaugucccuguguggcugucaccgaguggacauucucaaccaggccagaaccaggaaaaguuccucuuuuuagcguguacagcaugaacuagguuuuaguuguauucuuuucacuaauccucaaugagccguaguggcagugugcaucugugugggucaaugacgaugcauauggccgugccagaaaauaccccagcaggcagagcgguugaagcaccaaaaguugccauagugucugcaccugcccccaucuuguagcucaggaagcguaucuguaauaacugaaauucuaauaauauuuuaauuuuauuauucacuuacgcguuuuuuuccuuuggucccggagauaagccugaguguuccuugaccucccucucugucuggacaguuucccgugcagccugcggugaccuguggaaggagagcggugauguuucagacagcggcagcagcgggcacuggagcgggagcaguggcagcucuacccccucgccgccccauccgcaggccagccccaaguaccugggggaugccuuugggucuccccaaacugaucauggcuuugagacugauccugacccuuuccuguuagacgaaccagccccacgaaagaggaggguaggugacuggggagcauguguguacgugaggacagccaugccuagaggaacaggcgccccgaagguccuggguaucucaaguuuuccuuagcugcacuugugagguucccagacacaggcggcugguuccucuuuguuuuuugggugugugaguuuguggaugugcaugcacauggagacaccucaccccaucuuacuuguugagaaaggcucucuuguuggccuggagcucaccaaauagucuaggcaugguuggugaccagugagccagggaucuacuugccuccgccaugccucuugguauuacaagugugugccacugugcuugccuuguuuguuuguuuguuuuuaaaauguggccagccaccaggucacuucuaaauucucuugugccuguuucuaugcucucugggagacccuucccuugaauuuuuuuccuuugggucuggcugaaauccucaucaggcaaugagugaagcuggggagaggauucauauauaccaguugcuaaggcuuuuuuuuuuuacccccccuagaacuccgugaaggugauguacaagugccuguggcccagcuguggcaaaguucuccguucaauugugggcaucaaacgacacgucaaagcccuccaccugggguagguacagagcucagugccugucgauuccacccugcuaacaccaugggacuuacagcccagaaugcuucuagugaaauggcuuugcucuaggugcuucuccgagccucgcccugaccacugucaggaugaugucuuugcuggccagggagauucuuuguaccuuggucacuguugacgcuguugccagagagugagcucugugugucuuucugugcgacuuguggcuguaucuuuuuaccugguguaggaagcaagauguuucaguucuggguggaaauagaaccguuuggucuaauugccagugacauccuguggcuugagcaugguggccaaguuuuacuucuguggcugcaugggggaguuaggguguaucagcuguagugcuaacauagggcucucaucucugagcagagcccucugggcagcagcucuggcaugaagugccucacaggccuugagagcaugcuuuagauggugcccuaagagggccugugccagggcugggucuguguucacacauuugugauguugugugagcucuugugcagggaagaacagcuccuguggcuggaugggcguguucugaucccugauagcauccucugagagcagugguccuggauguucucuugggaaccccccacccccccuaacuucaugguuggacacaugcagucaguuccucuguguaacuuucuuuccucuggcuucgaaccaaggcagcgugcccucagugacggccacaugucuguuccacacagggacacuguugacucugaucaguucaagcgggaggaagacuuuuacuacacagagaugcagaugaaagaggaaucugcucaggcuguggcugcucccccugccccugggacaccuaugggcgagccagcguccaccuccagggugaccagcccgucccuugcugcucuuucauugccuccagccaagguccagucaucuggcccagaacacccuggccuggagucuucucugcccucaguugcacucagcaagucagcuccuggcucuuucuggcacauucaggcugaccaugcauaucagguaugggacguuacaugugugggggcuuagcuugggaucucaguggucacuggcuguuagagggcaggccucugagcaccuugaugaaagacugagucuuuuggccaagucgcuaaccuuacuuccacagagaaggaaaaggaaagacuagggauauaggccaguugauaaaugcuugcuuaaugugcacagggcuuuggguugauccucagcauacccccacagucccagcacuuaggguggagauaggaggaauaaaaguucagggucacccucaccuacauagggaguuuaaagccagcucagacuacauguaaacccuuugucaaugacaauaacgaacaggacgaaaaggaagaaaaaggaauccuuggugacacuugguagagaugagaagucuaaccauguuagcuguguggcugugaucugagagcugucacuuugaaggcugacucauacagagcuuuccaggcaacgccuuagcucugagguguuacacugaauggucccacuuugaguaccuacuaggugucagcauuggauuauguaacuccuucaguuagacuaggacaugggcccugcucucucaaacuuugugguggagcuaggguuagcaauguggacuaauuauaaguucucaaagugccauuuccucaggacacgggaagacacgauguaggcccaaggaagaccacuccauuaugcuuauggaccugggaaaauugucauggccaggagggcagugucauuuaaaaugaaccugauccugaaugcuaaguucacauguccaugggcugguuuauaacucuuucuguacauacaauuuggcuuuugcagacuugacaagcuugcaaauugguaaauaaaaaguaauguuuccaugcggaugugccugcgcaugcuuguaauacugguuguaccugggucaaggucagcucaggcuauauaguaaagccagccuuuaccccuaaaaccagugcuacuuucaaugagaaaaauuuuauaaaacaagcaggcucuccccauuagauuuauuggccacuuagcgucuggcuacggcucagccuuugcuggcccuguggcaucugguuaauguggcagguauuguuagcgauggcucuaagccagacauuccugccugcauccccacuccugaguaguugccuggcagcucucugcccuuuugcagacucagaaggcuuugggcuuucugcuucaggccuguucucaguaggugauccagccaaggaauaacaccccuaaggacugagucaggaggcgagcauguaagcaaccccaaagggaggauuacagaauaagacugcagccucccagaaaacaggcuauggcuauguugaaggguuagaugcuuugaggcugcuugugggaaaaccuauuuaccuguccugguguuuuccaggcuauugcucgggugcagauacuccuuucauugcaaacgggcaguuacugggaccugaggcagauaggauagguccuuaguugagguccaggcugaugcacucuugucucugcaggcucugccauccuuccagaucccuguuuccccccacaucuauaccagcaucagcugggcugcugccccuaccaccaccuccucccucucuccggugaguguguacccccaaaccccaaagcucuuacauacaucuucaggucugggggacuguuucguugguacaccccacauggcugauguuguccgucuccacccccauacuuaaugaagaucacugugugucuuaggguuccauugcugugaagaggcaccaugaccgacuccuauaaaggacaacauuuaauugggucuggcuuacaauuucagagauuugguucauuaucauccuuagaggaagcaugcagugugcaggcagacaugguacaggaagagcugagaguucuucaucuugaucugaaggcagccagaagaguguucccgggcagccagggggagggacucuucgccacucgguggaucuugagccuaggcccucaaagcucaccccuacagugagauacuuccuccaauaagaccacaucuacuccaacaaggccacaccgccuaauaguugcacuucccgugggccaagcauauccaaaucaccacaccguauguccucuaucuggcuacagcuccucucugugugugucaaguccuaacaucuagaugaaaggaagggagaauucggggcugucagaagggagaaccaggaagaucauagaauacucagaggcucugugugcuggaccagaagucucaggccaccacggauucauguacccuugacucugaacugaaauaaacuggaagugauuagaaccacauaggguggcucuacuuucaagugugugccacagagaaguaccacagacagcagaaccuaguugacagaaggcgucaccgaggcaauacaaugcccucauuugucccuuguaugguaaauucaucuaagcugacccugucugcugagaauguccuucuaggggaggccgcauggccuccuggaccagcaccugcuccggggcccagcgaagcccagcagggccuggggaguugccucucuguugugagggggucucaugcucacagccuaugcuuacauuccucauacccagguccgaagccgcucucucagcuucagcgagccccagcagccgccaccuacagugaagucucaccugauugucaccuccccaccccgugcucagagcagcaccaggugagcccucuccuucugguuucugccuuccaacagcacugguaauguagacugaaucuacccaacuguagucccuaggguaaguccccagauggagaccacaugguggcuucucuucccucgagucucuggcuguaggugccacucacuccugccaggagccaccccuuccagcuccuacauguuugugugcucaugcuaagccauuaccugggggucaccuccaucgagugacacacccucacuuuguucccugucaggaaagcccguggagaggccaagaagugccguaagguguacggcaucgagcaccgggaccaguggugcacagccugccgguggaagaaggccugccagcgcuuccuggacugagccugccucacuagccccgcuucucacccugccuggcagccgggaagccuccaggccugcagccaucagcagaacacagggagaugauguggcguggaugugggcagcuggggcuccauuggcuaagauagaacacuuaaaaacacuuuucucccccuuguugggagugcuuuauuuuuuaaaagcaaaccuaaaugaaacuauuuuuccccuuaaaauaggagagagccaaaauugaccaaggguauucugcagcgaaccggagaccaaagaguuaccccuaccccuaccccauuccacccucucugggacuacauaugcaucaagaguaggacaggaugcugccuugccugguuuuguucugagcuggugaauccuuugcucuuucagcuauucuagaguggccugugagcaaaugaacuucucucucucucucucucucucucucuuucuuucucucucucucucccuuccuuccuuccuuccuuccuuccccccucuuucucucucucccucccucccucccucucccucuccccccccucuuucucucucucucuuucuuucuuucuuucuuucuuucuuucuuucuuucuuucuuucuuucuuucuuucuuucuuuucuuucaaaaaaaaaaaagaagaacuuucuggcagguagauggccacccagggaauguggcaggacccuaagaagagcaggcagcugugcuuguugagauaugaggacagaaaagggacacccuuuuauggugucaacuuuuggaucuggguuucccccagauguuggguugcaugccaauaaacauguggcuucuucucaaagccugucuucaaaaaagcugaggcaaaaugcuaauauuaauucagccuggccucgaaacacuguccugagcacccgucaacucugagaggaaguguggagagucuccauccaacucugcuccuacugaguaaaguccccuucccuccagagugucacagagacacuagaaugucaggugcucuugucugauguagaagucuuugaugaggaagccuucuuucccuuggggucucuggaagauccuagcagacuuugccugugggccugcucagcaugacuuccaggaccccacuguucuggacugacaucccaggugucacaggcucagggaguggcaccaggucaccucuccagggacugagcaucauuggcucauugucauggggagcucccuccugaccacggaggcuccacugguggugccacaugggaaacaucuacuucucagucuaaggcacacuaaguacuaguagcaagccugugagccuaggagacugugugugugagguaaaggguguagugguggccugggcugcugauggaggggaagcaccaguaucuaggugucuuugguagggguguauuuuuauuacacagaguuuuugaacauauagggaccccaccaagaggcucuccucuccccuucuuaaucccaguauagacugaguguccacuucagcaaagguguuuucaucccagccuugguuuggagcuugcagacguaacugaauauaauuuccuccauuugcagcaugguucccaugccauuggcgcaccagacagaaaagggagagagaaaagacaggaacugaugagauaguuugaaagcugaaggaguucugaguuuguuuaguucuuuauuccaucucugugcggccucccgagccuacguucguucccuccucccuuaugguguuggccuccugccugcugucauguguccccccuuuugcucccccuccccauccugaugcuuucauguugguuccugacacauggucuggcuuuggguuugaagggcaaggguggcugugaaccacccccacccagccgucaggcccgcuucgucgucaucucuaucucccugcucccuggcccugaggguuuggaaucugaccgggugaaggcaccaccggcgagcuuuugaaagcaacagggccuagccugcaaacaguuaucuugggaaacuguccagccacguuuccauuacucggagcucucgguuaccuucagacauggugccguguugggagcaaccucaguggguuugcacuacacucacuccgugcugcaaguccagggauacugucuguggccacugaagucucaggugcagauggguucucccgggaacccaggguuggauccauaaggcuuuaaucuggcccugaaagcaguguugccgcuucagacaguacugcgagcaauggcugccuugucggagugaguguguagcuggacaccuuagaggacccuaugaaauuggauauggagacugauuuggugggaaaaaaccuguuacuuuccagucaccccagguucugacuuuaccuggggcaaaaacaaaccacaaaaagggagaaucucaucugugaauuugucuuaucggcgcuucuccccagccccgccccugccccgccccgccccagccccgcugucuuccaaguauuauuuuuacuguuaagauuuuuuuuaaaugugaaaugaaauguaauguuuuuacagcaaugauaugaaauauauuuuauaaggaauaaaaugguacauugucugac

SEQ ID NO: 7535 - RNA, 1178 nt, Mus musculus
ggaagagauuuuguccugaguggaguguggcaagagagagauucugcuuuucucgggaagcucagcuauauaccagcuucuccacgaugccagagugagagagaccacugcugaucgugcugaggcacagcugaaagaguuccuuucagggaagcagauccaaaaauggagucacuggguaagcaaucugaccuugcagcucagauaugauucuauuuuggaaagcucgagagcagcaguucaguagagagaaaaauccucauuucagacagucauaacuuuuuacuguagcaugccuuugccaaaugguaucaaaaagaaaaauaaacaucaggaaaaaaauagcuugacuuuucccaaaaggucucuguggucccuuuccgaggccgaguucucucugcuggacuggggaaugagcucuggguuuacuuaagcuguggaacuaucagcacucuacacauggacagagguguaggccaagaggcugaagagugaaauagagguguuucggggcagcuguccugagggccagucaagguaucgagaagagcuagugcuucuccuuggacuuggggcucagaagcgucagaaacuagcuuacagggugugagucucuggguaggcucuguguguguguaugugugugugugugugcgcgcgugcacacacuugcgcauuuguagggggugggugcacguauguauguauguaugcuuaugugugcacauguguauggaggcugauggacagccuuaggugauguccaucagaagcugccauccuugggguuuuuuugagugagggucucacccuagccucccugguuauguauuaacaccagaguugugucuauggcauguuaaccuuuauuuugauccaauuguauaagaggucucucuuuucccccucucucacacacauauguauucuaugcagaguguagacagauucccuucccuuugaaaauagccucaugcuuguuuccugugcgcuugguuugacccuugcuauuccuugcuguuccugacagcucuugucugccagguuguacucugggguuccugacccacagcucugcugugccuaugcauuccugcuauccugccugaguuugaagacagccuuggcuacaucaugagauccugucuuaaaauaaaauuucuuuucuuuuuggucug

SEQ ID NO: 7536 - RNA, 62667 nt, Mus musculus
uaugguacagucgcuguguuuucacgacagucccgggcggcuuuacggcugcuaaguuucuccgccuucuaaaccgcgguaacgugguggcauauugcuacgccagcgcagagaugaggcaaaagaggaaaggugcaaaauacgugggacaagggcgcaagggaggaaguggauucucugagaucacagguugaagcucaauuuuccaugggaauuacugcuuggucugggcccgcgggaccccgguuggcgggccucccuuccuaucuguccuuuguaaaacagcccccuucucucuuccccuuuggaagagacuacuuguuguuuuuuguguagauggguaaacgguacugcuauuccaagauaacuuucagaggagauagguguugaguugcagguuaauuugcgguaauuuacuggacguguuuauuuaagguguuuuuguuuuuuguuuuuguuuuuuaaaucuuaaaguaggaaaggccuccuuaagguagagauugugcaguuugugcaauagcuuuacgugacuuacuugcauuuauuuuaccuccggaguagucuggaguaacugugcaguuuuugguuuuuuuuucaacaggaugaagucauuuuuuuuuaaaucuuuuuuuuuuuuuugcaauagauuccauucuuaacucuguacugcccuugaagaguuggucugauaauauuacuguuggaugucacaauaauagcuggguauugagccuuucccagucauuuugaagacguguugucauuucaugcucgaaaaagcugagguuugguuaacuuuuccagucaaaguuuauacuuagugugaggagcugccugugacaucggaagcaucaaaugaaaagucagugcgguauuggucaccgcucuuggcacuaacuggaacugcccuucuagacauguucuauauacuugucacaucaaacacaacaugcacuagauccguuugaucuuacuuuacuguaacguguuuauuccuaggcuggcaaucagcaagccccagccagcccgucucccuugcccacuccuccaugguccccacguuacgggcaugaauguggccuagcuucgaacaugggagcagggauucaaacugaaguuuucauguguguagaucuggcuuuuguuuaucaucuacauugauuguaucuuucuuuuuuuagcuuucugacauauuuguuauauugguaaucucucuuuuaaaaaaacuacuuuuuuuuucuuaaguuacagaguugagaauguauaauuuuuuucuguuacguuuaaugccuuugccuaguggccaguguacugucuacuuacugaacccugcucaggcaaccuguggucaaguuagauagaucuccuuucaccagaauagguaguucuuaugccuagccuuguuccuucuuguuguuccuugguuuacacccugaccuuucuuuaaugaugcuaauucucuuuccuccaugaaauacuucuuacugguuugcccaaguaguauucagaucuuuuauuuuuguuagcccagccucuuacucucuagaugaagucuuaugcagaaguuuuuaauguagaaagaagaaaacagaguugcaguggucuuaauacauaugcauguguaugcgcacacacgcaugcaugcacacacacacacacucacccaaauagauggagauguauagauaugcaaguugacagggugauaucucaucuucugugcucaucccguaccccaaguccaccucuguuacauagccucugaggcaccuuuguagaacugagaaugcugggaaaucacuagucuuuggcuauccauagacuucucucucauuguuugauauguauuagcuuugccucauuaaguugguggaguacacagugcacaauaugguaaaaagaccugaaccugagaucuaacccugcccuuuacaaugacaucugaacuugcuuugauccaguuuuacauguauaaaauaggacgacaauaccaacuuuacagugucauugugaguuucaaaugggugacuuccaugguguucuuauccacacuccuaugaugacuucuuucuuuuucacaccagcaggcaggaggcguguuugcugccaucacccaagcuaacacagcgcaccacuguugucagcugguaaaagaugggcucuccugacccuugacaaaaagagcugagauuuuucuggcuuggauggguugcuuaugcuuggaugagucauuugugauugacaguaggaugauguggcaaucgugccagcaucuccugugucuguggaugagagagcaggcugccaagacaggaucaugcaggucagcagacaguagcuuagaaaugcagcuagacccuuagauaggccaggccagcuaguacguacuguaaucucaacacucaagaggcuccugacugacacacuuaaaauuucguugcauguacaaauaaauaauuguuaaagagacugaaugaugagacucugugguugaaauguucucugcaggggaccucagcccggcugagcugaugaugcugacuauaggagacguuaucaagcagcugguugaagcucaugagcaggggaaagacgucgaucuaaauaaguaaguggaucuauagaagggcagucuugcugucguguccuuaaguaaggguugaucugucugucugacacagggucucauuuuguaucccaagcuggccucaaauucaagacauuccucuugccuaaguuucccaagcccuggaauuccuggcaugccccgcugugccuggcaguagagccaggcuguucugcaaacugaccuaaagcuaccuguuuucuguguagugguuaagaauuguaguuuccugccuugucacaugcuucacggugacacaauugugcugaagccucugacucuaauugucucuggccuuccuuggcacuuucaguaccccaggcacugucaggaguacacugcaggucacagaaaccgaaggaaagggguccuaguuagaaugaccacucugaugaaacacuaaagcaacuuggguaggaaaagguuuauuucaauuuauacuuccagguaacagcaguccaucauagagggaagucagggcaggaauucaaacagggaaggaaccuagaaacaggagcugaugcagaggccauggaagagcguugcuugcuccauauagcuugcucaaccugcuuucuguuagaacucaagaucaccagcccagggaucgcaccacccacagugggcuaggcccucccccaucagucacuaauuaagaaaaugucuuaaaggcuugccuacagcccggucuuguggagguauuuucucuauugaggcccuccucugcuccaauacuuauaauugugucauauugacauaaaauuagccugcacaacugacuccuugucaacuugagacaaaaacacaacacuuuucaguuagaaccuuucuuuucucaucuauccccaacauggcauauuaaucuuaacaccacagucuaaaacauaaauaacuugaaaguccagucgucuuuacaauucaaacagauuaauaagaucuuuaaaagauccagucucuuaaaacuccaaaaucccuuuuaaaaguucaaagucucucaacucugggcuccuguaaaaaaucaaaauugaguuacuuuucuucacaaucugaacaaagcaaauccaaacuccuacaguuaaauaauugaauguccaguguuugggauucacucaaaaucaucuggacuccuccagggugcuuguaccucuucuccagcucuacccucuccaguacacacaggucuucuagguuccuacuggcacaacuccacagcugccgguguuuuuuguggucauccucugguacuggcaucuccacuguuggcacuaggucagaccuucaacaguagccucuccugggcucuucauggugaagcuucagcuucucugaccccuucaaucauggccuuuccauugcuagucugauuguaccuucuccaauggccucucuugaccucucacagugccaagucucaguugccguccaugaugccuccauggcuucaaugacuagguuuagcugccagcacaagguacaaccuugaccaccucaaaagacggcuugcaugugcuaacucugaggaaauuuuccccagaagauuucaccucaguaaugcuggccucuuccuaaccgcaccugauucuccagcugaucaggcaccacagaugugucacacaaacagacccgguagggucuuugcuucccucugaaacgucacaagccaggccuccuccaucugcacccuagucuuuguuaccgccugaaugaguggucauucauccauugcuuucaacacucuuaccuuuuaagcucccacagaacaucccauuggcucaauggcuuuucuugaccaaaguuccaaagcccuuccacaauccucgcaaaaaacaacauggacagaucugucacagcaauacuccagucuccugguaccaacuuaccuuugguuuucuguagcuaugaugaaacaccaugaccaaaauuaauuuauggccgggcagugguggcgcaccccuuuaaucccagcacuugggaggcagaggcagguggauuucugaguuugaggcgagccuggucuacagagugaguuccaggacagccagggcuacacagagaaacccugccucgaaaaaccaaaaccaaaacaauaacaacaacaacaaaacaauuuauggaggaaaggguuuacuuugucuuacaacucucagguuacacucgucacucugucacugaaggaagucagggcagaaguauaaagcaggaagcuggaggcaggagcugauguagaugccugggagggguguggcuuaccagccugcuccccauggcuugcucagccugcuuucuuguagaacccagggccauaggugugacccagcucacaaugagcugggccuuccacaucaaucacuaauuaagaaaaugcccuauaggcuugccuacagcccccagcauauagaggcauuuucucagcugggguucccuccuagaggacucuagcuugugucaaauugauguaaaacuagucagcacagggggcugacaagaugaacuaguagguaaaagugugguaaauggagaaaaucaacucccagagcugucuucugaccucuauucuacacugcugcuguggcacacgcccacauauuuaacaagaaacaguaugggguagauacugguguuacccucuccuaaaacaugggugguuugagaauuagagaagcuaaguaaguguggggguggggcuuagccauuggcacaguggggguucuguccccuuggaagaaccucugugccaggagcacucucuggugcccuuaaucuaaucacagccaucucuacugcaggaccucuucugcacccuagucuuuguuacugcccgaaugaguggucauucaucucugcuuauuucuuagcugcauuugcucuuuauauauucucuuucucucucuuucucccucucucucucucuuucucccucucucccucucucucccucccccccccacucacacacacacacagauugagagcgcgcuacucacugugucauguagucuccacauucauggccucuuguagaccaaguucuguuucugaagaugccgguacccaaccuucccuugaguacugugcuuagaaagcauguguaaaggaaugaguggucuuuuuggcuaugaaaguauuguacagcuuuuucuacagagucuuacagugucaucacugugacuacacugucugucugagaagcucuucugggucugccuuccuuaacuguuucccuagcauuuguucacaaaaguccuuucugcguucuggaagcaaccuuugcacgugguguguguuuggggagaggagaugucauagcuauggcacaucacaugaaaggacugcugacaccuggcauaccacauauguugguaguagccugugcgugcuggcuauuccauuagcaguuguugagaacaaagugagcaccucacagauacuucuggguggcuuaauuuuuagacaguguggccagugggauugugcuagugggcagagagaaagagaaagcuguucaaaucagagaaaauuaaaggaauaaucugggcaugguggugcauaccuguaaucucagcauucagggguggagacagaaggauuuugaguccaaagcuaaucuguguacagcaagauaaaaaugggagugggguuuaggaauuaaagucauuauucaagugaaggguacuauugagguuacagauaguguuaaagucaggaggcaacaugaaguuuuguuaagguagauucuacgauuuguauucugguuuuugauuuguuguugcuuuuguauagaauuuucuauaggaaaguaguuuuugaucaggguuauuccuucccaggagacagguggcaaugucuagucagccuucugcacacagucccaaaugucaguaaugaggcugagaagggguaggggcagaguuguucucuaggauggaagcuuggugcaguuuggaaugagaccuucacugugccgucguccugggccccacaguucugguuuacuuccauuuccuaguauucacagguuguuaggccauucuugccaccuggugaagggauagaggagcgggagacauuaaugcuuaaugcuuugcuuuuaggaugaaaaccaagacagcugccaaguauggccuugcgucccagccccgccugguggauaucaucgcugcagucccuccucacuaucgaaagaucuugauuccuaagcuaaaggcgaagcccgucaggacugccaguggggugagugauugaauuggugagauauugauauguagugaggcagcaguugaggacucaggcuccuaaagucgucaugcuguguguuugaaugaaggaggugugcacgaagcugagaggugcaccagcuaggaugcuuaaaggagugcaugguuuuauagugucuuuaaagaucgaggcuuggucacuuacagugugacaaaugcuguugacccucuuaacugguagcuuccaguugguacuucugaaagacauacaacgaugcaggguaguuuuauuugugauaaugguggagcaaaucucccaguagggagcgcugugaguguccagagaauggggauccucagcaaaaggaaaaaauaaagucccaucagaaagcuuggcacuuuccugacccgugaguaggcucauaugaucagggaggaucaggcucagagguugcugggagcaagaaaggaauaggaaagagggcacgggggggggggggggggggggggagcacaaagggcacggccugugcagacagaaaguacaacagacuggcaacaguucacuuggcuugccauggacuggacucaguuggcccccaaccuuagggagaaucagggucccgguacucagguggacaaggagucagcggggugauaaacagacaugaauaccagagagaauguugaaucugacugugauuucucaaagugagcaucagacuuauauuacagacaaaaacaaggaaguuaagugacacauuaaggucaucuaagguacauugagguuacccaaugcaaaaagacucuuuacacaaaacagagaaaugcauuacauaaaagcugacaggaaccaggcaguguuuacaacugggauaaaaagcagccccaccuaaggucagcuuauucuuagaagccaggggcaagggcuuuaugcccuugccauaguuccaauucuagucuuuggauaaucuaccuucucccuaggccauuguaaauuccuguguaugggagugacucagcuguuauucuaaguauuuacucuaguuccuucuuagacuacaaccuuccuucuuccuaggccauuguaaauuccugcacaugggagugacucggcuguuauucuaaguuuauuuuguagaacuagcccugcaauuucuagcucauuuccaguaaauuguaaugccugauuucucucacuaucucucugucaacacuggagacuuuucaucugaaugaguagcauucuuacaaaauucaaagcccaagguuggcucaaugauuuccuaggauauuggaacacugguggaggcuaaucuaacuuagcuauaugucaaaaucaacccuuagaggcacuuacaauaaaacuauauugaaggacagcacacagauccauucaccgacugauguagggacaaguuuggagcauucgugcuacaggaugccgagacuccaggagacuacguuucugugaaccuuuuugccucaggacugcuuccaagcuuuugggcuugccacaaagacuucacuggaguggguguggcguuggcuaaugauuuuuuugagauagacucauuguauaggccacacugccuugaacucacacugucucagcuuccugcaugcugcauucauuugagaaaacuagggcuuagcuuauaaacaacuacaugcaauugacagagaaaccaaauagcaggaaacuauuucaggugccugcacagugaugauaugagcagaguagauuuuccgaaaguuauucuagauacggcaugcucaguaguuuagaaacauagaggccauguuguacauucuguucugaacucugaagcauuagggggcugaauugggguuuaggcucugaggaccaaaggcugagugagaggccgggggaaaaugggcgggucaggaucugauggagaaggaguuccagaguugaagucuguauuccugaugugacagcauguuugcucugcugucuggaucaggaugugguauuucuagggcuugguuggcuaugucaguggccggauccccuggauucugauacuuguggacagcuaaaccucacgaucuuuacacacaaugugcgcuaagucugauacacauauauuacuaacagguacuuacaccacauaaaaacuuaaaaaaacaaaaauacgaaucuaacaugugcaccugcucagcuagucauagccugccuacugcaguaauaucucaguucagaaucacugcuugucugguugccacagcgccucagaucacaccugcccuggcuuuccuugauuucuuuacccucacacugaagagugcccauuguuuuucaguuugguuuaacaaaugcgucuguauaacuagagccgguucauugucuccuugguauucuacacacguguguacuuacauaaacacauucccaucuguuuugaggugucuucaucuaucuguuggcaacuauuuggaaaacaguagcucaauuucuucagcccuggcuucaucuggcuuucucagucuacauguccucugucuacaacuuccucucuguccauaagaauccagcuuauguuaaucuuaaugugacuuagugugaaucuguguggucaccuaccucccaugucaguagcuuauagcuuugaucucucugcugccagcccuuuucucaggcaggcacauuccccacccagccuggacucugcaggacucugagauuuugcacauaaauucuaaaucagucuaguuccugacugccucuucccgcuuuggauguugaaaucuaggaugucuguacaauuugaauaauaacgauuagguuuacauauaauaucauauaaagugaucuuuguaggccauuuuagcaaaauauuuggagaauaagaauuacgaugaccuuaaaagcuaauucccagggcugggcuuguagcucagcgguagagugcucaagccccugggugcaaggucuaggaucacaaauuaguaguaaugguaccuuauuucauacuuacuauaaaacuaaguacaaaacucgcaugcaauucacagaaacaauuuaaguauuagcaauaaaaaagaacaugacuucaugauacagcaucaucagugucuugcgggagacccucaguuucuucucagaucgaaucagccugccccuucaguaccuugaagaccuuuaugcgccuuuaugugcccuucaguacccuuguguccuuaugucccguuccaauugcauuccucuccuucacucuuaggguaaccacucuguaaaauuuuuguuaauuuuucaaugauagcuuucuaauuaguguuucuuuuauagaucgcuguuguggcugugaugugcaaaccccacagauguccacacaucaguuucacagggaauauauguauguaaguauggcucugauaagucgguguauguguguuucaguuaaaguaguaagugaauucccuaaugccuuggucaguacaggcuaaugauagguaaaacugacugaaagauccaaagcucagccucuacaucagcagcuuugauaagguguuucagcuuguugaaacugaucagauagugcugcggugcugagacacucauagguuaugaacguggggcaguggacaccugauaccucaggaaaauaauguggaaacaugggcucuguuggugccagcauuaaauuaaaaaggguuuggaccagagagauagccaccauuuuacaguucuuccucuaaauagcuguugggguucuguaacugaggaacugggaagaguucauggaugcacauguaugacaggggcaggaggauuaaaugggagggaaacuuccuggguaaagcaaaguccugggaaagcauggcgucacccaggcugggcggcuggacucccgugucaggccuguaggagcugugacugcaguguugugacguguguguguguugguuggcacguucugcacugagcugucuuguuugcuuguuggugaacaaugcugggaggucgacugcaguuugacuugauggugggcggggcugccuugacgggcggcaggauguccuguugaacugaguuuucauucgcccuuccuguucuguccuuguguccagauacugccccggaggaccugacuccgauuuugaguauucaacccagucuuacacgggcuaugagguaaagccuugacuugguccugacagaggguggccugacaaguaccagcauucuucuaaguuugccuuuucucaugacuagagaagcuuuuugccaaauaucugcacugugucuucgagugcuguauaugugccaagucacuggagaaaugcugacuugagcauuucuuaaccauuauuuccaaccucugucccaaauguuugccacucuaagccuuucagcaggauuuggaagguagauacuaugauucucucuguauuuuggcgaagaauuugagacauagagccuuagacagcugacagggagguaacauuagugagcagccacucugaccuguguauuccaugguucagauuuuuuacucuuguuuuuuauuuuuacauauuaaauaaugugauaaaauacugcuuugcuucucucucucucuuucucacacacacguguauuuuuuucccauacaugucucauuguaacucagauuggcuucaaccuuuugauagucuugcugucucaccuggaaagcacaaggacugcagguguuuaggucugaccacugggaguuggauagucugucagagcucgucgcugaagaaaacugauucucccugucucagcaccacugauugccuguaacucaugagcaugguucagggccuuaagaaaugcuguccauguuaaauguuagcugguguugucauugugcagaucuuguuuauacugucauuuguugagaucuauugaguguccugaugcugucaugucgagaagacacugccuaguccucugcccccuuucccugagucuuagguguaguggcugugcuguagcuguaucaguuaggcauucuacugucacuugaccucugaguucugaccagcugguggucaccauaacagucuccaccugcuggaaaaagacaaagaaccuuugaguacccacuguaugacagugacaucaagaccgcucaccgagcccuuagaaaacauguauaguuaagggccucgugcaaagagaugugugcccaucucugugaaugcauuacacuuugggugucaucgaauuuccacagaaagugaaugugaugccuugcuguugagguacgcucagcagugugggaugggaccagcuagaugcucggcaccuuguuaagacaggcuagaaagugggacaggagagguggcuuuagucuucaaaacccuagaauauuucguuuaacacagcccuucgcuacuuuguacucuuuuuuuuuuuuaauuuuauauuaaugcuacauaauuuuuuucuccuuguuuacuuagccaacuuccaugagagcuauccgugcuagauaugacccuuuucugcagacaagacaccggauagagcagguaaagaggcuguuuagauuguuuuguuuuguuuuguuuuuuucacuucagagauguugcaguugcuugauuuggagucauugugaaguacgaugaaaggagcgaaguuuaugcucaucugaagacugugcugugcguggucagacuuacacugcuuagagacuguuguguccuuucacuuugauggaggucacuucuggaaguguguaaaaguucuuuaacuguugacaaaggauugagcuuccagagccagaugaagaaguguuguggcagugugcucagugagagcaggggauuuacagcgguaugagcagcugauuggagaucguggacuuguucugugucaugacuguaguggugcauaacuccaucaaaacucuccaguugugccuuaaaggggguggguuuuauauauuaacguagcugguuuaaacaggugaccuugaacuucucaagaagucuaaacuuaacuuugcaagcacuaaaauguaagcguuggaaguugcaauaaucaacaugguaagacaaauagaaaggagugugcgguacguaaguugcuucuggguuuguguagcaguucauuauugaacaccacccagaucuaaugaugcaagcacaagugagggcaagagucagcagucagaggaccccacaugggaagcccacauagcuuaggaaaacauguucugggaugguuugaauauguuugggccaggaaguggcacuauuagaagggguagccuuguuggaguaggugugucacuaugggugugggcuuuaagacccuaguuguagcugccuggaagucuuccacuagcagccuucagaugaagauguagaacucucagcucugcugcaccaugccugccuaguugcugccaugcucccaccuugaugauaauggacugaaccucagaaucuguaagccagaccaauuaaauguuguccuuauaagacuugccuuagucaggcuucucucagcaauauuccagucccugguaccaagcauauacaaaccauugcauauucuaaacugauuuugacuuuaauuuuguuuuucaggcauaguauucuacauauuuaagauguguauuagucagacuucucuagagaaauagaacuuauagaaugagugugugcguguguguguauguauauauguaucacacacacacacacugcccaugaauggaagguccaaggauccaggaguuguucaguucauguggcuggauggcucagcuggucuugaguauacacuggaauccuaaagaaguaggcucuaaugucagugaagaaauggacuuaccaaugaagugggaggggcaagcagcugaagcuagagacugcuuccuuguauguccuuaauaaaggcguccaguaaaggucauggcccagagaaaagauucagauuagaagugaaucuucuacuucaaugauuuaauuaaaaaaaaaaaaaucugucuucaaggacagccagggcuauacagagaaacccuguuucgaaaaaacaaaaacaaaacaaaacaaaaaucucucacagguguggccagccauuuggauuuuaauuucaguugucaucaggcugacaaccaagaauagccaucacaagaugauaaacugcuuaaacagagugugcaauauuuuguuuacuaaaaauuuuuaaagauccuagguuuagauauuaggauagucacauauaauaacaguucuuuucuagguaagaucaguagagucaucuggagaacuuaguaauauagugacacagggucuccaccucugcagguagcggcggaguuuggcuuggaauccuagcacuuuuuauagaugcugccagaaugauucugauguucccccuuguaugcaaccauggauagagacguaauccucuaguguugcuggguagacauacacaugcucacucagacacccagugguagcacuugcuauuugcuacuuauagaaacaacuguuuuuaaaggucuacauggauauucauuacauaguauauucuaguucauauuugauccuauagcuuucucacacaauacagcaagacauuuuaaaacauagauccuggcuuauuauaguugacacugccauucugcccugggguagaaaagaugggauauuccauuuugagauagucaguuacauacuuuggucuuuuagaaggaguuugaaggccuguguccacaaucagcuuuaaauugcauauugaaggcucagucuaaucuaguauuuaucuuucuuccuguacaugaaguccagauacuguuucaguuucaauugugucuuuuuaccaugaagucugacauaagauauauguguaauaaauauuugcagcauuugauacuauauuauguagauuguuuuaauuuauuauaaucuauguuaccuguuauauaugucuuaaauuccuguuguugaauugcuaccuaacuguuggcauuaaagucuggcaucugguuuaguuuuaauucucagucucccaucuuauuugagcaggacuuguuuuucuuucagacauuucuuuuuuaaacacauggaguuagcaagguguguuuugcugcuuuucauuuauaaacugugcucgagagacugaaaugaaaucggaaguccugcaggccuggagcaacucucugauggaugugugugcuucuuccagcuaaagcagcuuggucacaguguggauaagguggaguucaucgugauggguggaacguucauggcccuuccagaagaguacagagauuauuucauccgaaguuuacacgaugcuuuaucaggccauacuucaaacaauauucacgaggcaaucaaguaagaagcccuauuucucacucugugaaaccauagccuauuuguccauccuccuagcagccgccuacggggauuggaucuguucuguguacguauucugaauuccucauacuccuuuuuuuuuuuuuuuuucaggaaggaauuauuuucauugagcuaauccuuuagaaagaaacaaguauguuucauuggcauagucauguuuucauauauugacuuguucauagaucuuuucagacacaggcugauuaagcuguccauacucaaacugguuuagauuggccuguuugaguuucaguccacccacaaagaggacaggcuauccauucauccuuccugucuuccuuccgucuuucuuuuuuaaaauuuauuaguguaggagagacagaaagggagaggacagcacaugcaugugcaccuguggggaugagaggacacauuuuaggaagccgucgucuccuuccauuguggguuacagggauugaacucagcccaggacugggugaucuuugucagaagcaucucacugcuguaagaaacacugggacaaaugacuauugcuuaagcaccaaguuauuuguaaucgauccuuagcuaucaagaacuugcuguucaagaauggucccugucuuagucuguuugcacugcacaaacagaauacucgagccuggguaauuugaaaugagcagcugucccaugcuauguuucuggagguugggaagugcaguaucaugggugcaguguuuggcaagagccuucugucauccccucaugggguaugaucagaggucaugaagcaccagggggccucacuuucauaagaacguuguuccauucucaagggcagagaccucagccugcccaccccucagaauuacuacucagcacugucacguugucaguuuuaauguggagcuugaaggagcaggcagccacaccauagcacgauuguauacucuuucugauuaauaaaaaagaagauaacugugagcuuuguuagcuagugugucauacuuuuuaucaggagagugcuaaggcuucauauaaaugucgguaguuauagaaaguuuuaaaauacucuugcuuuaaaaaaucugaggguaccugggcagcuacuuacacacauuuuaaauuauuaguacagucccacuagauccuaucugcuuaguuaccguucuauugcagugaagaacaccaugagcaaggcaacucuuacaaaagaaagcauuuaacugggggcugacuuacaguuucggaggcuuaguaaguuaucaauguggcagagagcauacggcauguaggaaugcuguaggagaaguaucagagagcuccauccugauccacaagcacagagagccuggcccuggugugggcuuuugaaaccucaaagcccaccuuaguaacacccuuccuccaauaggccacgccuccuaaauccuucaaauccuuuaaaagguauuccacucccuguugacuaagcauucagauagauaaguccaugggggcuguucuuauucagaccaccgugccauccaugcaguuacagguccugggcacagcauauugagcaagguagaacugucugugucuuuguggcacuguccuuuuguaguucagugucuuacaaaguaaaagcugugauuugaagggacugcugugacagagaccugcuguaggaagaggagucugagacuugugcagagggcagagugagggcacaagaggggaaacagcucauggcuuuccacgggccacuggauuauacuccagugaccaaagguauguccucaggugacauugaaaggcugaacaugggccagaugguguacccuaucaaggagcugaauucaugugaaaugcagaaguaaauuguuucaagccaagggcguggcaauauaaucucauuaacaggagagaucauuugacugccuucugacuaauagguuagagucuuacaagagggaaugagaagcccaugagcgucuucaucacuggcucagacaaggguguuggcagaggugauggagaacaggcugguuaggggaaggaaagccaagcaugacaccugaggaguugggugggaaugucguaugcuaagacagaaaagccauaggguuuuucagcuuuaagggaggaaauuuggguuuguuauauuuuuaguguccaugauguguguagagaugacugguagguuccaaaaccagaagucuuggcuacagguacacaauggugauuuucaaucauaggcaacauucacaggccccauggagggaugaugcuaucuagugggagaauuuuugcaucuccaagguaugcuaagacaaaaagcaaaaguucagaauuauaccacagguuccauauguauguguccauccauaucuguguguuguggucaucaugggccaacguuagcgcugaggaagaagaguugggagcaaagaaggccuacaguugcuguguguacaauguccauuguguuucacuccauacaguaagccuuugagugaaccggccagaucaccuguuuuacauguaaggcauccaaggcccagagggccaaagcaacuugcccagacuuaacacagguacuugauggcagggugggaauagaagccccaagccacguucagagccugaacuuugcuguaaugcuagaaauugcuagguggaaaaguguguguguguguguguguguguguguguguugaaaggcaucuagucucuuucugacacccuuagcacucagacuucggcuucucuuuuugugacagaggaggagaaugucaugcaucugauuacaagguggguaaaauagugccucugaguccuuuguguggugauaaguaggucagguguggacugaggcucagggcggcuuuguuaccuauagcuaaagccugaauaaacacuagaauggucuuugaguggucaguuuauaucaucaaaggugaccaggagugaccuugguaggguuaccuccugcaaucgaggucaugccucucugugugucucuuccccgguugcuuuccuuugggucugugaauugaagacauuucauagauuuaaauaaaugucaauagcuugaggagcagcauaaaggauuuaucuucuggaacgacguguggugagcaaguaguuuuguuugacugagaaaugacagguaaauuuucuguuuccgagucuagacuuaagggugugugacuuguucccacagggaccucaguaacuagaggagauggcaucuauuuuuacuguccauucaaacccugaucauucaugagugugagucaugcuuaguaaagcucugaaguuuccaaacucaagaggagaaaugauggaacccagcucacuccucuucguacucucgggucaaauuauaucucagauaaaguaugauucgggggaaguagccaucauugcagcuccagcaacucaggguuuccagaugacuuccuucaccccuaaaagcccuaacaguauucucuucaauaccauugacucccuuccucuuaagaaugagccugagguuguccucuggcuuccucacauauguguacacucaccugcacacacacacacacacacacacacacacacacacacgcacggcaugcaugcacacaacauuguaaauguagcugguuuauccaugccaugugccuguaaucccagcccuucugcugugggccaggagugguaauagucacauggaagcucaagggccagcgagccucgagugugcggcucagcagcacggauuggagggccauugccacagcacaguagaaagagaacugaaagcuguuuugacuccacacaagaaccauagcaugcacguguucacacacaauaacaaauuuaaaaacaagugaaagauuuucaaauaauuuagguaaggaaaucuucccaagcuuguguacuuauagacagaccccuuuucucaacacagguuucauaugucauacguugaagggguguguguguuuauauauauggaguucagcuguagcuaucuugagcauaccuccccuguaaguuugcucugagcuuuuuugugugugguuugagcccugggcaccuauggagcagaccaacugagcagauguagaguuucugggauacaguuuucagauugucaucaauucagaugucagcagucuagcuucaguucugaugcuccguaguauuugaccauaagucaucuauuuuuguuagaacucacuugauucggaucacgauguguuuguccaaaaaaguccuuaagggaagaaagugucuucugcagaugucuagccagggccagcgugggcuuguuuuuguucuuugccucaagagggcacucugcuuuuaguuuaaaaaauguuucucuggcuugagacuucauugcagcaaaucuuaugaauagaagugcgagccagcgcaacaugggcucaguugcagcccacucggcugcuguccugcucucuccugcucucuguacuuugugaggcaauaugaaaaaugccgauuugugaguuuuugcuugcuuuauugagguaaauucuucauaugacucccuauaauaaaguguucaggggaaauuuuauguuauuugaaguaguaguuucugaacuaaacuaggaacaaaauuauuuucaaauguuagcaucguugugaauuaaagagcagcccgggaaaacugguuuuggucugguguguucuuuucagaauguguaggcagccuuccugucuguuauuuugugaaaagauguuuggaaaaauagauguuuuccagaagagccacccucccucugauggaagcugguucacugcagagcccuggcaggugucucguucuucccacgcagcuguggcgcugacacucauuuucucaggacaauuggauguuuuucaaagggccauuuuaaacuaggcuuacagcuccuugagguggcaggugagccaccaguguugaagguuaaacauccuuagggccacacuucaaugagcucagcugucccuccuuggucuuccugugucuaacccaagugauuaaagguuuguuuuguucuuuuuacuuaaaaguuuaggacuagauuuuaaaccagcgugagccugguuauuguggccuguugauagcaggaagucugugaaaucauugcaggcagaaagugaaggaacacaagccugcucaaggacaacgcaggccuggccacugugaaggcuggugaaugaacccagugcggaucacucagcccaucagcuagacugagcauuuuugggucuccagagagugccaauuacugaugacugucauccccuaaaaacuaucacuuuggagaaagaccacagugggaccugagucacccauucaccagagugcgacuguugccagauaacucagagcaagcuccuaauggaguuuuauuccuuuuuaaucagcucugcccagaagcaguuuuguauucagugcuccuuggcuguuuucaagaggugcaauuuaaaaggguaguuacccuucaaggaggcaugagucacaccuuucccuguggaguuuuaaacucauuuccguuccuuccuuuucccccgccucaucagugccuuuagauccucuauguccuuacacauccugggagagcuagguugcuagguaaugcuggguaccgaaugccaaaguuaauuccaucaaaaagaaagcaaagagaagccaucagaggucuggaagcaacuggcaacuuccauggucuuccccacaugcacugccaugcgauguauaaacuggcauucagcuugguguuuuuucccuugauucgcuuggacagaccuguguaacagaacacuguugagauucagaacaugggaaguuguaguguaguuccaacaaccaggaggcagaagcagaaggaucucagaugugaggccaaccugggcuucuuagcaaggccgugugaaagcagauaaauaauggagaggauuucugucaccagaguuacuuucuuuuccuccagaaaauccucacuuuugcuucccagaaucagcaauucugguuuuuacggguuuuuuucacccaccauacauggauuaaacccguuguagaacuucacauacuguuaaucaucuggucuccuguggagggguucuuucgcugacuguugcuugagguucaccaggguuguuaggugaguccaugguugcccauuuuuaaugcuaagcaguauucugcuggguacacagaccacaguugggguggaccacaguuuguguauccauccuucugccuguggacaugggcugcuugcagcuuguuaguaauacaacuccgaccauuuugguacaagaauuuuuauggucaaauguaugaaugcucuuggguaguaaggagaauugcuaggcuuguuaguguuucaugagaaaggccagccauuuuucuggaaugggugugcuguugguacuccuggcacucaugggcgagcgcuugguggugcugcaucucuaccagugcaugcugcugucaguccuuuuaauuuuagccauucugguggguguguaauggcaucuauuguggguuuaauuugcauuuuccugaugacuaaugucauugaacacugaguguaugcuugcgcugucugauuguauuuccuuugugaaggguuuaaucuuuuucuguuuuuguuguuguuguugggcuguuacauguccuugguuugagaacccggucuguaccuugacuauucuauugaugaugucuuggggcagaauuaagaugaucaaucuuuuucuuccuuaccacuguuuucuguauuguaacuaauaaaccaucucauauucucagggcacgagguuacucacccguguugucuucuaauuaaaauuucaguuuuuacauuuagcuuucugauccccuuugaauuaguuuuuuuguauacugugagguaggagucaaggcaccccccccuuccacccccaguauggagacugaauuguuucuuuaaaaacucaccuuucucauuucucaugggccacacagugcaauguuguugucuguuucgguuuguagaccaguaaauaucauauuauuuugagcacuguagcuuuuuagugugucuuaaagacaaauaauauacgucuucuaacuuguaauugauuuguaaagcugcuguagguagucugagcccuuugcacaucuuuguaaaauugagaacuaacuguugcuggcagcuuaucuuacaaagugugaaagcguuaggauauuuuuaaaugacagauagggcacaaacucugggaagagagcugacuguggucaucggaagcauggccuggcuccugguuuauuuagacuuccuuuacuuuuuaucagccaucuucugugaagguauuuauugguuuuacuuuuuaugauuuauuauuuuauuuguauuuuagucuaugugccugcauuuauguaugugcauguguaugcagaagccagaaggacaugucagcucuucugaaacuggauuaagggguguuaggaaugaacucggguccucugggagagcaguaugugcuuguaacugugacacauauuucuguccccggggcuauucuucucugauuacuuaaguuguaaaaccuuggccaccauuuuucuuuucuaauaaaaauauucaaaguaguaaguuucuuuuuaggcuccuuuuuucuuucuuucuuuuuugagauagagucucacuauuuagaccagccuggccuugaacucagagaacaaccugcccagauucuggacauuucuauaugcaaaugcuguacauuuucacgucuuacauuuuaaguuauuaucauaucauauuuuaauuauucagugucaaguuuucccuauuaccuuuucuauuucuuuuucaauuccagggauuguauaaaaauuguuuaauuucugcauuucagaacagugaguuuuuguuugauaucuuagugauuucugauuuuauuucauuuuguucagagcgucuauucaguucaccuucaguuuugguuuuguugucuuuguuuaguuaguagagacuuguuuuauggccaguguaagugcucuugaugaguaugauaugugcaaaggaaguaaauucugcugugucuggugccuguacaacucagcugagugagugagagaacagcucagaugguaugugagugagcugugcaacacuauagcaccugacauaguuagcugagacagagaaagucugcugucuuuccucacaguuuuggaggguccaggcuauauuuuuagaaugugauaggaagauuauggcagaacaaaccugccacuucaugauggacuugaaaggcaaagggagagagauagaucacucagcccuucaugggcagcccuuggugacauaacagccuccacuagucucuauuugauauuaguucugccauagagccucaugugcuuccugccaacccuguaugccuuuccauuuauuugcuuuccagccuuauaugccuuuauagagcaaguggauuccuuguaggcagaaaccuacaauacuugucgggaagggaaugcccacaguugcccaucuugauagugugugccuuuuaauugcaauauaucgugcuguuaacauuugguauaauuagugauaacuaguuuauauugauuggacuuaugucuacuaguuuagucaucccccaugcuaguuuucacuaaccaagaauaauuucacugaacuccauuccuuuauaauacugcaucucuugauagagacugucuuuaagaggaaguaguaaguaucugauggaaaguaguguguaccugaagggugugaggugggggcagugggaauggccuucauuaggauucucuaccaggcugccuccuggccagcuccggccucaaccuccccgguagcuuggagauaagugcacuugugucuguggcugguaggcagcugccaucacuucccauugccacccacuuaagcacagauuuguucugugcuuccauuucccuggggucguaaaaugaagugaugggacuaaacugaccccaggugguccuggcugacauccgugacuuggaggcuuugauuagaggaacguuuaucuaaaaggugaauucacacuguuuucacuuagccgucuccuuccgccaggggcagcuuucuguaagcuuaccugugaccuguguucuguuacuacuaugggaccccuggcuccucagcuaucuggucaugacuacaaaauguuaaguguuuuuaucagcuguggaaaagaaaaacaagaacgucaagggacgcucucuugacugaugugcuagggcaccugacucgucucuaagcuccagugucaccagcugaccuuuccuagucauacuuaaacaucaaacuaccuuuuggcuuuuucaauuauauugggcagagacuguuggcucuuagauccuauuaacauaaccagucuccagaaagaaauuagauuacaauuucaaaaaagagguaggugcauccucuaagccuacacucuuaaguguagagccucccuaaugucagugugagauguauccgauuuuauugagguauuguccagguguggugaugguuuauaaaaggacauuuuucugcgggugugguucugaggcauucagugauaaccccagguggcaucaguccaaagaacuuuuaagcucuguugacccauccuggccuguggagaugggacgaauguagacuaugacuaauggaaguuaaucucuuaucucugugcccucauuuaauuguugguuuggcuugaauggauugaguuugguugggguccuauagcuugacugaagcagcucuaggauaaaaacuagguuuuuaguucuaauagaaucucugaccuaaugcaaauuaccuuuucuauuuccaagagggacaguaggcagcaagaucacuagaggcuaugggaagggagaaaguccuccuuuguccuagcuacaucugauuuauuuauucuuucuucauguucauuucuuugguuugauuggaggaguuagugaugaacuccuaagcuauuagacacuaagcauuguuggacccgcugggagcuccccgucuaaaaggaggaacagacauguccauaaauaagcguggaugcacacggagcuugucauaccaagggcucugagagcaugucacagaaaaagagaugucuuugagccgaguuaagacuagguggcauagguuuauuuuuaagguggggcucuccuuucccuccgcccugcuccccacccacucucacugugaacaguuccagcacuguauguuuccuagagagcagagcuuccuacauagcuguuaccuugguggccugugagaaaugaguaauucagagcaucccugcagccuuccuaaggcaguccucuagcugucauaaagagcaguagcccuggcaggaaaacugaguccaauugcagccucugguguuagaaguugaaacagcuccucucugccccagaaccuaagacugaaaucccagaagguaaggugucaacugugguccuggaagaaaggcgcacugguuaaguggcugcccacaggauggagggaggauuauguagcagacccugaaaugcucaaauggagcagcaucuuguguacuuguauuagcauaugaaaaagaauaguuacguagauaucuuuacaucucugaaacaaggcagcagauuuacuaagauacuggacuacacauagcagcaacaaaaucuccacagcucaccaaagauucaauacucaguuguuuuugauguucagauuugauaagaauuuccccuucguugcuuuucagauggaaauacaauucggaaaggaaacagaauauacugacccuuuucuuuugauuuucaagacaggguuucucuguguagccuuggcuguccuggaacuuucucuguaaaccagacuggccucaaacucaaauauccaacugccucugccuccaagugcugggauuaaaggcgugugcugccaaugacuuuucaaacuguggguuauuuucuuucuccacauuuucccagaggaaagacauuuuugagguggaguuaaguuuguuuucauuugcaaggugauggauggugucaugcuuguggcagccuccucggugugccugccuccaugcuccaugaugcucuguaacagacagaucaguuuguagcucuucccuuccucggggcagauucccauugcugcuguugccagcucucuuguuuuuccuagugauggagcugucacugugcccaggcucucuggccuacggccacuucuucugagaaauaccaguugagaacacgcacaguuugugguacauguuagauucuggauccuaggauguuuccagguacuuucugaacuacacucagagcuuccuaccuucugucuuuuaugcaucuuaauauaauuuaccuuuuuucuuuuuuucuuuuaauuuuagaaaguucucugaaguccaguaacugcuguuagaaguagaugaguuguguuuaucaugugacauuauguacuuccuguccuccaugagaacauuauggaaaggugcaaaaaagaaugguuacaguuagguuagagauguacagacagacagaagucuggccucucaggcugagagucuaaauaagcagacccaccuucaacucugucuggcagcuuuuuucacugugucccagaacaaggugccuguugagcuucagugucuucguguguaaaugaaauauaggacaccucucuguugauagucagugacccagugucauucacaauguccuccgucacugaguuccugccaccuaccucaccagagcccugacagaugauaugaccuugggccaacaguaaggucaacaucucagagaacuuaaauccaaggcggaccucacuauccuguaucuugacuuagugagugaccaaaaaccgcucucucaucuuacacauucuuaaagcuaggcgucuuccagguagaagagauuucaccugaaugauccuugccgccuacauugcuccccuuaccuacuccaccccuuguugcuguaguauuuaaaauggcucuaugaugcagggagaaauaaguaaugcagaugguuuuggcuuaugugaaaucaguugcuaggaauugagaaauagcuuuucacaguugaaaucacuguuuugaggaagauuauggcuucagccagcugugugaaugauaaugauaacgggaaugagaugggggugcaccagugcaguugugucggcucuuugaaguguggguaccguuguugccguccuuuggaugccaaggccagagagguuaauagaauuacuuucugccuggugagggaguaggagagcugggacuugaacuuacccuaucuggcuccagagcccacauacuuaguuaacugucucauccuaggaaaaguaagagaaggcaggcuaggaagaaaugaccccaggugugucauuuuacuucugcucugcagguauucugagagaagcuucacaaaguguguuggaauuacaauugagaccagaccugauuauugcaugaagcggcaccuaagugacauguugacuuauggcugcacaaggcuggagaucggagugcagagugucuaugaagauguggccagagauaccaacaggugagaugcuggcaggcagccuccucuguccccacugacucuucuuucuuccuugagcccagucucagagaaagaugugcaaucuuagcuguuuaacucucuucugccacccaugcucucaggccagcugucugugccuucauuuucaguauagucaucugacaguccuuuccaccuaaaaacgugucacugagucagggaaggucagucugugaggaaacuuguaaauaacugcucccucggcugaagagcaaagaaaugagugaggauuucauuagcagcagacgcuacugacacaaaguggcaccggccacuucacauggcaggacuguaaggggagcuaaggaaacacacuaguccauacuuagaagcagccuagaggaauggcaggcccaggacuuuguccuuuaaguaacagugaucuguuggauauuuuuaagcacagagaaaaaucuaauagguauuguaccuacaaaagaggaaucucagggcaaggcaaacuccaguaggaaagucucacccaaggagagcaggguaaucacaggcugugcuaggagaucccuguggggauguucagggacacuuccugaaaaaauaacagcaagcggaggcugaaaggagacugcgaguuacuggugugcauuggaggagagcugcuugaggaugggagcacaugacaggcagaagguuggauuacguggggcccugggugucagcacaagauccugggcuucagucaagaggcaggcugggagcuaagauaggagcaugccugcauauagucaguaagagcuccuuugugccaauaugggagaugguuuaaaggggggguaaggagauagccucgacccacagcuguuggagcaauuuaauuaggaaacccuugaguccuagaaaguguuguuugcuaccugcugggaagcaagggcuggagagaaagggaagugggagccuuggagagaagagaggcuucacuuuguagacacuaaauguuacauacuuguggaacuaaagguuugguuuagaacaguagacuguuccagaucugcacuguccaugugacaguacagcugaggaaaugaauauuucuuuguaacuuuauuugcauagcugcauaugcauaguugugaccauauuguacaguaacuuuggaguagaauauuugagugcagaauucagaagaaaguccaagccucgaccagaacauuagaugucauuggugaaaacuaauuagaaaaggaguggggccaugggaauaaguggggugucuagggggaauaugagggagcccauggcuucugagagcuuccugugcuaccugggagcaucuuggugguagaaggaauugucacaaggccucaaguuuuaguugccccaguuguuaucaaggccugcuuccuacuccgauguggcgggacagcguauguuacaaggccugaucagaccccugugccagccaaaccuuucucugauggacucuuugucauacuagugacaucugcuuuguguuuuaguuucuucccucucucuaccuauauuucauaguugugaaagaagugauacucaaaucagagcuccuucauuauuuaguguuguuauuguugcuguugcccaguuuagccccaaaccuggaugaucuuuaauuuuuaaucuuucugccucacaggaacacagugccccuuguuacuuccuggccuuugcgcagguuuauaagagauuucugagcacugucuuuaaagcugugauuuugcuccaggccucccuagagcugugugaaagugacuucuguucccagccaaguagcucuugcucucauagauuguuuuccuuuuccucuuccucuuccucuuccuccuccucuuccccccccccccauguguuagcuugauuguccauuuaucugucugacaggugaugcauuuucuucccccaggggccauacugugaaggcagcgugugaaucuuuccaccuggccaaagauucugguuucaaaguggugacgcauaugaugccugaccugccgaacgugggacuggagagagacauugagcaguuuauaguaagugcggccuugagccuguagaccccaagcaccuccucacacuuccacaccucacugcugugcgugcucacuguuguguuuuccauuuuuaaagcuguaaagccuuguuccaaaauacucaaaacacaguaaagaccaaucacccaccuccccauugucagacagaaacuauauuuuaauucauucuuuucaggcuuucaaaugccugggcuuggagcuggagagguagcuugguguuagagcaccaacuacucuucccaaggacuuugguucuauuaccagcacccacaugguggcucauaacuguccauuacucuaguuccaggggaucuaccaccuucuggccuugcugggcacuaggcauacauguggugcgcagcuauacauguaggcaaacauuuauauacauacauauaaauuuuaaauuaugaaaugcuuagugucuuaguuaggguuuccuuugcugugaaagagacaccaugaccaagacaacucuuauaaagggcaacauuuaauugggucuggcuuacagguucagagguucaguucauugucuucauggcaggaagcauggcaguauccaggcagaccuggugcugguggagcugagaguucuacaucuuguuucaaaggcaaaccaggcaagacuaucucuuccagacagcuaggagaagggucucaaagcccaccccuacagugacacacuuccuccaacaaggccacaccuaauccaacaaggacacaccuccuaauauugacucucccuaggccaagcauauucaaaccaccacacuuaggauuugaggaacugaggcuguuuuugcacguguaacacaggcacacucacauucacaugacauaggcuuuucuugauguagcuuuuuaacuuaauauuauaacaagcauuuauaguauaacaagauaacauuuccacaugguggcagguggcauagauaaggcacagggcccaucaguugggaugcuggcuuuuccuauccuaaauccuauaguccaguguccccagagaaaggcuggcacagggaguagagaugaguuccuccaugugcagacuuggagccgcuguccguuuugacuccggacuccgugucuguuccccucugccugguuccugggccuuugauaugugaacuuugugagacuggugugauggucuggccuucaucagccucuuaauccacagcuuucuucccuuucaaagcuggaugccagucuucaucuguuuucuguuuuccagucguaguugccaucccuucccacccucugcgucuccuuucuuguucuaaguuuauacuucuuugaaaaugucccuuuuugccuccugguuuuagaggaaaaggagagaaacccauguuuuaguucuccauguuuaaucauggguccaggaccaguucagucuaguuucauccuuacaaaggaguguaucacccccugugucuccugcaaccagaacuuuucugacaucgugugcucaguguauuuucagacuaggcagagaagggcuugccuacaugcucuuugugggugucuagaauauuuauuaaagaccuaauaacucuauaaaugauacaauggaaaucauacaauuacaaaagaaugucuuuaagaccacaugguacaacaagaauacagcauucaagaaggugacagacagucaaugaaaucuaaaaccuacaguuacauuuguuugaaaagcaaguuaaacaauggaaaguuugugaggauaauguagucagagauuuuaaagcaugauuuaaaauuuccauagcuagagcacugcuggcuggcuagauccugaugggggugcaggggugggaaggacagcacuuugugagcccacuucuguccaguauagugcuacacaaucaagaguagagucagcacuaugcaaaguccuagaaaggaccaagccugguaucucucugcugccuuccagauaaagaagcagccauugggaguguaagauagaagaggucugugccagaauagaugagcgaggugaaucccucaguguccagauagcaaaugggagcccaugucaguggugccaguuggcccgaguaugauggugacauccugagaucagcaagcuuucccuguaaagggcccuauuguaaacauuguagggauuuguuuguuuguugucuguuuguuuacauuauaaguuucacauuauaaucuccaacccaaauaugcccuggcgaugaaaacacaacucaauuaauaugaaugaauacaugcugugugccuagauuggguagaucuaccacuacacuaccaucuuccacauccaugagaccccuuacaacuuaugguuucuccaggccauguacuucugcucugcuuuucuucuuucuccuccucugcauccucucucccauuuuuccuucuucucucuaccccccacuuuccaccucaccuucccuuuaucugccaaaucaucagcucuccuuuauuuuacaaaguugggaagcagguuuacaggaaaucaccugagugcagacucauuccuuguucacaaccacucacuggacagcagaauuaacaucaaauauaauuagccucacggcuauccacaacagaugggacuuauuuaaaugguuuuucccccacaguuuuucaaaaguuugaacaaucaugucuauuauuaaagauguuguagucuggaaggaaguaggguagcguuucuaaagagcagugcucagugugagacgcauccgcagacagagcuguacaggagagcuguguagugcaggauaggcuggggcuacugaauagugacaucuuguucccccuguacacuugacagaagggacagacagcuccaggccugcugcagguggagagaagcuggcauaggaguccccuguagggacagaacaaauggaaugguaauuuuugguucucugucuguaggaauuuuucgagaacccugcuuuucguccugaugguuugaagcucuacccaacccugguuauccguggaacuggucuguaugagcuguggaaaucaggaagguacaggagcuauucucccagugaccugauugagcugguggcucggauccuagcccuugugcccccguggacucguguguaccgggugcagagguaugugugaccuuucagucccccagaugccucucuaaagggguagucugguuugauagcaaacauuuugaacucuguuuuuaaauuagaaguagaauaucaggaaugccauguguaggaaauagacacuaaggaccgugugcccaggccucuuugccaguaucuuauauuuauucauuguccauuuauccaugagccaggaaaguaagaacaacucgaagggucccaugggcaaaaucuaggacaauuugaacaucaaaauaaacauacuaaggggcuggggagauggauggucugucagcacagugcaaggggcuggacagauagauggucagucaguacagugcaagcaugagggccugacagugagcccuaaaguccaguguagucauaugugcuugucaucccagcacuggggagagaagcaggcaagccccuggggcucagugacccgcuaaccuagccuauuggagaguuccagaccaaugagaggcucugccucaaaaagguggacaccacaaagaagaaccacaccagagguuguuuucugcccuucaugugcaugcacacacaugcauacacacauaugcacauacacuacagacagguaggcuuguguguguguguguguguauguauguauguauguauaaaugucuguauguuaauaaaugcuaaccaaaugaauaaagcaggaacccuacaguccauauugcuacucuugauuguagagugaguaaucugugugcuccagacgcaugcugucggccaucuucauuucaugcaggugcuguauuugcagauucaccuacuagaaaauccugugacucaaucuaucuauccucagagcacauuugccauaaaucauucuuggaauggugaacaauuugggucgcucaugcacaugcucuuagcugaggucaaaacagugccucuccgccucuuuccagucuucaugcuguaaacaaguguucucuuugcacucuacuuaaugcugcauuuuucaaauuuuugugagcugguuaggaauuggcucuuuaaaaugaccuccagacacagugcuuaagugcugucuauugcuccuaagugcuggaaggccgugaagugguuuauggagggaguagcguguggugggaauccuuuauugugaaggcccaagagagaacuguuggccgugaguuccgggugaaucaaucaauuagauauauuaaacaaggugucuuaaaacagaaucacagaguacaagguacuuacuuauugauaguugacaaaaaaucuggccaagaguggcuccugggaaccuaacccuguggguucuggcucggugcuucauugucagaugugaccugagagaauauaauuaccuacugacugcuuaccuaccaaagaacuagaacugaccagauguggcugaagcuuuccccacaauauacuuauuacaacguagaaaagagucauguggugcagaagaagccuggccacgagucggagugaacauugucagaagccagugaagugaguuguggccgccugcugggacugacugacaccacaggcuuaccucugugacuucuaccuaacaucuguaacuaaguuuaaucaugagccaacauuaggcaaccccaaguagaugcacauucuagaaugugacagcuacacagaagauugggacaagguccuuuugcuugaaggacuuuguuaagacacuggugcaacucaguugggcucaaagagcaacaucagaugucuguuuugggucgcaguucuguggucgugauaaaguuugcccauuugggugcucagaguguccugagaccugccacaucuuacucacuuuuaccuuccauuggucaagaaccaugguuaccugaacuguuuuucugcagcuuagagauuguuucccaaaauguaaaugaguacagcaggaaagaagaaagcuacaagaagauuagcagaggcaagaggccaugugugucugacuuggaccaccccaccacagaagaggccagucccaccucaggagccauggccuucuaaugcaaagugcucacaaggaagaaagaaaccucugcucucuuaguccuguagacagugaggcagaggcacuugcaagcuucaugucguguugugggccauuauacugucuacaccaguaaaacaauaagggcuugagaggugacagcaacccccaucugagggggagggacaauggagugugcaggcugcaggcuuugaaggcagcccucugcuucccaaacacagggaauggcaagguuuucagaagccauggagucaugaugcccuggugaguccaaggacagcuguuugaagagagcaaggguucaagcaguaggugccugguuucaccucaguaccauuguggggucagguuuccaugcuuagcggcugauaacuugccuaacuuugaagauaaucuuuugauaaguuuaguucaaagacuguuuucuauauugcuuuccaauuuuccuuuuaaaauuauuuucuauguugaagguuuuaaaauguaacuauaauaauuauacagguuuuuauuaauagagguuugggauuguauagcuuaccaugguuuggguaaauaugggguaaauauugaauuucuucaagauauuuuuguuuuauguuuuuaguuggauauuauuacugaaguguuagugugacuauaugcauugaaauuuguauuguuuauauuuugcuacuugcuuuuuuugugugugugugugugugugugugugugugugugugugugugugugguaucuauacacauauaccucuuuaugacuauguggaggucagaggacagcuuucaggagugaguucucuuucuaggaauccaacccaagucaucagguguucuacccacugagcugucgucucaccauccuacuguuugguuugugcccguuuuuauuuccagaucuucuaugugcaucuggcuuucuaugucucuaguucuacauucauggccucaaccagccccagauaagaacuugccaggugggggcuccacugagcacauacuuugcuccuugcuguuacucuguaacuacaguguacagcaguggcugacuccccaacauuugccuuauaccggggggggggggggggugaugggccaucuggagaugguuuaaagcacuuauauccagcauuaucuucauggaaacaagcauuuuaugguaccugcagguaauucuggaacuagccucucaaagauacugagggcugcuauauacugcauuuaaacaugacucaaacuuuauaauauagacuaugaaguaccauuuguccucaauaaucacuggagauuuagccuccacuuguacaaugcugagguaguguguaagauuguaugugcugguuuguguuuauaugguaugguuuuugcugcaaagucaauacuucauacauugcucugcaaccauauaaugauaagcuuuggccacagcaagguauauuuuaauuuucaagauauauaaucccuucauaucuagccacacaguacucugcccacaugaaagcgauaauguuuuagaauuuacuuaaaauccccuuagcguaucuguuaacaaggacuguuuacaaaaugcccuuguuuggugggaauucaucuuuacagaacuguuaaauauggcaguguuuauaugaaauaagccagauacagagaaccagaugcuacacuaucgcguuaguauguggacucuaaacagaccgaccuacaggagugugagguacaaccagccgcccuucacuggggcuucguuccucaguuaaaaccaaaugccaguaaggaguggggguggcgucucugcucaugcaguagaauugcuuacaucaaggaagugaaguggagccgguaacacuugcccagcaacugccccuccccaaaaggcagcaaugauaagaagaaaggauuuugaguguucuugucacaaagaauugauauuaugagggauagauugcuuaauaaugugguaaaccucugugauguauuggcauaucagaaccucaugcuaggaccuauuucuauauacuuauuaaaaacuuauacauaauaauuaaaauaauuaaauaauaauaaaauaauuaaaauaauauauuuauauaauuauauuuaaauaauaaaauaauuaaaauuuuagauacaaauaaaugauuggggucauuuuuagagcuauacuuuaaaggcagcauaacagccucauuuccauuuaucuuacacaguaauuggucccauuguuaagcagacauuagguuacuuccagguugucuuacuuacuuuucugucacuuugauaaaagcccugaaagggggaaaacuuaaaggaaaaggugguuugagcccacaguucgagacuccagucugccaugucaaggaagccauagcuguagaaguuuggcaagcagagagcgacagacuugugcucagcucgcuuccuucuuuuccugcauccaggaucuccccagggaauggugcccuguggugggagaguauuccaaccucagauuuccuauugaccaucauuucccacaggcacucccagaggccugucucccagugcugcuagucuagauccccucagguugacaguugggauuaaccaucacucaggucucuuuucauuccccuccccaccuccaccacuuuuuucuuuuaaagucagggucucuauuuagcccuggcugccuuggaacucacaaagaucccccugucucugcaucucaaggacuaugauuaaagggguguccaccaugcccagcccucuuuauuauccuagucuugauuuagcuaaaaucuaucuauaucaaaauauucauuucuauuacaguagugcaaucuguggaaagaaucaccuaugguaaugaauggaucuauguaucuuuuaucauuauuuuaauguuuuaaaguucuuuuuugaagaaagagagcuauaaaugugaugggauuugcaguguauacgguuuucuaaagagaugaugccaguucauguaaaucauugcuaauuuuaucacaugcucuguagccuugaugccuauaacugacucuguacgagggugugauuugcauuucccauuaguggagauugccugugccuuguaccugaucaucacuuacguuacuuguuuguaucgaauuuacaaaucaugggauccagauuacaagauggugcuucuuauggagguaacccccacccccaaaggaauucauaaguguuaacucauuuggaauccucuuaccugggccgccaggaagcuaaggaacugauaguuccugcagagugagacacugaacaccagaacauucugacagcaucauucugguguaaagugguaucaaguguguuuaaaccccugaaaugacauuuugagggguauuaaaauuuauauucagauugagguagaaucuguuaugucaaccucaagaacuuguaucaagaacuggaugauaaaacuuuaaaugaaaauguaaaugagcgacauaaaccuuauuacagagauacagaggaugggcuggaaagauggcucagccacuaagcaaaagcacugcuauugugaaggaccagaguugugauaccagcacccacaaucgguggcucacagccaccugugagcuaucacuccaauuccaaggaaccugacucccuauacuggccuccauggacaccugugcucggggauacacagaaauacacacauauacauaauuuaaaauuaacuaaaucuuuuucaaauguauaaagguucagagguaaggcuaggugcucagcaguacuuggaaaccgagacaagugguguuacucagugagugucuucuagccucagucuuaaaguuuuaggcuaguucugcaggucagaagacugcugcuggccaggcaugucuuaagcaccucacucuaauguggaggcugaggauagggcugauaaaaggaagccccuagugaugaagaaacgucucugccuggcacauuccguaucuagauuguuucugucugaacucauagucaagggaagucacgguguccuucuguccuggaccauuaggaguucugccuguuucuacaucguucuaccucuucaugucuucaccagccacagcugccuagcaaaggugaacuuacuggcuuuacccaguggagagacuuggacacuguguuguaggcaugucucuaggagggaccauguuagaggagguaaugcaagucugcuuuuccgucuuucuaagagaucacuugauguucgcauugguuauuccuacacccugccccucccugcuucuaagcucuuguauacucuguagccuucugacaguugagucaggagcaucuuccuggguguuuuuaugaggcacauccugcugcaagguucuauauucuagcccugaggaguauagucagugauuaaauguaaaauucuguccaggcacaugauggguuccgcauuagagcguugcugcccuugggcuauuugacagcugucugccuugauaugauauuaaaucacugugaggcgucagacuaggaauaccaauuugcaaccaaagcaugcuucugacgcaugagaaacuuuagacagaaacagcucuaaacagcuuggaaagguuuuugaugggcaaauuguaaauauuaguaccucuacucuugaaauauuaccuguuaagccaacauguauaaucucucuucaugccaggaaagaaaauagaucgacugacuuagaaaaaccuaaaaggaguuuuaacuccugccuccaugaggcaacaaggucaaccuauuagggaccuggcucaaguucugaacauccagagagguguaacccgucugaguggagucagagagguguaacccgucugagugggguugagcuccgucaugcacuagaucucuguagauuucuagccagugcagaaaugugucccucagaugcagugaaggagacuaucucugagaguugcacuugccacauuuucuguuccuuaaugaccgagagcuuccaucugcugugcucuaggcaugucacuaccaaagaccauuaaagccguguuucauuuuuauagugacagaaauaaauuugggacauuuaugaacugguggcauccuuguaagguccugcguagccagggccucucugguaaugagagcaucuauggggacauacagccuguguggucucaggccuaucuccugucuuuucuaaucuacugucucacaucuugaaauuguuaacaauuuuauaagaggcuauauguucuuucuuuauuauaggucccaccaauuacauagcagccucuuaguaaauuaucauaucgucauuuuaacacaaacacaaagugaggucacgaccugaccaguugaagccuagcccugcuuuuccuagaacuagcuuugucugguucauuguucauagcaaccuuauaggacuuaacucccaggaauaaccacacaggaaauuaauuugucggguauuaaguauuagcgcgaccuccacugaucaucacagguuaauuuuagaccauguauaacaauguuuggaaauauauuuuaaguucuaaaauauuuaguauguuaaugaggauagccauauaucagauuacuauaaaauauuccaacauuuaaaagggggcacugugaagacuuagauuuggcuuauagaaccagaaagauuuaagcaauguguguauauauauauauauauauauauauauauauauauauauauuccuuucuaaauaauuuuuacuuuaauaaccauugugugauuuuuaccugauuauuaacuuugaagcauauauugauuuuaaaagacuaaauuucgaaaguuaggaaucauuauacuaaaacaaccucuauguaagccguguaugcuaccguguuaagacauagucacaaggugaagcaaaugucuuagggcacugucacuuuaagccuccuagugugcuucucuuuauaguaucgccauggaaacaguuggguuccagagccugguagauucaugaaauguucuuugugcucacugaucagccuucaggaguaagugcaguacaacccugacuucggcuuuugacuggccucuccuugaugucgggcacucugcacuaucccagugcagaggacaaaucucauuuccccauccuuaggccugcugaaauggggaagggucugugggagcaguuaaaccaggcuuuugaccuuccuuguuggugacuuucagcugcuguguagaagggaaaguguuugccaagugguuucugauucacaauugguuuuuuucucuccauugaguugagguuuauuuguuuuaauccuuguuucauuuagugcagugucucaugaaccccagauuuuuccuaauggcucccagcauuugggcagauucugugcuuuguucucuacugugauuuccauuauaugugcuucauaccccccugagagaugggaagaagggagcuuacagauggguaaucuaggguacagggaugcucucuaccuugccuccucucaucccuagcauccucugccuucugcuccgcagcuuuguggucucucauuguuuuuuauuuuuaaaaucucacugccggacuacuauggaaaauaguuuacauuuccccacaguugguguuuuucuccuacagagacaucccaaugccccuugucagcucaggaguggagcauggcaaccugcgcgagcuggcauuugcaagaaugaaggaucuuggaauacagguaugaguuaauguggcugccagccaggugugcugugaaggaauagggagucuccuugcacuuagccccagggcugucacucucaggcguugcugguaccagcugugucagaaaacuuuguguguucgagguguucuggguagcuugcagaagcuguaugaguggugacaaacacugcugcuguccccuugugucuuugucuucugacuucuauaaccuguugcuuuauacuuaccaggcagcgucucucucuugaccguaagagaaggaaggaagcuauuaauuuaacagucuugggagguaguagugagucugaaaugaagcauucuagaaacuucuuggaacuucugaagagauaagcuggaagcagugucuggccagggcaccagggguuagacucugccuucagaaaccagugcaguggaucaggagagagcaggggaucuguuggcuguuuucaagcauggacccaugacuuacuuuacacuuccucaaauuaucauggaggaaaacauguuagaacauuguccaaaaugaaauguuugaauacuauugaauuauuugaauauucaacaaaauaauauaauaauuagauauaauagacguuuagaaauaagcaagugcaugaggcuggucaccagcaucacacaguacugugccuacucugcucgucacuugccagcuggccuccaucucuggccuccuaaggauccgcuucuagggguccaacagaccugguuaccagcagucuccuuguguauuggccaucuuuacccugcccccgucuaacccuugcuagccucugcuaaggggcccaggaaucaauccaaagagcagagucucuuaggcuuuccuuuccagaaaguaaguagaugucaucucugccuuugaaaaaucauacuccaagaaagaacaaagaggaagcagggugccugcugauugagaccaaugaccucuagccacauacaccuagucuccuauagagagcuggucagcuguagaaacccauggcccuuauuugcuguucaggccacaucagcagaguaucuugcuggguggguuuccugaaacaagaaaauaacuuuguuuuuugcaaaacugaauaacgaacucuuauagauacauuguuagugauauugcuugcaugauucugucucacugguagauacauguauguuuauucuguagaggaggacuaagcagggggacauaucauuggauaaugcagggauucuguaaugcuaagugucaggcuguaugggauggacaccgggcugaguaguaggagcgagugcuguuaggauccugaccaugccuuccauugacaccaucucccggcagcugcgcacaggugggggaugcccaagagcuaucuggaguugaaguccaauuugugucagauaugaaucuagguuccuuuuauaucuucccuuccuucuuuccuuuacaaugccuuucuuggaaaaggaaacauaucuuugauaugugucuuuugacauauuuaaaaugauacaacacuaaaaauaauaaugucauacauagauuuuaaagacuuaagaauuuguuuuuacucuuccugugauauuuugggacuguauuuucaaucauauuuuggaguuguguuuuucacaguuaagucucuugggcaaaacuauuuucuaacuuucuaacuuaaaauuguucauuuuccaagauuauauauggucucuuugaguucuaaacucauuuugaaagggaaacaguacaccuuuacaaauccccaucaucaaauuuuguaaagauggcuuuuuaaaguuuucauuuuucuauuucaguguaaguuauguacagacaugauuuugaguccaggauuuguuuuaaaugaacaaugaaugagucacuacuuugauuuuuuggcagugccgugaugugagaaccagggagguuggaauccaagaaauucaucacagagugcggccauaccaggucagucuccucuaaaucugccccaagccuggaccccaccugcuuaccccuaacugagugaauagcucauugcagaaaguagcaagcaggaaaaccagccaugagagucacugcauuauagaagagccagguaaggaaaaccaaggcuagaccucauuuuuucaccaacucugcagugugggaaauguucuaaggugaagcugcuucauguuaccccuagucugucugcagugacucuggagagcacaguagggacucaagaguuccagucauuugauuuaaaugcauucauguguaaguagcugcuugugacuagugacugcuuccuauggacagccuugcugcucuccgcuauguaaccugcaaguucuuguccuaacuggcuuucccauagcuucagcacagugcccugggcauucugaguaguucacuuccauacaucuguaacaucuaacucagugcagcauugucugugaagcacaauucuugggaaucccgugugugaaaggcuggauucuguucuuagcaugaacuguugcuaaagggccuauuaagaggaaaaaguagaccugacacauuaaucauuuuauauaccaaacuucaagcugagggguuguuuauuuugcuuuacagggugugucuaaauauguagaauucuggguguccaccucuuaugccauacuauucauagaaucaccuguacagcagguugaagagucagaaucuguagauuucuaccacugaaguucccauccaucccucugugguaaacugugcucuauugaucaaucuuaauguauuccucccucacuaggccuauuucacaagccccgcccaaugucacacuuucuaaaaucuaggagaggaguucacacguacacguacacacacacacacacacacacacacguacacacaaaggagguuuuaguggaagaaguaagaacuagacaaggaaaccauuaacugacaguuugaaggcaaagugggggagggguccuaaaagccacaugugugauuuaaucuguaguuuuaucuuagagacaguuugugggacauaaauuuacauaaaagcauucacuaagcugaauaucuguaagaaucucaagguuaauuaaguucaaauauuuguaaaauuguucuccauuuagaauagcccaugaacaauccugugcuacuugagaggaggcaaauaaaagccauaauuagugaugauucaugcuuuguuccuagcugaacauuagccuaaacacauuccugcaauuauaaaaaugaacuugguucuuuaguucugaaugagauguuucauggcuccuuauccaccaggucgaguugguacggagagauuauguugccaaugguggcugggaaacuuuccuguccuacgaagauccugaucaggacauucugauuggccuccuaaggcugcggaagugcucugaggaaaccuuccgguuugaacuggguggagguguuuccauaguccgagagcuacacguguauggaaguguggucccugugagcagccgggaucccacuaaauuucagcaucagguauccuguuuuaauuggguuauacuuaagaaauugccugaaauagggaaaguuaaggcagcuggugaggagagaagggagagagggugugggaaagaggcuucuuuucaguuguuuuggggcaguccuucuccauguugcucccaugugguuccaaaggauaacagauacaccccaauuaucagauucaaacaaaacugguucacuuccuguggaaucgaaugacaggaaagugauucacaggugucaguuguguuguauaaguaaccccuagcaaccuaaaguuggaaaucuguauuuuucaguuucaggaaaauuuguuaaaagcaguaauaauagguuuaggguaaacaccaaaugggaugcuacaacaauuuuaccacguuccaaacccuuucaaaaguggaaggugggucgaauaaauaagaccuguugccacagacuccugucagcuggggcugccuagaccccaggcacagcaccccgaaugccacgcuggcucucgauggagugcugacuaagucaggagugugcucugguugggauccgugcacucuucuggcucaucaguagaguuuuaucacuguuuaaaaggugcugugcagcccuugcuuacuggggucccuucucuucccuuaugcuccuucuagggguucggcaugcugcugauggaagaggcagagagaaucgcucgggaagagcauggaucugggaaaauggcaguuauaucaggugacuggagagauggguuucugacucaucuguucacacugagauucgaucuuuugccucuccaugauuacuguguucaaauugauccaggcugacaagugagagggacuuauguccaaacgucggaacaugucagagagcaguuagcugggugagugcuucuagaagcacucuguuccucagagcagcaugccaguguccugggcgcaguuucugcuugucugaccucaggucacuguggucaaccgcucuggugcuucgugccagcugcugugugaggaaaugugagugguggggaccgagcugcugguucaggacgguucaaggcagaacggaguucaugcugcugcccuugccguuguccugaaugccagcgucuucauuugggacgagaugggacgaagaagguuuucucuuagggaccuaccaugcauucagaaauuaaauaggcaaaacgaaauuugcaggagaaagaugaauacaaacuaauauaaaaugaggcagacacaggagcauucaugaggaaaugaagacuagaagaugcauguaagcccgaguguuuuagaacugagagugggaagucguggaaauacgcuaaggggagacugauaaagugggggugacuuagcaggccuguugguuccaucauuagaggugaggauguucuucccuccagcaugggcugagagccucucauggagucuuccagagcucuuccugaaccugcugucuucucaguuccuccagcguuugcuaagccaacuacacagacuuuuguuuucugaaucccagagacgcguccccaugcuaauaaccagcacaucuaaaugguuggagaaggaaacaaaggggagguuuggggggaagcaagaacugaucauucacauuuuucagugugcugucccuauaagaaaaauuacuaauuacugugggaaaccuaagauggcagaacacagaaucaagauuuaggauagauuugaccccagaauuuauuuuguuuuccuguuugacuaccacaucccaaaagcuuacucgugaccuaagaauuuuuuuuucugaaaauuaaagcugaaaugagguuuaaaaaaaaaaaucaauaagaaguugccagucaauaaaucaauacugguggccaggucuucaugauuaccauuacagagauauagucacacggcucacuuaaucauuuagucuggcguggguguuugauguuacccagguugauaaucuauuucuuagcaugucuagcuuuucuuauuuuucuccauuacuuuagucccacaacaaagugccuggcugagacuaccuggccagcccugaugagcaauaagaaagguuucccucuuccagcuuauccugaaguggaccagaaguaccagggaagggcaggcugcuucagaaggccuucugccuguacaucuggguggggcugauccccacagagcuugcuaaaagucauuuuagcacauccuagcucuuuaggucuaguugcggauggagagcccacaauugcuaaccagccagugugcugccucugauugcccucagaccauggaugagaagcuagacuuuaguauucuccagaugccguccuuucuucccagccaucaagguuguaacucuggcccauagcccuacacccccagauggcacugagucaugugacuuuccagugucuuugagagccuaaucagguuuccauuuuccaucacugccuuucugccaucguuuucccucagaaguauccacccaaggccccugacuugccugaggucaaaucuaauugcacauaagagccucagucuguuuuucucugagcagggugucuuucugagugggagucagucagcaucuguccucaccagcuuuuuaucaucaucuaaaugauagcucaauuucaugucaucugcauggugaauuccuaaaauaacaagaagugacuuacuuagagaagcaggcaagggaaccuuucugucagcugcaaugcugggucuccuccccuggcacccugcagaggguucuucuccagcuagaauggguuucuauaggaacagcccugaagggaguucuuugagagaaaaguuggcgagcaucguuggcuguccucuggucugggagccacuccauuguguaaagaaagcuucauauagauuccuugacuuccucuuuggcccugaccagccuuccugaggaaacauuggacacauuugcuauguggcaagugcaucuucuucucuuaguccuguaucccugaucugagaaaucuguuguucagaacuuagaggauagcaaguguuuguuauugugcuguguuguugauguugcuuucuccuuccacuuguucaccuuggcuuuggauuuucuaaaucugcugcugcugcugcugcuggugugcguguguuuccauagaugauccuuuaauuucuucaauaauuacuuccauccucguucucagugaggcauuugaugaugaaauuggugaugcuaaaguuuucauaagcaguugaucccagucaucgaucauggauacauaacuuuggccacagcugacaccuuucucugacguuguucucagcucauaacucugugcucucuaugaguuguggcuuuuuuucuaagucacacgcagugguggcauggcuuccugacuuggcacgauucgugaggacaggagagacaggaccauuuaucauuuuguuggccuggcuguaaguaacgcauuuauguagagcuuggaaaauucugcucugguucauuccagcuucuccucauccuggcagcagguucccugcuacucagauuuaugaucggggcucuaccucuagacaguauuauugacgucacuguagaucagagaggugcuguauauucucauuuucccuauuuaaaaacauugcuuucaucuguuaccuccauguauuuauuaaaaaguauacacaugugccugaugaaucagccuacggcuaaagcuggaggagaaaaacugaaacugcuuuaagcagucggucagaugaaauacuuaguaagaggcauucaaguucacucacuuuaaaguguauaauuggcuuaguaaacaguuuuaaaguuaacugucaucuuuaagugugaaaauuauuuaaaagcaaaaauuaaauauuguuucauugccaucagaaucacuagguguguugaggggaacaauaaaaauauaaucuccacgcucugaagccugaaccaggaggauugcugugaguuuaaggccagcaugggcugcauagugagacucucaucucaagaggaggcaugguguugagcugccuucugggacugaacgcucaaaugggcaggaaaccuggucuccaccacugaccccaucugcaagcgaggaugagucccaagggagucuaaacuccuuccuuagacccaggccaauucuccaccaggauuaauugcuucuucccgcacacagaaaugggcaaaucacugcucuaaaaccagcuguuuauaaaguaauguauaggcagggaguagcuguuagcucuugcugaacuacaaagcagucagucccagcugggauugcggccuuuaccaucuuaacagucucugugggugcccagcuacggaagaugaacaaguuguguuuacuuuuaaaaugugauguuuugccuacauauagugaucagcaguccgucuaucaggaagcaguuugucucauuccuucauguaugcuguaaggugcaaggaccucuacuguggaagcuaucuacaaucuuuaaaaugccaucacuaauaaucaccauggaaaccagaauucugaugucacaauguccauacgauuucuacaagggcaaauauaacuaucaauagccacuguuuaaaaagccacuuaacaccuucaacagaaugagggauuuuucccccacucuggcaaucuuggcuagguaucagauucaaucauguuacuguuucaguuugccaagcuaauugcuaugcgcuaagauagacagcuauuccccaagcucccugacuaccuucgucauaagcaguauucuauuugugauccuucaaguagaaaauuaauauggccauuggccaagagcuguacaagcuugauagaucacacagugauggugagagacgagaaaaggucugagugguucaugucagaagucuuccaagucagagcgggagagccauucuguuuaaaucuguuacagugccagugaugagcggaggggagggaaaaauuuaaaauacagggugaguaaagcaggcaguauggauaugaggucauucuuuaucaugauacccuaucaugauacccaaagccaugugcccuaaagcuguaacuaccguccccaguggugaaaaauuaaugugucugugccuuauauaauccaauauagcuuccuagacagaaauuaaugguuuugugccccaguaccgcugauuaauaaugcccuguguaggcagaaaguaguaguuguuucuuaggcuuugaccagcugaaauuuacuuccuggaccugagaaaccucaccuguaucccaggcuucaacacaacucccuccauuuugggugaagguuauuuuauucuuugcauuauaaucuaguugaaaagcagggucuauuuguagccacuucugccugauaauggacucauaauccuaccagaguccccagaagagcuucucuuuauuauggcggacuguuugcuaaugggucagggagccugccaaaugcaaaccaguuugugccacaugugcauuuguguuaauacaggacuuagcagaaaggaagagaaaagguuuccucuuuugugcucucuccuucacccuucauauaauuuucuuguaaguaaauuacuccucagcauccccuaauuaaaugcacauuuucuggcuuccuugugucuuccacuuugguauucuaacaguggccauacauguugucuuuuagaugugugcuccaaugggauuguucuuauuacuaucaucuugcuuuuaaagacaauagauacagcauaaaaacuuguacuaucacaaguccucuauuaaauucagcaucauuauuaaucagacuggcauugauggcauagaaugcuguucagcuagauaacaaguugagugcauguuuucuaauugauguccgucguagcucagcuguggaggcauuauugcuuagcucaucuggggagucuuauuuccugguuugacacgugucccuuaugaugagucagguaccaguuuacuguagaugaaugagacaccaguuugcagcauuuugcauuagaccaucccacaguaagcaucacgugaccguccuuagugcucguggccacaguauuucucaguaggccaccauuugggucuuggggacauuuccucagcagaagcaguagcgcugguuguaauggccugucagcagggaaagaacuacacuguggcauuuaucuuuuagccuucuuguguuugauaaaugucuguuucacccuccaaaggcgagccuugcuuccauggccguacuguaguaggcuucuccccagccuuguaccuacuaguacccaacuagcaccaaacuaguccuguaccuagccuguggauuuuggcagugaugguuaauauuuucagcuuagaauaaagaaugggucguaccaugugcucugugcuaauaucccuaaaagucuaggagcuuugagcucauggcugccugccuuuauuguaaagugggugcuucucaggcuucuugcuggggaagcaagccuucucuaaguacaaccucacuguacuggagaagcaagcuuucucuaaguacagccucacuguacuggagaagcaagccuucucuaaguacagccucacuguaauggagaagcaagcuuucucuaaguacagccucacucuacuggagaagcaagccuucucuaaguacagccucacuguacuggagaagcaagccuucucuaaguacagccucacuguacuggagaagcaagcuuucucuaaguacagccucacuguacuggagaagcaagccuucucuaaguacagccucacuguacuggggaagcaagcuuucucuaaguacagccucacuguacuggggaagcaagccuucucuaaguacagccucacuguacuggagaagcaagccuucucuaaguacagccucacuguacuggggaagcaagccuucucuaagacagccuuuggucuuuuuugguuuuuuuguuuguuuggcugguugguugguuuuugguuuuuuuugaguuuuuuguuuugauauuuuauguauuuacauuucuccuuuuuaaauguuuuauugcaauauugaucaugaaauaauaucuuuuuuaauguuuuauugcaaucuuaacucauuaacucuccuaggaagacaguuagguuuuuuuucuauguaaacauuugacauugucuuaacucauuuaauuuaauaaguccuuauuuuuauaucuauuacagacaggauucuuccccuuaauuaaggugacuagauauugcuaaauauugcugcagcccugcaagccaagcguucucggggccuuucgguugggggauuuuugcuuccaucacaucacagagcacauuuucacucuucuggaauccuggccugagcucuggacucugacagccguucuccucucucugagaggagaguuggguuuuaggauuuaagguggugguuguggaauacauucugccuccuugagcuuugaaauggguguguaguugcacauccccuuaggaauguuuggcauaccagucuagaccccuagagcugcaccugugagggccguuccuguuuccugugacucauacagguuacugguuugaaucauuugacaaaccaacccuucccuugcuucaaaucuagugguuuaaaacagaaauaaauuauuugcuucauggugcuuuguaagaacuucagcaggauauagagauggcuuuccucuggccugugcugugauagacauuagcuggaauggcuccagagccuggguguccuggauaggacugucagcaugagcaccucggcucugacacuggagagaagaguccuucuccauugucugaaaguacuugggaagaauugauacuaauucuuuucaaaugcuugauagaauuuaccuaaagccauuugauccugacuucgcagccauacauuuauguaaggaauagagagcgauguuccgugaucacaagccugauucucuuuacuguggucuggacuuuguucuccaucugcuucugugucuguuccugaaguguuuguccauuuuaucugggucgcucagugugcuuguuuacagucuuucauaggaugcuauuauaauuacauuucucuuaugaacgcaggaguaaugccuccucuuuauuaaaauguuucagaacauuuauuuagcaggagaggcacuugugugugucacaguacaugugcggagguccaaggacaccuuucgugccuucccccuugugugagacccagggauugaacucagaugaccaguccugguggucagcaccuucacccuugagcaaucucaccagccccucuuguaaccguuguuuaacauuuaguuguuuacucauuugugugugugugugucugugugucuguguaugugaauguaagcaaugucccuaccuguuucuguuuuaaaggcauuuuuucugugguaagguuggacaguuuuaagaaugaacuuuugaguuuauuuucuguucaguauuuucucccuaguuucuaucauugccuuuuuugugcuagcuuugaguuuaaucucucauuuuuuauucucgauuuugagauauuucuucuuuuaguguaacuguuuucagcuaaacauuucccucugaaugccaccuuugcuggacucagugauucugagaaugaaaugcauucaguuuuuuaaccaaaaaaaaaaaaaaaggcuugggucuuucucugaggcccagauuggccuagaacucaccguguaucccagccucagccuccugagugcugggacugugggagcgagcaccagccugcucugcacucacccucguagcucuugcucucucaguucccuggcauuacuucuuuggcaccuuggucaaguaagaauauauuacuucauuuccacauguuuauuaugaauucugcaguuuucauugagugugcaagugugugugugugcgugugugugugugaauugccuucagccucacaaguaauugugcaggucuaaaccucaguaccaagucccaggacauuugaggcagagagaaagccuggagaccuaaagauggggcgacaccaccccgccuccgugacacaucucccuggaauccuuuccgucguggcgugcaccagcuggcccaaagcauggguucuuucucugcaucuacagagaaguugaugucuuaagaaccuuccagccuggcagcacgccucacaagugcaugggugccaagguguccuggggcagcuuuaaagcgugggcagccccagaacuacugcaucaccagagucgcacgccaucauagccaccuguggacacugcagcuugagguccugccuuugguuuccccucccauuugucagcuccaacgucucccuucuuccuguuacugaguucugguuuguuccauugugguaggaaagaguauuuguuagguuucaguguuuucuggccugacaugauuuccucacagaacacaccacaggccccucugaagccgcuugcucugcugauggcaguccugcaagcgcuggaccccggcccaucuguccccacugugugcuguuuuaccacagauuauaucuucagacuguccaucaacagauucacaauuauugcuauaugaauuugcuuuuaaauuccgucagaagcaaagagaauugacaagucaaaacuacaaaaccaguggcuuuccuguuugcuugugugugucccuucaccagggcccuuccuuuaguucauguugcuccagguucugucggccuuucucacgaggcaguucuggcaacaaaacgucuuagcuuuuguuuaucugggacugucucccucccuucuuuguccuugucagauacagaacucuuagcuggcuggucauauucuuuccaugguuaaguaugugaucccacaguugagugaagaccccuuacauguggcaagauacccagggaggccaccacccacucagaggagaaggggaaggggugaccgggaaggggggcagugagugggauguaaaagaauaaguuaaaaaaaaaaaauuuaaaacaaaaagcguguagggugccgacaaccucacccuccagggcaucgucgugggcaaggacagucugggaaauccaaauagaacuucuaagcuuuggcucuugguuccuuuuacugugucaucuucaaagagccauugcaggguacagagcagaguuagggugcaggugcccucuuuccaguugggacuuuaaugacuugccauaacuggcaaccuugaggagucaguccuauguggcugaccauugucaguguuauaagcuuucucuuucccucucucagagcaggaggaaaauugucugagagcuuucaggucauucaguuaacugauucuuuucagauguugagaguaaaagccuuucccuaucuuccaugucagugugguuuugcgugaaauauugccguccuugugggucaaugagaugcaacaguaaaugaaugaaacuaaugacuauuuccccguguuaacacuccacauauagcgagccuuccauacauaaccgaaccauaaguaauuaagauacaguuucuuuucauuugucuauuucccuggguuuugaugauggugaugaugaugaugcugaugaugauagagaugaagugaucaucaccucagacuuuuauaucuauuuuucaaaacucugauuucagcgucaaggaaaggauuagcauguuuugucuuucucauuucaaguuugccugugggaguguggggaugugggcucaaucuucauucaguccagcuaacauugcuaacaauaaagggcauccguguaccccaagaaaagaaaugucagcaagcaggaguacaccuccagguuucuaauccuuuccuugucagcaugaaaaugucugcaucauguacgcacguguucuuuccuugaagaauaccaggcugugccgugcaagcacgcguucaucugggaucccagccuuaucucuuccucugguugguuacacuucugucccaugucuuuuuccagccuggguuuguuuguguuuccauccaugugaaggguugauugcuugauuuuccaguuggaguaacauucauguaguagaaacugaccccuuuuaaauuucauuuuaaaaagcuuggcugucaacugcaccagauggagaggggagccuauucugaugggacugugagcuguuuggccuugcugugugucugucugucgggcugcucacaggaacaggagagcuuuaguuacugcaguucuggaagugcaaaguccaggaccaagcuccacugauaacaaaggcuccacggcaggagcucgcuugguguccuaugcaggccaaucaucugaggggacaccucugugucuucacauggcugaagggcaaaaagauaaacaggcuuccucuauccucuguaagggcccaagugccauucauggaacucccaccucauaacuuaauaaccuccggauugccugaacucuuaugcuguugcccuggggcaucuugacuuggaaaucugggugagggagcugcagaugaccccuugcacagccacaugcaaaaaaagaccccugccggcucuucccugucacagguccugacugucacacucuuucuuuucucgguggaauuaaagucauaagaguuucuagcucuugauuuaucuugcuuuucaaaggaaaaguagaguuacuuaaguguucacagcuauguaacugauccccuuagaaacaaagagcuggcuuccaguggguugaggcaucccaccaacaggacccuccauugccugcucccucccuccaaagaagaaagaacuguugugugggcaguggggguucauguacgagagcagcggccagaggagaacauuacuaucccuuagagccaggcugccagccagucuaguccuucuccaucccaacacacgugcacagccacacccagccuuuaacacgguugcugagcaucugagcccauauuuucuaacaacccuugcauaugcaucacccucugagccaucuucucaguaguguagaacucaaguggauuuguuccauuugugucuugguuaguuaaucuucacacaaacacacacaccauuuccuagaccucaugcaaucuguacuuaaucucccauaggcagugguuggggcauuuagcaaagagucuugaguccuuucuucgagcaggcagagcuaugucuuaagcuaggugguaucagggagaguggaucagaaagcagggggcuucucucuacaucaggggcuuggagaguaagcacauccagcaaagagaagggauugaagaugcagucacugaugauuuccagguugcagaugcccuaggaggcuggugggccuuggcagccagaauuagagaucaucuagggacaggggcuuccccacuacaugcugaguggccccuuauggaaugagucacacccucuccuuuuaauuuccacuuugccuaggucagcauccccuugaaagaagacugcagaagccauuuuaauaacugcacacaguucagucuaugcaaauguauuuucuccuuccaaaagauguagggcagaaauggaggccaaggagguaacacaggcuguuuacuagagugacgucugaggacagugcuacagacaguuuuaugguguuccuuucccucuugccucauuuugaauugucauagcuggcaauguagugaacauaaaauuuuuuacucugccuacaauaaaaccaagguccuugugacauggguaaguucugauguggacuaaguaacucugaaaauaaaccaagguagacuucaggccgugucccuccccaccuuugauacuauugugauaaguggggacucuacagugagcaccccggugaccaccccaccuuugauacuauugugauaaguggggacucuacagugagcaccccggugaccaccccaccuuugauacuauucugauaacuggggacucuacagugagcaccccagugaccacagcugagagcacuugagcccugcucauuccgagccuagggauuuggcagcagcccacaggagcgauggaguguagagcuccugcuugcacagcuguguguuucuucugcaggggagaggcagcaacagucaggcugaucugagaccaagacagccuagcacgucagcaugguccaggaggcuacugacgucagcuucaaaggguaauugcuuucuccuggcugacuaacacaaggaaaguuaccgugacagagaacuuugccugagauggagccccacaaaggcagaagggaggcagauaaggccuucacccagccagugacucucuuuccagcuggccaagagcaggcacaacacugccaguuuguccuucagaucggagaaguggucaugucuuaacugcaugaaucaggauacauaaaugcagggggaagauggaguuuggaccagacagaagcuaggaauuccauaggacuccaaaccuuaggagucccaggagcugucaggggcugcuguguguuccugaguacaaagcuaagcugaccagagaugguuccaguguagccaaugccucucccaaccuggucucaagaacccaguucuaugugaaggaguagagucccaggagcaagaggcucacuuggaaucguugcugagaaaugcucccgugagcuccaggaaagcucaugucuuaaccacacaccuggggacucacagcucuccccauuacucacauuccugguuauccaggcuucucuaggccuggauuauaugaaaacacuacccagcugcagaucuuaaaacuaggccaccaucucucuuugauggggaacauacaaacaagcagaauuauguguguccugaccugaaccuaaguaaaucuaguggaucauuugggacacucccaaacagaaaguaaggagccaagaaucagggugagccagcaugacugcucgcagggucaguagaccugugccuucacugcuggaugcuugagacccuuacagcguaaauaaguccaugggaaauggcuccucucagccagcaaaguggggaucuguaagguuccaaagaguuguccuucccaccuucugguguaguccucccacggucuguguguagcccuccugacuguaugucgucuccccccauccucugccucaaagugccaacucaguucucguuuucuacaguguguccugcaagagcacacugcucugugugugcacaacaugaaaauaaugaguguauaauagguccccagacauuugcuacauccugauuaugugcuagucacuguaauaacccuagugacagaagccauuggcuuaaagaccugacacugcaggaggggaggcagagacagggggauagagcauucagcacugaaacagugucgcugugauuaaagccuguccuucagccagucaggagaggcgcuaauccuggugacgggggaagccucugccuggaggguccccaguaccugagcugggacuggagggcaugugagcaagggcugcagagggguggcugguuagccugauccgccaguucuggccuuguauuacauuucagacaggaauucaguguuuaggaucuaccugcccuuagugauccuaggcucuggauucagauuucuuucugauggcuugacaggugggauuaucucuucuuguccucacacacgcacgugggucacaaggaaggacacugacuucuacauaagucucgccugcucuggcuuucacuagaaguaaugccaccuauaagaagcuccuuugucuagugagagugagucaggcauagaauuugcuguucgguuucugguaaacaguguucuagaagggacugggcacaggugaccaugucuguaccuggaacacacuggguuguccuggucccggcuucuuagcugccuccucucuguacccacucugccuuaguuuccuggauccuucaggcagcugagcucuuggaacacuuuucguguauguauuaaauggcugugccccugagguuuuguaaugaggagugacauacacagugaggugaggugccaagaagguggcuucauuaauaagugucaccacugccuagaucaguaacagcauucucagcaccgugaggcccugaacccuuagcaucuuucaaauguaaccauuaucuggccaaauuuuggaguuuccuaugccuaaauuuuguguaaaugaaauguuuuagaucuggcacaguccugagagaaaugucucaacauggauacauagacagaccacaguugcuuuuucacugcuguguuauauucccuugugaguauauccaccuguaguugauacuugaguucucucuuaucuuggaguguuagaauauuaugucaucugcuggacauaguguuucucuuuucacuaagguggauaucugcugguucuuggaguaugucuaugaucuagaacuuggggaaaauuguuccuuuggcaguuugagccuuccucuucucgcugagucugagccguuguccaugccuguuauucauauguccauugucuccuuguccugcaccugcccaugucagacagaagucauaauaauacacgacugguagaaaugugcaaggcaguaugugugccugguuagagucagucguagugagcugcaucuauccaucuguccaucuguccuaaugcuuaaaacauucagaagugcauagaaacagacaguguucuugaguguuuggguugaagauaguguacuuacaacugaugucugagguugaggcagccauguggggcugagcccuuacccugcaucauguaguaacucucaguagugcuggaacugaguuaagccaaaggaugccaagcuuucuccugugagcccucauguacucccagcaccucagacagcagccacaagccgugcggagaucccauuuccaucugccuucucagucauuuccagaaaaccguuuggaauacgggccucuuggaugugaacucucgucuucuugugcuguguucccuacugcagugcugaacaauauuggugcaucuguugugccuacacauaugugcugccauauacccugguccugugccagcuguuaggaaagggcauuucucccacagcagcgucuauguucauggaagccagcauaauagaaauagggcaaguuucuauaugagauucgguuugggcaguagugcagucugaauaagagacagggcacaaggccgagggguucacggcugacuucugagagcugcuaaaauuaggcugacuagagcucugguacuuuguuuucccugcaggggucggcacaagaaauuauuaccgaaagauuggcuacagauuacaaggccccuacaugguaaagaugcuaaaauaaugaccacccagucuaccuucuugcagcauccucccugacagaagauucaagugcagucucagcagaggcugaggagguaaacggccugcacacuccuggacgguccucugcccucccccugugguggcugccgcucacuacucugaccccugugacagaggccaaacccaccucuuuaugugcccauggggccucuucuggcuuuaaggcuuaaacgauuuuuccaguuucuaaauucugcaugaaggcugcaggugacccauuuuggcucagacgcugugaccagagcaaaucaacuccuuuggccaucgucacucgugauugucaucugaggggcagccucgggagaagauuauuuauauauccaaagacgaaagccagacugcagcacagacaagcugucagacaugacucccugcccuuuaacuacaugcacauucacccuggaauuuagaaaaugagcuuugcacuggaaaucucaguggcugugccgugucuugaaaugugcuguguuuggagaaagaagagcugagguaguggguuguguuaauaugcuugaugccggccgucucuagcccaauccugucagaagcuugcccugaccagggccaucuuggaagccuuuccuuugucucacgucugugaaagucuguauguccauaccccugacaccugcaggacagugugaacuaccuucagcaugcugggcuagcuugugccagccaguucaucuguccugagcagacaugguccagaauccacagcuagagccggaggcccuggucaggaccaggccaugcucagaagcuucucugcauguuaguucuguaaaguagauaguguugauggugcugcaugaagaagguaggaguuaggcuaguguguggaaggaggccugucugaccugcauggagggacaugggcuuuccagagccuucaucaccauucaguuuguccccugaggaggccaggcucugagugacagcccaucucgccugggcaucuguccuuuccagcaguguuuagugaaaacuguucccuaaaaggucugaaaaauaaagucuuuaacauaaaaga

SEQ ID NO: 7537 - RNA, 11992 nt, Mus musculus
cguagucuucuggcgggaccuuugaaaaagcgugcuucuuacacaccgcggcgguuacugcgaguguuggcgggagggagcuguuccugcauuuucuggagcgagucuucugacugcuuuuaguuagaacuccagugccccucggcgggccgcggccuuugaaaaugcgcgcgcccuaaacgcugcggcgguuacgcuguuggcgggagggagcugagccugcacuuuccggacuagguguccagacagcuuugagccagcccgucacuuucaccuuuuuacccgagcgugcgagcgugguaagggaaagccuggccgacucgaaggugguuggcagacugggggucagggguggagcaucgaggaccugaggggagggucgcggacgggagggacggggacgagagggaggcugccuccacuggaggaccuggaggagaucugcggggaagaacagcaaacugaggguacacagcggcuaggggaggacccagggagauaguggauggagaauaggggaaccccuuggagccaucgcacaccuccaagccccugacccugagcuccuuuaucgcggaaaguuuggggguucagggagaaagucacucccuuccccaugaaggaggagggggguggggguggggggaggauuucucugcuuuuaaggugaggccacaguagaaaaguggccugugguagggcagugacucauuggguacagucugugcccagcaugcaugcagcccugggauccaucuucaggaccccaaaaccuggaagcaguagugagugccuggggucccaguaacuagggaauggagaccaaagaaaggacagggaauauggcuguggguagaguuuuauacaugggauuacugguauuaaaaaaaauauguuuacaugcuuauaugaaaauucauagugaaacucgaaaucauguagaguuagcauaugcuaauaaaaagauacuuuugaaaagccaagcagugcuaauauuauaaaguuaugggugggggacgcuggagucuugauucauugguuagagccugcagggcuuuugcaaaggcccugagcugguugccagcacccauguggaguggcucacaaacaacuacaugucauuccagaggaggccauccuucacuucaggcuccuguacuguugugcauagaccacccaccccugccacacacacauaggugauggaagguguauaaugaaaagucaaaucuuuuuuuuguuuuguuuuguuuuuucgagauaggguuucucuguguagcccaggcugcccuggaacucacucuguagaccaggcuggccuugaacuuagaaauucaccugccucugacuggaguacugggauuaacggugugcgccaccacgccccugggaaaagucaaaucuuaaauaagcaguucucaugguaaccaagcaugugaccucagugcuuggggauugaagcaggaguaugucguguuggaugucagcuugguguacacagccaguucaggguagucuaaguaauggggagacccacauaaauggggcuuagaaagcccaucaauagaugccccagcucugucagaugugcccuuugaaccccaagccuaaaggugauauggguuaaagaaaguauaguuauuuaacaauuaaugccuauggaauguauaugcagaucuacgacaguauagacuaaggcucuaucucagccaggaaagaaaagucccauuagacaacugagcugggcgggacguaggauauuuugguacaaacaggguaaguggaagagaggcauuuuugaguguccagaauaugagggaaugcugaaauguuuaagccuagguauuuuuuuguuguuguuguuguuuuguuuuuuguuuuuuugagacaggguuucucuguguagcccuggcuguccuggaacucacuuuguagaccaggcuggccucgaacucagaaauccaccugccucugccucccaaguccuaggauuaaaggcgugcuccaccacugcccggcuaaaccuagguauuuuaaucuuugaaaaacacacugugcccuuuguauccaguccucaagcugugguggcaaggacagucuccaggcugcucuuugccaaggauuuugcacgagacccuuucucaucuagcagcccagcuuuaaucccacugcuguagauaagcccacagggucaugucuucagcucuguuccagaucuguauuugccugccuguucgaccuuuccaccaagaugucuaauaaagcguccaaaaaugagcucccaaucuccagaacccucuuucguuuuuucauuuguuugucgccacaguuaagccaucaggaaauaauggccguuucuggacagcucuagacaugcgccaucaauggaaucuguguguggcuuucucugucugguuucuuucaccuggcauguuuuccuggcucauuuguguuguacaguagcaagcuuguuacuuuuugcucugcauucagcaucuaguggguacuucuguugucugucuggacuauuagaauaacgcugcuuauaugcauggguuucuguuuuuguuuuguuuguagcaaggucucccuguugcccaggucggucuuagccucccgagugcugguauuacaggugugcauauagggcugucuuaaaggaugaugagacguuuguaacuggugggaaguaugagagggagacauaguauuuaccuuuugguuuugucacuggggauugaacucaggucauggcuuugugcaugccaggcugacucuacccaugagcuacauuccuaguuucugcuaaccuuuuagaacuagguaguauuuuuuuuuuuaaagaugugacaagauaucuucaccccaccccaccccaccccaccccagcccagccccauucgcuucggguaguuuuuuuuauugaaguuacauauuuaaaaguuuuuaaaauuauaguuguuucuauauguauuguauauguguguggguagauguaugccacauaguguguuugguggucagaagacaacuugugugaguugguucucucuuucuacuaaaugagauccaagaauugaagucaaguugacaggcuuggcagcaaguaccuuuacuaagugucugagcuaugccucugaccgcuauauauuguauaguuaaaaccacaacuccuacucaaugauaguaugaccgugaguaaagucauuguaucucugggcuucaauuuuacuuuuauaaauaaaauuggacuauuugcugaggucauuuuuaggucucaaauuguauauuucugugauaaaaugauguuaugggauucuccucacaaaugagaguauuuuagauaguugcaauauaacuuugcuuguuuucauuauaggaccuaacgugauugcuacaauggaaggaauuaauaauuucaagacgccaaacaaaucugaaaaaaggaaaucugguaagauugcaaaagaccuucucuuguugcuguuucuacuagaaacauuuuaguguuuauuccuuugucauugucuguaaacaggcauaagauuggucauuauaacagugcuaaccauaacagagaaucuaauagcacaguccggacuuucugucuacucacugauggucguucuggaauuuaggaccugucuaguagugguccucuggcuugaacuagaggguaauaggagcuguaaucuuuguacaugggaucuaggaaucuagcaucagacuugcacagcaagacauguguaggugucucgaagauuguucaagaugucuuuaguuggucaaauguagacuaauagacauugugccuuuuuuuccauuucagucucuaugacuuuuuuuaaaaaauuaccuuauaaccuggcucagcauauuuuugaauuaguguuauucccaauguauuuauuagauauagcuguccacaaaugcccuuuuuagacaccagucucucuacuaccuccugagauuacaacuugugcucccacaccuagcccaugaggaucuuuaagaacaucuauagugugcccagacuaucuuuuacaucagucagcaucuuucugagcuggguaccuguuuuucuauucauucuccugccacuucugucauuugaugguauauuuccauugguuuguuuuucuucuggcaugagcuguguuuuuugcuucuuucauaccugguaauuuuuuauuaggagguaguagguauuuugucauugagugcuggauuucgucacucuacagaguggugaaaaugguuuggaucacucuacagagcuccaagcucauaucacugaauggugauaagccugcugcuuuugagacuggcuuuuaaacuuuuuuacagacuuugcuugggcuaagaguuagccguaguacugaacuguuacccuuuagagggcuucacucaacugucugcugcagaaccaccugcucuggcuaaugagaaagugaucuuauuccugacuugucauuuccaguuauuuagcuuauuguuuucguugcuuuggggucgcuaaacaugugugcaguuaaguacuuaagcaagcacucuguggaucuuuucaauccuuucuuuucuuucuuuaagcucccuccuguguucugcuccuuagacuccagcuaccuaguuguccuugaccucugcuuugucucugugguuugacuguugggcuguuuccucuguguucaagccugggacugccuuucagugcuaugggguuucaacagggcuugcuguugucuuuccucagaggucucugcucugcucugccucuugucauguaucugaaaacuauuguauuuugucagauuuuacaauucauggagagagcagguccaagaauagucauuuauuccugacuggaaacagaacuaugucaucuuuaauaacuguagaaugcucugacuuauauuuagaugguuuguuuuuguuuuuacagaugccaaaaguaaaguccucuaaaggguaacagugcaguacuauaguucaaacauguuuacaugguguguguguguguguuuucuccuuggacaugugcagcuugugucacacaggucauauguaccccaauagaacuaugaauguggcucagcacagaaucauaaaaguacuuaaaacauuacaagguuuuccuauuuuaugauuuuguaacuagagugcaauuuugagcauguuuuuugucaacuugucacagugucacaaaguugauguuccugguugauuuugaggacuacauuaggacuuccuuaugcuugcuuguuagcaacccuucuuuuucucucgauauauuuauauuuguguguguguguguacgcacacaugcaugugggugcccuuggaggcuagaagagggcauuggauucucuggaaacuaguuauagaugguuauaagcugccugauaaaugugcugggaauaaaacucucuuguaagagcagcaagugcucuugaccacugagccaucauaccaaccucaaauucuuuauuuuuaaguagccuuuuaagaauguacaaaggggggcuggugagauggcucaguggauaagagcacccgacugcucuuccgaagguccgaaguucaaaucccagcaaccacaugguggcucacaaccaucuguaaugagaucugacucccucuucuggagugucugaagacagcuacaguguacuuacauauaauaaaaauaaauaaaccuuaaaaaaaaaaaaaagaauguacaaagggggccagggaacccaacagguugacucaagugugaucuccccaaauagaaccaaguucacgaagcuguccucugacuuccacaugugugccagagcauucacaucugcacauacaugcauaccauguauauacuacacaauaauuuaauggguuuuuaagauuuuuagcuuguaagccauaaaaaccaagccauuuacauuaguauuaccaugagaguugcagaagucaucuuagucaaaggguaccugcacacucuguagaaaacaccuaugucauuacuaaucuuacgacagggcuuuaagacuguuaagaugauuuuguacugcuccuuucaagugcuaaguuuuugcuuugcuuuugcuuuuuaguauuauguuccacuccauguguaaauaucccugccucuccauuuaugcagaagcuuggcuuugggacuggggucagcguuuaccuaaugaaaaggugaggacaagauuccuugcuugggggacugugggucucuuguccuuggauuggagaaguuucucaucacccugaaggcuacauuccaguccuuugaaucuugauaacugccugagcucugccccuaauacuuuacuucuagaucccuccugguagaguauuaaaaaggaaguagcuuaguccauuuuccuucuagcuucuauaagaaggugaagugguagaaagaacuuguuagaacauggcuuugaguguggugaauggguauaaaauuguuucguguggaguugaaauagcuguuagugaagaagagcaugcugggacggggaaccauuggcaguuacuggcuccagggaagagccagcucucuuagggaugcaggccuuagaggcuacccaugcuccaguaggaaguccuauacccaugcacuaaguggacucagcgggcuucaaaaauaaagaacacaugagguuaguggugguggaauagaagaggaccuggaggggagggaguggaaaguagauuugaucaaaacguauguaugaaagaauaguuuauauagaaacugccuuuaaguuucuuuaauauuaaucauagcaugccauaacucaucucugaugcauauagauacauguuaauuaaguaguaggcugacaugccaggguagaaauguuagaaaacaguguaguuguucugagguuuaauuguauuuugauaaguuccuaaucccccauacuuauuuguguccuuugaucccuucucagaguguagacaucaggugcuuuucagggcaucugguuaaaucuugacacagaaauguaacagguguugaugaccuaaagaauuuuauauacuuuaaaaaaccuauuucuauggagcaaaauuugaguguugguguuuuuuuauucauuuuauaucuuuaaguuuacauauguauauuuuagaucuccaagaggguugucucauucuccuugggccgugaaaaagauaagucuuuuaugcgaugaucauuaucgaacuguguaucagaagagacuaacugaugaagcuaagauuuuaaaaaaccuuaaucacccaaacauuauagguaagucugcauauacuuuguggcaguaugugguagagcaauguucuguguagcuacugguuuugcuaauaacguuggguccacauauuguugggacuugaguuaauguaaguugucuaagguaaaaauucauauaagggccuggagagauggauuaucagguaagaggaccugccaugcuugcagaggacucagguucaguucuuggcacccacauggugacuuacaacuauccacaggggauauaguaucuuggcuuccacuggcaacaggcuugcaugcgguguacauacaggcaaaauacucauaaaauaaauaaaaaauauuuaaaauucacauauucuacaucuuuaagcauauguauuuaaccuucauggaguugaguuggaaguauuuguuuuggugcugguccugugaagauuucaggaauguagaaugguccugguguagaccagucauguucauuuagaugauggguucuugcacuauuuucacuuugcauuuuugguacucauggggcugguggaauccuucuguuuacagaagcauaauaaaaguguuuugaucugugcuacuagacacaccugaaggcauuugaauuauuugggcuuuguacauaguagcugcuucauugugcuaguccagauccguguuauauuaauggagaguuuaauagaaaaaugccauguuuucuuaaggauaucgugcuuuuacugaagccagugaugguagucugugccuugcuauggaguauggaggugaaaagucucugaaugacuuaauagaagagcggaacaaagacaguggaaguccuuuuccagcagcuguaauucucagaguugcuuugcacauggccagagggcuaaagguaacugugucacuguauuuuaaacagcuugggugaacuaugaagaaauuaaacauguguuguaccuauguugcugugguuuuagauagaagauaagggaagaaauauauacauaacugagguggugguggcacacgccuuuaaucccagcacgcaggaugcagaggcaaggcggcucuuugagggcagggcuacagagaaacucugucucagaacccccgccccccaaauuauguuaacuaaacacugguaauagugacguuagagaacuacucacaguguaaugauagugauguuaggauuacauguuaagguuucauaggaaauugauuuauggagcagauuguaguacauuuuuagauaggauagagcugggcauggugguacacaccuuuaauuuccagcagaggcaggcagaucugaguucaaggccagcauggucuacauagugaguuccagaacagccaaaggauagaaacaucugaauuacuuacuaaugacuuuaaguauguauauauaaugaagugaauaaauuacagcguaaccauauugggccuccuuaccacaugauaggcagcauugaaauaagcauaagcucuuguguaagagcagaucacagaaagaauggccucucauuucaaaguuaggcucaaaugcugauaggugaacagauagcuauugugcagcacuguucaaaaugugacuaauuauuugcaaccccaaaagaaguuaauguauaaaacauaauauagcuuuggauuacaguuuugcuucugcuugugaauuaugguggcuccaugucuccugcuuuucuuguauuacaucaaaguugagcuauugaccucaaguaaaauugggaguguugggaaaucuucuggauugaaauuuuuaugggcuuugagaauucaaacauccugaaaauuuuuagaugacauggcaggucaucuaaauggacaauuacgucuaguuuacaaagggaauucaaaucauuguauuuuuuuuuuugguguuauuuugguuuuuugaaucaggguuucucuguguagcccuggcuguccuggaacuucucuguagaccaggcuggccuugaacucagaaauccgccugccucugccuggcuucaagucauuguuuuauugaaggaguuuuuauuaauuuuucuguucauguauuugauugcuuuuuccaauuuuaguaccugcaccaagaaaagaagcugcuucauggagacauaaagucuucaaauguuguaauuaaaggugauuuugaaacaauuaaaaucugugauguaggagucucucugccauuggaugaaaauaugacugguaaguaggauuguuuuaaauuuauacaauuuugcauuguaaaacauaauaaaccuucaugguuuaaaugaacuauuuuuggaaacuaauagugucuuuucauuguuuugccuccugaguccucagcuccuucccuugccacauggucaauuauugacuucuugguaguguguauauuuuuugucuuugacuuguuuuaaauaugucaguugggcucacaggccucccagucuucagccugugcccgcacuggcccuuauuagcauggauuuuaacugaauaacuuugggcaagacacacccaauaggcuagagcuuccccagcuucuaggcauucuuaucuaaucacguuaaucaggauccacuauugcaucuucccuuuccccuucaaauguuucuucucuacuuguaauuucauugaaagccucaaaauagaauuuugaagauaaacuuugauuaaauaaacugcuaguuuuucucccuuauuguuuggaagugaguauaagcauuuuguuuugguucuauccuuauuuguguaaaauggagauuauaguaaugaaauacagaaaaacuaauacacuuuaaaaacuguccagugcauuugauuuaucuuaguuacagaauagaauuuuuaaacauguaaagcaaauuuugccuuaaggaagauauuauagauauaauacuuuacgagaaaaaggaauuagauauuacaaauuuaaugucuaguagaaccuugaguauuuggaagcuuagcaauguaaauuuguguaauuauuggggaauauuuggaucacagagaauugauuccuaagugauacauguuaaaucacuaguuuccugggaaaacuaguagcuauuagcuaaugauuauguuaaaaaagacaaaacucgcccccacuggcugcacuuccuugucagccagaaaaggaagaucagaguccaugaaagaagaaagacagaacagaagaaaaacaaacccugaaaaauguuaauaauaauaauaaaauucucaacaagcuugagaaaagaaagacuauaaccaccaauauuagacaaugaagagggucucagcugcauguucuuucuacacaucuguaagggcuguuacagacagcuauauuucaccaaguugugagcauagaugaaaaugguuauuuccuagaaaaauguaaucauuaaaauugagguaaggacuaggaaguccaaaaaucucugucuaguaaagaaacauuccuacaaagaauccuacaugguugauuuuaagugauacuagaaugacuuaaguuauuuuuguuuuagugacugauccugaggccuguuauauugguacugagccauggaaacccaaggaagcguuggaagaaaauggcaucauuacugacaaggcagauguguuugcuuuuggccuuacucugugggaaaugaugacuuuauguauuccacacgucaaucuuccagaugaugauguugaugaagguauaaauacaaauaaguuuuaacauaaaucugaauuucuuuccacuaaauuagauuuuaaacaguuaggauuauaacaauacugugauuaauuggcuagauuuaaccccauauaaaugagaucgacauugauaauaggaagacaaggguauuccucgcuccacucauggguucucuuuuuuuuuuuuuuuaaauaauucuacauuggguagguaggguauugaguugaacaaaguuuccuuaaaacuuuugcuggagagaaaguagauaaacuauggcagaagaguugaacaaacugccugugguauagugggaugcauacuggauaacccucucuuguugcaggaggguaaauaauugagcuaucccaugaccuacauuuuguuuucaucucuuaacucccucaugugcagaugcaaccuuugaugagagugacuucgaugaugaagcauauuaugcagcucuggggacaaggccauccaucaacauggaagagcuggaugacuccuaccagaaggccauugaacucuucugugugugcacuaaugaggauccuaaagaucgcccgucugcugcacacaucguugaagcuuuggaacuagauggccaauguuguggucuaagcucaaagcauuaacuuguaugggaacuguuaacuagauauauguaguuaauauaacuuaugguagcuagauucuagaaguagcuuuaacacuagugaccccugucuaagaugacuuaagaaucaagggaccauugcuuuguuacagaucuuuuuagauauucuugcuucuuuaguggguuacuaaaaauuucacuacguacaugugguacagauaucugucugcucauagugucaguccuucagcuggccugucagcccaugcgcccugggacuugagaagaguucauaaacguagcuccuagggugucuugccucucuacacuuagcuucuaauuuauuacuuuguuucuacugauugugucuuaagucuuuuaaaauaaauguaagaauaaacaauaaaagacaguuuuaguaccaggcaccuca

SEQ ID NO: 7538 - RNA, 29308 nt, Mus musculus
cuuucugacaaaaaugauacuuuauuauaauuuuuuuuaaaucacagaacuccagucuaacuaucacacacauacacacacacacacacacacacacacacacacacacacacacacacacacacucacacucacugaucucuggugcugacuuucauaacccucaaacuggcucuccucaaauuggcuaacaaguuaugccucagggaauuuuccaguucaacccauacucaacuuggaauaccagggaucaacggucugguuuugugcauacgucagugaugacagcugguacaucugcugaagaaaucauuucugcuggcucagcaccgcagagcugugggcacuguguggugugcuagaauauggauuugcaugccagucacaacccugccagcuuuucucucucuccucucacuguucuguugagucucuucaggggcucccuuaaacacuaacaaaaagguuaucuaucuacuggguagcagguggcucagaccaguaccaaugcuacauacaugugaagucacuaagcuuacaacuguggguuuacaauucaacauaaauacuauuccaaaguaaggaaacgaaugccuugccuggcuagggaaaaugcuugauucguucuaaagcuugcaauccaugguggacuuuuguuucaugauacacuccagacaaucaugaggcaaucugugucacucucacuacuagcacagcacccuuuccugucucccuccacacacagaaauagcuucagagcccagcugucacaucugcggcuuggaucaccugugaucucaggugacguauucccaagcuuaguuaagaucaacuauguaacuacgaugcugagauggggcccucaccucacagcagaacccucagaacaagcuaagagcugggccagcuacucugacgccagcaagagagaacuugccaaaugcugaaaugcagguuaaguaagcacugcugcugccuucaaacccacgucccuuucuucuagucaggaaaccgucgucaggagggcccuggccugaguaagccagucuucuucacagaaguagauauuuuagagauaggaaacgcauuuuaccacgucuguucccaggacagaccacagccacagaagcacuuuccagaguccgucugcuccaaugucuaucucaaagacaaaggcagccagccuucaugagguacugacggauguucugccaaaaauauucuccuuucccuaaacuuuaaguugucuucgaguucaacuauauuauacauauguucuuuucaucagcaaaaaggugacuuuuuuuuuuaaacuccaaaaccaaugaugucuauguagaaugaagguagaauuuugguugguugguuucuguaauucagaaccuagaugaaaucaaaagcucugcaauggucugcacauucaugucuucccaggguccguugcucagcucacaugaacucaucggaaucguuaccauccugcaggagacaaaagagaccgugaggccuugagcccgacagacagucauaaucaucaugcgacccgcugcccuuucucaguccgacucucagggugcagggcugcagaaagcagcagggcugcagaaagcagcagggcugcagaaagcagcaggaagaugacugagcucgccacagccugcugccauuagcucuuauaugacccaggagaguggacacaaccuccaagucccuccaguuacuuuaacuuccaaguaauaauguaaagcccaccccaacugguagacugugggaugaaauugugacucugcuaaagaaugauuuaugcuaaucacuuagcauaaauccugaacuuuuaaaauagagugacugagagagggcuauggagccucuucuccuggagugacuuuacucucugaacacagcucauguuauaucagaucaugaaacacacacacacacacacacacacacaauuuuagaaaaggauuaauccuccacaaguauacuauaugaacaguaucuugcuuccuuaugccaauaacacugucauauauaaaauaucugugcccuaaaucucaguauuuugaaccuugugguuucccuagauuugugauuucacaugaugaaagcuaacuguuuuccuucccuuuuuuuaauaggcaaaguccuuaagaagccaaacaugggcuuuuaauaaagcuagccagcuuggccucuuccauaccacagcacauggguaaagggcauucuuagugcacagcugauacgccccagcugccuuacagcagcacacacuggcaagacucuucccuggcacaguggcuggcuugagcaacacuggucacugccugguucgauuucuaucuauuauuguuuaacaccaguacuaccagaggcagggacaggacuugggguucuuuuucuuuuaaggacccuuguuggaaaugguaggaagacaguaagugaggguagaaaacgguaguuucuauaaaggcuguuuuucucuggcuucauucaguggcucucucucucugcugcuccucuucccccaucuucuuaaaaaauaauuauugccgggcgugguggcacacaccuuuaaucccagcacuugagaggcagaggcaggcgaauuucugaguucaaggccagccuggucuauagagugaguuccaggacagccagggcuauacagagaaaaacaaacaaacaaacaaaaaacaccaaaaaaaauuauuuuaggagcuagaaagaugguacagugguugaaagcacuuguuacucaugcagaagacccagguucaauuccuggcacccguaugguggcucaucagcauccagaaucccaguucacgggauccaacaucuucuagccucuagggcacugaacgcaugugccgcacuaccacacaugcacaaaacaccuacacaaaaaauaauaaauuaaauuagauuaauuuaaaaguacguuuuaguguaugugugccauauguaugcaaaaacccuugggaagucaggaggggacuggauccccuggaacuagagucuuaaagagauguaagcugccaugugggugccaggaacagaguccaggucuacuggaagagcagaaagcucugcuuacuacagaaccacgcccccaacccaugugcugcucuuuuacuaggacaaugggaaaugugcuaguaggacugcaucagaguccuaaacuuuaggaacagcaucagaaacauccgaugucagcuucuguacacggucagugaggacagacaacaguaaggccacccagcugguaaaagggacagugcacucuccauacaggggccacucacuggaugugugggcaggugaucuggcaccacaggaauguuuaacugugugucugcggucugggacuguccuuggacaacuaucacauuucagauucccaguccucuacuaaucagcuuagacaggccucuuguugcccagugcuaacugaugagcaagaagaaugcaagagcaaugauauaugccuccaagcacacauaaaaaaaggacuaaaaauuacagaucaaagcaguuaugcaauggaaaacuaagcauucugaugagcaucuagcucgucucagacagagaccaguacccuuccugaugagcuuguacaguccuaucucacacaagucucagccucuggaugaagaucaggggugcacacuacaaaucagguuguacaacacaagaugguaacagagcagaaaauguucuaaggagacugaagcuuuuucauuggagcaccucacacagggcagcaaguaacagagcaggggggaggaggagcauuuuucucacacugaacacuguagucuugagacucuuaauuacaguaucugugcacacccaugcauggcugguccuuugcaucuguggggucuauuucugcagauccaaccaagcacaaagagcacuuaggaaucccacaaacacucuuucuugucagcauuuuguaagcacuacagugugacaacuaucugcgccugcauuuauacuguauuuggugauaauagucagaauaaaucacauggggagauaaaacaugaguuacaugagaauaauuuucuauuucaugaggguuuuggcugggcagugguggcgcaugccuuuaaucccagcacuugggaggcagaggcaaauggauuucugaguuugaggccagccuggucuacagagugaguuccaggacagccagggcuacacagagaaacccugucucgaaaaaccaaaaaacaaaaaaaacaaaaaaacaaacaaacaaaaagaggguuuugaucaucuacauauuucagauuuuaguauuccuagggccuuggaaccaaugccucaaaaauuucaagagaugguaugugcaaauguaugugugugugugcaugcacacguauacauaugagcauauacauguguacauaugcacguauguuuccaauucuaaaagaacauguaaagcucuuaaagauccacugugggaacaacagguacaaggcugaaacacaggccagauuucugguggaaagccacuucuaaauaacguuucaagaaguuuucagucagcacagcagagacaggaccauuaguuuuuacugaauuugacuuggaaucuaucacaggccucugcuaagguuaaaauguucugaauuucuagaaagccaagaauaauaugcagagggcuaaacaaacucaggacuucaaguaaggaccaaugacaauuaucuaugacacgaccaagucuaggaugagggcacacccuuguuuauaggcuacgacaaccucaugagguaaugucucuacacagagcaauaaucccccuaaaaaggcuaaaaauguaguaggcucaauccagggacaguuuaaaucuccugacuucacauucaguccugaugaacuacacaguguuauuuuggaaauuuucagaaauaauuuacacagccaccaucuugauucauaaaggagccucaaaauuuuagcuuugugguagucaagauguauucuuacccauuccuggacaggcaccagacaugagcaacauuuaaaauccuacugacuccaaucauacacuuagcuuggaauuugaguagauaaccuuaggugggaaacugagccacuuagcagagcuuucuguaguaauguagaaaugguuccuuaucucugcugaaauaguagccaucgggccacacaaagcugauauggcugaagaacacaggcuucaaccuuaauuuucauugagacaccauuugcaauucaugucuagcauaucugaugaugcaaucuaaagcauacauucuaaaagcuguauugugaaagagccugagccaaaugugcuggugccugcuuguaacccaagcacuugggaaacaggagccgugagacugugaaucugagaccacgcuggguaaggggaggcucauggcagccugagcaacaaagggaaaaccugucucaaaaacaaaacgaaacccugaaacaugucaacaauuauuccaaguccuaacaaguaugacaagaaucagugcugguauuuaggcauauggucucauauuugguacauuuauuugguacuuuuauuuuuaauugaaagggguaauaucgacucuguuuaacuauauugugaagucuacagcaccauuaguagaggauuuuaauaaauggaaauuuauuaauuuccuuuuuuuuuccaaagccugguaauggaauaggaacuaagaaaggagaaaaaaauuugacuacagugcugugccacagucugggucuguccccaaaggccacgugcugaaggccuguucucuaguccaggcucuaggagacagaacauuuaaaagugguguccagagugaagacagucagguuucugaggaggcacggccuucccaggugcugggccuccugccuucccccucaccccucugcucccagcugcucuaagacaagccgcucaccuucuccuguguucccaugaugcugccuuaauacuggacagaaagcagcagggcaacugacuguagacccaaaucucuuaaaaucccacgucaaaauaaagcuccuuucuuccuaaauugauucucucaggcacugugcugaaguaagggaaagcugacuggugcaccauguaauacuaauaggccuacccuucacagcaggugagcuauccgacccuuucuuuaaagugaccauguaaaagcaaacauuggaacacggggcaggaugcuaaugccugccagacacacacacacacacacacacacacacacucagccuccucuuccauacuagcugccaaucaugguaagcaaucugcaacacuacgacagucgaaaacucaacuacugaagacucuguuaaauauuucaaggugcaacaguagagcaagaaaugugaacguacuugauuugaggacauauucucaacuuucaugagugaugaguagcuccuagaagaaaagaaaauagucaaauugagguuauuucuccauaagcauuuugugggugauuagcacccuaaaacccaaaugagguuacuaugucaacaagcucucacagacagucaccacguugguggaaggcucagugggcuaacuguucccacucugaagacagcagcacacaagcaugcccucugaaggucacauuuccucuguacucccuauuaacccaaacuaccccaacaccuuuugagauuccuaaaagauaguuccagacuucuggucuguauccgacucaaaaucuauuccccuacggaaacaaacacguuucguucuccugaugccuagaacagcaucacuguccauuccacugaaaaccuaggagccauucucagcccuugcuccucaacccaaacuacaucaaaccacaacuuuaccgugaauuucccucucacggaguccaagccucauccguggucuggaccacugccaaucacuuaacuucuggcuccccugccucugggucccucuauaacccaccaggcaaagagcucuuacuaaaacacaaguagccagcuaaguucaugccugucaucugggcccaugccuacaaaacuaccacucaggaggcugcgguaggagacagccaccaagugugagacaugcugucucaaaaaaaaaaaaaaaaaaaaacaaacucacugacucacucacucaaagccuccucacuucugcuugaaacuuaaaaaagaaauugucuuauguguauguggguaagugcagcauacccgugggggucagagggcagcucuaccuccagcacgaaucacagaaucucuauauuacucaacucauucugaauaaauauuguauaaaaugaaucagcuagaagacaacagagcuuuguaauguguugauuugagaaucagacgacacacguagcuauaacucccagcaagaugcuuaggugcuguucaggcucucacucuccuuuuacaaauccagguaacagaacuacgucacugcugaaugaggccaugcaagaagcacuuucaagaagagugucagucagauggcaaauguuaacguaucagccguuccuccuuagcaagcuguaaaugaagugaggucguguuucuaacacaagacaaccauguuucuaaacaaagcaguuaaagaugugaaggaaacagaagggcauauuuucuucaguuuuccccuacuccaaacuaaaaccaagaauuagcugcuguggugguuuaaaugaaaaugaugccacccacacccccuaccugaaggcucauagagaguggcaguauuuggagguguggccucacuggaggaagugugucacuggggguggggauuuggggucucaaauggucaagccgggccuaaugucacucucucccagcugccuuggguucaagauguagaauucucagcuacuccuccagugccaugccugucugugugcccccaugcuucauaccaugaugagaauggacuaaaccucucaaacaauaagcaagcuccaaguaaaugcuugucuuuguaagaguugcuguggucaaggugucucuucacagcaauaaaaaccccaacuaagacagcugcaaaugcugcuugccagaacucacaaauguuacuggagugagccauuuuaacaacccucagcagguucccauuugcaggcaauaucagauauccaagucuauggaucugccugcuucagucagcagaccaaugcaagacaacauucccugagcucgccaucugaaugcucaacuuuaaaagaagccagacuuccugauucagcagaaccuggacaggaaggaacacaagcagguaccucacaccugaccauauacaaucgcagcagcuucgcaccugcccagcaagcuuccuaagaacccaggguauucagagaaagcugggucagagcacgggcagauagguggcuuuuaauuugaugccacccgcauuugugucuuuucugcugcacauaucacaaauggcauccauggaaaccuaggaguucugugacugcaagucacaacaaggacaacugugcuagagcauuugccccgugcaugagccccuacuucaucccuuagcacuacacaaagagaggaagagaaaaaaugaaaagaaaaacaagagguagcuggcacgugucgguaaucccagcccucaggaggcagaugcuuaaccacacucaaacacaaacagggcaacugggccgguucaagugcagcaacacauauucagcacggcaguggaaugaugcuuccaaagcucuccccuaccccaggacuuucucauccaaaucucuagaagcaacagacauguugucuucuguggacacacacuuugcacaugugacaguucucuaugacagggagaugacaggauggugcaagugugucugaucuagucauauggcucuuuaaaagcagagaaagcaacaagccgaagaaugugggcagucucuagaaaccagagucgccucuagagccuccagaaaagaacugcccugcugacuucucguuuguuuugauuagucaggacuucuugcaggucugaauguugauuugaggaguuaaauuugggaccauuuguucuagaagcaacagaaaacugauacagucagcauucucauggccaccaucacuaagaugucaagagccaaaauauaauuuaccugcuaauuaaaacuguaggcuacugaagcaggucucgucacauuaacacauucaacuuccgaaaagcagaaaaagcacgugaaagcagcugugaguaccugacugcacagugguuugaaagcagcugagugcccggcugcacaucaugguaacagcagcccagcugcucagacuacacacuccuacaccucuucuuuccccaagaacaagcuggcagcacuuggggggcagagacagguggauuucugaguucaaggccauccuggucuacaaagugaguuccaggacagccagggcuacacagggaaacccugucuugaaaaauccaaaaaaaaaaaaaaaagaacaagcuggcaucugaggacagcccauggugcuuacggugagguaaaaccuuucauuuugcucacugacacccaacaccucuguaacacggggauucaccacaucaucacaaccaccuuuaacaacucagucaauacucuuaacuuguauguggccuccagccacuggggcauuaucuucagaaccuguggggagcacccaggugaacagcaaggccuccuccccagcguaccuaaguucauccauuucccuuuucuucuucauuucuucuuucucuuuccuuuucaucuccugaaucugggcuuucuucucauuccucucuucacggucucugccuuccuucucugcugcaaggucuggaaacuucuccaguuuggucuuuucuaaucgguucaagauuucauucacuuucuucucuaccgucacaaucuuuaccuuugagggaaauaaaggaaaguacuuagccuuaauuauuuuucucaccuaagagggcaaggcuuuggcuuuccagggcuuuagccacccaguuuaacacccauaggacacacaggacacucagcuuagggucaggcccugccucccacaguauaugaacacuuacauccuucugccugugaaagccuaucugccccacauccaugucagcuguuuucuucagguuagaccauggcguguaaaccacauuaacguuguucaucuugcagccugccaagagagacugucuucagcaggcaggaaacaugagugguguagcccucaccacagcaaaaccucauccaccccagacgaggcuuaagagcucacuuccaaugucccaaaguaugaaaggucagugggaaguugaccauuaugccaaaguauuagaguagaaaaagcaagggcccuggcuccugacgcugaggaaagcaacauguuuacgaaggcuuguuugguugucaguggagccuuuuccccuaaauaaaaccucugagucugaaccgaaaugagccgauuuagcagaacccagcaaauucaaucccuguccucugguacugagcagagagaacuugguaacuacagagcugccagugggguguccucugcaagcucacaauucucuucgguccucagcacuguccucugguacugaguaagaguggaaccugaggccuagcuccuucucugcugugugacaggucacugcagaaggcugaggaaagaagggaauaaucccgugucacaacucuuccccucuguuuucucuagaacccauacacucuaaggacauuaagaagaaaccaagccaagaauaaagagucuacagcucuuuaagccaagggucuucugcaagccaggggcauggaaaagaacaaggcuguggaagcggcuggaacacagaauaaacaguuugcuuauuucauuuuuuacuucaguaacugaagaucugagauuuuacucuacucauaaaauaaagcguccucccucagaaccaccugcugacuauggagcuggaaacugguggcuccuaaagguaaacuuuaagcuucguagucugcccaccgggucuguaacuagggcugccugggcugagacugaagauaccagucuacaugaaggaaggcugccaagcucgcucuccuuguguaaucauuaacuccagugccuguuaucagcugugugcucuggggccucuuccaacuucauuuaaaaccaguucucucuuucuaucuaggucuacauccuaccccuagaaacuuauuagcucaaucauuuaaacccacaccucucucaacccucauaaccucuacccccauccucauaaccauccuucuagaccuuuccauuagauuuaaucuuaucuagaauuacacaggcaccaagcccaguauuuuuagcuacugccuaaaacacauaaggugauuguuuccaauucacacugcacacuggacucacugagagcuccugaaagauaaggacacucccagaccacccaggucaguggggaaggaggacaagagucaaaugacucaaaaccuucacaaauuaaaugaaggaaaagcaugggagagaaggagaaaagaaaaagcgugauuuaaagacucuggcucuaagccgggcguggugacgcacgccuuuaaucccagcacucgggaggcagaggcaggcggauuucugaguucgaaaccagccuggucuacaaaguaagcuccaggacagccagggcuauacagagaaaccccgucucgaaaaaccaaaaaaaaaaaaaaaaaaaaaaaaaacaaagacucuggcucuaaaccugaaauaguuaaacauaccuauacuuccaggacccaggaagcugaaauaggagaauugugaguugccagccugggccacacagugaguuccaugcuagcccgggcuacauaucaagauuccaguucaaaauauccaaacaaggggcuggggagauggcucagcaguuaauaacacuggaugcucuucuagaggaucuggguucaauuuccuaacaaccacauuguagcucacaauugucuguaaccccaguuccagggaaucugacaacuucuucuggguucaaagugcaucagacauacacauagcacagagacauacaugcaaauaaaacacauacacauauaaauauauuuaaaacaaaaaaccaacaaaacacugaaccaaaccccucuaguuuuacagucuguugacagcugauggcagcagacacaucuccuuagcuaucaacacugccauguugccaaaagucuuaggcagagcuggaugacuuccuacucaaggaaagggaaagucaagugucaagacagaaaggacaguaaaacuaagaggugugggauaugagcaucuaguucucugacaagccuccuccuccuccugcucuccccagacucaugcucacuaaaauggacuaugauccaaacauagaaaaagggaaugcuaggccaacugaccuugaaugcuauuggccuucacaaggugggcacaguccaucaaaaccuccuuuggaaugucuucuaucuucucucccugcaacacaaaauaaaccaaauaauccucuugguuacugauggccacuggagcacucgcaaggcaugugcugccuuaccggcuggacacgggcuuacagacaagcaggggcucuccggguggacugcagagcacugaaagaugagggacauuuacccaccacagaaugguaccugaacuaggagaaggcauuagcagaaaacuauacucaacacauuuuaaaaaccauguugaagauauuaacugcaguugugucucagugguuucugccauccucauucauuuccggaaagcuuggggggggggggcacgguguccauucugagaucuagacaccuuccuggcugaggucccuguaaccuuccuuugaaacagauaauggccuggagcucugaaucccaaauaucuccccagccgucuaccucccagccaaaauccgggugaaguucuuguguucuucaucuguugugcugcucccaugggaagauaaaguagccaguggaggcugcagcaaagcagcaauggaugggcgagcucacacaagugagccuaggaacucagguuugcuuugagucacuuuacaccagugagccaaaaacacucccaaaugucauggcuuuucuauccaaaauggccguguagcagugaacacugccggagagucugcaucgucacgcuucguguuggauucaaaccacaaugaaggcacacagugccugccagaugccacucugcaaagcuucagcaugugccagguccuaaccuucacaaugacucaauaaaggaagaguuggucccuucuacacaggaggaaguaggcaguuaugugcuacagagucaggauuucaggcuguucuacaaagcaaguuccaaaccagccacagugacaaaaaaaaaaaaaagaaaaagccaaagucaggugugguggugcaugccugccuacagucccaucuacucagaaacugagguagaaagggcuuuugaacccaagaguucaggaucagcauggccaacagugauacuuucuuucaaaacaaauaagcauuucuaaauaaggguuuauaaugcugaaaaauugcauacaaucuaauccugacaaaguagcuuuccuacuaacugugccacuauuaucagcucacuacaggcaaucaaaauaacaaacaagaaaacaacauaauauccaguuuacaaaccacgacccuaaaaaguaaucugaccaaccugggcuacuguggcugucgguaucccaagguuaaacaguguaaaugcaccccagauguacagacagaauagaaaugacagcuugagcugaacuuucaguaacaauguuuuggauggaaaucacaaggcaaaagaucaaaaaaucguuacaccacuguccuuggguucucagcugcuuaaagccugagcugcaguaucacaaccuggcaacugcggguuucugaaacucacaguggucccaaauuaauuuauaaccaaacccuucuggcaucacuucccauguugcccagugacuucacugcagccuccauucugaacacacaacaggugcgacccaccauacaacuugagggcaaggaacgcugccagaggcugcagcucagauuuaagagaucucauguuauaaguuacugucaugugugcuuguaaucccagcauuccgaagggggaucacaaguucaaggccagccugcucuacuuagcagguuccugaccaggucuucacagcaaaacuuuauuaaaaacuuuuuuggacugggcauggcggcacaugcuuuucaaucuagcacucaggagguagagacauuaaugggaaaacugcucaaaucaacuccagaacuuaguuggccugcuguuugagauccccgccauguaaugugagaugcuagcagcagcagggaagucauuugaccuuuguaacguucuaaaacccuguaaguccaaaguacauauuuuuuaaaacauaauacauacuauguaguuuaacuauugaaaauacagauacaagcaaguuagaaagaaauaguggugcugcguucccagggcacaugaacucuucguuccugcaucgccaccguguuuuagacuguccaaagacacucugauaaggggaacaagugcccucgugagccaggugaacugagugugucggagaagcagccacuagaaauagacgucagcaucagaugaacugagggggacacaagcagaggggauagguaaugcaccgagcuggcuagacaaggcagggcuuccaccugggaaaucauccagaauuuuccauaacaauuucuagauaggaggaagacauuuacuaacuaaucuuuaugacuuugaacacauuuauuauuuaagcaacuuaaucacacaaaaagaauauaugauguucaucuauaaagggaaggucaugaacucacgcuuacauucaguuaccuuuuguaaucguagguacacaugggccgaagagaguuuguccacgugaaaccuacaaagaaggaaaccacuuuuagcaacaacaagacaaccaugucuucagccacuugcacugaaagcaucucauuccaagacaguauucucggggacuuaucacacgugaagcucuauggagaguaucagacagucaccaucgccaaaggcugcccagcaaccuggagaggcaagacaaacuugagagcuguguagcugugccuggcuaugagccaaggugagucagauaauaacuaugaaacauccuggguagacugcagcuucaagcaacaagaagagcuaucagugaccaaaggcuuuguggaagagcugagauuuggcugacccgaccaaagcacaggccaagaaggaaaacagggcgagaauuucagaugagaaaggauggaagacgucagugaaagcccacuguguugcccaccugggagcuuugcaggacugcagucuggagaagaggacaacaugguuucugauaccuccagguuucaagugauggcagaacaaucaagaccaaguaucgagugcagaaucagaaaaguuagcucacuaaacaggcuacaucauuaaaugaaccagaugaagcagacuaagaauucuuccaaccucacacccugccacacacacacugaugaugauaucaacacacaucccuggaugaacauagucucuaugguacugaaacugucuggaaaucauuuggaaugccccacagcacaccccacccccuuuucccuugaaguagggccucauuacaaaguccugguucuugcuauguagacugaacuaacuuugaauccacagagaaccuccugccucugccuccuaaugcuuuaauuaaauucuuaaauucacuuuucuuuagaguuuguacugauuaguuuuaugucaauuugacacaagcuauggucaucagaaguucaauugagaaaaugccuccaaaagauggcacuguaggcaguaagccuguagggcauuuucuuaacuagugauugaugugggagggcccagcucauuguggguuuggccaccucugggcugguagucuuggguucuauaagaaagcaggcugaggaagccaguaagcgcacuccuccauguccucugcaucagcuccugccuccagguuccuguccucacugcuuuugauggugaauguuauacugaacuguaacugaaagaaacucuuccccaagcugcuuuuggucauagaguuuuauugcagcaauuauaacccuaacuaagaugggguucuuaucguacaucaauuuaaugcaaucuuuuaaaacugaugugacauuuuucauucauauaauuagcuaaauaaagcugauucacuuugcagcacagagaugggucuagaauuuaagcaucaacaaugaccaaggcuaugcacaacugacagacacugcgacccuguuaacuuuaguggguacuguuccuaacaagguuuggggaagccuguagagacggugcagaguagcaaaggucuguaguuccagcaggcaggaauaccaugagugcagggucagccuggacuacuuagagaaacccuagcucaaaaccaaacaaaaaccuaaggcaggaagcaucauugcaucccauuacugacuucccaaggcauuuucuuguuaucaacuucuauuuuacuguuaaaaggaucacacacucgguacacaauauaacaaguaugauucaguaugaagguuaagauuaugcccacaaagaagcuaaauaccuuguuauuuguucuggauauaaaacaauacucagacuuugggcaaaugauuuauguugccuuauucuuagucauuacugauagccaguuguguuuuuccaagcuguucauuuacucauuugcauucccaugcaaaauucauaguaauugucacccuuaguugggcauuuuucuguccagaaucuagaaauuuuauacauuucauucuccuuucaggaucuuaagaaaaauaucaugcuaugaacugaccucaacugaaaaggugcaccugccauucuggcuccugcuuguuuagugacagcucuuaauuaauaacagcaagaguagcucuauuagauucuguuuucuuccucaaggucuucuaaauggacugcugccaauagaaauaccaaaauaauauacacuaaugaguucauaccuaaguaaucaaagcacacauaggaguaacagggccagaguggugguuugaaugagaauggcccucagaggcucauauuugaaugcuuagucaccaggaagcagaacucuuugaaaggauuaggagguguggucuuguuggcuuaagugugucucaggaagagugagcuuugaggcccagucucucucccucuggcagcugccugcagaucaggcauagcucucagcuacugcuccaguuccaugugugccaccauaugcucugcuguggugacaauggaguaagccucugaaacuauaagcaaggccccaacuaaaugcuuucucuuacuaagaguugcugugaucauggugucuuuucacagcucguaugagaucuucaggcuuacauauacaguguaugauuacaaaggguaaagggacagacagaagugcaggguuugagauacccacuccuggaacaauucagcacaaacuacuuccuauaaaaagucuuuccaguuucaauaaaaacacucacucagaguuuaaaguaugcccacgcuagccucguguccuuguuauguccuugauaucccucacuaauucagagauuaaaguuuucaauaaaagcaacaauuaccggaggaugcagaggcccagggaaugguucaauuucuuaaagugggguccaugaaacuacuucucauuaggcagucuggggaccacaaggacacaccuuuucucuuuuccucacuuaaaaacuaauuugcuucuaaucucacuuaauccuuagaaaguucuugcuuaaaggaaccucagauuuaccaggauagacucaagaugcugaaacagguaaauucuccaaaccagcaucagagaaucccagguuagaacucugcacugcagaugagcucggagucacucuuggcuccugcaagauugucaggauugacagcacaugaaguggaaugggcccugaggucugggguuacuccagcuucccugaguucucaaauagcuucugaacauaaaagucaacugugcugagcuuuggccauucaucccuagccuacuaaaggugccacaagggaacucuaggucgcuaucauccuggugagucucaaccuuaaaaaaaaaaaaaaaauugaaaaaacucaagcuguaauuuacuaguguggguuuuaaauuagaaaucugucuaaauaaacuagaaauuauaccucuuuaacuuaaaaaaauauuuaaaagguaugguaaacugacuuucaagguguaucugaauauauaaccuuuccuacuaggcagcuaggugucaaaucuguaggcuaauauacaacacagauaaacauaguagcuguagcucuagcacuuggaaaacagaggcaagaaagugaguuccaggaaagccuggaauagaguuaaacucuaccuugaaaagaguaaaaggggacauaaagagaggagguaacgaccucaccaagaaguacagacacuggcaucaaagaggcuuuagcuggggaugacagggauucaaaggcgagacaaggaagcgcucauggugaggaagccuucagcauguguguuucuacgaaggcagugagugagucaagcauaaacuuuuguuauguuccaacacugacgaccucuuguucacagaacagguaaaucacuguccuauggagguuguagggccuucugaaggaaggccagaaauucccagcaguacaaucugccuacaugagugaaggggcccuaccuaagcagagucuaacuugaugguacacuugagugcagaagcuaggaacugugccgguaggaacugugccuuucaaauuccucauguuucugccaccuacugguuuucuuuuuuuuuuuuuuuaauacuuuuuauuaggcauuuuccucauuuacauuuccaaugcuaucccaaaagucccccauacccucccacccacuccccuacccacccacucccacuuuuuggcccuggcauuccccuguacuggggcauauaaaguauccauguccaaugggccucucuuuccagugauggccaacuaggccaucuuuugauacauaugcagcuagagucaagagcuccgggguacugguuaguucauaauguuguucuaccuauaggguugcagaucccuuuagcuccuuggguacuuucucuagcuccuccauugggggcccugugauccauccaauagcugacugugagcauccacuucuguguuugcuaggccccggcauagucucauaagagacagcuauaucuggguccuuucaacaaaaucuugcuaguguaugcaauggugucagcauuuggaagccuacugguuuucaacucggacaucagaaugacaggagaacaugcccauuggagccaugaacuagagcccuuuauaaccaaguagauaaaaguccgagauaguagccuacucaaggccauccaccuuacugaaaacggaaccagcucuucugaaaaguggccguccaaccucacaguacuguaaggaaaucagugggcuggggagcucacagcuggagaaaaggucuguagacaguuacagcaaugggccuggggcagggaggggggagcggggagcagggaacugaacagggaagaauggugcccuaaggugagggaaaaucaaccucaacauuuagaagcugagcugggccugugagagccugggcugggccaauaauaaccagagcagaccuauucuguuccucaucugaaagguggacaugguagcaacacugcagaggcuguugugagauuaaauguauugacacuuggcaguuaaguacuugaaacauguacauuauugccaucauccccaaauacacugagaacuuagccaggaagcaugauagccacugaagugguaagacuggguuccaggacagagaauaagcacuggagaaugaacauggacaagaccguaguaagaagcugaguuaggagcccgcccgcacccuucucuuuggucagagugaacacugaagggcacagcggcuauucacucagaaaccccaugaacgaaaacagcauggaggcaauguguuuaaauuauaggcagcagguagauagaucuccaagucugaaaucuaaaugaaacagauauuugcuacuuaccaaauaucuucaggccagccauacuuuaucagaucuucaucuacaauaaaauacaagaggaggaaaaaagaaacuaagaaaguugcuaaguggaaauacaccaggauuuuuauguugguaaggggaaaaaaauacuaucaccccucuacacacacaaacauauucucucucucucucauucucucucucucucucucucucucucucucucucucuuucucucucuuucucucucucucucuuccuugaugaagaaaacagugguggggacuuggaagcuugacaaaaaaagaaagaauacagcuuuuacagucagacaauauacuuaagauauugauacuuaaaaagauaaagauauacagaggauauacuuaaggauauuucaaacaaagucuaaaaggaaaggaaagaucacgaaugagaugaagcagcagcagacagaugugaaagagugagaaggaauuacucugggagguagggaguggaucucaagccuugggagggaugaagaggaacaagcuucugaggguggggaacgacuguguguguguacuguaugaucugauauuuuaaguuauacguggcagguaagccauuaaagguaaagucaauuaacaacugcgaggaaagcaugugauuccgaugugauggcuuuaaacguaccuaagaaaggacagccuuagggcuaagcuauacacaacccuuuggagaggacacuguuggcacuagcugacaccggaagcuuucugcuagacauuagaaauuuacuauggaaagugggaaacugaacaaaucaccaaaaaaaguaaaagaaaauacuaauggugaaacuaaugguaagugugcuaugaauggcugaggccaccugcuggcuaugaagagaacagaccugccaagaguucggcaaauacacuacuuaaaaauuccauuuauguuguauccaguguggagcuuacuuggaaacugccuggcuacuggaaauaaaugggugaagccaagaauauuuccaaaaggggacuuuaaaaugcagcuuccuuucauauaaggcuaauuuggaggggcugacaacuccauucaacucuaagucuccugaugggcaaguguuccauauauacagacacaauggcacaaaacaccagagggcucuagacgucuagacucacaaauggacucugcaucuaggggugugucucuaggcauaaauucuaccacaaaugugaaggcuucucaacucagugccucaaaccgccccuccuacagcaugugcuaguauguaaugugguaacaacugcauuuuguccacauuuuaaaacagguuuuauauuucagagcaguuuuagguucacaacaaagucaguacaugcuacuuuuugugucuggaugccagaaugcagcaaaaccgccaccuacaucuuccuaacagaggcuggaaugaggccucccuccauaaagaggagacaaccacagaaggaaaacagagacaggcggaaaugucagaagcaccacuaguccacccaugugaaccagaacagcgccggccuuuaagaaauauguaaagcucccccccgcccccccccccccacacacccgcccaguuauagugugcaaaaccugcaucacucaggaagcagccuggcucuaagugcuucccaguggcuguggucucaugcucuuccacugugauguaguagaaagaaaaccacauuuggcagccuuggcaucugcuuucauauccauucuaaguaacuauggcucuuguagcaguggcuuacuauucaguguagaacaugaaacagccuccuuuucuccaggaccaguguuaucaugggcuacaaggagaaacuaaaacuuaaguauuaguauaacauggaugacuuaccauuaggucacaccuaagucaacgccauacacccauuacaaugaaagacugcuucaaagugugggcuacucuaucuugcugugauuuguuguuucucacuucauaauggcagucuugaucuuaccaguucugcuuuauagcacccauuuuggacuuguuuauaucauuacuguuaagaaucucuuacugaagaugguaugugugucucuuuuaaugcauauaaacuaucaaauucuaacuguugucaaugucaagcuguaccaaacuagauugugauaguuuuagaaagaaaugggaaaagcagauaaggaauaucaaaagauuacacacagacaacagugugaccagcuagcucucagacggaccccggggaauguucccagagaagcaagguggggagugguaucugggagcuuaagaaguuccagggauucuacccaccagcuaagagugcuccuauggggugggcacugugugaugguuuguaugcuuggcccagagaguggugcuguugagagguacagccuugcugaaguagguaugucacugagugugggcuuuaauacucuaguccaagcugccaggaauacugcuaguggaagccaguauuccacuagcugccuucagaugaagauguaaaacucucaacguugccugcaccaugccuuccuaggugcugcccuacucacaccuugaugauaauggacugaaccucugaaccuguaagcuaacccaauuaaauguuguccuuuauaagacuugcuuuggucauggugucuguucacagcaguaaagcccuaagacagaaguuguuaccagggacuaggguauugcugugguaggccugaccaugcuuuugucuggaggaauguggacuuggggaaagcaguggaaugcuuuaaaugaggcuuaauggacucuccuaguaagaauaugaaacacuuuguugcugagauggauuugaacugugcagaccuggcccaagaggguucaguggagaagaauuucaguauguggccuagagaguguuuuugugguauuuugaugaagaauguggcugcuuuuugcccuugucugaagagucuaccugagucuaagguaaagauauuuauauuaauugcauugacaauggaacccucaaaaaaaaaaagcccagcagagacuugaucucugguucagucucaugaagaguguucugaacaagcauagcaagcauagaaggaaaaauauaaaauauaugguucgaguauuaaaggggcaaaagaagugaaauggagcuaaauccuguguucuaggagauaacagauuaagggauuucagggcaagaucccauccagcuaaauuuagauccaagcaucuugguacacaccuuuaaucccagaagacaaaaccaaacagugcaaggccagccugggacaaagcauguucuagaagaaaagcuuaaauccagucguggugguacaagccuuuaaucccaacauuacaggagacagauccaugaagaucucugaguucaaggucaaucuauagagcaaguuccaggaaagccacacuuaggcagugagggaguuguaacagaauaagggggugggguggggugggagcauguuccagccccagcagggaguagaacauggcagcuucagccaugugacucuggcuggaaaaacagaagggacuacugggacaauugaugcugguuagcugaagcuaagaaauuagcagugauuaagagaccagcauccugagcugaaaucuucugggaaguguuuucugaaagcacaaagaaacuguguuccagagagagccaagguuguacauugugcugcagcuguacuugguaauggguaagagucacccaagugguagugguuuuaaaggcaugaaaggggucaugaacagcagcugaggcuuagcacugugagaggccacggaaggccacugguaaaggugcagccucaguugcaguugaugcccaggacugaaagagucaugcaaaggauuugaagcuuggcaccaugaagagagccuaugagaggcuacuggucaagccuagucgcagcagaagaucccaguguauugcagaugccaguaccaugggaugaucaccaauaacagcagcagcaguggagugaaucaaccugagcuuagagugcuacagagggcagagcuggagaagcgacauuugaaggagcccaaaagaucacguguggaucccagacauugaaacaagaggcugcaauguugaauuugccuuggcaaccccaauauuuucgccaugccagagccaugggauaucaccugaggaaugcugcuaauggaguggaaccagcccaggaaaggaagcuuguugcagucaacagagaugagaaaggaguuggagaucugaaaacuacuuugacaucagacaaggagaugcagaguuuggaguuugcccaguugguuuccuaucuugauucagggauuacaguuaugugauuggauggaucucagaagagacuuugaacuuuggacuuuugacauuguuaauaaugcuacagacuauggggauuuuggagguuggacuaaauguaauuaugcuauggcuagauauggccccuauaaacucaaguguuugaacaagccuaugggagucagggaguggaauaugaagguuugaauaugcuuggcccagggaguggcacuguuggaagguguggucucggaguagguaugucacugugggcaugggcuuuaauacccuaguccuagcugccuggaagccaguauuccacuagcagccuucagaugaagauguagaacucucagcucugccaccaucaugccugccuacaugugcccugcuccucaccuugaugaugauggacugaaccucugaaccuguaagccaacccaauaaaauguuguccuuguaagacuugccuuggucauggugucucuucauaccaauaaaacucuaagacacugcauacagguccuuuuccuuaaucuagacaacccucugcaguagcuacaugagccuuucaugucuaagaacucggaggucugaagagguugcauaacugcagcuuguucgcuggggagcugauucuggcgugacuucaagcugucuuuucuaaacccucacacuaccuguauuuuccaaucuugaggaaugacacucuucucuccagcuccuccugagguucagcuucucucaccuucacugugaggaucaggguugcaaaacucugugcugucuugaccaccaagaaggucaacuugaacuagucagagugguucauauucguaagcuccgcaccgaucuccagagggugaggcaagagacugacugaauucuaagccucugcgcuauacagagcgcaaucuugucucagaagugaaaacaaaaauguagcuuaguuguaguauuuguguucggcuucaggaggcccucaguucuacuaucuccuauaaugcugggaugacagacauccaagggacacauacuacagcuaagcuacaugccaggccccgcugaacaggacaagcagaggaaagacagaaagucaacccucauagaaguagagacuacugguggcuggggagcucugggagacacuagucaauugguaaaacaaugaucuauuaggagcacuucuggaauucugucgcaggguaaauacaguuaucaaagucuaugcuacagcagcuagaagacaggauguugaauacucuaacugcaaaggaauaaucaauguuugaggugacagauaugcuguggauuucaacuugaucaccacacaaugugugcacguaucaaaacacuguauuugaaaugugggcaacuguuguuuguccagucuaauuuucaaaaggaauuaaauaaaucaguaacaaaacacauaaacccaacaacaagggcacaggaacagcacuuaccugccuggaauuucaaaaucaaaugcuuuuguaaacuuacuuucauauuuauccuuucccauguaaauaguguaaguagaugaauuaacuaaaauaaaacaaaaauaaaaagacaauuaguggggacccauugcauggccaugggccauaccuggcucaccuaccugcucuuaugcauccucugaguuaagcauaagauguauccuuuuaaaugacugauagcagcaggccaagacuaaacuauagacugcauaagucuuuuuuuuuuuuuuuuuuuuuuuuuuuuuuucuaauuuuucgagacaggguuucucuguguagcccuggcuguccuggaacucacucuguagaccaggcuggccucgaacucauuaagucuuacugagcguaaaacaguaacuuguccccaaagaugaugcuuagcaaugcuuacugcugaauaguugcuuuccuccuuuucaagaaaauaucucuauuuuuaaauuucucuuaagggauaaaguuuaauggcaauuuccagcucagcccuauacuuuugccuucuucaacgauaaugacaauaaugacaacaacaacaaccauuccccauaaugaacaacaaucucuucuacaaacauuuaaaaacagaucccuacacaugggagacagaggcagguggaucucugaguuugaggucagccagguuuacagagugcguuccaggacagccagggcuacacaaagaaacccugucucaaaacaacuauauaaaaacgugugucuaugugugugugcauaguauauguaaugaauauaauguauucuuaaaacuuagcuagcuggcauugcuuauaucucauugugcuacgaugguggaugcccuguuccacucaggggaaccacaguucucaaacuucuccaaacacuggcucuaacgcccuccagcuaccucaaacaagcuaaauccuaguuuuuacauugaaguaaugagcauuuuguugcuuagaaagcuuuccuuaaucuugauucuaaaguacaagauuaggacugaaagaacuagguacacacccuaccaaaacuugcuggacccuaaauggagcuaaauuugugagaugguguucagucuacaaagcacaagaccugguagauagaaacagaguuggcuggagagucuguaccccugagcagaacacacacagggcagugaugguguuguaugccuauagucccagcauuugagugggagaagggucuggaauucaugcuguccuuagcuacggaggcuggcuuagggcagucuggucuaucugagacugacaaaaaacaaaaaacaaauaaaaguuaagagaccauacauucgcugggcggugguggcgcacgccuuuaaucccagcacucgggaggcagaggcaagcggauuucugaguucgaggccagccuggucuauaucuauagagugaguuccaagacagccagggcuacacagagaaacccugucucgaaaaaugcaagagagagagagagagagagagagagagagagagagagagagagaggagggguggagggagggaccaagggaccauacauuuagaaggccagggaguuucugcccccaccuccuggaucacaggauuccaggaguggaccacauacucaguuucugugguauuagagaucaaaccccagacuucaggaauacuagacaaacacucuaacucaaacaacugucugucacuccaguuccaggggaucuaucauccucuucuggccuugauaggcacuaggcacacaaguaguauguagaugcgcauguaggaaaaauaccuacagacauaaaauaauuuuuagaaguagcauggcuacaaaaaagaaaaacaaacaaacaccucacacugaaggacgcuucacaaaauaaugcuucaguuaaaaguaucaugaaaggcuagguaguacaugccuuuaaucccggcacuggggaggcagagcagaggguagcaugaauucaaagccagccugaucuacacugugaguucuaggccagccaagggcuacauaaugagauccugucucaaaaauaaacaaacuaaaaaguacuaagagacaaaaccaccaaacaauaacuccagaucuggggaccuagaaaguaaugccaacgucagggagccuucaggcaggagagucuauguuugaagcaaccugagccacucacugucucaagaaggggcaaaaaucaacacagcagccaacuguguaaguagggcacuaugcuaaggagacaagacagacugccccucaagagaccugcccgguagcucaagcagacaccuuuuaauaccacaugagagcaguccuaaaggaauguuaagggggguccagaaagaaaugcauauuuuaucuugacgaggaaacugggucucacacagugucuucaaaaaggcaagcgcuauuuuaauggggugagaguuuaaaauuagaaauugauucuggacaauaugggcagagaaacuaaguugacgcggcauuuccuggaaaccgaaacagcucuuucuggccuuccaaaaccaacccaguagccuuagcagacguccacuggaccaucaccucugcccagggaggggcuguacuaacauuccagcccuccgauugcucuccgcggcaccccaggcccucccugcguaggagggcaagcuacucuuccugcaggagacaucugcuggcaccugucgcacuggucaagcaucgcuccaaggugcgggcagaacgcuagggcaaaggcuugcgacggggacgugggggacuaggcuggaacgcacacacguccaggaagcguuggcgggucugucaaguggggacgagaaugauuaccggguauaaagaaagcgggggcgcauucccgccgcgaccaccggggccaggggacgaccaggcagccgaggggacggccaagcagggaaccagaaggcucugggagaggugcccgcggaaggacgcgguucaggacuaaguccaagcccagcgcggcggcuggggaaugccggcuuuggaagcaggggccccggcgucacucaccgcugcugcuggugaaguagaacaccaugauccugguagaagaguggcgacuccuacucaaaacgcgaagcuugagauaccgccggcgcgagggugagccggcuuccaggcucuccucaggacacuuccggcggacgugccgucgcgucacaacgccguccugucagcgccaucuuuaguccug

SEQ ID NO: 7539 - RNA, 1175 nt, Mus musculus
ugacuauaaagguucaaacuuuauuaucucggcucuagugagauccagugaagcaacugagcagaauggggggaggggaaguagggugggggaggggaaggaagacagcuugauaaagucagauaaaugugagaguccaggcccagggcagucaagaccacccacucucuguuuucugaagaagaacuugaaggcccaagaggccuguucugggccuacagucccacuaggaggaaagguccagcagggcuggagcaggaccugucccagcucucgguccacugacgaacccugucagguagcccacccuccucucagacaaguagcagccaucucaccagaucucaugaguaaccccccuuagaucaggcuguaugguucugacugcccacuccuaagccccagucagcuccuuagaauuccaauagaauugaagaaaauaguucagauccucuaaaggacugugugacaacaugggacagagggacgaaagaaauagcuagaggaccagccucucacaaugcaggaaagcgugcuggcugccugcucugaguguucauuggcagaguggcaagcauccaugaagcguaugaagcuuagauucugugugaugauccccaccugggugagggcuggcgucguuggaggaauaacugcuggguacccugauugauugacagauagacagcuucuggguacccugauugauugacugacaguugcugucaucaucaccucaguguagcuaucaggaaaucacuaagccuaacugaagccauaggguugggcuuaagacuggauaagcuuaaguccuuagcucccaugugaggaugcaggacaaugguggccaugugcaaaccaggaagagcugccaccuugguuuuaaccuucccagccucuugaacugugagaaaacacauuucuguuauuggaaccaugcaauccgagauguuuucuaguggcaguugaggagaccaaauacccuggguaacuggccagaagaucuccccagcaaucucgugggaggaaaugagagagugguuaaacagcaugcccaagucugucucagcauggggagcagacgugagcuucucagauaaagucaugcaacacuguccuguuauuccaguaccugcuggaguuggcugcuagcuugccuauaguucaucucacuc

SEQ ID NO: 7540 - RNA, 14431 nt, Mus musculus
cugaauuaggaggaaaauuuuuaugugauucaucugacacaaaggaacuuuuaucuagaaugcauaacaaacuuguaaaccuucauaauaaaaggucagacaacccaaugggcaaacacccugaagucucugaagcagauacacagcaaacaugaggaaagaugcuccccagccaucagagaucgcaacuacagggcaaaugagaccuacuccagcuuccucagcuuaagagggcagagagaauucguuacaaaccagcccucaccugcugccggugggaguagaaaaugggacggcucucuuagaaacagcuuggcaaguccccaaagggcuuaaaauaauuaucauaugaccuggaaaacagacuccaagguauaugacagaaaaucaagagacacagccacacaaaacuugcacacaaauuucauagcagcagaacucauaacagcuaaacacacugcaacaagccaaauguccaucaacuaacaaguugcacagcacauucacugcacacgauggaaucuuacaaugggaaggacagaucagguacaaguuacacuaggaauuuguguuuacaaaagcucugaaagaaacaugucaguugugggguaagucaaauuuuucuaagagucuaggucauugaaauuacccuauuuaagaguuaaggugaaaauuaaaaagaaagaaaaaacuuuuaaaaacuuauuauaacaguaauuucagagaguuucuuuaaccaaacacauacauugcaccaggcgcaccuuucacauccguggugcccaagcaucugacacucacaagcuggcuugccaacacugucccugcucccggccuggccugcaccaggguuucuucugugucuccacuuguuagauaauccacaagugcacaugacccauuuagagccaauuaguggguaaucggcgugguuuaaaacaagucuuauguaaugaggggugcaggcugaaauugggaugcuagguccuaggucuugacgaugacagggcaccccugagaugguauuuuuuccuuacaacaucucuugggauuugguuaguuggcaauuagacuccaucuacaggcaugacugagaaagaaaaggcagagggacacauaaaggaaagggguggaaucugcagagagcagagcaaggacaggcagguggaagccaaugaagacaaggccagcaaggccaggacucgucucccagaccaacagucacugacugaagcagcauucucugaggcuccuucucauaccuuccuccagugauuuccaaggacuagugucaaaucacagauguggaaacacagguuuaaaaaguguucuagaaaacuggacaauuccagaggaaacguucaaagcaugaggugaccaaccagugucgauuccgugccgaaagacugaguaacagaguggggcucauguuccaacccagcacuagcugucuucucacucacugcauucuggugcuuuggccucuauggcacuaacuugaggcuggucaguccuuaaccacugccaaaggcccuggagcugccuuuccugagacacccacaacucugagcuguauuccagaguaccucacacccuacaguguucccacagagagagucaaggacaauccuguccuaggaaccaacacggggacuccugguucagaccagaugcuaaagccaugcaugcucagugaggcuggccaauaccuaacuuguccuacuggggugggagagccuaggugaaggcuuugcccacucuugucucaaaccauccuggggcuucccuguguggccugacaaggaccucuuccugggaaacauaaaugacaaauagacucaauaagaggcaucuccugauaggcuggcuucaucaucucuaaaaauagucuacaccuacauuauaaugccauccuacaaagaaaacaguauaccagcaauccaagaacagaaaacccacauccugaagguagcaugacuguagacagagccuaggcucagccaagcaccuccuggguggcuccuaacuuuggagcuacagaaaagcuaagacaggauauaguaugcugcaugugucaggggugggcagcucagauguccagcucuucuuugauggagacacgcagguggcagauacgcagagguuccgggggaccgucaccucgagaggcucccagguagaaguagggccucaccuccccaaagugggcauggaagguauacagauggcaguggcgcucagagucauagaaggauagcucacccuccucacacuccagcuccacacgcagacggcgcggcauggccuggaccagaggggcuguggcagugucggaagucaugcaguggucuccauccacacccugcgugcggcacagguaccagaagccugagcguguaucaugguagcagcugugugaguggccuucaccaccuacgucagccugagccugcgccugugcaugugccugcacccgaaccacacccacucgccagguuggcaggccacccacauccaccucccaagagugggagcccuuggagaacacuugagagccuagcaggcagggugccgaggagaagcgcucuggauucuccacuugcacgcgguagccaugguugaugacacucgugaggucaucagccacuuugagccagccagcagcuguguugggauccaagcugaagggcacuggggacagagagagaagagagagucagcaaacuggacacccuucuucugccaggcuggcugaggucccacauacccuaacgcaugcagggagcugcccuggguuguugggguaguauaggccaaacuaccuccacccccaaaaagauauuuguaaguccuaaacacuaguaccucaggauauaaccuuauuuagaaauagauuagagauaggcacagagagagacagagggagaaaaaagggagcgcaagugagagaauauaugucauuuaaccaaccaaggcaggggccaguugggcaguuacaaccaaggauacccaagcaaugcagcaaaugccaaggucuaagcgccuucccacagaucagaggagcacgguuuugacuauuuccugggaaugagcuuuuagccaucaagaauaugggaacaaauuuuggucauuuaagccaauuuaugguucucuguuacagcagccaaggagacuaacauaggcagggacuaugaagcaggacgguuuacacacucccaggacaccuaagaugaucaaguaacauuccacugaguugaugccacuucuggguauaaaaccagggcacacuggcaggagagaguuggaucuuucaucaugacuguuagacuuaugaagacagaaagaagaguuagccuuucucaagugggucagagcaggaaggcccuuggccccgccuagaaagggcugcagggagagcagcugagaugcuuggccaggccugugcagcacaggaugguuuccauucuccuggagcauggugcugcauguccuuaccagacucaacggauccaagcaucuucuuccagacucgguacugcagggacuccagauacuugcaugcauccauuagcaagccaggcuggagaggagcuggcuccacggugcagaagagccugguaaaggaaggcugggcauuggauggggccacgaccccuggcugcauuuacuacaagcagggaacaggacugcuucccuuaucuccaaccuaaguuuccuggacagcugucccaaagcaggagcccacugggcugccacagcccuucaggauucagcaggaggaucaauccugaauagcugggagacacacagggagguucuccaaccuagcugcugccauccucauggauagaaaucacacuuaggcucaggagagguccaagcugggccuuaauugugcuugaauucaaaagagccaugguguuacauggccuuugcgagcucccacagagacugggaacccaucacaucagcccagagcacuuucucucaucuugacaggacacaacucuuccuuacccaucuuggagagcccagcaagcauccacccacagcaaagcaugccaacgcucuuucccagagguaggaagccagccaaaaaccaagccuguugacgacugagaaacaugagucaugugccuggugcugucaaucccuguggagaguaucgacccucuauguucugaaacaacucccugucuccaugccaaccagaacugggaugucuuuaaagcgcuccccuuggcuggccucuacagcucccucuggauuccacccaguuggacacacuaccugccuagcccuuccaccacuggacagugaaggccuggcuuucuaucuauuuacccuuucccauccccauuggguuugccaacuuaccggcguuuucggcucuuguguuucuggaaagaaaaaaaaaaaaagcagagacaaagacuaagaaacugcagguaauuucugaccaagaauugccagaugucccacacucauggaugagaagaacugacaucauccagcugucacauaccccauggggaucucaucucagauucagugucccccccucaccucccauugaaagucccauggugaggaugcagccaugggagggagaccuugcucgguauacacaaggccuugggccuucuuuggcaaaacuuaaaacugauccuaaaguucauauggaguuucaggaaaugcugaauaaaagcaaccuugaaaaccaccaaguuggaggacucauacucccaaacuucacacuuguuacacaagcugcugugguagagauaucaggaguaaugaggacagaagugacagucuagauaacgcuggaguuucuacaggaccaagguaaguuaauagaacugccuucucagagaacaugucaauacaaccaaaauggggaaagccucugccuugugucagauucaaaacaaaaacaaaaacaaaacaaaacacccuuaaaauacauguaagauuuaaaugcaaaucuaagacggaagagguaagagucauacuggagcagaaaaggaacgaacucucacagcuaaacaaugaacagacaacccuacugaaaacuggauagcugggcacguuagcacacaucucuaguuccugcacucgggaggcagaggcagguguucugaguuugaggccagccugguacagaguaaauuccaggacagccagggcuaccuacacagagauaccccaucuuggggguggggggaacccaaacaaacaaacaaaaaaaaccaaaacaaaaaaaaaaaggaaggaaaaaacuguauaaacaaauuaaacagacauuuaagcaagaacuaguaauguccacaaagccacugaaaagacagaugcccagugucaucagcuauccagagagugcacacuggaagcacaaugagagcccaagugacucacaaggaaagcuauggagaaaagaaguggccaagagguacaggaacuugacacccagacucugcuggugggaagacaaaauaguguagcuacuuugguaaaacugccuagcagcccuuaauggguuaaagcagaauuaucaaguaauccagaaaucccuuggguacacaucgaaaaguucauguccacacaaauccaguacacacacgcuuagagucuuacugcccauaaacagcaaaagcagaaguaacucaagugagaacggaaggccaacugacagguaaaaacgccaugcacgaggggaacacucgccaucaaagggggcugacugauaaacuagcugucaagucugggaaacugcucugcaaggaaggacaaaaucaguaaagggaagaaagacaaugaaucauguuuuuaaaggaagaacagaauuucuuuccugugcacucaugugugugugugugugugugcgcgcgcgcgcagcauuaauacauacgucucauggggccagagguaaaccacagcuuauuccugccuuguucuuuaguacaguguguuucacugcccuggaucgcaccaagcaggcuaggcuggcaggccacuuaguggcuuuuuuuguuggcugguuaguugguuguucucaacuccugaaugcaauagucaaauuguauaauaauuucagcuuaaaaacaaacagagugagccaccaugcucagcuuauuuucuguggcaucuagggaucagacuggcuccuccuacuucacaggcugagccagcuccucagccugaaagcguuagagaaagaaggcagagugcaauccuguacccucacacccauccccaaaacuaaggaaaagauaaaagauaccucagugagaguacuugucauucacaaagccuaagcuacagauccagcacugcacagugagggagggagggagggagggagggagaaaagcaagaaagacagaggagaaagcaaacaacaaagcaacaaauaaacaaaacaaacaacaacaacaacggagccagcuaaauggcucagcagguuaaggugcuugcugucaagcuuagcaacuucaguuuggucugugggacccacgugguaaaagaagaccgacugacuuccauacaggcacucugcaauguguacccauagagacaguuugacauggcccccauagguccauagagaggggcaguauaggagguguggccuucucggaggaagugugucacagggggaugaagcucaagccagacccaguggcucacucucucuuccugcugccuacugauccagauguagaacucucaacucccucucuagcaccaugucugcuugugugcugccaugcuucccaccauaaugacaauggauuaaaccucugaacuguacgccagccccaguuaggcauuuuccuuuauaagaguugcugugguaauggugucucuucauaguaaaugaacccuaagacacucaucuacaguaaauaaauaaaaauguaauaaaaauuuuaaagcuuaaauuauuacacaauuugacuauuucauuagagauagagagauaaccaaucaaagaauaagaaagcagcaacaguaaggggcggaggugaagguaagaggguauucucaaccgccaagccuugcucugccacaaggcaugccaauaaggcccuccaccaucacagaaagacuguugaacauggucuguggucugagcugcuggccccugacccugaccccacccucaguucacacgaugagccucuuaccaugaggaaggucaugucaucuuccuucaucuccaucugcagacgcucaaucucccgagccagcgccucggucuguucugcuagcugcuucaucuucuccucagccugcaggugcuucuuucugcucucuuccuucauggcauccaagguggccuguuccuccacccucaggaaaucacggagcuugucaaacucaucccggaugcggccuuccagccaagucguuugcaccuacaccagaggagggagaagcaagcaaggucagauguaauggcuuugggacgccccagcuggggaccacuuucagcaaagcaacucaaugcucuaggugugacaugaagagccccaaagacagagaugggugggccaaugccagggacucauccucccuccccucucgguccucccaggcuuccuaccuggcccagccauguugagguuuggucuuuugcuauguauuauaaugcuaaauacugcccccuacccacccacccaaggcugguugacuucaggaccaagauaaucaguaccuagaccugacugacucuguaaccuugucccccaaguuaucccugauuggugaauaaagaugccaacagccuguagcugggcaaaagaaagaggcggguguuuuugguuccugggcucagucaggguuaaaggaagagaccaugagaaaggagaaacagaagacagucuuaggguagacucaugaaaacauggccaugagggcuggccaaguggaacuaagagcugcccagauggaacaaugcaaauuauaacucaggguuauugaugggaaguaaacucucauagcuagaguaguuagcuacccagcuuuagugcuaauuaaggcuuauuauaaauagagaaguugugcaucuuuuaucugggaacugaacaaccaaagguggggcagaaaccucuacugagauuaaauauuuacaaagcaaucucaccucauugugcuuggcaauggccucauaggugcgccucagggcccagaaggccuuggcuuucucucgcaauacaugcuccauguucuuacacuuggccuaauguggggaauacaggacaaauuagaacuagaguuccucuguggaguccgaccacaagccagugugcuccaagugcuguucagcauagccccaaccuugaacggcgcugcuucccaccucagggucucuaacccagcccuggagaggagacaccuggugcagguggggagcagggcucagggguuccaggagcucugcccaacuggccacaguacagcagagaacagcaagcuccagcuuaugucugcuccuagaaggcuagaccuguggggauaccaucaagaugccauggccacugguucacucuggagucuucccaacuggacucuucuacagccuuuaugaaaaggguugucaguguggacuguugcagucauuucccaagagguaaaauauucaaaugaacuuucaccuaaacauggcuccacauccaccuuuucccgauaaugguguuaggacaagaaacacagcaaacucacuuuuuuuuuuuuccuguauguuuuacuuucugacauggggcuuacuccagggcacaggcuagccuaaacucacuaaguggccaagcuguucuaggacccacagugagccuucugccaaguggugggaucaugggcauaagcaaucacacccaacucuuguccuuccuacuuuuuuuuuuggggggggggguccagacguacucuguggcaugcauggccccacaugcucuugaaagcuguguagguaggugucccacucuuuucauucccaucacaaucugucauuuugucuuuuuagagaauuucaccauuaucccuugccuuucucuccaagcccuccuugcuuccuuucaaauucauagcccuucucacauaucaucauaugcauacacuuauauacacauaaucuccuagcuaacccugcucagucuguguauauuccuuguaaaugugcuguucaggaguggauauuugguauuggauaaccagcuggugugcucuucccccagggaacuacacccccaccacaucaguugccuauaguucucuguguagggcugcugguccgugaccuuccgccauccacucuggaauguccacucacgcugccccuguugagcccuugcucaggcagucauuggcgagacaugggguucacucuugacaaucccaggagacagacccacagccaacucacugauugucuggcuuuuccucaauguccccugagccuuagacuaccauaauccagacaaaguaucucauuaaaucuagagcuaggccuacccagcaauuccuaagaaccuccuuauucugccccauaacagagcuaaaguugagguaaucaugugaucucacuuuuuauguuagaauuggaacuugagccaagcacucaguaaguacuuacccauuuagccaucuaucuugcauccugcuuaauuuuaaaaaauaaaaucacuuuuguuuuaaugaacacacauauauaucaauuuaaggaaggugcucaaacacuugguuuuuugaagauuuuuauuuuauguguguuuuucccacaugugucugugaagugcguuuguggcuugugcccagugcccagaagagaauguuagauuccuugguacuggaguuucagacuguugugagcuuccauguaggugccaggaacaagacucaggugcucuguaagggcagccagugcucuuaaccgccucagcaacucuccauccccucaaugcuuuuacauuuuuuaauuguugcugcuaagcuggaauucggaagaaacacuuuugaguuuuaaguuggguucuuauuaccuuuugcauccaaggccuauuaacuucucuccacuuuuauccuuuccucucuacauuccauaaauguguuauaggcuuuuccagaaacaaauccaguguuaauuacaauggcgaccuccguccacugagcacucgcuaugcccccguccgcacucauccgcgcacugugggucacuucguuaccacauucguucucuccaguaaguacauuagaggccacuccagggaagggaaucggaagugcaccggggaagcacccugcucucuccaagagugugaaccucaauuuggauuaagguugacagaaaacucacaacucuuugccaaggacaaagauuucauuucaccaaugcaaacaaccucaaacuaaucucccagcuagaauggcacugauucuaguuuuacugagacgcaguaugccaacuuccuuuggucacugcuuauaugaggaacuuuauccguauacacauaagcaauagcacaucuaagccauacugcugggauacuuuucccuuugagaagaaacgugggguuggggaggcgagucagccaguaaagugugugaaguaggagaaccucaauucugguccugagcacccacauaccuguagucucagcucuggaucccuggaguucaauggccaaaccuagcucaaaauggagauucagaucuagugugaggcccggugucaaaauuuaacgagagagagaucaaggaaaggcugaccuugccuaccucuagccccugcauacauacacacaccacaaccccauuaacacacacacacacacacacacacacacacacacacacacaaagugugucuaugcaaaccugugaccacuguacucgaggacuuccucuggucccucugagcauucagguuuuuuucuugagcucuggauugauccgcuaugacauguuccaaaaucuugucacccuuccuuccaucaggucccacugcaucaggacaaagucccagcucaucaccaucccccucagugucccaugaaugugucugccccgccguagugauagaaaaacgaacacacacaaccuuuauuacuuuugcaggacugugaaccacaaacccaacaggacaaccagagaaaagaauucuucauuuugcugcucugaaagugucagcuuugucccucacaggggugggaguauggggggggggggaccagagguggccaagaagcagagauaggagcuuuaggacacagccuccaagaacaguuccacaaacugccuuccucaagcuaggcccugucuccuaccuuaccuaaccuccucaggaggccaucaagugaugaaccaggauucacucacagggucagggucccauucuuggaacacuugcaggcacucaagaaguuguacuuuacugccacagucaagauuaacccucauacagcuucagggguucuguggacaguaaauuuuguuaauacuucagggcaccuaacacagaguaagaaauccucagagauuauugcugcuggguuaucaacacggaggccaaagggaucuuucuaagcacccaccucugggauuccugaggguacccggcagggccaagcuuagucaaucucaccauucuuaccugacagugggucauuccuaugcugccugcucccuuaacaagccauacccaucuccaaccacacugaaccagcuuaucuaaugacugccucaccaacuccucugaaaugucgacuacugcaaacaguguucuuguuugguuucugcugccaugacaaccaaaaagcaacucugggaagaaagggucuauuacagcuuauauuuccuagucauacuccaccacugagggauaucagggcaggaaaucaagcaaaacuaauguagaaauuauggaaauaauggagguaugcugucuauaagacauccccucugauugguauggaagagcccacguuggccuuacacuacccaggcaggaccaauguacugggcccucccacacccaucaccaaucuagacaaucucucugacuggcugauccauuugaggcaauccuucaacugaaauccccucagacgacccuaggcugugucaagaugaaauugaguagaacaggggggcugucuugcggacuuaagcagccgcaauaucuagaacagggugugagaaucaaagagguucuuaggauguuuauuucacacaugaauacaucaugaagaggccacacugcaucuggcugagcacacagccugaggacuccugggaucuuucagaucagccccacucccugcucuucaaggcucacucacacugagcacccacuggcuuugcaccaccauucuaagaugcagaauaagacuucagccuucuggccucaccugguguccaaagcuuccucucuucuagaaucuucuauaugcugcagcaucuucuugcaaaaaccuccccucaccuccuucaccugguuaaugccucuagguucuuuagauuuuugcuagaagcucccagagagugggaauuauuaccaccuaucucacuuccagugucccucggaccuccuaaucaaaacgaggcagccagcaagaacagaaggcagucuccaggcccacacgcucucuguccccuggaucacaggccuucgguugauguuuuaccccauucugaggacaccacccaugcuaaucaguaccuuugcuagcccaggggaauucgaaccaggaccuaaacuucuaggcugucuauuucagcuaugccaaauaagagaucuagcacuaaugaacgagggaacaggcacuaugaaccacugcugagcuaauaugauggauaacuggaggaacguggauguagacagcacccaucugcucugcuuccaaucuguauggagcugccaucaacugcugauucucaaaaaaagacauuucaccaaguggagaaagggcgucugaagaucaggcccagugggcucuuacaguaccuccuuuucacuaugucaggcuuccuaguggcuaacccugggcccucccaacugugggucugacccguguguuaguggcugaugaaacaaauuuagcuguuucaguacaucaaugacuuuaaacgagaaaaguaacaagauacugccagaguaaaauggacauuucagaaacccuuuaaaaaaagaaaaaucagucaauaugucaguaugaauguuuuggaaagcaauggagcaugcauaucuaagcgauuaggucaaauuguuaucgaaaaugucugccuuuuuuuuuuuuuuuuuucuguuuuagaacaaagacuuuuucacugggccugguggcacaagccugcaaucucagccacucgaaaggcugaggcaagcaaagaaaaguucaaggccauccuggcuaauuuaagagcuuggcucaaaaucaaaaguaggcuuggggugcagcugcgagguaaaguacuugccuagcgugaucuccuacagccccgacacccacccuuccccgccaugcuaguuuugcugugucagcugcucuugguuuaauuauaaccacuggaacuccagauauuuggauacuaagaguaagaggagcaaggcagcaggcaagcgccacaggccuuucuuacggcucuguaacccguugaucaaggcacugcugggcaggggaaaucucaaggccuuagaacucugcuagguccuggccucuuccauuucuaaaaugaccgcgccaagcccaaaugucugcagaccauacuauuccccaucguuguucagauuggccuggaccgggggcaagaugguugcuaggccuggaggagggggaggggcaggccggggguccccagggcgggcuggcgcggugcucacccggaagucuugcgcaguguccuugaugggcugcacacgaugcucuuggugccgggcgucggccuggcaagcacagcacagcagcuccuuguccuccaggcagaagagcgugagcggggcacggugcgcacggcaggggcgcggggaccggcgaccgguccagcgcgcgcccucagccuccucgcgcagcaaggucuccaccagguuguugagcgugugguuggugcgcagcuccccgggcaccgcucguuccuugcacaccggacacgagggcgucgucugcaccucccagcagccgcucacgcaccggcggcagaaguuguggccacagcgcagaguuacugcgucgcggaacgggucguagcacacggcacacagcagcuccucuuugaaggagcgcgaaggccccggggacacagaagggcccggcuccaucgcaggagcagccgccgucaccaccaccggugucgccgccuucaugccuagccugcgggcguugucccugcugaagaucugggagcuuaaggcggcuccaaccaaucacggaugggcuuu

SEQ ID NO: 7541 - RNA, 66577 nt, Mus musculus
cuuuuauugcuguaguuuauuuccacccccuucccuccuguucucucucccucuuucuuuuuuccgcccuagcuggaucuguguuggaggagaggaaaagagacagaggauugcaucuguuuugaaaucuccuaauagcaagaccaguuaagggauuguaccuuuuuccuacaaauauaaauauauauauauuuuaaaccaagucuuuuuuuuuccggcuaucuuugcuuuaaagcuguccucuugagauuacuuccucccgccccccggagagaugucuuaucaggggaagaaaaauauuccacgcaucacgguaaguuugguacuugagaaaggcgagcaaccuuuugugacauagacuaucuaagaaauguauuucaaaggcgaaggaaagagacucaacuuuuccuucuuguugccaacguaggcgaugguggugaagguggggguugggguugaagaugcaauaacaguuauaaggcacgcaauuugcaaggcauugaaauaggugcgaggaugcauggagguagccuuggguagcgcgccagauccgcuguaucuuucauugucagcacgagaugcugcagcgcugcccgcggggugcaagcaaauggaugccagauugaauaugcauggucgacgcucugauauuguucuccgacugcgagcggagaggcugggauccgggagcuuggggguguggggagcugggaaaacagauucucccguuucuuccgcccccuccagaaagagcuuucuggagccuuccuccugugagaaagagcgaguuccagcccggaggcgucaugacagggagggaugcuggaaagggcagggugaaccgggaugaugaggagggacucaaugaugagcagagaagggcgggagcuuuuuguggacgcggaggacccguggaacccucugguuugaggcuggggucuuggcaggguuuccggcucucuuuuucgucuuuucugcuccuuccgccaccagggaggcggccgugguggcgcauacaaagcgggcugggcgggugggcgcuggggacagcagcgagcaagcucgcggagguaauggcgcuggcugcgacucgcgucucacgcagauggcccggcugguuccagacaaugaucgugguggccgagaugccguccucuuucagggccuccauccccgacaagcaccucugcgaggaauuuacgaugcuucggggaugcagaggguggugcccugcccucccccucucuuugcaucuuuuacugaaaaaaaaaaaaucucaccagucuaauuuucuacauccuuggagauuccaggcagggagaaucgccaaggaaauucauuguuauauaaugcugugcgauagcacuggccagguuggacccagggauaugcagaugcgaaggcaucucaaauagggaagaugaguuuuaaggcgggauuugaggaugagauuuugcucugcuugucucugggacccugggaccucggccucuuuuuccuuggugcacaaggacacacccaucugcaguaggaacuguugcccagaggagggggcgugugccugagguuucuagcuugggcugaguuguuuuuaggcgaggguggguacuagccuuuucucaaggcaccccaccccccaacccucgcgcgcaaauccucgguaccagaucccaaagggcugacacaccggaugcauguuaaauguucaucgcgcugaaggauggcaucugagcaguggggguggggagauuuccagcaaaccucacgauuugcuguuuucgugcacgaucaagacaaaaaucuuuugacaguauggaaggggaaaauaggcaaccaacaagacuacuuuuuaaaagagugcccucuccauucuuuaaaguuaucuaguucugugcccuaggaccuauuaguucaaucccucugucacuguggccagucucuuauguaagaagccuucuagaaggcucuagguugaacagacuauaauuccgacuccccucccccgcccguuggcugggaacucacagugauguuuugugacagguauugcuaugaggaaggggaggugguaaagagcaggacuucuugacucccacaccacagccaguucccucaggggagaaaggagggacccuugcaggcugaagccucaguuuccucacagucauagaaucuugcuccauucacuccagagaaguuccaaggcucugauagcaugauauguaugugggguagguuuaauaaagauuuuuuuuuuuguuuacccucuccguguugaugguuuucaagggcuuucccaaugccuucaccugaauagaugacccuacaguguaaaacuaaacugaucuaguuuuucaacuuaacagaaacaauaaacauuuuccaagcccaauaauggcuacauuugugcgccacuguaucuuguuuucuuuguucuguagcauucuaugaaucuuuuaaggaaacucuauaguuuccuuuucuugguaguugcaaaaugcaaguggcacuuucugagauuguacuuuguaaccgaguucuggguugacucuuaucuagaugaaugcuguucugaaaagugcaguguagggcauggcucugcuuguacaguuuauaccuauucugaaauaauaaaccuguacauccucccagcccgagguggugacacugcaugcaucccgcccacaguauuuuggauagcugugcaucagaacaaagcguuuuuuuuuuuuuuuuuuuuuuuuuuucauacucuuggcuuuuucaguuggauuaucguuauuuauuuauuuauuuauuuacuuacuuuacauaaaaguggaccaaccaucuguagugguauuagacauaaaaucccccgcaucucuaauuuaucaugaagcucuguuucuaccuguuaaauggguguguguuuuuauagccccuccccugcccacugcacuugcugugauucaccacacagauaaaugaggacggaguggacgcgcugagcugaaaacuuguuauggccgauguuccuguguuuguguagcaucugcuaugacaacagacuuuuggucaguuuuccccgacaaaaacuuugccaagacaugacuuuccuacauguggguggaauuuucuuuaauuaauuauuuuuuaaaagaugagguuuagccaaauauaauuucagaaggauugucuuccuuugcugggguguucuguaaugccccuuuuguuuuggacucuaaggcguucuuuaaaaggugguuguuugucaggggugagcgcugucagugccuucugaugaaucaggcaaugaacggcuugucuagcguagguucaccuugguuaagguaccuuccaaaaucuccuggcuuugagcaucacucuugaaugguaaaaagcaugcccuucaccucccuuuccucgggacugauugaugcuucuccugcggcaguuauguguugugacuugguuccccucucuguuacagagcgaucgucuucugaucaaagguggcaagauugugaaugaugaccaguccuucuaugcagacauauacauggaagauggguugaucaaguaaguacgauucauugcuauguggagguguguguauguguguguguguguguguguguguguguguguguauguauguguauauauacaugcauucccccccccccuucccaguguuccuaagcuuccacuucuuucauguaguagucucaagcuuuaaugacuccaagagucacugagcuugggcugggaauguuguaacauugguagaaugugcaucuggcaucagucaggcacugccaagaaccaaaaagugaccaauuuagcauauuuuaagcuuguuuuuauuggugguaauuaauaaauuuggagauucagauucggggaauucgaagucacagcacacacaaacacccauguauuauguaaucuacuauuuuuaacagaggugacccagcgucccccuguugccaguucauauacuugguuugugauaggcuacacugcaguuauuugggauggaguacucaggcauaggacauaaauguggaaugcagcugcagccuguccuguuaagauguguaucugcuugcuuagucaggaagggccacaggacacugaguuaauuaccagcaccucagacaaaugacugccuaaucuuagaaggauuuuagauuucauuucuuuauuuguuuaaaaaaauuucuuguagauuuauuucauguauaugaauauguugcuucuguguauguaugugcaccaugggugugccuguugugcccuugaaagucagaagagggcauuggauccugugaaacaggaugguugugagccaccuuguggguguggggaauugaaccuauguccuuuggaagagaagcaagugaucuuaauccuugagccaucucuccggcccuaagguucaauucuugaagugguuccuagcacagauaagaccacucuguguugcuugugcacuggguucugaguuuggguauuuugggacucuggaggguuaauugaacaguguacaacaauaucuucaugccuuuccucuggggacagcucacaggcucuggagagagagagagcacaucugcucaaagacaaacaucacagggaaugacaucuuguaaauaagcaguguucaucaaacuccagcagcaagugagccuggagaagggcgagcuggacaggcucugauugcuuggaagcucauauccugacuuaggaagccaaaauggaucuuaguguuuccauagcuaaugcuuucuccauguguguuugucuguaacagucccagcuuugagcaaucacaggcuaugacuuucuuauuccuuuggcaucccagucauaggagagugugaugggucuggcugaaggacacuggcuuggaauggaacagccugaugauacuauuuuuaggauaguucacuugucugagaaauucagcucuuccuuuauucauucuucuuuuuaaaaauugguggaaagauguaguaaaauuaaaaaaaaaaauuuuuuuuuuuaauaggaugaggagaucuugucucaaggauaaaacucuacagccgggugugguagcacacacuuuucaaucccacaucuucggagguauaggcaggcuguucucugaguuugagauuaacuuggucuacauagugaguucuagggcagccagggcucugagagagacacuaucucagauacaacacaacacacaaaaaccucacaaacagaaagagccgccacaagccccccuucccccaguggguaugaugagcguccccagcaccgccaccauggauguuuguuuucuuaccuuuaucugaguccaugagcaccugcuuuccacauuguaguugcuggaauuacaguguuuacuuuuuccuuuuuuuuuuuuuuuuugcuuuugcucucucucucucuauccacucuaccaccuccauuuuucccacauugaaaaggaaaaauagggcaaacagauguugggagagagagucagcucuagagugaguuguuauuggaaaacuagccgaauggggguugucgggagauggcggagcgaauguuaugcaaguguuuuggggcuuugucauuauucaaucuuagagguuucugauaacuuggcauugaauggggaauuugcugccucguguaaguuaccguuggguuuaguccaggugggcuaggaacucacucuguagccaaggcugaccuugaacuagauauaauucucaugucagccuuucaagcgcugggauuauaugagccccugugccuagcuuccuaguucauucugcaugaaggugagaaugaggaugaggagugggcgggggcucccaugaaagauuagaguaacaacccaaaaagcacucgucgugcagggaagguaugcuuacaguuuaaugaaaacagauugucagauccaauuugguuccacauuucccuggcaccucucucucaccaacucugcuuucuuaggcaaauaggagaaaaccugauuguaccaggaggggugaagaccaucgaagcccacuccagaauggugauucccggagggauugacgugcauacucgcuuccagaugccugaccagggaaugacauccgcugaugacuucuuccagggaaccaaggcggcccuggccgggggaaccaccaugaucaguaagacuugggcgccaucaguuuuaaccuggauucagggcagucugaaaaugagccugugacacuagaaucuucccuugggugaacggagcagagguuugaucuacccaauaaggagaccacagagagugaacugucuuuauuuccuuagccuuacuuucuccuaagcuuuguuccugcaguugaacgugauggugagcuucuacgaaaagguagaggaugagaggaggccuagcugcuugauugucuuugacacuuuuguccuccuugaccucaaaaugugucuggguuaugaaaguauggcauuugaagucauaaauauuagauuauaaaacuuauaaggauucuucucagaaugaagauagaauagggaagaauuuucuguuuuuuuuuuucuuuuguuuguuuguuuuuucuuuuucuuuuuuuuuuucagacaaggucuuaaguagcccaggcuggccucaaucccucuguauuauaccugagguuuguuccugaucuucaugucccugccucccaaaugcuggggugauaggcauaugccaccacacucagacgcaauggcguguucgacugaaaccucuauuccaaugacagggagguccaucaagggaguacuauucuauucugcucuggacacugaaugagaugggcuacugugcugggaacaagacccacugauaugcuuugucugugagauaggaaagcuguaggcacccacaguggugugcuuuuauggcgucccucucaggguuuuguguucuugauucaaccaagucuaaaguguauucgccagacaaggcagcuguguucagagcuugcuugugagugguuugaguccagcaagccuuuugacuggugggcugggggaggugaaggagcugcacaguggccuagcagaguccuuuguuagaaagggacguuguccaaagacguccaaagaaagaacugacguugucaguucucugugucauggagggaaaguuuagcgggguugggaccaacacugaaagagccccacaguuugugcuuuuugaggccugucuuccuggguguuuuuucagugaugacuguggcuuugggggucucaucauuuuccugaaaccagaggcguaauguccuguggcuccugcauuuuaaauuagaaccagcucccuguuguuccuaucauccugguuuucagucugaaguguuggggacagcccucuguucccagacagauccuccaggggugguucuugccgcucugccuugggagugacguucuugggagagccuuucauggauagccccaucuuggcuugcuggucucuuuggcuucuuggcaucccacugacugagcggucacuuccugaucccuccccauuuuuuuuuucugagugaaccaaaagaaauccagaccacucuaauaucagauagaaaggccaaaucagggugguaaccagccuugaguugaaguggacaccaaggaggccugugcuguggccucuguggauuagcauuccacagacaacauuuucccagggaguggucgguuacaauaagcauugccaugccucugugacaggaaaguacccuucacuaggaaucaggagucuagggaucuggucucuucucagcaugaacuugcugggcauuagaucucaucuguacaguaaguauuuacauagcuaauacuuucuucucauucccacacuuaacaaugcaauauauauauauauacacacacauauacacacacgcacacacacacauauauacauauacacacucauauauacauauaugcaaauauauuuauauaaauauacuuauuuauauauaagcuauauauaaauauauauaaacauaauuauguaucuauuuuccuguagccaccuguacuuuguucugcaggugcagaagggcuuguuuccucucagacuuauugggaagccagaggagggccuggcaugcauuaccuaucacuuccuccugucucugccauugcuccuucacuccuugcacuuggucugagcuucagcuccagucugcuggaacuugugccuucccaucccuccccugcugcaggccauaucccuucuugcuacccugacgucccuuuggccgucucacucccuuacucaguaccugugggcuucucauuccuucccuggguggaggcaccgucccuuacgaugaucacuauggggagagggcacaacagcuggcucugucuuuugguauggcaugugauagcgccaguuuggguuuaagaugcaguccauuuggcuuaauagcaagggggcucgaugaacgaacagaugaacgaacaaccucauggaacaagggccaagccuaucucucagcaguagaacuugcauauuugagguccugaguuugaaucacagguuguaaaaccuggguagagccacaccuuaugaaagguggaaagggaaagacagaggguaaucaggugauauggugugcuccgagcugucacacccagccucugucaaauuuuguaguuugugaaaaaaugccagugacucaugaaaaacuucaucaugguugcugaugaggacaggauacucagcagcccacugccuuuccccuggagaggagcuguaaugugcaggugagaaaucgagauuauuuccccuguauucugcuugcugggugcacauacauucuucuuggcuuaaguguguggccaaagcuugcucugcagggcaggggcauagcuucaaggaacucagggcacacuucuuuaaagagcccccuagcuuccuggauacacauugagccagaagggaaggcuuuggguguuuucaguugaugagccucuggcuguuguagaaacggcagcugggugaacugcuacaaagacugcccaccccgucucccucuccuccucucaccuccucuaaucccugucagcugcacaggggggugaaucuucaccucucuccuugcuggcuuugguuuuucugucccuggaggcucuguuuccaucuggcaaggcucuacuugcugaagaagaugcagccgaauguuacaguguaaagaaggugacauaucaccagauuacuagcagaacaugucauuaccauaaagccaagcuccucuugggcuuuacacaaugggaccuuugugagggacccagaggagggugguagggugcccuuugcccuuucuguccagggaugggugggcagagacaccagacauaaucagcugguggcauccagacuggccccacagucguggugguugguggcuggagguggcugcuugugugggugacuggaaugcugcuuuagagaaauggggauugguucuacgacccccacaaggauacuaaaauuugagagcacgcaagucucuuauguaagaauggcauaguauuuacaugucuccuacacacaacuuccuggagacuuggaauaaccucuaaauuauuccuaaugccugauaacaauauaaaugcuggaggaaauuguuguccagcuguguuauuucaggguguguccuaguuugcuuuccuguggcugugauaaacacgaugaccagaagcaucuuguggaggaaaggguuuaagucaacuuaugcuuccaggucacaguccaucuucgagagaagucaggacagcaacucaagcagaaacucugggggaauacugcuuacugcuccuucugccucgcgcuuaacugacuuucuuauacagcccaggccugccugcuuagggauggugcugcccacagugggcggggcccucucacguugaucauuggccacaggccaaucugauggaggcaauucuccaguugagguucugucuccccaggggacucuguguugucaaguuugcaacaaaauaaccagcacaggacuugaugacaagaaaaguccacacauguucaguaagaugaaauaaaaggaaaaaaaaauggacccgggauuaguugauuuaucagauuuacuacgugaauacagagcacaguugagcucuccgaagcccgugcuggcuucucaggacaaaucuccaaggacagaaguuacugugcugaccuaaguucaaggcuuuuccuggagguguggaaccugggcacagugcaccccggugacuccucugcugugucuccagugcccaauuccagagcacugccucaugguuacgcuggcuugguucccagagucuccuuggaucuucaggaguucuagugcauguugcucuauuuccacauuugcuuucuguuccugucguuugaccccagcccucuguggcuggaaucuuucucuccaggcuuugcucuugcugucucuuuucucugaauccuucagugguccccucagagaacacaacccaaguuaucugcaauguggugcuaaccugcuacccagccuccacucccaugguuuuuuuuuuuuuuuuuuuuuuuuugguuuuucgagacaggcuuucucuguauagcccuggcuguccuggaucucccgcuguagaccaggcuggccuggaacucagaaauccaccugccucugcaucccaaguacugggauuaaaggcaagcaucaccacugcccggcucccauugacuucuugauuguccucucgucugccuaugagaauccuuacucccucugagguucagcaucggugcccucugccugcagucuauaacuucuuugaauccuggcaaaagaugggcuuuuaucucauccuuugugacacuuaguuucuuguggugugucuuuugagaccuuuuguuuuguuuucaaguuucccacccaaccagugucagugcuaagagggauggaugagagcuggcuggcuagcuggcugaauaaauaaaagaaaacucaaaggagccuugauuugagugaugcugugugacugagccagguguguuucaaagacacccgccugucuugugcucacuaugaugacagaggcugcucuagccacacaaaccacccaccaccaauaccagugccaugcucagcucugccagcaguuggggagagcccagagcucaggcguguaagccugugguuguggacuaggcaggcucuuucccugaccuguucuuggguaagugcucaugauggucugcauagcaaagagagcuugcuuucugaggacuguagcuguaggagaagucacaugacccuagagacccugcuggacccuuugggcuuguccuaggccucuugguggauggaggaaacuugagaggacguggcucaggagugccacugugguacauccguugcuugucauuuguucauccauguggcauucggguuugcuccccgccaguggcaagccuacgugugaacacacaguguaagcuggcugugucuguaauagauacuuugauuauucccuuuguagggcucauuugacucugguuagaaaguguuuagagaacacccaaccacaucacacugaaguuuccaaguccaggacuaaaguugucaccacagaaucugccuguggucugauuuagaaaagccacgcuauccaauggacuguccgagugggugcacccugcccacccccacccccaccccccagcuucuuaucucucccaagccucacauggauuaagucacaccauucaccuaaggacaugaaggccuuuucuagaccugcucaggugucauuggguggcuggauuggaagguuuuguccauggcugggccaaucacuugcuaucuguugcugaggacaauagggagacguguccuggaggagagcagaggucuucccaaugguccagaaaucaugucugcaauggauucucucuugaaggagcccuggcugucucucuuguauccucuuuuugagcuggcagacauagccuuaagggucaaucaauccggcuuaggaagggauggucuccaucuccugaaacgucccccuccuccuggaucccagucucugcucuguuccuggggcuugacacagaccugggagagucucagcucugagaugcuuccagaacuccccaguuuuccccagaguuuucagacuguugggaacuuuccauccgucccguuagugagagugaacuccagaagaacaacagcaggagaacagcacuuccucuggcuucuguauuggugacuuuucagucacuauaauaaaauaccaugaccaguguaacguacaggaggaacggcuuauuuuguuuuaugggcccagagaaauaagcguucauuauagcggugaggccuggcagcaagcaagcaugguggcaggagaaagaaacuacucagccaucagcgcaaagcagagagcaaaugaaguggccugaggauuuuagaagggagggagggaaggagggaaggggggagagaaagagagaaagagagagagagagagagagagagagagagagagagagagagagagggagagagagagaaagagagcugcucaugcaggauacacacacacacacacacacacacacacacacagacaauaagugguacauaauacuuaaaaaacaaaacugagugccuuggggcauggugggccaggagauguguuguuuuccuccugguugauagcucuguccuaagucacucccuuacgguucuuuaccucuuugagcagccaguuuuuuuuuuuguuuuguuuuuuguuuuguuuuguuuuguuuuguuuuuguuuuuucuacuucuucccuuauuucuuugggcuuugagggcucugucucagauuugcugccguuguugggugaagccacucauucagauucuuugccauuagucagccucacugccgugguuaaugauaaagggggauucuggggaguagagauuaggguucuuucugguuaacccauuugggaggcagcccuuuuacaaugugacugaauguuccccuaaugauagagcggaugcugccugaaguggggucgugguggcccaggccucuccagcaaagagaauuuugcagugaucucuggacaaaauuaaagagucugacugcacauucagacccccuggggagugguuuuuuuuuuuuuuuaaauacugcagacacagaaucuucuggugaaguggacugaaugaauauaaguucacacaggucucuagaagccagagguucccucugggcucuguuuccugcucugcccucuucucuuugcaagaggaggggcuucacugcuauggccugguuggggguguggcuugcauagccagugccucaagaaucuugggaaacaacuggaaaggagccuccggauucaguuugcuguccuuggugucuaaaagguuucacuuggcuccuuccccagcacugguuaggauagggagugagugggaaagugagugggugggaacugggauaagaggagcacguggcagaaguaccuuggcuggcuuggugacugccaucuccagcuccgugggccacccguugugcugcguuucugcagucuuagauugacugagucguguuuaugaccuagucucccucuaaugauaggucagagcuggaguccuugcuuguggggagccugcgugcaaggaaucaaaugaucuugguaaugacauagaaucaggguacuccgggcaaccauugagaucuguccuagcuccgcucuuguggcuaggaggaacucacuggccacuucagaggaugagcuucaugugacaggcaguaucaggagagcaccaagaaccagcucugagcugguuuucccaugugcuacuuacucgacguuuggaagccaccauccuaaugucuuuccagguagcaauuuuacaucugugagaauggcuagguuguucucucacgcuuauguacagaauaagugagauuugugcauuuuuaaaaacaugcuauuuacaaaugguugcugugauguuucuggugugugugacucucauguaguuuauccaucuucaucuguuagucuacccagugucucucagcuauguauucuuagcaauccacgucuaccuauuaccugccuauauuuaucaucuaucuuuuuucuguaaucuauaaguugucuauaauauauaucugccacuuaucuuuaucuaucuaucuaucuaucuaucuaucuaucuaucuaucuaucuaaccuaaguaucuauguauauauguauguauguauguauguauguauguauguauguaucugccaucuguugaaucuauugggaaauaucucucucucucucucucacacacacacacacacacacacacacacacacacacacacacacacaccuacuuaccuacuacccugggcuauuaugacaaaauaucauauggggcaguuuauaaaccacagaaaucuacuucucagaguuguggaugcuggggaguacagcaucaagacaugagaaaaugugaugucuugugagggccuguuuuaugaguuauagacacugugcccucacaugguggaaauuguugggggguaguuauggcagcguuagcaguucuaugaucacuuccuaaagccccgccuccuaaugcuauccuccuaggggugggauuucaacauaagaaauuuggggggggggcacuacucuucuccaggucauagcucagucugugacccauccaucuaucuccugucugucuuuuaucuauucaucucuuuuaauuaaucugucacauaugcaucgaucuacuguguuuauuggcaucucuguaauuuacuguaguauuaaaugugucuguaccuauuuauaaucuauugaauuacccauccgugugucuugucugucauucaucgaaacugucucucccaucagucaucugucugucucuuccgaauggaggaugcagucaccuacugccugaaugugugcugagacacaguauuugauaagaucaggaagaguucaaagucuguuuuguggcgaagccuauguaaagcaguuccucuuggcuuuguagauguaaauuugugcccaggacacuuuccucacuggaucucaguugucuuuggaaauccaagaaggccagugcugcgccucuucugagcugcugugcacacugagcccugugguuuucaugguggaccuguuaccuggucuguaucuuaguguccauuucgccaugagcugguacuagcauccucugcuccacccuccuguccuguaacuuggugaggauccuaggauacagucccgagucuuucuucugccagccuuagugacagauccuuuccaguggguauuuuggcuaaggaaccauuuagucauauagugccuacaacucagggaagugggcuugggaagggccugacagaaagcagagcucugucucuucuggguggacacugcgggcugugucuuccugucucauagcaucaaaccagaggaugacaucauggcucccauggugccgugaguggcugguuccggaaggugcuauagcagacaccucuacuguucuucuuuagcugguaguuguuacuaucauuauuuauucugcaccuuaauucauuaucaauacaaaucauaacagauaaagccaggcugaauacagccacuauuaaaccugggagggaaagaagguuucucuucaggguuugaacuggggaccugauaggaagucacagcuuaaguaaggagucuugguuguguguugggucauuuugugcaacuccguggaacaucucuaaggacaaacauuuaagguccugucugauggaugcacuucaaccuauuuccuauuaauguaacaucggggcaaggugcaggccagacugacccaaacaaaggaaggcauguguggacuauuaaggugcucuccuguuuuguucccuuguccucugacgagcucugccaaugaccucacagaugcuuucuggaccuucuccauagacauacaauacccgggaagaaaguuuauuugcaaguagagauuauuaauuaagugcucugagaauuugcaaacccugggcccucauuuccuguccuguccucccuuugaccuugaaggucaagagcugacuacccagcuaggacugaaggauugggaggaagcccagagaugacuacggacuugcuucauuacugugagucuagcuaagguuccgauccaagcuccgacauugugcagauaggagucagagaggucacgcagcaaggaagcgaggcagccagcacuagagguccacagagcuccacaucugcagugcugggauuuuauugaccaccaccacguccaaauuuucugcauuuacucuggggauugaucucagcucuucagauuuguacggcaagcacuuaaucaaauaagcuguuuucucagcuaaaaggguuugauuuuuucguuuguuugcuugcuuuuuaacaauuagaaugugcgugaacgccacagaaacccugagcacaucccuuacuuacuuugaguuggccggcagcaucaggcuucuguccaguccccugucuugccagcagcaggaagauucuaguauucaggcuuuauccugcauuuccaaccaaccaucacuucaaagugccuuucccuuuucuguaauauagagggcgaaaaugaucagcuauuggacaucucccacuaagagggaggcuacacccguggggagaggcuugccaccaugguggucuaccgacugccuuuggucucuccacaguagcccugccuccaugaccuagauuucuccugcauuccugagugcuguuuggacagcaguccccaauagugacuuaugcuaugaauucaccagccuaagugaaucccacuugggagaggccccagccccuguucaaugucagguggagccaacugcccucagaggauccuugaccuugucuggggcuccucuuuucuaagucucugugagguuuaucagcucaucccucccuauaccugauggugaagcaaacaacccucgaauaugguguuuugcuguugggggugggaguccgaggacagggaggagcccaccaccgucugggcuugggcuguugcucauagcauuguuuuuuccuuuguguagcuaucccagggauucacuaaggaaacaugaggugcaguggaaagaauuugaggccuccaucucucaaggacgcaucuuagagaaaaucaggagaccuuaguucugggauagacuguugcuuauuagcuccagcaagaagcccucuauuucccccuggcuuuccuugccuguuggaggccuuucaugccuccuggcauuuaggagaggguucagggugugguagauuagacagaacugggcacgaggcugggguggguuacagagguggagcgaggcaguccaucagcucuccucugacagcccaacugguuuagaggaaugucugacucugggagauuuggaggcuaaauuugauuugugaucugacuucuguguuguugagaauuguuuuaccaccccuuccucaaacucaaagugcuccucacuguccugaagugacuuuuguccuguuuguuccagagacacauucucuuugucaccugauuuuucucucugguuaagagcauucagccguguggcuacuggagaccacuuguguuccgccacuuucuauggcucuaacuaaauagcacggacuagguccuuuauaaagaacagaggguuuggggcucacuggugagagucuaggaaauccaggaacauggugagggcauuuggagaggguaguggggcuagggcaaagccaugggagggagguguuacauggugugauauggucagccuuguccucucuuccucuucuuacaagaucacuaacugaugggggcccauccuuauaaccucuagucuaaccacuuccuuaagucccugcuucugacacaucgucaacauaaaaaucuaggauggaaauuuaaacacauucacuuuggggaacucagugagcuuugagguauucauucaaaucauagccgugcucccacucccaccaucuauagaaacagcuuuucugccuuccuuugaagacccuuugcuuugcugagcuccaagcuucuccaggcagggcagcccgagugccaccuucuucaccacccuggugggacaucucuccugugggacacagccuccagcuuagggagagagucagcuaucuuagaucauaggagaaaguacauauaagucccggcugugacgccuggucauucugucccuugaggauguagugagcuggaugucagauguagauugucuuuguuacgguuguuucuuggguggugcgcugaagaaagggggcuuggcguuuagccagggcugaggucaccugugucgucccacacgugaaaaucgugaauacauuuucugucuguacagaugugcuuauuuggggcacuucauguaaguagaaucauaaucucggugcuuuugccgguggcuuucuuccuucauugugucguuuuuaggguucaccugcgcugugcugugugccccgacccucacccucagugcuaggauuaucagcauguaccugcucagcugacaacuuggguuuugaaccgguuuugcucauccugaugugauaaguucaaggugguacagagaaaacagguguauuauuagcugggucgcccccggaauguugcuugcacagacaaagaaaauacaguucuugaggcacuuucucaacgcaguccuuaaauauucaaagggacugauggaagaaaauaguugcuagaaagagaaguuuauugaagugaccaguuugaaaauauguacuagggcuaaaagcuucuauaauaagccauaagugaccaaugggaaaauauaacuuaaguauccuuuuuacaguagcgacauaaaauuaaugauguuaagaacacaauacuacauaugcugccuaagagaaaaguuuaguaagggaaaagaaaugcaucguucauagaaaaacugcaugcuguaaagaaagcuuguucugcaauuacuuucuauagacucuaaauaucaaaaggugguucucagcaguuaagaacguauauugcacuugcggaggacccgaguucaguugccagcaccuauguuugguggcucuuaucugcaugcaacuccaggacaaccaacacccccuguguguaccagggcucaugugcaggcacucuuccugcuccagacagguguacacaaacacacacacacacacacacacacacacacacacacacacacacacacacacagacacacacacacacacacguaaaaaucuuaaaaagaaaucucaaaagcugcaugugugugucugaaggucaggugggagauuaaaaacgaugguaagagaugagaaugcuccaaaaggucaugauaaagagagacaggagaucacaacuggguagauacuaaaacaaacuacaaaauggucauaguuaaaauaguauauagcacugccgggcagugguggugcacgccuuuaaucccagcacuugggcggcggaggcaggcagauuucugaggccagucuuuucuacagagugaguucgaggacagccagggcuacacagacaaacucugucucaaaaaaccaaaaaaaaaaaaaguauagcacuguuacuggauauaucaagucaaccacaaugaaugaagugacugguuaaggaacauguaacuuccucucuaggaaaagguaguguguagucauuacaaacuucuguggaaaacugcuacucugcuggaugucuucacaguguaucugugggagacagucuggucuguguggccaguuggguguugcuuucccuuuugggucaugggcuuugaacccaaggccuugcaccuguuaagcacauuuaccaguuaaguacaaacccaaacucucuuuacccucaauuuuacuuuccuaauuuaaauuuauuaaaaauuuaauuuucagaggaaaaguggaaggaguugguucgcuuucuaccauguggcccuggggacugaauagccauuaggcuuggcagccaguuucuuuaccugcugagacaccuuaccagcccuaauuaggucauuuuuauuuuauuuauuuguuauuuguugccuagaauggucuuaaaacucauaggcucaagagagcuucugccucacuuucugaauucuaggacuauaggcaaacaccauugugucuaauggauccccuuccccuuuauuuuaacgagagaacuuucgugaugaacaauuuaucuacuauacuauuuuagcacuguauuuaaauuauauuuauguguauggauggggaacaagaaagaucuuuucuucugcugguuggauaaauugcgugugugguuccccucguuuuuuuuucaguuuucaggugcuuuugcguuugaagcugugcuucaggucuggguuucccuguuguuccugaaaaccgggagagcauauugugagccuguauuauugugagcgcauacuuuauuuaugugugauggggugcugauggguguccccuggaggcuaagcagaggccccuuaucaggauccaacaguguucguuaucagacgcuguccagauuggcucaucccuauucagucuuucuaaccaacuggggacaaaacacgcccaucgaaccgucauccccaguggaaaagggagacacuggccagugcaguggcugugucaggcuccagugaggcugugauaugguuugugcuggacuuuugaauucaguccagguuccuaggaagaaaacaccccgcccccucccccaccccuccuuuuggcuuuaaauugagcccagucaacagaugaccucaccaagucuuccuucccugcuggacuucguuuggaggggauguaagaggcauugugcaauguuggaacaaacaggggaggccagccuuuuuuguuuuuguuucuuaguuuagcuccaagcccagaaaaccgaucuauuccugacuguacagggagccagccgcacagcagcuuuugugugagggugggauguacugaucggcuccuguaugcucugugguucguauuugaacuaagugcuccuuucuuuacgguaaccaugcauuauccguaaacuauguccucacauauaggugugagcacaguacgguuuguuucaauccauauuuucacagccgagucacugucaucaggcuguaguguuucuguguggacgucuagggacacguacacaugacccuucuccuugacuggcacauuguucuuuccuguuauugucuguggccuuuggguuucugggaguauccugacccagcuuugcauaaguaaauguguguguuacuguuagucucugcuaaggggaagucuaaaaccucaagucuauccuuggauugucuucuggacaaggaaccuuugcaauggaaacugagguaaucgcauucuuuguacauagaagccuuauagcauauggcuggccugccugccugccugccugccugccugccugccugccugccugccuuccuuccuuccuuccuuccuuccuuccuuccuuccuuccuuccuuccucccucccucccucccuuccuuuccucauuuuuuccuugccucccucccuucuuccuuccuuucuuccuccuuucuuucuuccucacuuaacucccucccuccuuccuuucuccccuccucuccuuccuuccuuucuuucuuucuuucuuucuuucuuucuuucuuucuuucuuucuuucuuucucucucuuucuuucuuuccuucuuucucucucuuuaucuccgucccuucccucccucccucucucuuucuucuuucuuaauuucuugcucucucucucucucccccuuucuuuccuuccuucuucuuucuccuaugauguucuauccugccccauaaucucuuauuucuggccagccagcacccacucugugguucuguagcccagggcaacugaaaacugagacaaacagaggaagugucaugaaugacauauuucuccagccaccucaucuggccagcccaggcauuggcuggcccaccccgugucaccaugcucaguguuguuggugcucacagcucaaucuggucagggaggguggaccuagccucaugaggaaaaucuuuaggcuguccucgguccacagacuuaucacaucucuugauucuuucuguaauuugcucauugucuagaauuuauuucuggcagacuguggugaaaauugggaagugucuucuauuucccuuaagcugcccaaaggccucuauguugcucaaacacgggccuuacgugcaugcaugaacuuccauauacaugcauauacauucacucaugggcaugggcacgugagagcacacacacacacacacacacacacacacacacacacacacaccccuacaccccugugggcacauauacacaugggaaagggaaagacccaggcauccagccagcccaggcuuccugugucccuaggggguuugaaguaagcuuugcuccaacacugucagccugcugugcaaggggcugauggggagaucucuaggaagcucugggaucaaguugcuuugguuuuuauugggaugacagagagcccugcuaaugaggccaguuuguuaucugcccugauuggcagcuuuccccacaucugaguccucuuaacauugggaagugaguuuaccugauccuaacacuuuccauauaggggugcuuuuuguuuuguuuuguuuuguuuuguuuuguuuuguuuuguuuuguuuuguuuuguuuuguauccuggcgucccugagugaguagguaugugugguggcgggcagugcagggaauuuccgcaggaagugagaagccuccuuuccugacagcccucagaggaucucuccgacuuagccacuugccccauaaauaggacagccucgucuaguuccuuggguuuuugucuguuucugcagaagccuguuccucugagggcaugauucagaguuccaagucuuucuuguggugcuguggccuuggccuucccuccgcacagccuuuauccaguuccuccucacacccuguucuuccucugaaacucccugcuugaggccacccucauucccaucccuuccccugcugauggggugcguggcuggucuccccaacaggagcuuuacgcuuuagagaccacagcacuggcugggaaucacaugaaacagcuuccuguucucccguguuaccugcuauuucacaacagcccugcgugcagugauuagaauaaugucuauuuuacagauaagaagacugagguccagagcgggucaaggaccuugagguucuacaaccagugagagaagugguacugggcugcaaacccaggcaaugugguuugaguuucccacauagaugcucuugcugugccucuuuugcagauggggaaguugaggcacugaggaguuaaauaacuugcucagcuuucuggaccucaucaagggucgugcuaggauucaaggccagaccugugacuugucaugucccuguuuccugcaagcucagagugcacaguuauagcacugguccccagacauuugaaugagcaacuauuuccuuccaucuuuucagaugagugagcccccguggucugaggaugugagagcuggugaguuugagggcuuucggugucucugagagcagguugcuggcagggcugggcagucacuucuccaaagcuagaggaauuccaggcuugacacacccuuuggagucagaguguguuucucccucuggugaggggaugugaacugcugucaauguggcuuuuguucagagucugauccagagugcuugucaaaugacaggaaacaggaaccucaccccucccucagccagugacuucaacuuuucuuagagaaacccuacacagcccggagccugcagcauggcaagugaacggguuuggcuagaguauuuuggucacccuuggcucuccuugcuuucucccgcaggccacgguuguguccuccugcugcaggcaugguauuuucuaugaauuguccuugcugugacauggacauagaguagagaggggacacagcuucucucagugcugggacuaagugccugagcugcccuacccuguggacuccuuugugcacgccuaauguuagcugggaaauugcccuggaggcaggcccacagcugaaggagggcugagcgagaguuagaauuaagauggcaaaaguggccacugauccaggcuucaugggauagggagugugucuguacaagacccuccaugggucccucuguccuccuagaugggucuuggaaaguggccaguuuucuaggacaauggcagcggugaagggugaaggggguguuguguuugccucuuuaaguagcaaacauguuaacugaacaccagaauuaucuggaguuucuaugaguugcugguggcagagugaagccauuuugaucaucuggacugagagcuucagucuaucuguuuaugccaugccaacuucagcauccucuccaggaaggaccucgaaguaguggaccaguuaggaacaugaguguguuccuaagaacauuaugcaucauuggagggaugugggaacagcugcaagcuguuucucagggacaaggugaaacugauggacauccccaagggcgucuuucaaaggaagauggaacaagaagauaguagcccaaccugcucuuaagauaaagugaagcuccacacagguaacaagggcauggccuguuuugacccccucauuauauauauguaucugcaugacagauuaugacaaauaguuauuaauaaauaaggugguaggauuauggguaaccuuuucuucuauuauagugaaaaagaaaaaaaaagagauuuaggguucagaccugaguuaaacuccaaagcugcuccaucugguuauuuaucuuuaaaaagaaauauauauauauacauauauauauacauauauauguauaauuauuuauauauauaaaaucacacacauauauuuauuuaguguuuggagguguaugcaugcacggugagggagugccacaguguggaggucggaggauaaccuucaggagccucuuuuuuuucucucuuucuaccaugugcuucaggucauuaggcuugguggggggggggggggcaggcacuuccacccacugaggcaucuugacagccaugauuaucuaacuuuuaaaacuugcccagaaccuggauucuuugucaggaaagugguaggugguccuagcaaacuuuugacauccugaucuuaguugcaaaaucucuccagguugagucuacccggcuagcuuauaugucaguuggcuucuuugucaugugguaacagucuuguguaugaugucuuagucuuugaagaccuucugugguuaaccugggcuucuucagauccauugucagggcucaaaguuuuugguguguguguguguguguguguguguguguguuuaugaaguggucucucacugaaucuagaacucacuguuuuaacuggacaagcuggucagcaagucgcagagacaugccugcugcuuuacuaggguuauguugcaugcucauguuuuagugggugcugggauauggacuccaguccucauacuuguacaauaagcauguugcccacucugcccauugauccaucucccuagccauguggcuugccuuaguaacaguucuguugcugcgaagagacaccaugaccaaggugucuuauaaaagaaagcauucaauugaaggcuugauuacagcgucaguaagccagucauuugucaucaugguggggggcaugggagcaggcagacagucacuggagcagugccugagagcuuacagcugauccacaaccaugaggcagugagagaggggagggaggggaagggaggagcucaaguacuaacuggggauggugacuuuugcaaccuuaaagcccgccccuguggugacacacuuccuccaacaugccacaccaauccuucccaaacaguuucaccaacugcagaccaaacauucaaauauaugagccuauugugugugugugugugggggggcauucucauucaaacuaccacauggcuccugguuugauaaaacuuucagacacuacccaaaccauguuaaaccucugugagugaaugagcucaagcccccaaggccuagaaagccagcaaagcuguuaguccuggagagggucauucugggcagacaagagcgugggaagaggcaaccacucugcagcagagaagauguuugucgcuggaggcuggaggaaggcaagcggcuucacguucccaguuugcauggauuccccuucaguuguaugaugaacccccaugaccaaagcaacuuauggaaggaagaguuuuauuuuggcuuacaguucagaaacagaguccauaauaguuggggcagggggaacguauggcagcaggcugcugaggcaggaggcagagggagagagaucacauccucacccacaugcaaggaacagagagggcauagaaauggggugcggcuaagaacugucaaagugauccacgucccucagcuaggccauaccuccuaguuccaaacccccccaagcagugacaccuacugaggaccaaguguacaaacaccugggcuucuauagggcauuucucauucaaauuacuauagcagauaggcaauggaggccugcguguccccagcugugacuggagggucauauacccacccugcaugccuacauugaguaucaaucaaaggaagguccaagacaucacuuugugaugugcguagacaggaggaugcccacgaauugauaggauugcuugaaauaaauacaagcugaggugucacacugcaacagguucauuguccccuccugucacugugggugacugcuggugaggacagugggcguuucuugaaucaggugcugugaauguguaugcucuucugggauaggagcaaagucuggagaugcccuucuaaggacucgagccauggacaucacugaguuggcaaugcugaccgucuuucuuccuugcucccaacuuccaucucugguuggucuccuagagucauuuuccugcagcuuggaaggaaugggucacuuccuccuaccaggcacaacccauaagaaggcauggguagguggacuucagagaugggcagcuccauguaucuugugacagggagcuuccuuugugugacggaaacuaucaccggugucucccauuuaagguguuuauagggggaugggguggauuuugccuaauacugaagagagccaucccucagacuccauugucuggcaagugcuaggaccaagacaggcucugagggagacugaaggcagaugaagguuaggggagacgggaggaggcaaggagacccagguagcaccccacuguuuaguuguucagaccgccuccugaguaccaccuccugaguacauaucagaagugggaauggaagccagagaauugugaagacuuggauguugggagaagggugugagucaucuuucuguaccauuuuuaaaaacugcaugugaaggcuuguggggagagggcccaguggguaaaugacuugucaugucagaguguggguucccagcauccaugagaauguucgauaagcaugucggcccacccuuaaucccagcaccugggagguggaaaucgaauccccacagcuagcuggcuggcucuacuagacaaacuggugaguucuggguucagguggaagagccugccucaguguagagugauugagcaagacggcugaugguaaccucugaccucaacgugcaaauacacaaggaugcacacuugccaguacacacaugugaacacacaccaccacauaacaaacaaaugaaaacugcacuugagccuacaacgauuuuuuuuuuaaagaaaaguuuaaaauuguugagucuuugagauacugcaaauuccaaagggauuuuguauccagguuuuucaaguugcuguguauuucuuuguaucuuuaagauuuugcucacgaccuaagagcauaaguaugggguagcagagccacugcagguccugaagagggauaaagugcuagcucacgcugcaguggcugcccuuggaaagcagcagaggagacccagaagaccacuccguguacacuucugcuuuaugugaacugacagcgaucagauuagugguugcuuugggcugaugagcaggaagggguggggagggacugcuagcguuccuuuugccuuuuuuuuuuuuuuuuuuuuuuguggggagguguuuuaaaaucagaugugacgaugcuuguauagaaacauggauauucuaaaaauauugaguugugcccuuaacugguugaguuuuguguuauaucucaguuaagcuccccaaaagaaguaggauccuuugaagguuuuuauagaaauaauacaggcaagacuacagguccagcacccuuuaucugaagugcuugggaccagaagaguuucaaauuucagagugagguauuugaacauauauaaugaguuaucuugaauaugggguccaggacacggucuaaacaugaaauuccuauguaauguuucuuauugaccuuauauacuguccaugggcauuuuuuuuggugugugugucacagucucauguauccuguaucccaggcuggcuuccaacuugcuuugauccaucagcuuccuuuaccuccuaaaugcuggguuuacggaccagguuucuuuaguacuggggcauaggccuguuaagaaagccuucuaccaaccaagcuccuucccuggccccugaaagcaauucugugcaauucguuaacaugccugcgauaugaggucagcguggaacuuuccauacgugucaagauauuucagauucuggagcaguuuggguuuaggccuuucagaauuaagaacugacaacuuguagucagucauucucugggaagcccgggauuuucauugaaagcguguccagauucagccgaugguuccagggcaggcucugggcaucuguggacucuguggcaaugcucuaaggagggcagaaagggcaguguaugcaaggcauuucacagauacuuuccccaugcuccauauguacccucagcucugcguggaggggagccuugugccuguuuaguagaugaauccaggaaugcccccccaaaacaacagcaaggaaggccaccggaggaagcaggcccaugucuuggggugcuuugacccuaauguucaccuucuugcuguugcuggcugcugguggguggcuaugccuuucucacagggcccgauagcccaggaaggucaucguacagaugaucugugagugauguuuuccagauugcauccucgguaaggacccuuggucccuccggaaaugauccugaccuucugcccuguuccugaggaacagcucuucccuggagaccuuccauggaaggagaauggugggaaagcucccgaaggccuuucagggacacauuugcaagugucacuagcuuagaggacacauguuugucucucagaagugcugggcucccuaaucagauaccaacuucggaugugccuauagagggccuagccucguagccagggagccugguuguauuuugaaggugucauuaccauugugugaugaacaggccccucacaggccugagugggugggaguggaaggagaggcaaauggaaaaacagucuacacucagccagauuuagaauggcugcuuaucagaaacucccuuccccaggucaccgccuggacccaugauuccagaaugggggcaaggaaggggugaggccacagauggguguguacacccaaggcgcuucucguguuccucgaggauggagaagcauggcgucacauugucugagucccuuuguggguccuguuacuggucugaaggugucccuggccacugucccuacugccuuguggaguggagucugagccacagcccgauccuugcuugagcugcccugaggggcacgcacccugcacagagcacccuacucaggacucucagcuuccuuagguagagaaagaaaucagacagaucucguggaaagaagcauguaguugaaagaaacguuuuuuucucauaaaaaugagaggcccgaccauguaguucagucguucauagaggucuugccaaccaugcacgacacacucgaucugauguccagcacuggggaagugggggugggggugggguggguggagaggaauaugaggaauuugcauguguuuaaugcucaggaacuuuaaucaccaaaucuuaaaacauaggaucuuaaaggguguccugggguuggagagauggcucagugguuagcaagcacuugcuucucuucuagagaaccuagguuuggcucucagccccccacagguggacucacagccgccugucauuccaguucuggggugcucucuucuggccucuguggcacuagguacacugguggugcacagacuuccauggaagguaaaacaccauacacacaaacugaaaauaagucuucaagaagaagaguaccucaaagcagcucuguuuccuacugacaggauaaauggggcaaaagggaaccagucuggggaagagcuuagucuauucucugagcugggcaaaucaagacauucaguguauagguauaaauuauuuuauccaauccaauauuaagauauuuacaauaauccucauccucccuggggugaacauuauuauucccagacugagcauugcugcguucaguguccucuugagagacgaugcggcuuguuggucccuaaggaaggagagcuccuugaugucagacuuccuggguguggcccugucgugaagucuagcugaugcacaaggcuuucaaaauguuaucuacagaggcaugcacacauacaagcaaacaugcauguaugcauacauacaauacuaacaaagcaucuaugcaggccugcacauguguacauaugaugcauuuauauaugucuccacauauaugaacauguaacauacagccuuguucuugauuucauucuaugggcuaccauuuuuuucccuucccccuagucauccauuccucuuguuucugugugauggggucuucuuauauuggaagguuucauugauguucacuugguauuuuuuuaggcagggugucacugugugucucugguugacuuacacacucuguagccuaggcuggccucaaacuugccaagcuccuccuaucaucaauaccugcaugcugagaaugcauaugugucagccaggacuggcuuggguaucuuuuuaaagccaccuuuaagcuuuugggaaagagacucuaaauaaggaaauagaauaaaauacaauagaaaaaagauauaaagaaaaugcaucagauugaguuggcugauuugggggagacugguggugguaauugaguagaugugcuaguaacuuaaaauuauuucuauuuuagaaaagccagcuuugaagaaggcaguuuuccuuugugcuccaugcggucuggugggagaaacauucuuuguccagcaggcuggggcaugagggucucuaggcuucauagcagccuuuuggguugcaugggaaagcugacccuguuaccaggagagcguaguugacucaucagauccaaagauucugcaucuguggauuuaguuaauucuggguucagccaaaccacaaguuaaaaaaaaaaaguuuggaaaacauuucuggaaaguuucaaaaugcaaaaauugaaauuugccuuaauguuaguacuaauaacgggucaacucggguggagcgcuaugugucacugcaccagguacugcaagcaaacaagauagagaggguucaaggcacagggagagggucuggaguggagcccagguguagcaugcugggauccuggggucaguucucagccuccuuacaaaaguacacggaucuagugggaugcacacucuaugccaaaauuuaugcaagggauuuguguauuuacggauuuugguauccuaggguuaucaaagaauguugcucacagauacugaggguguaccugaacccauuuacauuuucagcaaaaugaaaugagguuugggugccaaggcacgcaugccuugagcugcuucaguaucugaacacuguaccugcucugaggagcucacgacuguaguguguguguguguguguguguguguugugcucagaagccuuugcagaugauagugagacccaagauggugagcguucaugagcuugguggggagguggugccaggugaagagccaaaggcguggauuugagugaggggcacugccugagcgaggagcgagggguggcaggaacagggugagucagaggaguaagaccaugcugggggcagagaaaauggaggacacuggagacaucugcagggggucccauccagcugcgcucaggggagauguuugaguugcccuuccuggcagaugugcaugagggcugcagcugcagcucaagggucuuacaaggucucugugggugaggccggcuguagccacagacagucuuaagugcuugcugcuaacaaagcgauguuuuuguuguugucggggagugggguggaauagggaacacaguuuagggaggaaaauuggaauugucuugacagaguuucuagggaagccuuuugcuaaagccguuaucagcugacaccagguucuagauacuagguagcuauggaucccuuucauugcauagacaggucuuuaugccugugccuaggaagaccccagugagugagcggugcaaaaaagaauucucucaaaagaacuuagaagcauguuauaaaauacauuuauuuuaauugggcuuacaggguacagugugacauucaauacauguacauaauuuauaaugauuaggcaaggguagcugcugugccucaugacuguaucucugauuuguaugaagccaagucaagccaaucacaacuuaguugcaucugcaaguuuugauccuuaguguaggaaaucuaauauuucauauggaggaauagcuucuggcuuuaggugcccagagaccugagcucuuuuuccuuauuguugcaugaguuuuauugaaccucggacaacuaauuuuagugcuuucguguguguguguguguguguguguguguguguguguguguacauguaugcagaagauagguaacaauaguuccacaaaaccucauguccucaaggaagcugggcaagaacccuccagggaaccuaugagagauaauaacaugugcaaaggcccugggguagaggaacuauccugauguaacaacugaaagauagccugcagauagaguacguggcagagauugggucaugcuguggaggucagccaggaucucacagagcuuguuggggacuuuaaucaucgucuacaacgugggaggaaggcccuggaugauuuagauugaggagcaaugucagguugauagacuuccugacuaugugugaucuucauaacagagucaguaggaaauauaauccccuuuaaacgcagcacugagacuuaggguggcagaauaauguacccaagggcaccugcgcgugaccacuggagccccgggaacaaacugugcagccugaguucauggucguugguccaaaguaucagccuaccuuaguaauaauauuacagcaagcucagcuucaaaaugcuuugaacccuuaagaugaaagauuguccuucaauuauggaguggaauuacacgggagaaaccugaguggccaggagugagugguucugcuggguguuuuagaaaggccuaucaugcauggcuccacuccagccucacugaggcccggcuaucuacuggggcgucucauagcagccagcagcacaaagaaggguuuggcuccucuugcuggcccucugacacugcuguuguccauaaggacucauuguccuuggaaugugccccgggucucacucagauaaaucggaucugagucguucaugcgugguuucacuugccggcuaguccagugccaaguuucucccuguugggugcucaguuggcuuaagugcauuccuagacauuguuggagagaucccugucuccagugggaacccagggggcucaguucaggguucaaguggguaagcaccugcucuugaguugcuuacgaugauggauggcauaugucuguuucuuccuaguugaccauguuguuccugagcccgggacgagccuauuggcugccuuugaucaguggagggagugggcugacagcaaguccugcugugacuauucgcugcacguggacaucacugaguggcacaagggcauccaggaggagauggaagcucuggugaaggaccacgguaggucucgcuuuguucuaacccaaagccuuccucgagcaagcgugugggugggcaguugggacuacagcuuaugcugauugugggggcccuaccccagcacggggagcauaaacaagacagcguggcuuuccccugggguuccuucuugguuaacagcuuccuagagaucacuggcuugagggacugguaccaaggauugauuggcccuccaaagcccagugaaguaguagggguugucuuuggaguuuugaggcaaacacgucacacagaucuggaagaaggaggcuagcucaguaggugaugagucuucaaaccugagacaacaugaggagccuuuucugcuucaaagaaucccaggaauugugggggaaggguucacaggaaggccagagggguccucauuuaccuuggggugcccaaggacuccuauccacaggagucuuuggggguugggcuuagggaguggagcugaaggacaugguuuuccugggcccccuucaguuuagcuauggauuagguccuaggagucacucuuugaucacagggucuugacuuguggggaaguuuuacuaacuuuuuguucuuagagguucagagucugaaaaaguguaugcugugagucagacggcaaaucucuaggcugggaacagccaggggcagccuucacggaggugcuacagaacucuagagugggaagccagcuugucauagacuaacugugaccuugggcaauucaugucaacuuugaauucuaauauuuugaaaaucucucuugcgaauauuggacuaagaugcccugcuaaccuggaggucaccuuccuaacacccuugaccccgaaaauucuguguuuguuuuguuuugaagcucaaggaccauuuuaauagaguuuaaaagaaaaaaccccaauggcagguauguugccuggaggagggagggagaaagaccagagaaagagaagagaccauguuguuugaguuaagcuggcaugaggccagccacaugacagacaagcagccacgaggcagggaugggagcuggagaagcagcaaaggccagaguguuagagaaagcucaguuugaaaggggaagaaagaggaggaggaggaggagcagcaggaggagcaggagaaggagcaggaggaggaggaggaagaagaggaagagggaagaggaggagaaggaggaggaagagggagaagaagaggaagaagaaggaggaggagggagaagaaggaggagggggaggaggaggaggaggaggaggaggaggaggaagaagaagaagaagaagaagaagaagaagaagaagaagaagaagaagaagaagaagaagaagacaacaacgacgacgaccagcuucucugaguaauuaagaauauugggcagaugucugaagccucagggcuaugagccuggagccugcuacacuagggaguggagauuuacaacagaaagcacacuaccucauuuaaaggcuaauuauuccucccagcuuuuuagcuuggcccaaggugaaccugccuuccugagggguggucccugggccaggugacucaugguccagggaggcaacaacccuucaucuccguccagaaauagaucucauuuuuucagagaggaggcaacagcuuuuccuuagugaccauucaguguuacuguaaauuccccccacccccaagagguaacccuaaaaucauuuaggaaccagaccaggguccacagccuccagacacaugucugacauuguuggccuccagcuagaaccauucccaugccuugagaaucccagaugcugguggauuuucacuuucaauccuuggggccagucuaucccaaaucaggccaggcggguuaccauggcaacuguugccuggcaugaagugaagaacugggaugcccagaggccuuuaucucaggcagcauccagcauccccagguggcuugaguuaagcuccgaggcucugagguugucaagacgauuguuuagaauugugaugaaucuuggagagggauauuuggucuggugccucaggagguaagaacuccaggauucgaggauggacagcugcuugccaaacuaaugguuuuuuuuuuuucuuauuuaaaaaaaaauguuucuuaaaaaccagcauggcuugccaaagaaaagacaauuuacauagccagaaguuuauaauuaauuuucuugucaaagucagaauaaagaguuguuuugagaaaaaaaaguuuuugaagaaaaaaaugugauaaauacuauacauguagcauuagacuauaugugcaugugcaccaugugggugccuggugccugcagaagccagaagagccgauuagaucccccuggaacuggagugacagacaguugugagccacuaguaggugcugggaaucaaaccuggauccucuggaagugcagccagugcucuuaagcucugagcugccuuucuagcccgagcaacacaguuugagucacuuguaaguaugcagcuuguaaguguggacucacucagucuucacuucguuuuuaauccaucaguauggggcucugagauggaucagcagguaauacugccaagcuugucaaccugaauuggauucucaaagucucaaguugucaucugaucuccaugugcaugcuguggcacaggcacauucucacacacacacacacacacacacacacacacacacucauacaaccauauacccacccacccccacacccccauacaaccauacacacauacacacaccccacacacucauacaaccauauacauacacauaaccauacacacacacucacacucucauacacacauacacacacagugauauauaucuauacacacacauacaaccauauacccaccccacacacccauacaacuacacacacacacacacacacacacacacacacacacccauacaaacacacacacauacacccauacaaacacacacacacacacacagacuacacauacccauacaaccauacacacacacacauacaaaaccauacacauacacacacacucauacaaccauacacccauacacacacacacccauguaaccauacacauacacacauccauacaaucauauacacacacacccauacaaacacacacacacacauacauacacacucacacacacacccauacaaauacacacacauacacacacacacacacacacacacacacacacccgcgcgcacgcacuaccacucucuacauuuaggauacuucaucuugccaaaaugaagauccaucuccauaauugcuccuuccccuuccuccagcccagguauccccauccuacccucucucugugacacugacagcucucugugacacuggccugucccgugucccucccguccaugggguuuuucagcacccaucuuuugauacugcuguuuucacucagcaggauggcuucuguguuugcucccauugucccauacagccaaauguccuuugucagaccgaaugguguuccagcuuacacagagacuguuuggugaugcugacacagugaugcugagacggugacacugaugcucacuggcugguggggguggggcuuccacuuccaaucguugugaguuauguuacuacagacaggagucaguaguguuauguagcuacagacugcaagcuuuuaauuuugauagaccugugaaguucucaaacaggaaagucagaacugcaaaaacaauuuccagaaacccugguccuagcuucccauuugcuuugucauucugccugccugucugccugucugucuguagccugucuuucugucucugucaugcuuuuccucuuucauucugugguacuggagauuaaauccaggacuucauggugccaggcgagcacucuacgcugagcgcuauauugagcacuuucuaguuuguguuuucugagacagggucucucucucuaaacuuuacacgaccuugaacucacccuguagcucagacaggccuugaacaugugauccucccgcuucaguagcugggaugacaggcauguggcugugcuguuguacucaggcucuccaucuccuucucucuucuuuuguccccucaacacccgcuccccugcacagaugugcacagguccacacacacgugugaacagauuguuugcucugaguuuauguauugaaagucacgugucugcuucucuucuuugucugucaccagggguaaacuccuuccucguguacauggcuuucaaagaucgauuccagcugacggauucccagguaagaaagccaacuuuucugaguagguuccugauguucuguuuaguuugguuauggcugccaucuggggaaacauuucuuccgcguguguauauagcucacucauagcuugaugggauauggguggcagguuuggaguuuaaugaaguuagccuuugauggggucuugcccuucuaaacucucauaucaaaccguaaccucuaaucaggauacuguguggccuagugguagugcugagagucuuggucacaccuggugcagagcugggugucaucuccugcauuucacacuucaccccuguccuuuugguugggcugccucucugacucucagaguggccagaaggcaguccccuugagccuauugccaagccaagccugucacagcagccugggugccauuucaacccaggggaugauuuccuuugaccagaaacuugcagguuugggucucugaguucguucccuucuuccucagaucuaugaagugcugagcgugauccgggauaucggugccauagcucaaguccacgcagagaauggugacaucauugcugagguaagggacccauccuuucauauuuucuuccucuccuggaaagcaagcucaagaguguaggacagcuuuugaagcuggaccaccagugugaaaauccagagggccguauggucugguacaaaggcucuucggggacuuucugcuaguguuugguaaggcauauugcuuauuuccauuauagaaaggccccuucuuuuggcacugcaguguagcuguucuggauggagucaaggaacaccguagucacacuuggauaccaucauauuacugugcugugggccaagaguggcugucagcuucccuggggaugcugaacauauugaggggcucuagaggaucugucuugcucaagugggauuggaauuaguauagugaugccucuuucugaggucuggcaugacacccgguauccagcagggcccacugaacuucuugcuagggagcuuuuuugcccaggucucuuggcauccgccaccugaaacccaccuucucugaccacucggcuuucuaugcacauuacaggaacagcagaggauccuggaucugggcaucacgggccccgagggacacguguugagccggccagaggaggugaauaucugggacugggaugugcgacaugaugucucguagauucugugcagggccucuccuccaccccuguaccuguugaaaguggggcuuuuuggaugugcuuuggucuuucaaagaaaugcgugugcaugugcaugcauguacauacccauuugcaguaccgccagucccuuaaacauaggauggaaccacagaguuccuuuacaccucuaaaacgcacaugaugagucauugcugagugcagcacacucaguagggccugguggauagaaccauugggagccguaaacaggauuagcccaggcugagaagcacaagguuaucacacuggaccguggagccuguaggucagaaggcugcagguaucauauccgugcuuuuucagaggcugguccuucaguauaggaaaaggucuguagaacggcaggcagucuuacagcucugaggggcagaggaggauggaggaguucagcaaggaacagucuagacugcaaagauugcaggcaaggggagacccucagggaccugggcggauggagguucaacauuuaaggugucccuuccaaaaacaggacagagggggauguuugguaaguggccugcgaaggagauggggccacuagaucccagggcuuggcagaacaaagugugggaacaggaaggaugcccacaggagcuagcucucagggacccacuguucugguuaacccuuuacgcagaaaaguuacacccaugcguacguggcucagcacagggccuccucuuuggccauugucucacagaauuagagcacugagugaccaguucuggacauccugaggcucagcagggcuuaggagcauggugggaggagccuaacuuaacgccaggcacugaguuugauaaggcucuugaguaauuuugccccaugucaguccuaugggugggaggaaucgagggaaggagggagggagggagggaaggagggagggagggagggagggagggaggcaggcaggcaggcaggaaggaagaaaggaagaauaagauuucgagcccuucacccuugcuguucuuccugaugguggcuguuucuucugucaagcugagucuuuuguguuuuaaacucuugagggggcgacacagagaaucaaacauggaaccacucugaauggacuuggccauacagcccacuuuaggaagagaccccccagcacauaggaggcaacacuaauguuuuaacuuuguguagugucaggaucucguccgucuguagcaccaugauggccagcuugguuugaacugugcagggcggccagcuuccugccgcuguaugcugcucuucgcagucuaccaugugcacagcucgcagcuccguaggauuccccccucaagaagcugggaaaagggagaccgguaggaaugccggaucuagggaucaccugucugaggugguaccggugagaagcacauguucugaccaccgcagugccuggacaucuguggcaagcaggggauggugcucccugagucuuucaaugagcuggugacaaagccgcagacaggaaguauaucugugagccagaaugugacuuacuacuagcaaaaggcagcugguaagagccugaggccaaagaagaucuguacagcaaagccaucacagacggaaggccuuuccagcugggccucgcaggauauaugaccgaggcguguagguugccaaggcgggagggacuugcccagagauugucuggacucugcuauggguccuuggauaggucauuucccuguggugcuuguucugcuccaucuauaaaaucacauagacaaccucccagauguucaaggucucuauaauaagcagagguuuuauuuuuaagcgauuacacccuuccuacaagauuuaaagagauuuuggucagggcucagugcacaguguuuguuguguaucagaggcuggacuguucuagcuggagaauggagagcgaggcuuaaauacucucuucuuccagagagcuagcguuuuuaguuuggccccuguccaauuucaggccacucuguggagccagauggagccugaauuccauucacaguguguaugcaaauccagacagaccccugggacagcgagucuuccucaggagucuuaguagcagccagucccacuuggcuucuuaauuagaggcacugcacaccccgcuuuacugaggacaggccuguagcucccagacuuuauuuauagugugucuguccuuuugugaagggucugggcugggaagucugcagggcugugucugacaucccugugaaguguugagcaucuuggaguccuuuucauucacacuucagagacuucugagcugacagccccacaggaaacuucagggaggggagggagggcagggagcaggagggaggcucucuucagcuaucccuggaaugggaaacauuugaguguuuggugaguguuuucugagagcugguugcuuuccuguaagauucauagacucuccucacauaguugaugcccagaagcugagugugaaugaaggccggggucucccucacugggaagagcacagagagcagcgacagaccccagcccugccgugcuccaguggaaacuggacuagucaaggcaacuaacuguaggagugcagcuaucuccucugaaaagugaccgccuggcuuuuaaaguuacauuaacaagaugaagccauuuauguuuugacccucugcuuagggauguugggagugggguaguaugguaggcagagaaagggacuaucucccuucuuaccuuuaagaauuuacaccacaauauuuucuuaggacuuggcagugaccuuuugggaucccguuugaaucaguuucuucuguuaugaugaucccacguuguuguacauaagauauaccuccauagcaaggcgguuuucccgguuguguauucgguagaugugauguggaaucugaaauuccauucccugaggaucaggcauaaagagccagauguuccauuuggguaguucuucaucugcguugaaggucguaccaggcuguggcuggccagacacacucuugggggaacaugguacagcccuaguccauuccagagacuauugaagcuuguuuuguuuugugggugauguuggcuuggcccacaaguaucuggcugacuugucuccagagucacgaacauugaaugucuucacucuggaucaugagagcagaaugaauauccacauugagaucagccagggccuggguauucucaaaugugagcaagugaaauuguuaccagagucuuuacgccuaacaagacugggcccuggcagcccugacaagcacggcuugaucauccacaggcuaauuagaaaaacgagcaguggcgaacuguggagaaaggagauugguucaguguaguuaggguaggaagaggaacagagauccagcgucuuccugagcccauccucagaguccugacauaaagcuuagguucaacuagcuuuaacuaggcugcugcucauggugguacacuuggugggcugugaugaagagaugaggaagcaggaucaggagucucuggccagccuggaucuuuaauggcuuggagauguggcucaguagcuaagagggcaggaacgcucacacugcucuugcaaaggacccagguuugguucucagcaucuacgucaggcaggucacaauugucaguaccuccaucucugggaauugucagugcuucugaucuccguggguaccagcacgcaugugcacacccacccaccggcagacacguaguuaaaaaggacgaaauaauaagagcucuuuagauagagggcgcgaagcaugcuuagccaaacaguccacgucgugguguggucccucccacccaucgcugccuuggccucugcuguccuggaagguguucuguguacucagaacugugugaacugccuuuccuggagacacgucucuccucuggcaggcacccagcuucaggcuuuuccuucucccacugugaaauuucuccucagaaaacucuauaauuucuuagaggccauuguuucaguacuuugauaacuaaagggagugacauaaguuaucuucauaauaucuuguuuucugccaauauucacccagggugguuacaacccacuuggcaauguuacuagacugugggucuagguggagccuguggaucuuuguccugggugucacuuaggaaagagccuugggaauccaucugucucuguuagugaauaaggacaaagaugggcaugaggaugggcgggguuuucaugcuuaucugcccucccauaggucgaggcugaagcugugaaccgguccaucacuauugccaaccagaccaacugcccucuguaugucaccaaagugaugagcaagagugcggcugaagucaucgcucaggcacggaagaagggugagcaucucgggccuuucggaugccccgugggcagguggcgggaaggcagcgcggauccuggaggaggcucuuuuuccgacccucuugccaacugggccacuuugaucauguuccagcauuaaccuaauugcagcccagcagagcgggcagcucuaguuuccucccuuuguuccguggcccuggccuuguucguaucuauuuaaagccaaggccacgugggcagguguccuccucucucuauaaguugauuuuacaaacuaguuacauuacauagguuacaucacuuuucacuggcgacagaaccccucuggggaauguuauugugcaaagugugucuuccuuccgccuugagcggggauuucugcgggggucagucagaggcuggugugggacacauaugcuuauucaccucaaauuacucguugccgguauacuguggauguauaccgagugaagcugguucucccgagacagguucuuggaaacuaauucacuaagugucgcuuccagcacuuucccucagggauguucuguggugcagcuuauucauuaugcauaaguagcuccauugccaccugcugcacuaaaccaguuuggcuaaucacacugugcgcuuucugcuuaggcaucagcacagcauauagagcuggaacccauagcauugaccuugaugggaaccuuagcaugaucugaagugagcaucgaaaggggaucccuaucuuccuucuugucuccacaaccugcauguguaucuuuccaucucgugugucuccauuuaucugcuuuucucucaugcucacuggugccucugccucugccucugccucugccucugccucugccucugccuuugccauuuggcccauauagcuguuucuacuuugcugcaugauccucaugaaucaauaagggcugugggauguuuucacugaugggugacuugguacaagcuccagaagaaauugcucaaugacuacucagccagccugucccaagaggcaauggcuuccagaccgauccugugauuucuggcuuccugcucuuuggagcuuucuggagcuuaauuugaccacuugcuauuaauuuuugagagccugcccucuccuggaugcuuggagaagcugccuuuuauuuaguaguaauaguaguaguaguaguaguaguaguaguaguaguaguaguaguaauaguaauauuuugagagguggucucauguagcccaggcuggccuggaacucccuguguggcucaccauggagcuucugaucccccugcccccgccuucugggugcugggagcacagcuguauacaaccaggcccuauugagaaaaaaaucuagaauuucuucagaauuugcuuuguguuauuuucugaggagacccuguagguggugacugaaguuguggucuuuucucauccaggcacacuuuuaagguagcuggguguucagcuucagcauugaacacccuuccuggcacuacuguuuuaguguagcacgaucauaguggguucagugucugaaaauggggaccguggcaccauggcagcuaguuuuguguauuuuacuggucauucagcacucacaugauaauaaggaguuaguuaaggcaaacagccacaugacuuuggauuccuguggccuuccugguccaaaguguaaaauauccuaggcucaccuuggcagagggagggugucagccccuggacagaccacagcuagggugagaucuugagcagcucuccagcagcacccaugcucucucccaagccucuggucaucccugaaggguggggcugacacaugcguguguggcaugcagcuucacucgggcaugcugccucagggaccggaggcuuuuuguugcuucuguuaacuucugagucugcucagaaagggaagcaguucagucaguucuauuccagagccuuccgugcaugaaucuagcugugcccacacggugcuucucuggguugcucugccauccuucaaagucguuggggaauuccacugucuuccagcgcuaacaagagcagcagaaggcucuagcccuccagagagcuggggaggcucuugccacccaguugggauuuccaaacauccucaggaugcagccugggcaagcagccuucucuuuuguuuuccucugaagcucagagcuugggaagaguagaacuaagcuuggugccuggccuucucauuucaggcuccaaagcuccauguuaauguuugaccgacucaucuuuccucuugaagguuauuuaguagaggaaauucuugugguuuguaccgguugggacuuaguuuagguagaaccuggagucugauccucagcguaggcucagguaauaaaaaaaaacagguguucucaaacaaucaagaagcaagcaguggcaggcugcguuaggguucguucccugggauuaauaacgugguucaggaccagacccugguuauggggcuuuggccacaggacuuaccaucacuaaucugugucccgcuuacaaagugaagguagugguaguuacucuucucacagagggaugcuuguauuuaagagaugauguguucaauaaccagucaucuuugccauugaaggaugaagugugaugguuuaaccuggaguguguucaguauaccaagccaagacaaagacguccauguguuuuuccugugugaggcuucaggccucagugccaggagcaaaaaguggucuugaccucuagugucugcccuuggagggagggugaggugggagcagaaagucacaggggaguggucagugacauugugggcaagcaggacuagaguacagaguagagagccugugagucucaggcugugggaaggacucagaacaggaguuauaaucucaguaaacauuggccagaccuucucuccaugugcauucacucuccuuagccacccacagacccucugcuucuaugucuaaggugggagacauuagggcaaauagagaaaugcaguggauauaagacuaugggcugagaugccugugaggauuauagcugcaugcaagcuagacccagcacaaugguagccuggcucuucuaaguggcccaugaguaccauuguucugugccaugcaacagcacaccacuugaccaaccucacugugcagagagagaaaugaaacacagccaagacuggaauacacuagccagauuuuaauuuuuuuucuggacuuucuuauuuucucuuuuauuucuacgcauuacugggauuugaaccuagggcccuacacaugcuagaccaguguucuuucucugcacucuauccugguauuucaucuuacuuuguauuuugggauaaggucccuauauugcccaggcuggccaugaacuugugauucuccugccuuagcacccugaguagcgaggacuacaggccugugccauugaguccuggcuuggguuuuagucuuaagaagaauuuagacagugguugauuuggugagcucaugccacagaagagaaauuaaaaugcagggacuaaacauguuguucccaaucauccagcuugugagaagaaacaggcacaauuccagacaccuaccaucuguuugcccuguguguccaggguggcuccuucucccuccacccuuucuuagacugcuguuuguucaugcaaggagcccugugcggcuacagaugcuuuucugagggaauacuaaucuaugggcaguaccugcugauauaacccauggacucuccuuccccacccuuaaaaccaagagacagccacauucaaacagccauggcugcugagggauacuaaauccaaauccgggauaagacuucuguugaccuacaggucaauaggaugcugaacaucaugaaaauaucauagucaugucauauaugaagauuacgucaacuuggggaggaggccauaggguuaaacuaauugagcacauaauaauaauaaucuugaauuagacuugagauugagggcagcagguggguuaggcuguggaugucauaaacucccaguagaucccauuagucagagaaucagcccauugaaggauggggaguggacaggcagacagagauggauuuauuucaagccauuggcucacgugguauugcagcuggaguaugaaaucuuuagggaaggccagcaggcuggagucuagauaggagacgauggugccacucacaucugaagucuguguggagacagaagcacuuccuagccacugcucccauuugaauagcauguucccagaggcugggaauucagauugcauuguaauucaccucgguaggauaagauccuggguuuuauuuucagcuaccugugcccugcggcuguaccgcauacaccggcucuuucagggcacacagaaggcuggugccuaagcugggaaugugaaucccuaaauucauucuuuccagccauuuugucuagcaccauuaaaggcaaccaaccagugucauucugucuguuaauuugauuuucaggaguggccuauggcaucaaauacaacacccagagacuugccucauagaaauauuugacucagggcucccaguggcauuuuguguauuucauuacaucauugugguguagacuacauauguuuucuuuacuuacuauaagaagaaucauuagugcccaugaacuaccucauacuagagaaucgagucuagaaacuucagaaaauguauccuaaauauuuuguuucuuaucccaugagauggucuaugucuaugaucucagcacagggauagggauucauaccaugagaaaucugaucaugagacuaugagggauaauucuaaagcuaaguuaaaagaggcauaaagguaggauuguuaguucaaggccaggcugggcuauauauuagcaugaucuugacucaacaaacaaacaaaacaaaaaccaaacaaaaacaggacaagggagauggaguuggcaaacaagcacaaggauucugaauuugccucccagaaucuacguaaagaaaguuguguguggaggugcaugccuauaauccaugcggucugacugagcucugcaagccagcccauuggggaggcaaucucugggcucacuggcuagccagucuagccuacuuagagagauccaggcuaaugagguacgcugucuucuauaugugcaacucccuaccccaugugcauuguguacacauagauucacaccugcacgcucauccacacauaugcacauacauacucauacccgcaugcacacacacacacacacacacacacgcacaguuuguugcuauagaauggagccauccuugcugucaaaaccucacugcauagaucuuaggcgguugagauuguggcccaagcacuuuaagagaaagacacagugaugugggucugucugucucauuucccugggcuucuguggcuguguguugaguucccuucacgugauuuuuucauuguucuugcuuugggauuuguccugcuucucauucgugggaaaugacagacugccggagccugaagcugucaaacauuuccaaaccccagcuugcaguuauucuucaugaaugugcucggccccagggcugguugugaguaaacacuagccucccauuccugcccauccccugcauucuuggccugacuggugugccugccagagucuggcuuggggcacagccuucauuuuagacuuucucuggagaagagacucaugaaacuacaacagccaccaagaaagcaucagcaguguguuuagagaggcauaaaaaggccaauuaagccguucgugguuuauuauuauuagugguaaugauugcuggcacauggcagcucacuggugucuguggucugacugagcucugcaagccagcccauggcccccuccagcacaggaguuagagggaaggagccuauugcaaggcacugagccacugagaugaggguguguguguguguguguguguguuggggggauauagauaccagugucuuaagcacacuccccugaaagugggggcuuuggacacaauagguccuuuccuaauuuguggagcuuaaaaaaaaaaagaaauaaaagcuuguaaggaccucugacuccuucaggagguuuaauugaagcaaagcaggagcuagagacauugcucagcaguuaggaauucuugcuuuuguagaagaccagacagaguucaguuccuagcaccuacauuggaucccucauaaucacuuguaacuccacggggaucuaacauucucuucuagccucugcugacuacccauauucacacacacacacacacacacacacacacacacacacacacaaauaaaaauuuauaaguucggugaauagagcaaaacaagaaggaagccacaguuugggacauccucacucuucccaggucugugccuggcuccagcaugggcugaccagaguccucacucugcaauggucgaaggaagggaggaaggaaggaaggaaggaaggaaggaaggaaggaaggaaggaaggaaggaaggaaggaaggaaggaaagaaggaaggaaggaaggaaagaaggaaggaagguccccagugaucuuggaagcucugacccauccugggguuuccagaggcugaaggcuuuugcuaccguagcaaaggucagggaacccagcccuugucaggcagucuggccuuagaugaagcccaucuguuucuaguaccagccuccuccaaucagauuuccaaagccaggauggagcugcagacucagugacaggauggaggaugguaaauuucaggguauucugggaaugcagauuucccagauagcugagcuguugauuccuccucugagcaccccugcucuucugauauuuuuaugguaacaaagccuguauacccugggggcugcaggugcuaugugcucaggugggcagugggcagcaggacucucaggccaggcuggauggggaguuagaugucacuagaucuguuggaaauuccugcaggagccccugcugcccccgcucugccacugcaucucagaugggcccgaggaaccgcuaacagcugaccuuagcuuuaugaggucuuuuuccauuuggagguacgugcccagugagcuuguacaagcuucuacugggagagcuuccaguaggucaggaaugcuggguucuuuuccuggugcuguuuuuuagggguuuccuucugggcaugcuugcccccaguucuagcaaccuuccuccugccuggaggcuguugggggggggguguggaugggaggcagcuguggcuggggcguuccaucacccucucacugaacagccacuucuuugugacauuccugaggcaggagggggcagcucccuggagccaguuuugagugucugggcaagaggguguuguggaauaguauccagugauaagccuuugcaaggaccguggagaggaagggagacacauuccugacugagaaggguuuggccuugagggcuguguguuuugagaagggagaagcuugccugggugacgggaggagaggcagauggauuuggauaaccugagagaaagguccagcucucuggucuuucauuaguugaauguuaagagcacugagugggcuuugcacacguucguuaagugccuacuguguacaggcacgaagguguguugagugccuauugugugcaggcagagaacugaugauuauugugucgccaucaagagucaaaagguucaaaagugggcgauuguuugggguagaaugcaaugcccagggaugccgugaugucuggaccauuaggggaggcugagaggccaggccugguggcacacuucuguaaucucagcucucuggugucugggcaggaggacaagaagugcaaggccguccucugcuacacacauaguucaaggccagcuuccgcuaaaucgaaaugaagagcuuggcuuuggaucaggagagaucuagguguucagaggcuagauaguuuuucauuuguuuuaaaccuggaaggcaugacauaagagguucuuagaugaguguguguggaggaggaugguauauggagagugcccugugaagagagucccugccaugucacagagcauggcuaaggagcugaggaagcaagcacaacccugaagucugcuggaaugagcuaggggaagggagggggcguggccaagggaagaaggcacauaaggcacacagggaccuacaccagcaguguaagugggcacagcugucuggcccacucugaauagauagagaagauaccauuuggacuucuggggggggggggcugacauuuucucuuggacauuguguagagucauccugagcuucuagagauccugaaacuccaguggccuaagcacagguucucaugagucagcugucacucugacggaugccauugaggucaauuuaggcaucugggcaucucuggaagauucuggcacugcucucugauaccuuggcucugugacuuuauuuaugauuucuguucccuaucuagaauuagacaugauaaauaacauguauuguguuuaggauugccucaggaaagagggcgaaguccacagaacagggcaucuuaguacacacuuggcugccuaggguucuggacuucggccuucgguguugucaccugugagaugaggcuguaccccaagaagggagugcugagggcaaucuacagugccgagcauauagcaaugccugcuaagaguggucucuuguucuuagugugucagacugagccaucugugcucuuuuucaggaacugugguguauggugagcccaucacggccagccuggggacugauggcucucauuacuggagcaagaacugggccaaggcugcggccuuugucaccuccccacccuugagccccgacccaaccacuccagacuuucucaacucguugcuguccuggugaguaccgcugacucacucacauccacacgcuagagcaacucagagcaaaaugaguccguaggugacggcacggugguggcugagaacaggcuuaaaaacagaccuuuauuggccgaaguuagggucgcuaagugagaacaaggaaucaaucugucgccaucuugggugggacuuccugauauuaaccugggccauucugaccagucagcugaaggaagggucugagugagcgccaggauggugggcaagacgucaucugugaaaugucucaccagacagauggagguaggcugcucagcaaggaagccucaugucauguguuuccuuccaguggagaccuccaagucacuggcagugcccacugcaccuucaacacugcccagaaggcuguggggaaggacaacuucaccuugauucccgagggcaccaacggcacugaggagcggaugucugucauuugggauaaagcugugguaaggacugauggccuuccucguggcuggcccaugcaugccccugucgcuguggguguggggcuaacguuggccaguugagaacauucuagaaacuagaacuuggaagaugauauuucuccugaauggaaauccaagaugagauucccuaaaagcacauuuccuucuaaauauuccugcaucaaggaggaaauggcuuccucaguccccugcugaccuucucagucaagaguccucaacuccgguuccuugagaguguggcugaggacaucaaggcuugguauucagacccaccgugggcuucugcucaaccuguuuuggacagauacugaucuuggggauuuggaagcuuuuuuccuucugauguuugacaauacaguaacaguauuuaguaacaguaaaucaguggguuuccugauucuuagugaacucuuacaucuugugagugaacaucaccuuguuucagaggaaagcuacagugaguggggaguauccucgggcuuugccagcacuuugugugcacagcaggucagccugcuggugacauuagcaucacacacagugucacagccugucaaaaacaauuccuaacaucucaugcagcguucuuaaauccacaggaggaacaaaagacuuauuuuuaucuccgccccccaaccccuggagacagggugucucuguguggccuggguuggccugaaacuggcaauguagauuaggcugaccucgaacucacagagauccaucugccgccgccuucccagugcugggauuaaaggcguggccaccacacccauggaaaaccuuguuuccuccuaacaccaacaguaauuugucucuaauucuuugacuggacauuugugaugcuccuaauuuuucuuuuaacugagaugcauauccguagagacauauccuuggguauaucuuuaauuauguuuguaggagaaguuucuggaaguaacuugggcaggccaaggggaaucuauuaaagacugaauuuauauuguuaacauaaugcaaagauuacaucugacacaaugcaugacacuucucgcuggguuuuaggaguagaacccccaaaacacuauugaguuggugaauuuugucuuuguuauuugacauucaauuucuuugguugcugauuggguugaauuuuuuaauaugcuuuuuuggccauuuaauuuuuuucuuccucguagugcacacucauauccuuggucuccuguguuuagaauggaaagauuucaggaaaugauuggcccuuaccuuggaaagccagaugcuggguugagacuuacugacuagaagcccagaccuguugggaacuuuauugaaagggaaaucccaggaugaauugcaugccaacauaccuucagcuuucugacccuauccauguauguguguguguacucuguacccuauccguguguguguguguguguguguguguguguguacucuguacccuauccuuguguguguguguacucuguacccuauccauguguguguguguacaugcucuguacccucuccauguguguguguguguacucuguacccucuccauguguguguguacaugcucuguacccucuccauguguguguacaugcucuguacccucuccauguguguguacaugcucuguccugcaggucacugggaagauggaugagaaucaguuuguggcugugaccagcaccaacgcagccaaagucuucaaccuuuacccccggaaaggucgcaucucggugggaucugaugcugacuuggucaucugggacccugacagugugaagaccaucucugccaagacacacaacaguguaaggcuugccugucuugaguagacaugugugcugcaggcaacaagagacagggguucaggaaaccucaaucggauaggaguaaaguuuccccaggauguauugcuaacuugcagugucccaagggccagacuggcccuaucacuuucuuuauugagauccacaagacuaagacucuugggcacauuucagaggcaauagccgcuguccuuacaccuuuagggucccuagagcagagguuuuuuagcccuuggguugugaccccuuugaggguugaaugacccuuugacaggagucacauaucaaauauccugcaugucagauauuuaauuaugauucauaacagucgcaaaacuacaguuaugaaguagcaaugaaaauaauuuuauggcugggggucaccacaacauauuaaagggucacagcacuaagaagguugagagccacuggcccagagugauuuuagguccucagaagcuucuagaagucagucaacacuguguugucgugguuugugugguguguuuacugcaagggauccagcuagagcagccagugucuguucccgaggcggcauugggcacugccauuuccugucaguccucucucaggagugauugaccgcuaugcuucuuguccuaaaggaagaagaaauaacccagguuaauaggucacaguuuaggaacuacagaauuuggggaagcuuguggucacagagcuugcagauguuaguaucuguuagucgguuagcaugcuggcguuucaacugagaaccagggauucacguguucugcuaguuuauagauucagugagcccagagcuaucagacacccgcagcuccucccaaccuaaaauccugacaaucuaaaauccucucucuuggacagaagguuuugggugggguaugcuggguucagugccagcuucuuugguaccugugggcgccuucaugguggguacuucguggggagggagauggcuggacuccauauuuauaacugguuuugcccugccgguucagcagagccuuagugccaagccggcuuaaauuuguaccauccaucuugggcuccucaguggcgcccucaggacugaccuuucugugcguaugccuauuauuucauaauccuccucuuaaucugaccuucucacuaaaggguccggugugauuauccuaagugagaagauaaauaaccucgaggugcagagagcuuaagugacccgucuaacguuacauagugaucuugcggucgagccagaauuagaagccuuaauuuuucaacauucuucccucccagacugcguaugcaugugcagggugggguggggaaaguccugucccucuucuguaguguccccuccccaaaagggcugccauggcucaucaaacacacaggugaccgggcugcuagguggcauugggaccucccugccuggauggacgagagagcaggggagagugaagguuugggaagacaguugcugcucacaugacauuuuucuggggggaggggguaaaauauggcaguuuuuauuuauuucuuccauggcaagacaaacagaaaaucaaaugguuggcauuggguaucaucacccugaagacagagaaacagagaaauucagaaaacuguacaagaaucaacaagaaaaaauccuagcauaaagaaaggaaauaaacgcaaaaauuccacaguuauguacuguuuuuuacagacaggaaagggaauauagcauaaguuuacauuaaauucucuaaauuccuaaaaaauaaauuucuggggauuuauacagcuuacaaacgcaacuauaaaaguaucaaaagccuucuucuacauuuucauaauguuggcauaggauguuagauguaaucugaggaaauaugaucacaucgcauuuuuaucucacucuguuccgggcaguaucccgcgcagcccugccaaacaccucauugucucccccugcugucggggcuggcguuaagcaugccugugugacacugcccaucuggugaaguacaaacaagauucuagguucugucuucaguguggaacaaccgaauccacaacccgauugcuaauccucccuuaggauuuuccaggauuccaacuugcucuguaauuuuuggaaacgcaugcgggugaaguugaaauguccgugcuuuguggugguugcaaccucccaccucagcaaacggcaggagcucugauaucacaucuuugagcaucuuuaaaucacuuagagcagagguguucaaucugugaauuucgacuccuugacagggguugcauaucugcuaugcuacauauaagaugcuuacauuacaauucauaacuagcaaaauuacaguugggaugcagcaaugaaaauaguuuuacaguuggggucagcacaacaugagucaguguauuaagugucacagccuuaggaagguugagaaccaccgacuuagagucauggugcugcuucccucuguauuuuaagggagagggggacaucggucuaaaagccuuaccaccagcucccuccuaggucacuagccccaguuuguguguuauccaaggccuuggguaccaggggucagugcucaugcaaaaugcagggaucagccagcgguggacaggggacugggugcuuuugugaccuguauccuuucugauguuagggacgucagagaaguauguaaagucacuucacugauggauggcaggccugggaugaaagggaccaaggucaaggcuguguuuggagaugaauuguuagugaugaagugauagggaagagguaggcuucgccuuuaucuuagaggaugcucaccccuuuccaaggucauuucagaggagacuggauccccucaccaaagguucuuuuugugucggugccacaccacaugugucuuacugaggaaccguaaguacucaggcaggcuuuaagugacacgguccacuguuauucagugcccaucuuuugccauguccaagacaaauccaaucgugcgguacgugaugaaggacaacaccugagaugaggucuuuaguuggggacugggaaaaaaaaauaaaggcagagcuggcauguucuucguaugggaucagggagaugaagaucuguccuuggggaggucgugugaaagaucccacuaugccucugcuucaauauuucugaguucgaggccagccuggucuacagagugaguucaaggguagccagggcuacguagagaaacccugucucgaaagacccuccaaaaaauggccaugggggcgaaggucucucuugagacucugaacuggaaacuggcgcccauacaggcuuuagguuuaaauucccauugccugggcgggccucacagccuugagcugaaaaggcugugugggauaccucagagguggguggcugcaucccuuggguacucccuggagaaucuggcucccucuggcuauuauguuuacacagucagcucuggucaguggcagaugugagacaugauggcccccagcaucuuaggauucucgugaggagccgcuugcguguagccacaucucucuacuucuguuuacggcaaccucccuguuucucuguggagucucugagcugugcuggcagcaguccuugcacuucccgggcagugcuccuuuuccacaugggaaugcaugcugcucugcccuuucucugucccucccucccccagccgccgcuccagagagcagagaugaccugugacccgguuguugguguggcucugcccucucacagagccucaagggcagugauucccaauguuccuaaugcugggacucuuugauacaauuccucauguugcggugacuuccccaaccaucaaauuauuuugguugcugcuucacagcuguaauuuugcuacuguuaugagucauaauuuaaaaucuguuuuuuuuuucugauaguccuagguuaccccugugaaagggucauccuaucccccaaaggggucuugacccacagguugagaaccacugcccuaguuuuucccccuccauuggccuguguuuucccagaagcccaugcucugugccacauguuacccauuuguuagccauuuguuccugaaaggcagucauguggagagagcuguaggcguucagccugagcugagccagaauuaaggacaccacucugacuuacagagcuuucugugucagaaagccucuuguuuucugucgcuuccgacugacagacaaacgcacuggcaggcaaaccaccuguuucccgugagggugugccaaauugccuguuuucacucucugugacaugagcccccaaacaagggugggucguuuaggaaacuaaaccucaauccugucaugggcuuguugucuuuuaugugccaccaguccacgcaguuggggacguuugguuuaaccacaggaugcuuaaguccgugagaaaacggccucguuuugcaauuuaguuuggaccuuguucagaggcgagccuugggaguucaaucugcacaggggagaguugguggaaaugggaagacaaccccaccccaccccauuaguguuucucuuuucccuucuuuuuuuuuuuuuuuuuuuuuauagaauuguggauugaauccagggcccugugcauucuaagaguucagccacuaaguucuaccacugagauucacaucuccacucugagcuacaucuucgcuccacuaaaucgcccaggcuggccuugaacacacucuagcucagacagggucuugaccugagaucuuacugccccagaauuccggguguauaggucugccucacaagacccacccagaaugauuuucuuuuuauuuguaaagcauuuacacacacacacacacacacacacacacacacacacacacacacacacacacacuauuguuauuuucuucagcuauugcccucucagauuuggaguuguggaugagaugaguucagauucuaggcagagaaagcaugggucccugggguggccagcaaggacagacagccuucuucucugggguuugucaguaaacuccauuuccuugaguccaggggcagggauugcucucaugauggcuugucucuucccucaggcucuugaguacaacaucuuugaaggcauggagugucgcggcuccccacugguggucaucagccagggcaagauuguccuggaggacggcacacuucaugucacugaaggcucaggacgcuacauuccccggaagcccuucccugacuuuguguacaaacgcaucaaagcaaggagcagggugaguggucuugcaagcuuuuaaauaucgugggcuggucucuacuccgcagauauccacuaagcaccaugagucagaauaccgagaugggggcacagaaggauaaaggaaaccugacauuuucauccugaagcuuaaccagcugcugggugagucugggaugauuagagcuuugaugcugagugugggguaaggacucacccagaggagggaagcacugcucuagcaucauggagcaggaugacagggaagauggacaguugggcuuugaaggcugaguaggaguuucucaagccaaaggauggagauaaagauacuagaagauggaauaugaccuguggaagauguacaguguguccagagcguggugaacaucgcguggcugguggucaggaacugugagguggagaaggaguagagcuuuaagggaauuaagagaggagugauauugggaagacaguuuugucuugaaaacggcacgagacccucuucgcaguaugaucagaggcuucuuggaggguucaaaggugauguugacacgaugggggaaguucuaagaaaccaguugaguaacucaucagggagucaccuugggagagcguuuggccuagaacuuugggggcugguugcacaucuuucucuguuguaccugucuauaaugggggccauauccccacacaucauaguccugucucggcuaccucuccgugacacugagaagguacagggaagauguccucugugaaugugacauaggcuguggggugauuguguguuucagcuggcugagcugagaggggucccucguggccuguaugacggaccgguaugcgaggugucugugacgcccaagacggugacuccagccucaucagcuaagacauccccugccaagcagcaggcaccaccuguucggaaccugcaccagucuggauucagcuugucugguaaggccagggggugggccguuccggguagguuccgcaagcucuguggagccagccggaggcuuuuggcuccacugcugcggaaaccgaaaggcuguaaauggcagcuggguuucagaaucuucagaucgguuuuugugccaugccaugcugagacacccacccugugagugaagggccguuuccucaucugucauguccguuguuaaagaauguggaacugggaguuucagcagucucaccuugcucaggccuuccgugugaugagucgcagcaagguucccuguggaguugcugugacauccacugcuacacccucaguggugaaacguagauuucugucuuggaaacauccugccccucuuucuuuuggcccacaacagggccuuuccucucucccccggugccuugaacuuagacagcguaguucauuacauagacuuuccuuuucuugucccaucugcuggauuuuaugaagugccaucugugcccaugaggaaugaggaacacuucaggguguuuugguuuaggagacagacccuuaagcccuguuguccuaaagugugagaucagucacaaugcguauucccauaucauucgcauagacagcacagguugccagucuguuguguaaaagaaaugauugggacuggaagcuaguuugccucuuuaaaaauuggaaaaauauguagauauugaaccauguugugacuaagaccaaaguccaagcacaaagugugggcagggacaaauggcucagcaguuaagaaugagcucacaucguguuggggacccaaguuugcuccuaacacccaugucugguggcuuacaaccauuuagaauucuagcuccagagaagccagcgcccucuucuggccuccucaggcacugcacuuacguguauagcccuccuucuccacauacacagauacacauaaauuaaaaguaaaaauaaaauauuaaaaaccaaaaugcaauacuucuauguuucauauacauauaacccagucaugaaagggauuugagacaguauuuuuaauuacaucaaguuccacuacaguuagucacaucaggucaaguguggaauuuuccacuggucacauccugucaacccucaaauagguguagaguuuagagcauucugggucugggagcuucagauucagguucuuuaucugaaccauccauuccuccugcgugagaggcgugggucaaaagagccauacucucuaguaccuugcaucgagucuagacuuccccagggagaggaagucacuuguaggcugaaggcaggcccuccuacuuccuguaguuugaacuuccuguaguuagugagguuuggagaaagaggucgggacaugugugcuugguucagcuuuuuuccccccaggauuguuccugggcauaccacaggagucugguuuuauuucuaaagacccucacgcucacucguuucuugucucuucuuucuucucuaggugcucagauugacgacaacauuccccgccgcaccacccagcgcaucguggcacccccugguggccgugccaacaucaccagccugggcuaaagccccuaggccugcaggccacuuggggaugggggaugggacaccugaggacauucugagacuuccuuucuuccauuuuuuuuuuuuuuaaagagccugugauaguugcugugggcagccaguuccuggggcuuccucuugggcccccugcacucggucuccccuggaguuucugaauucucucacccaagucccuacacagucaugaacaccacacccaagccuagccauccaccccacacggagcugcauccaacaugcagacaugcgccaccaagcagaucccagcaagggugccccagucacauccuuggccaugcaguuagcaccuuccugucauggggaagauauagugaauugcccugagcugccuucuuuucuuuuuaaaaauuuuuaaauaagguuuucuuugugggacuggggagggguggggagggugggagagauuuuuuuuuuuuuuaauacuaaauugaaagccugauucaauauuaauccucgggucuugaacuggacauccuaaugaugcaauuauguaaccauuaagcugauuccgaggcuggcaggcuagggccgccccucuggaaagguuccaugugucuccauccccaucccuuacucuucgggucagcuguugagaagaggcggguuuucuucauuggccuagauuuugcggcagauuagaccuuuugaagguucuccaccauuuucguacgucuccuguccugguuuuuucuucugcacucuuggagagauuuagauguuggucuccugguuuguguuucuccgagacaaugcucuuuuuuuuuuuuuuuuuuuuuuuuuuuuuuuuuccucuuaacucugucugcucuuaaagccaggcaacccaguuuggucucaggcauagccugagcagaucuuaguuuugcccccaccaccauaguuuugugcuauccuaguuucuguuaagauuggugcuauccaauucccaucacuaggagguggcugagcuugaggcuugccagacacaggaauggccccgauuaugucaccaauauugucacaugugggccaagaauagagucacaugugguggaaagaugaggaguuaggcuguagaagugacaguuuccagucaaaucuguaaacccagcccccaagcugagaccagucucccuguggcggagccagccaagauggggccauucucucuguggaggagccccuuccagccuuugucaggaagugucuuuggggauucuagaauguugggacuucucaguguguguguuguggugggggaacuuuuuuuuuuuuucuguacaguuuuuuuuuuuuuuuuuuuucucaaaaggucuaacauggugguggaagguagaaaucuuugggauacuuagacuucaagucuuuuacaagagggacaacccuauuuugggaaacaauaucucaugggaagaaaacuguacacacugaacgcauagcccgcuuagagaucacaucgccucuuagagaccaugucaccuccuaucugucacccuuccucuuccugucacagugacaggucuucacuagcuggcuucuuucuguacuugcugacuucugucauauuucuuuccagauguguuuacaggucccuguaagcaguguuagguccauaggcuuuuaugacuccagucugcaagcaguguuagguugaccucauaggcuuuuaugauuccagucugcugguaugaagcagagcaucaaaaaaaauucgugauuccuugaguguccacacguuuugucuuuggggguuaaggguugggauuuuggguuuguuguuaauuuuguuguuuuaaagguaaauugcacuuuuaaaaauugguugacuuaauauauuugcucuuuuuuuuuuuuuaccugcacuuagagaggaaauuugaacaccagaaaccacuuuuuuuuucucccuguuuauuuguuuggauucugagaaacuugcagcucuucaccauuuacuccugauguuucuuguauggggccguggcccuuuugguuguuuuuggucauuuucuuaaaaacacaacacaacacaauacaacacaacaguuuuaaaccugaagauuuccgcaguccguguaagcauguuuacccguuggcucgcuuucugugucuguuaaaugaaugucauauguaaaugcuaaacuaagucaacagugucucagaacugaauaacugcagugacuugaugcucuaaaucauuguaggauuuaccgcuagaugguuuugaacccuugaaccugugauugugacccaugaggggggaccuuucagugcuaaagcugaucauguguguagccagaaagguacuuuuuuucuuuuaauuuuuguuuuauuuuuuguaaccacugucuuaauggcaaaauaauuaugguaaaauacaagucucguguuuauuauuccuuaagaagucuguguuauauuaccacggaacacccaauaaagcaaaaugugguuguuucagaggugugucuguauugagacucccacagugugucggccucuccucugacgugaugcauggggaagcccuggccuggcuuagccuugggcuugguccagcccaugagugcucacccccaugcucaucccagguuccugugaguauccuggcuacaggaugaauucucaacccauguagugccauuccugggggaugaggaccacggaggcugaggaucaucagugucuuaaaaccccaucccggaaaggcagugagcaucccggagugccaagccaaauuugaaccugggguucaaguggggccacagaaggcgaggugggguuuuagucgaggugcugggcuugcuucucauguguuuacucugggaaaucuucucacuacaugggugcaggggagaaagagauugccuagagugucccgacaccucaguggaggugcugucgaaaccaggaccaaggccuaggcuuccaucaucagcucaggauggaggaugcuggugggggugagagucaggcuggguuucuggguaucaguuugcacaguuccuugcuuugagugcuguugguucugaaugaagaagaugugugcuuugggcaucuugugccuaucauauguuagggaugguuuacccccaccccacaacauccuaucauuauuaucacuauuuauuauugucuaaacuguauaugaggcaacacacagaauuacacaggcccagccuggugauucacaggggcaaaugccaagcauuccggagggcgaggagagacugggugacauaaugagaucaucccuua

SEQ ID NO: 7542 - RNA, 9856 nt, Mus musculus
agacggagaagggaggguacgaggggguggggggcgcccggagccugcgccccggaaguaaagcggacacuccacccgcuaauggacgcgcggcagccgcccgacagaccucucucggcgccagggugagugucggauagcuauagccgggcaaggacccgaaggcucagacccuaguccagagccccucuccccgaccugccucacugcauugcuaagguggcccuggggcuccccuggccucgggugagagcugaggguugagggagccaagguucaagccugaaggcucuuggaaacugggcaggggugacccuggaaacagcaaagucuacuccgggauaaccaaguauccggcaccaaugcuucaguuuacccacgaccugggcgccagggcgcgcacugcaaggagcagaaggaaaggagaauguucucccugcuugcagccccugugguugggagguggggcucacaacauggcgggggcgaaaaagcagaggagcauagcaaaugcaagcggugaccgggggagaaagcagcaagccugcggugcggggggggggggggggggcauaguaaagaaugcagacugaggauugcgcuucagcauagaaacuggggacccguaacaucaucugaaaaggccaugcccugcacaucagccauugccucagaaaaggcucagaagaguccuggauuugauaucuccaaucccucaaaacacacacacacacacacacacacacacacacacacacacacacacacccaaaacggaaaaugguuggggacuaagcagacugaagcacacucaucuugcuuucaagucgccccgccuagcuuccccgccccuguugcacgcugcgcaggaggcccgggaguuugccagauguuccuucucuagggccgcagcgguuugcauggaggguagagguagauugcuguucaggggaggguuacaugcugugugaguugugggcagccaaaguguggggauuuggagugugugcgcgcgugcacacgguucagccacgaccgccagguucgaggcuuuuccuugcuuagucccaccuccugguccuggcuugguugcauuuaagccccuccuguuuuuccagaguggcugaaagcugcaaaaguguugcccauccuuuagggguucuggagcgagaucugagcaugcucacuaagauggauggguuuggucuaggagaggcaguuuacugcagcguguucucacagggcguugugaccaagaaaucagucccauugucagccuuugcuuagguaacgauugcuugcagauaucaacgcccccaguugcccgagauagcuugauugauggagucauaauuugugcgcacacacacacaauccuguaggagccgaaaggagggccuauggaccuuagcaccagaaaugcuuggaauuuucuuauaaaguguccauuggaauugucaaugccacacuaaagcccugaggucuuucauccucccugccuuccaaguuaggacaccaguuuaugagucauuacgccuaaagucaugugucuaguuguccaggccuuugccccaagagccugguuccuucaacagguuauccuauaggccucuuuagugagaaaaguacaaaauccuugcauucuuccauacccaagcauuucccuggugguucuuuuguacaucaaggguguuucauuuacagucuuaaaaucuuuuuugguuaaccuucauuuauguauauggauguuuugcuugaauguuuguacaugcacuguguacaggccuggggccauuggcggccagacaaaagugccagauuccccuggaauugaaguuacagaguaagccaacuugugggugcuaguaaccaaaccugugcauuucaccacuaagcaaucccuccagaugugugaggccuuaguuaauugaagagcaacccuuguagguaugguuaccauuggguuaaaggucucaaaggcuagcagauuucagcaugacaauuuuucugugaaucuggacauuugguguuuuuuguucauuuguuuguauuugucuuuuuuguuuguucguucguuuucuguuuguuucgguuuuucaagagaggguuucuccgugugacagcucuggcuguccuagaacauacucuguagaccaggcuggccuggaacucagaguucugccugccucugcuucccaagugcuaggauuacaggcaugcgccaccacuacccagcaugucgcuuguguuuguuuuugcucuuucugagacaagguccuguuuguaagcccaggcugaccucaaacucccgauguagccaagggaguuaaacuccuggcucacuuaccuucaccacuuaagugcugggguaauggguaugugccacggcgccuggcuuaugcagugcuugggaucuaacucaaggcuuuguacauagugacagcacucugccaacuaggcuacaguccuagccccuccagagcucuucacaucucauuccucgaaacaacuccaagcagaggaaguucacucccauauuuuacaagggaaucucaggccuagauuggucugaaguuccgggcucccaugcugccaagcacagggugagacagcaucuugcucuccugguucugacacaguggaacagccuucaacaccuuccaggaagaccggaucugcuccugcugcugccauaguuaagaccagcaucuguggcauacaaccuccuucagagugaugggagauguucaaaccaaggaggaaguggauauagcacccuaacacacccucuacaagucucugagaggcacagucaggcaccaaauuacaacauuucaguugacauaacacaugugcccuauaagaaugcauggucuagugauggcacucugacauucagccaauuaggaagcggcuucucuggaggcauccucaugacuaagugaccacacugucacugggagcacucccuuuuacauucuccagucuccccagcccugcagagcaagcacgcuuggugcacacaucacuuugcaguggauauguguucugucuuugcccuuuucucaacggcccaguuaaauuuaaaugacaaugucaaguuuaaaugucuuaguuacuuuucuauuucucuggcagagcaccaugaccaaggcagcuuauagaagaaagcauuugaugggggcuuaccgucucagaggaugaguucauaaccagugugggcaggaauauggcagcaggcagggaggcauggagguggagcagagagcugauauccgauccacaagcacaggacagagacugacagugagaagggcauggccuucugaaaucuuaaagcccacccccaguggcacaccuccuccaaaauccuucucaaacaguuccaccagcuaaggaccaagcauuugaacacaugagcuuauggggcccgcucuccuucaaagcaccacaggaagagccggguugguaacuuaccaugcauggcccuugaaaagccuggcuagacacagccacagaagacugacuccuaacuccaaaguguacuucuuuuucugagauuugaauuuucuccguucuacccauuuuaaguacucguaaguguuugaaugauucuguuuaguuuuguuugugucuucuuuuggagacaugauuucucuauauaacccagauugacuucaaacuugcaguccuccugccucaacuucacaaaugcugggagugcuaccaaauacaauucaguuggauuuguuuuuuaaagaugguucucauguagcccaggcuggccucccacucccuaugagguuaaaaaggcucuuaaaccccugauucuccugucuccagcuuucaggggcugguguuacagggagggagcaccauacccaguuuauacgguacuggaaauugaaugccaggcuuucuaaaggcuucuucuaggcacgcauucugcaaagugaggugcguuccccgaacuaccugggcuuuuucuucuaagaaguauggugacucuguccuguuuaggaugcuuuauuaaauucugaggauugucauuccuuucuuucuuuacuaaacuguuacguuuuuaauaagugcauuaauauuugcuacuagguuuuagaccuaaaaagaugcuauucauguuuguguguaacagggcagcuugacucgacugaaauugagacacauacauccuauuguauagagaugugugacaucuuccugaucuggaagcugaguacuuggcuccuugguucuugaaaaacauucuggaacacaugaacagguauuuaacuacaucuccuaauuccaucuuuugaauggugaaggucuugaauccugcucacugguagggcuuucaggguggaaagacuggauuuuagcugguucucaccggggaaaaggacaguuggcaaagaaaagggauucaccagagugggguagacacaggcacagugggagucagagcccuugguucaccccuagucccaccuaguguguguguguguguguguguguguguguguguguguguguguguguccccugggaaguagagggcuguguagucaaaaugagccucuguuucccuaggaguccuugccaucucacugugugacuccccagaguugggugcuagaguggaagccaccucccccauugacuagagagaggcgaagugacagaaaccaggagauggugggaaaagcgauuguuccaggugccucccgaugacaagagucagcaccacgcaguuacaacaaccagcccucggaagcagcagcgaccccacugcagagcaacagcccacccuacguacgcugcaggacccgucagccuugcugugggucugaagacagacagggagugucugguucuugugacuggguaaagggacagagcauuuggcccaagaggcuuugagaccucuuggagaccaaguccagaagcauauccugggacaauggcgguggcccugcuggaggagugguguaagaucauggguguagacguccagaagucacugcuggugguugacauuccgguggacuguggugaaccugagauccagacaguccuccaggaggcucugaagugugucggcagcuaccggcuacuaggcaagauauuccagaagcaggacaacaccaguguugucuuaguggaacuuauggaggacacagauaugucugugguccccagugagguacagggcaagggaggugucuggaaagugaucuucaagaccccuaaucaggacacugaguuucuccaaagacugaaccucuuucuagaaaaagaagggcagacggucgcagggauguuccgagcccuuaagcaugagggagugucuccagccaccccacccugcacguccccugaguuauuggcccauuugacggggcaggcaaugguucacggccagaggccucuguugccugugaaguacuguaagaugagaauauucucugggagcacagcagcugccccagaggaggagcccuuugaggucugguuggaacaggccacugagauagccaaggaauggcccaucccugaagcagaaaagaaaagguggguggcagagagccuccguggcccugcccuggaccucaugcacauaguacaggcagacaacccuuccaucagugugggggaaugucuggaggccuuuaagcagguguuugggagcacggagagccguagaaccucacagguaaaauaccuaagaaccuaucagcaagaaggggagaaaaucucagccuacgugcuccggcuggaaacucugcuccggagagcuguggaaaaaagggccaucccccggaacauugcugaccagguacgccuggagcaggucauggcuggugccaaccucggcaacguucuguggugcaggcuacaggagcugaaagaucagggcccacuccccaccuuuuugcagcugaugaaggugauacgugaggaagaagaagaagaagacgccuacuuugaacaagagagcagggaggagccgggggaaagggagggcucuggcugcuggaacaauucaagaaacaacugagagauauccccacuccgucccugaucuggugggcgaugcuugacaagagacgaugcuugacaaggcuaaccccauuacaguggauucuucuuaagugcaggacugaagcuaaacauuaggacugaagguuuuugucuuuucuuucuuuucuuuuguuuugauagggucucaccuuauagcccaaguuggccuugaacugacauucuuccugccucaaccucccaaauugagaguucugggauuagaggaacaucccaccacuaguuccccaucucgguuuuucuuucugagaaaaaaaaaaaauacaagacuaaguuccaauaccuaaaacuucugaacuuuaguuuccuuuaaguacaccaggguuggccagacagcucgguugaucaaguuacuuaccauucucuucagagggagcaauaaugugaacaggagauaggaauuggccaggcaggggcuggagggaugcucagccauuaagcacauuugcuauucuuuuggaggaguucagaucgcagcacccauguagugguucacaauucucuauaacggggauccaacaccuucuucuggucucuuuggguacuuugcauaugugguacacaugcauacaugcagaccauacacauaaaauaaaaacaaauaaaucuuuaagaagaaaagaaccuggcuaggcaguuuccaggcauuccaaaagugucccuggucuucuggugcaugaaccucacaaggagcucugauuucccauuguccccuuccugaagguuacacuugagggugggaccuucagucagacacuaauccauuuguggauaguguuagaauuagguccauagauuuuucaugauaaaauggcuuauaucuguuccccaguuuuagccuaaucuccuauaugauuuuagggguagcucaucagagggggaaauuuacaguagccuugaucaggacuuuucugagucucauuaagagaaaaccauugccuucuggucagaaaaauggaaucuaccucuugccuaggccgagaccuaccauugcaagcuaaccaaaacauaagcguuaaucaagucgggcagguccaucaccaggcuaauggacugcccauuaggaaggcagauucaccuaacucuaugcuaaugagauggaaggaauaauuaucccuuuaaugaaguaauguccuuuuccuucccagagucccugcuaucuguacagucacuacagaacuaccaugaaaaguaauuuucacuuuuucuuuuucuuuuugcuggcccaggccuaagcgcacauucuuuaguacuuugagcuguuucacucucuccauguggcugcaugcuaacccucuacccacucaaaagaaagcguggcuuucucucuucuuuuucucuauaucccucuuccagguauguuugauccccauaagccauaggguagaaggagagaaccaauuccugcaagcugucauuuuacacacacacacauguacaaauaauguaauuuuuaaaaccacaacaaguagaccaauguuuacucauaccuuugaaaaauggacugaccuuauuuaaaaaaaaaauuauacaaaacacauauauccuacuuaaugugugcaacaaccuacucuuuauagggugugugugugugugcgcuugcaugcauguauguguguguggaggagggguggggcuugugguacacuucauaaagggaaagaugcaaaggucaacuaaguuaaauggccucagcaccaaaaugcucagaagugaaaccagagcagaggcccagaacaagacuuuagggauccacccucugugcgucgcucaaauguguuuucuuaguucuguagaggacugauuuuaagcacuaguguuuuaaacuccuuacaucucagacacccagcagguaguaucaagugugcuaaugaccaagucucaguaucuccguguucaccaagcuugcuuuuguuuccaaacugacccaggacugcagaacaaagcucccugcuggcaauggugagccuauuccaaaagcccuguaauugugcacagacuugaaaagccauagcgccuugugaguaugugugccaggucaagaguacuagggcaccauaaacaaacacugcuuaguugccugccaggcagagcucgggcacaguuagugugcagccugugguagaucccugugugguuagcaagcugcuugguuucucugaacauccguuuccuuaucuaaaaaugggcugccauuaggaucaaguggcacaaugcuuuuuaagggcuuggaguaacguuuggaacuuagaagccccuccauauacugaggaucuuuguauuuuugugauaguugucagcucaaugcauguucucuugauuguuuccauuguauggaaacaagucacaaaguaacagacuuacauuccagucgggaugcuccugcagugaggaagaacuuuggcuuggaaguaagugugcacuagcuggccguccacauuugugguaaguauuccagaaguaguuggugacuguuaaucgacuugacuuuggaaugaugaccuguucuuccggguuguggguuaguuuaacugaagaauaagaaguucuaagaaaggugguuuguuuguuuauuuaagucaucaucugugaugguuuaucuuucggaaauauauuucucaacacuguccagccacagugaugucagugaugggauuguccuugaccacucuagccugacuccacguggcauuauguuccugggaauagcuuugccguuguacuuaccaacagaauacagaguuaaauguuaccacugcgaaguuaccaaauaaaucugagcuagugaaaucgugaguuguuuucugcuuccuauaugccugaguuuuaaggagcuucauuacuaaaagcaaaacaaaaucaagcuaaaggggcuggagaaauggcuccgugguuaagagcacuugcugaucuuccagagguccugagcccaguuucuagcaccuacaucugguggcuccuaaguaucuguaacuccaauuccaaggccuuuggaggccuuaaagcugcuucaacucuccgaagugcauuuggcgagcaucucauauuguggugcuggacacacugugagcaguccaugagaggugaguccccacccccucaagggguucucuguucccaugguuugaacaaacuccucccaggacucucaccucaagucuuaucuccacuccuaacccuuaaggauggaacaauccaagauuccagaaccauugauuuugaagaucauuuuccuuuugaguagguguuccuggugcaagcugcaggccaguccaucagcuuccugcauguuucagaacacugaugucauguugcccaccacugcaucagccuugugcauccugcaggcgucugcuucccaaacuacacgcaaggcacucacuuuuauuaucaaaugucuaguauguucaucagaucuucuggacaucccaugguuugcuagacaaguggccaagaccggcugagucuugauugaaugccugucacccauauccuuaacugaacccuugucuuguucccaagguucuacagaccuuguagccccaguaaaaaucugcucuguccccucuacccaagaaagacuggaagguguuaggagcauucccaugggcucuguaucaucuaggcucugcucaaaaggacacgcauuucuuucugguauguguucaucccucugcccaccacccacuauccacucagaccuaauuaucuggauggcuguuauccaaagcaaacaaauaaaagaaaaaggacuuua

SEQ ID NO: 7543 - RNA, 23655 nt, Mus musculus
cagacgcagaaaagggggcgggggaacucgacuuguuguguugcugcucgagagccggauacugucguccugcggccgugccgcuuccagucuccagaccaugucucacuuagucgagccgccgccgcccuugcacaacaacaacaacaacugcgaggaaggggagcagccccugccgccgcccgcuggccucaacagugagcacggggccgccgggcucagcggagggaugggggaggaggagccgcucggccgccgccgugcgggcgggggggggggguugguggugguggugggggagugggcgggagcagacgacagcucauugguugggaccgagauugugcguaugacugacagcggcgcgcuccgguuaggagcaggcgcucggcgcuggcucgcggccugcgccuugggcgccgagguuuagggucgcggugggcgucgggagccggaggcgcacgcaacucgggguggcaagcggaggcuggccagcggagggggagcaugggacgugcggcggggacaccgggggauggacgcgaccggucgggcguggcggguggacgugcggccgcgcaggugugcuugcggagcucgccuccuaccacacgccgguccagggggucaucggaguuucgugcagggugcuugcuccgccccugacauuuaucuuuuuuuuuuuuuuuagucugaaaauucccaaguuucucaagugaguuuuuuguugcuguuaaccuugaauucauauuuuacugcuuuuucuuuucuuuuucuuucuuuuuuuuuuuuuuugagagagcuucucauguagcccaggcuggccucacucguuguguugcugagugaccugaucccuccuacuuuccacuuucccaaguucuugggugacaggcggcagccaccauacuaguaacuuuucaagugcuguuucuuauguuaaauggauugggugcccagcacaugcccuaggaucacguccauuucagccaaaucugcagugaacuucaggaaauacaguaaacaacacaacagacgcaggccacagguacuagcaauugaaaguugauggucaggauccaguugcagucaaacagacaucuuguccccagaguguccgcuguuguugugagaucgccggaccuucuugcccaaccuuucuguuuggauuucaugucuuaaugaaagagguaguggguggugguaguugucacagggccagaugaaguucuuuaaaagccauuuguaugcuuaaaggucaggcagugucuuucauaagagggauggcuuccaggguggccagaacgguuuagggaagagcuguuacugagucuagaggauaguggcaggagcguuuggguauuuuagccagguguggugccacuugccugucauucaagcacuagggaaguguaguaagcgugguccccagaauaaaacuuugugucagaaaacaacaaaaccaaaaaauaaggaacaaagaauucaggaauuuuaagacucugucccugccccauauuuugauaagcaauauuugauaacuucucuaaaaugccggcuuuuacaaagaucuagucaaguguguccuuaaauuuuacucauaaucacauaauucagaauuuaaaauuuuuacccaucuuuagcauacauuuuuggaaaugaaaagacuaaagaaauacaugcuucauguuauuuccagaagcuguggcucuuuuuugaggcccaugggugcuuucgggagccuucccuuguuuuuggcaugcuuauauaugaguaucuuccgccugggccuuuaugaguuaguugugcucagcgucuucuuacugcuuagaugucuggaaaauucaaagggauuuucauuuuucuuggauucuuuauuaacaacagaacugaaaaggguugagcuauguuuguuuauuccuaagucucacagaccugggagguguuugucauggaccagccagcuucuuccuuaguuuucucaauggcucuuggagacccuccagccuauagaugauaccagauguuacuuugggaaaucugcuagauaaaaaguauuguacuugggcuaauuaagcuguacuuuuaaaaguuacugaaagcucgauggugccagguuuaauuauuguccuugccucuuacuuugcuugcuuuguuguuguuguuguuguuuuguuuuguuuuguuuuuuuuuucgagacaagguuucucuguguagcccuggcgguccuggaacucacucuguagaccaagcugaccucagcacuugggaggcagaggcagaggcagagagaucugccugccucugccucccaagugcuaggauuaaaggggugugccaccacugccuggccuuuguuugcuuuuuaaaguuuaguacacaacccuggauugaacaaaacaaacuuuauugauucuuccaagugauuuuuuuuuuuuuuuuuuuuggaugagcaaaacaacuuacucagacaucuaaaaccauccuaauugcugauaacucuaagcacuuugcuggccgcaguuccacaacuguggaaaacagcagcugaaacacauacagauuaucucuggcuugggauuuuuaucuuuaguucaaggaucauggcagaggguuugucuguccguuuuaauguguaugggugugccugcauauauguaugugcaccaugugcauaccuggugccuaugaggccagaagaggacaucaaaucuccuggaacagaaguacagaugguugugcgccuccaagucaugcugggaauccaacccagguccucuggaagagcagauacugcucuuaauuguugagccauuucucuagccccacagcagaguguuaauagcaaauuauuaaaauuucuuaaggacuauuuuagggguguguguguguguguguguguguguacacguaccuauguugugguauguccacuugagugcagguacccauagcauccagaagaugacguuagauccuuggaaucuggaauacaaacagauauggguccuggaaauugaacucugucuguuccuuugguuuuguuuuuuuguuuuguuuuucaagacaggguuucucuguguagcccuggcuguccuggaacucacuuuguagaccaggcuguccuccaacucagaaauucgccugccucugccucccgagugcugggauuaaaggcgugcgccaccacgcccugcaacucuguuccucuguaagagcagugcaugcucuuaacagcugagccaucucuccagcccaaauuauugauauauuucagacagugaaaccuuucucugauucuguuaccacuauaggaacuguuggaagacaaauacccaaaaggauguuuccaguaguuacuuuuauaauuaacaaaacuaucaaguuucucaagguaagacacauaggagacugcaggaauggcauaaggaagaucagagugguaucauaacucugguguaauuggaauuacagccuuuucuugcuaucugcccuggggaaagguucaggcuagggcacauaugaugccuuugucagucacuaauguguaguguccacucuucuggcacagaagagugccagggacuguuuugagcuuaucugagaucccagcaucuaggaccugaaacagacaggcagagaggcucucaggaccccugagugcaagugauuugugaggccuuaaaaaguugggagaaaaugagaauguuuccugugauguguaagaggauuuaauuguuggugagaagcuuaggggcugcaagcuucaguagugugaugaugaguuacuggccagaaccuguaaugccuuucccuagccauuccagaagacuucaauuagaaaaugagccuccaugucuuuguacaaacuagcacaaaagaacagcuuucaacauguaaacaguccuuuaacaauaacugcuucagcucgcucuuuaaagcuuucuuguuaggaagagaacugccucggaggugguuuccucuguauuuuuuggauuacaugaaaucuuugccuuguuuccuuuccaaguauaaggggaguuugugaggauuggcagagguggcacauuggaaccugagacuguaaaugaguucagaucauggcuaagguaaccuagaucacuuaaugagugagguccaggguggccuaggcuugaagugaaagacaauaacaaaagaaaaguuuccccacccccaccuguuuuccuuuuuuaugucauauucagaaguuaaaguuaguguuuuaaaauguuucuauuucuguuaucaacaccagauuaauuuuguuuucauacagggucucauugugcagcccaggauaaccuugauugaacuuguagcaaccccccugccucagacacccacuggccaaaguuacaggugugagggaccacaccugucuaauagguuucuuucuaaggaauguauaccuagcauucccuuggcacugcacacuuccacagagaacacagcuggagucaggaagauggcuccauccuuaagucauugcaaguaugaggauuugaguuccccagaaccuaugccaagccaggcacaaugguccacccuuggaauccuggcauugggaagcagagauagguagaucccugggacuccuuggcuagccacccucaacuaauuaucagcuucuuggucaaggagagaucuugucucagaaaaugaggguggcucuugagaaacuaccugagaaugaccucuggucuccauaaugcacauguagucacacagaggcacauguacacauacuuagacuaucucuaaaagacaguugcugaguuaaggauaaucuagcuuuuuaaggcucuuucagaauguucacugauucugucagugaacugagaauauagucuacuggguaauugucuuuggauaauaguuaaaaguaugcugugucuuuauaagaagugagauuuuagguagcuggaaagaagacucaauaguuaagagcauugacugcucuuaaagaggacuccaguuugauuccuagcaccagguaguggcucgcuccuaacuguuaacuccaguuaaaggggugcugacacccucuucuggccuucauaggcaccagccaugcauauggcacacagacaccaugcaggccaaacacccguacacaugaaauuguaaaagaaauuuuuaaaaugagauucaagguaaucaaaagaaugcacauacuaacacugaaaagcauuuuaagccgggcgcacaccuuuaaucccagcacucaggaggcagaggcaggcggauuucugaguuggaggccagccuggucuacaaagugaguuccaggacagccagggcuacacagagaaacccugucucaaaaaaccaaaaaaaaaaaagaaggaaaagcauuuuagaguuauagguaaaaaccaguacuuaacacagugguucucagccuuccuagugcuuugggccuuuaguacaguuccgcguguuguggagcaugaggacgcccagccaucagauuauuuuguugcuacuucauagcuguaauuuugcuacugucaugaaucugaucugcaggauaucugaugugugacuccuaaaggggucaugacaugagaaccagugacuuagaggaacuuaauauaguauaauuccauuuguuuauuuuuaaaaauaauuuuugaaguuacucuagucuacagagugaguuccagaauagucaggaguacacagaaaaacccuaacuaagcaaacuaauauaaaaaguauuuuauguacauugcuguucugucugcauguuugucugugugaaggugucaggucuccuggaacugggauuacagacagcuucgagcugccaugugggugcugggaauugaacccagguccuuuggaagaguggcccaugcucuuaacuucugagccauuucuucagucccaaaaaaauauuucauaaguuaaaaaaaacuuguagaaauuuccaugugaaaccauuuaagagauuuccucuggauguaggggugggagccagggguggugccuucccaugaccccagcacuuaaggucuugggauuugagguauauacuggguuguaugagaccauuuccagcaaaccacagagcuuggguuacauagccuauugcacuuggguucagucccccauuaccacaaacaaccuucuuacccccaacccccaaaaaaaagaccccacaaagcuuggcacuaagaaugggaggagagaauuauuauuagguuuuuguuuuuaagauuuaaucaaaaauuguagcuguguuuugcuugcauugcaugaaugugcccagcauguguaauggguggccagggaguccggauaggggguauggaauccucuggaacuagaguuacagauggcugugaaccuucgugugggugcugggaauugaacccagguccucugcaagagcagccagugcuuuuaacugcugagcccucucuccaucccugaaucuuaguuuugcauacugacaucucugagcuuaaggaacacacuuuagaaauccagugauuuuugaagucauacagaauauauuuuacuauaaugacugaccuguauuguggcacuucucugugugcuuuauuugugccauccugguaacucugaaauagcuacagcauuuauccuuauuuacagauaaggauacugaaacacaaaggcuaaggcaccuguccaaacauaagcuguuaacauuagcaugggcugugacugacuucauucugcacucuuaacuguggugcugcugguugccaagugaagacauucugccuuacagugggagugggggcauugugcuucaggcuguugagccuuggccggggucacuuuuaaacuuuccuaggugugucuucucaaguucccagcgguaaagguagugacuguauauguuuaaaguggaaaguagaguuggcaugauggcuuggaaauccuuaagagaaaugaggaggagcagaaacccaggcacuaugucuaccacuuuccuuugaucagauuuuccaagcacuuguugauugucugagucucugucugcagcccuggguccucagugcuccugccagggcaucccugggcuuuguugguuuuguuuauuuugcacagugggcugucugcaagaaccaaucucauugguuuuuauagacacuugaaauccuagaagcagugggaguaggggaaagauuguuuauucucucuuccccucccucuagaauauuuuacagaucuaaauuuagaugugcucuggcacuuuuguauccacuccacgggcacucuaaauauuuaaacucuccuugcuagagaucucuuagcaauacugguuuuaugugcuccuccuguguucucaucaugaccauccucacguagguguagagugaagccaggugcuguuguguggcuguguuguuuggaauuaauuggugauuuccaggcugcuggcaaagggcagagggcuggcgggcgggcgggcgggcgggggggggggagcugccuuugauggggaggacuagcuaacucuuuaguaacagauacaaacuccuuaguauauaagugagcgucugcuguuugucugcaguuacuguguuuaguucuggcagcucugggaauuaggcccccugucacagcucuguaaucuggugaugcugagugaggaugguggugaggggguuguuaaaggcuggagugccauuccagucagaugagcuuccccuccugggccuggugucauuggcuccuuuggugcauucuuggguuugaggcggccuuugacgacucucacugaucugcuaaggguuuagagauuuggcccugcugaccuguuagauuacauuuugaagguuuugggggagauuuuguuugcuuuuccauuuucuuucaaguuauggcuuuacucuguagcccaggccagccuugaccucacucuuuuuuuuuaaaaaaagauuuauuuauuuauauguaaguacacuguaguugucuuuguuuguuuguuuguuuuucgagacaggguuucucuguguagcccuggcuguccuggaacucacucuguagaccaggcuggucucgaacucagaaaucggccugucugccucccaggugcugggauuaaaggcgagcaccaccacugcuuuugaccucacucuuggucgucauauugccccagauucccgagugcaagugugagcauugugccugacuguugguuacuuuccuaaaguacaguauugugcagagggagcguagagcaugucuauuuugugaacuugauuaauuggcuacugcuacugauuccuauuaaaauuuuaagaaccuuaaucauucaacuuacugggccaauaagaacuuucaaaacguacagauuauaaaggcccacccucuuuuccuguggucccacgcccuucagccauacucuccggacuucaugaaaacccuagaaaguagagguccuaggagagaaaaagggaaggaacaacuucacaagguacguuugguauagaagagaaagccuugaaagaguguagcaaaaggagagacacacaucuguagaauagagccagugcuccucaccccucaguuuuuaauuuuuccuggcuuuauuaaggaccuggguuugggaacuauuugagcgcuuugugguaacauucagguuuucacuccaggggcuuuuucaguuguguuaguagacaguuguacuguuaaggugaacuguaugauguugcuaagucauauguugacuuaauuuaguacagauguaccuaaagagcugaggaauccuguggcacacauggcaagugacuuuguguguaacugaaauguuaaauguaacauccugucuaguaaaggaagagguauguaauuuuugaaggacagccugaguuuucaccaaagcauugauuggauacaaauuaaacuuuaaccaaaaagaaaacuaacuggcuggagagcacaucuuaaguuucggauuucuaccuucugagugcuuuaaugcaggaaucccugagggagcauaagaacaugggcuaugacuuuguucguguuuauuuucuucagaauacuuuggcuucuguuugaggcaagucagcauucuuaucugaacucaagcaugugggcaucugugugcacaggagggauuuuggcccugcagugguuaugacuuauuuauuaucugacucguccaacagguuccuggguggagcuacccaugaacagcagcaauggcaaugagaauggaaaugggaagaauggggggcuggagcacguuccuuccucgucuuccauccacaauggagacauggagaagauccuccuggaugcacagcaugagucgggacagagcagcucaagaggcaguucgcacugugacagguaaguaaagcucugggugcuaagucaggaguggggugguuauaaagcuaacucucacaaggggcaagcucauuugcuuaaauacucauuagcagaauaggccuccagguuuauuguagcguacauguuuaaacuggacagcuaggccaggcaugauuguacacaccuuuaaucucagagcgugagagguagaggcaguaaguuugaggucagcuugaucuacaucuugaguuccaggccagucagggcuguauaguaaggucuucucaagaaaauuaaaaacuguauagcuaauggauuuuuauucucagauugaauuauuuuugguuguuuaucaguuugaaauugaauagcagaucagcaagaugguuaagcacuugaugucaaacuugguugacccguuucauccugggucccacaugguggaaggagaaaacugacuuccucaaguuguccucuggcuuccacauauacacccacacaugucuacauacacaaacuaaaugcaauuuuaaaaugaaaauacaauuuagugucaugaauguucucucagaguucaucugaguuuaucccauuuuccuuuguuuuugagcccauguugugacucauggugacaagucucucccguucuaggcaucagaagcagggaccaugugaccuuuuuuuuuacccuucacaguaacaggcuggcacacagaaaacacucaguaaaugcuagcuugcaggaccugcagguugauggcgguuacagccaugucugugacuguggcucgcaguaagcagugcacugaaggcgugcguuucucagaggaaggguuauuuacuuacaucucuguaugaugcuuugcuucugaaaaccuaaguccauucauuaugauuauuauggugaggacuaaaaauacagaaagauguaggaaaggaaaacaagugguuaauuaauuuucaguuugugcuucuuuuccuuuccuuuccugagaaauuagguauuaaauaauauuagcaauucuaagcucauauagguaugacauaccuauugaagaggcugagcaggaauauuuccacaaggugaaggccugccuggacuacauaacaauacauaguaauaacccaucucuaacaauggagagaacuuguugguguaguuccugggacaguguuagccuccuaggcugcucagugcugguccauuugcagcugacugaugagucaccacggugaagaugcacauacacaggaagaauauugagggaugucuaaaaagcagcagcauggguaggacuggaggaagagauugugcauauuugucguagauguuuuugugucucaucuauaguacauuguuaauuuuuaucugagagauagagaaagugguuaaaucacaucugaccuucuuguaugccuuaugugacccagcucugucuccaaggcagcuggaagacagguugguuggcuguuuggcacagugagcacccugcuacccucgugucaucucugccuuguugcugagucuccugucacaagcagaagugagcacauguuucuuucugaguaguugccguugguuuuggaggcuauagcacuagucuguuuuucaguagucuuguugguuuguuuuuugagacaggaucuuuuacauagcucuguccuagaccgggccuggccuugaacucauagagaucugccugugucugccuccuuagugcugggauuaaaggugugucccaccaugccuggccaaaauaaaguuuuuuguauccaggguuuuuguuuuaguuaggguuuucuuauaaggacaacauuuaauuggggcuggcuuacaaguucacagguucaguccauuaucaucaaggagggagaauggcagcguccaggcaggcuaagaguucaacaucuuguuccaaaggccguuaggaacagacuggcuuccaggaagcuaggaugagggucuuaaagcccacacccacagugacacacuacuccaacaaagccacaccuucuaauagugccauuccuugggcugaacauauacaaaccaucauagacuugcugaaggauuucaagagcuuucucuuuuuagguuccugaagcuuucugcccucuguagaucauuuuuguauaugugcaagcgugagacugaucguugguaccauguguccauuauacuucacaggguacaaagaagucacuugcuugcuggaccuuuuauuuagcuuacgaugucagugaugugugccuuggacuaugaauucaucuucccagggucagcuuaguucagguuccuaaauaugaugaggaauggcaaaggggcucccuggccagcuaguccugcugggacaguggguccaguuagaggcacuaccuuacaaaauaagauggagaacaaagaggaaaguagugagagucacuuucagcuucuacagagacauacauuugaaccugcacagauguguacaccaaacacacauaacacaacacugcuacaaaauaggugccuucaauauuugugucauuugacuuauaauugguuauuaggacauguuucuuuugugaccuacaauguagauggaaggguucuucgaauuguuggacauuagcccuagcugauguauauuuucucuucuccuuuucccuuucauuucuaccuccucuucccuacuuuucucuuggugcugaggacugaacccaaugccucuaaccugcuggacaugaauugcucugcugagcugcaucccuagcccucuugugacucucugguuuuggaacuguccugcugaguugcacagacuggguuuaaacuugcuguguagccuggggaagcauuaaacuugaaaauuuccugacccagggucuagaaaagcugggauuucaggccuccaccacuaggccuagccuguuuuucagguguuuuauuuaaaaauuauuccaugccagaugugguaguacacaucucuaaucccaccacuccagagagaggcaggcagaucucuuaaguccuaggacagccacugcaguggagguuagaaguugucccuagcguuccuugcuuugugcucucuccugcccacucagggcagcuucugaaagcccaguauagauucguccuuagagcucuuccuuuggcugucagugcaggagaagcauauuaccguggauuaacaggcucccuagcugagccugagaggagcuggcuuccaggccugaugacauucugaauccucagguguaaccagcuuaccagugaagaagggagcauuucucuagcagagauuggugucagcaauacaguacuucugugggcuuauggaaaaguccucuuaaguagcaggucacuuugacugucgggucuggucauaguuguaugcagcuggcacuugaugccaugguguugucaucacaaagaugauaaauguauaucaugcuuguuugauguaaaccguuucuauuuccauuuaagacuccuuuuaaaaauuuuaauugauuguauauacuugccauauuugugcacauauguuaugugggucaggaggauuuuggauuugguucucuccuuauaccuuaaguagguucuaggaaucagguucccaggcaagcaccucuacccauugagccaucucaccuacucauacauauuuuuuuuaaaagauuuauuuauuauauguaaguacacuguagcugucuucagacacaccagaagagggcaucagaucucguuauggauggcugugagccaccaugugguuacugggauuugaacucgggacuucuagaagaguagucagugcucuuaaccacugagccaucucuccagcgcccacauauucuuucuuggugaaaaaugccuauuuccuauaauuaaauuuagacuugguuuuggguuguuuguuuuauguuugagauggguucucucuauggaagguuagcuguccuggaacaccuguguagaccagauuggccucaaaugcacugaguuccaccugccucugccucucaaguacugagauuaaaguugugugccaaaaauauuauggauagcaguuguuuacaguuuuccucuuuaauuucuggccuaacagaggcaucuguauucuuaucuaccugugcauucaguuuguggugucacauacuguuuuaagguuucugugcuguggaacauagccaagagaaacuugaggaaaagauuuguuuaaccuuacaguuuauaguccaucaucaagggaagucauggcaggaacucaagacuuggacccaaagcagaggccaugaggagcugcuuacuggcuugcuucuccaggcuucuuuaggcugcuuucuuagaguacccgggaccagcagcccagggauagcacugcucucagugagcuggacccucccacaucaaucauuaaucaagaaaauucucuauagacuguccacaggccaaucugauggggccuuuccucaauugagauucccucuaacaaaaugaguccagcugugucaaguugagcaacucauguauuguauagccuuuaaaagcuguaguguauacucacaagaggaugguagcaaagacacauccugacaggacuguaagagcaguuucugccucacagaagacucugaagagucugaaaugcugaggaguugugugagcacagaaguguugagagaaaguguugugagguaauuccaucagagaacacacauaaacacucuuaaugccacacagaaaguuuauauugcuggcugguggcuaugcagagagcuggccucagucaugcagccccugagcaucauaauucuuuguuuuuuauguagaaaacccucauccuaguugucacacuucaguuagcaaacagugaaauuacagaagccaaaaaaagcagaguuaauacauuuagggacuuucuuagauccuggauuaugaauuuuuuuuuuuuuuuuuauagauuaggucuuuguuucuguuuuggcagguguuggcuggcuuuuaaagucagaauggugcuucugacauggcuucaguuguguuaaggucugggggcuuguuacaaaagaacucaggcuguuuggauuggacagugguacacgacagugugaugcuuuuacaucaucgggccgccguauauucccuguugcucugaaggcaugcauuaccacugagggagucugaacauucugcaugacuauuccauuagauucaccacuuucucucacauacgauucgcuuacuugguguuagauagacuucagguuuguuccuguuuccaagcuaucuugcuauagcuuucaguuuucuguuuuccaauaaagucuuaagauacgauaucaagaauuaaaacuacugggaaggcucgauagauggcucaguuggcuaaagagauugcugccaagccuagugacuuuuugaguucuauuuccaggagcccacauggugacagggggcaauagacucccaguuguuguccucugaccuucccaaguaugccaggcaggacacaugugcaaccacacagagagacaucuauguccauaaaaauaacuaaaguguaaaaaacaaacaaaaacuaaugacuaaguuuucucucuuagcccuucaccacaagaagaugggcagaucauguuugauguugagaugcauaccagcagggaccacagcucucagguagguguguguuuuacuuuauuuggaaaauacguaagagucucucacguuugauggcugaaaacuggggcugggcuccaagccugauugcauucugacgagucagcacugaguaguuugccauuggcguguuuacugcagagucagagggagaacaucucuaugagcucacggagcugucacuuugacuguugggaugcucacaguuguacaaggcuggcccuugauaugcugcauucuuaccagcaagcauaaagacaguaaguggaagauaagacuuccuuguccuugccauuuucuccuguguucagguguuugaaagguacugguggcuaucugagugaggccugcagacaccuguuugcguuguucucuacugugugagcacagcaccugugcugggguugugugccugguauggguucuagucuucugucccacuacacgguuuucccacaucucauugcucucccuuuugcuguuuucugacgcuggaaaauccaugugcucaacacuggcuuauuaagcucacuucagcugcucacaugcugaaacuuggaauaccaguuuccuuugugauacgcuuuauuggauagagaagaucggugguaaauggcugaaagaaaugugagugaguuuggccacaugcaggaugguguaacuggugugggaaaagcacauggaguucauggcaaaggcauccccaggacagaagagagcagggagcugaugaucugcuguguaugcucuucagucuguguuuucguuuagacauuuucaaagagugucuucgggugcucuguuggaagcuccauagacauacucugcagggaaagcacgggucauccuguaggcccugcccuaggagccaugcagguuguaaagagcccagaguaagcacaccagggaucaggcagauguggucaccgaauuuaacugugauuuuagggaugaaugcagcuguccuaaaauuaaaaagaaaucugaaauucaggauaguuuaugauauucugacagauuaagaauuaagaaucucagugagauugaccuuaagcaggggacaagccaugcugauggacucaacagcagagacgacauggguuuuggcacagguagcauaaugcuucuagagacaaaguugggucucuggggcaagaauuucaaacaagggagagauauuaguagaugcuuuauacugcccuuuuaaaauugaagaaacaauugaaaaauuagucaccagggauuaggaaaaucauaucucaugaguaagaaaguuugauguuagaaaguuaagaacaguugacugaggcugucucuucuuuaugugcaccugagaggaauagguuuguccagagaaagaagugaggaaaaauaccagguacuuaccagucuuacugggugcugaguuauguaaacaaaacaaacucaaaaacuucacacuuuaacagugugguguuuuuaguccaguuaagggaaauggggagagagacacuuuguccucaugguuaucacuuaagaugacaaugcaagucaguguuggagucaggacugaaagcaaauccaagcccaugaucuaucuaucuaguccuuccacugaacuaaccucugaagggaguuagucccaggagagcuugcugggcacacagagaaacuugacaggaccgcagagccgugggguggggauuccuaagcuggcacagagcguuguucuuacugauaggacgaugguacucaugaggccccauuguguagcaagaaacauuuacacucucaugccgacacuguuguuguugagaauggguccagugcagaacugagaucuuuggaaguagcuucuuucuuaucuugugagacucugguuuauuuguauguggauacaggcgugcagcuuacuaucccgguuuagagacuuugaaaggaagauuaacugaguguaagauaaggacugugagguggugaagacaguugacuggaagcauguguccagggaagagcaaagcaugaguccugugugguuagaugaggggcccuuuugucauauucuuuagucacaggaagauggcuuaaaaucucaaaaugaaccaagcauaguguuaagguuuauugcaguuucuggacucaggaggcugagaaucaugagaucuauagggcagccuaggcucuaaagaauguuugaggcugucucaccauccccucuccaaaacucugggauugacaaauuucagacaauaaaagaauguagaaucauguuaauauuagaguuuaagguuagaaauguguuuguagacuaaaauaacuauaugacuccaaugguaacuuugcuuuauucccguggaggaaaucucaucguauucgaaaauucagagcacaaaucucucuguuuguacucugaaaagaauaaaauauuaacugguuaaaaaauaccuaagcuaaaccagaaagcaggcauucugggaggccaaaggaggaacuaagaacaaacuaccaucuggcuagagugcaguuacugaggcaaaacucuugccuaacaugugggaggccauggguuuaagucuccagcauugcugaaaccaaaccaaaagaacagggaaccagcaagacagccugaguuccaccccacauugaagccccagcacccacaugguggaaggaguaagucagcuuuuaccuguugaccuguggcuucuacaugucauaaauaaacaaacaaaaaaugaaaacaaaagaaucuccuauaggggcuggugagguggcucagcgguuaagaacacuggcugcucuuccagaggucuugaguucaauucccagaaacuacaugguggcucacaaccauccguaaugagauccaaugcccucuucuggugugacugaagacagugacaguguacucacauaaaauaaauaaaucuuaaaaaaaaaaaaaaagaagaaccuauaguagucugaaaacucacaaauguugugcacacaugcugcucagugcuugcagcaugacugcugauuggcuucugccugaggaugaucucaggguugcuccacagagccagcucaugauucugaguaagcucagugccugcugggaaaagcucugucuuaaaugcugcauuguguuaguugguggaauuugccaacuucagcagaacuagauaaggaccgugcugacaaagggacgcaaacauccccugagcuuuuggcuuggauuugguaguaaaggggugauguguagagccaggcucacacucccagacagcugagucccgaggaacuggggcuauggggaaagcguccugugaagaggccagguggcuucagcugucagucagaaucagaguuuuggggcucugguuuggagucacagccucacauuccuuugaaacuaaauaaauacaacuaaugugucauuuuuaggaauuuuucaucucucccuuucuguuaaaagaguuuuccagacaugauagcccaagucuauuaucccagcaguugagaucaaaggccagccuggccccauauugaauuccaggucagccuaggcuacagaaugagguacugucucagagaaacaaaaacaagaaaaggcauguggaaauguaaugguuuuuuguuuguuuauuuguuuguuuguuuuuuucuggccugaaagcuuagguuaucauuagcaauaaaaagaauauuuuucauuuauugcaauagauguuaacuucuggcucacuucaaaauagcuuauuccagaaaaacuugacuaauauguuuucaaaaucuugagaaauauucaucuuuaaaaaaaaaucuuucagagaguaagaaaccugggccuuuggagcaauuugccuggguuagaaaacaguagucuuccccuuuaguuacgaggcccucagcaaggcacacacgcccuguccucauuuguagaguggaaugcagcaguuucuguuuggaauugaccaugguaaaguuuaaugagugacauuggcuuuaguagaugcuggucucaggugguuggcagccucaugauuuaccacaucccuuugcuaacuuccucacagauuuaauuuguucccaucuccuuuuugguauguuuauuuuaaaugcaguugggaauauguacagcauaggaaguuuaauguugagaaggacacagugaaacacuacgugugcauccucggguucaacagcaccaaggccacagcauugccaccccugcagaggacuuuuccaggguuacagucuacuucaguuuuagaaaacagcuuguuuccuccauuaaaaucaccaauacacaacuuuguauuuaguuuguuuuuuuauuaaaaagaauuguucuuuucuguguuucuuuuguuccuuucuucucacuguuuaauucuuuuuagucagaagaagaaguuguagaaggagaaaaggaaguugaggcuuugaagaaaagugcagacuggguaucagacugguccaguagacccgaaaacaucccacccaaguaaguuacugcaugugucugggcgggcggugugauuucugugcucauguggaggggcuugcucaggcccggcaucugcagcacuuguggucugauuccagccucugaacuucuuccccagagaguuccauuucagacacccuaaacgugcugcgucucuaagcaugaggaagaguggagccaugaagaaagggggcauuuucucugcagaguuccuaaaaguuuucaucccaucucucuuccuuucucaugugcuggccuuggggcucggguaaguacccugauagagucaucaugugacuuaaugggacuuaaugggacuaggcaacaaggcagucaaaagaaaggagccaucauuauuuaucuuuuaugaguuauuuaaaauuuggcuaauugugaguaauguauaaauuauuaaauauaaauguaggaguaaaugaaaaaugcuacccucccucccccagaugguaaaacaccauuguggagcaugauucuggaauacacugguaggcugcuauggguaccgucuuugucuuuuaaacuuuguggcauuuauucaaaagucagccaguauuucccuuaauucauuaacuuguggcaugucuuuucaauuaauagcuuccccccccccccgauuuuaauauuuuaagaaaacauacuucugaaauauuuuaguuuauaaacauuagcuuaauuaauauuaguuucaaguccuaccuacuaugcucugagcaugcccagugagucuuuuucugugucugaugcauggaaaguggaucauugcugaucuugcuaugaguggcucagcauagcagagggaagugccugcucuggagcaugggcaggugugcaucuuccacugucucuccuguagaggaucuguuccuccagacagggccaguauucacagacagcugagugagaggcgcuuguggaggaaacaggauaggagaguguggagcuugggaggacucguaauaccugccaacuauucaguucauuuaccacaaaagcuuggcuugggggccuugcaguauuucuugcuuucaugaaucuucaagcuuuguuguugcuuuaauuaaauuuaacucuuaccacagaaaauguuuuaaaggggccuuaaaaauugcugcgauauuguugaggaguuugcugccuguuuuucuuggccguuuuuugcuuuugcuguugaaagggucauguucuugccugguauuggaaagccauguuagguucccaucuuaaaaacacuggcucugugaccaccaucucucuagauuugaaauagcaagagaacauuuuaucuaaaaggacucaguuggaggcuggggagugcucugcuuugggcuuugaaggguucuaauuuccuuagccugaccuggcuuagcaucccugcccuugagcuuuccaguccugacuuagaggaaacagaauccauacagccauuugcucugagcucaucaggggccuguagcucaguuggcacaugcuguuuuaagguuggggagucugggaagugugcacagagucuuucagggcugucccagcuugucagcagagaucucccuaugggccaggcugcugugauuguggaaauagauagaacaugauacacucugcuuccuuacagcaucuauauuggaaaacgacugagcacaccuucugccagcaccuacugagggagacgaaaagccccuggaaauucguguggccugugaagugguguauuguaguuugaauuugagaccuauuguaagcaugaucccuaccuacaacccuauuuuuacauacccaauuccaguaacucucaaauccaguauuuuacucaaacucuguuggggcauuuuacuaaccuuguucccuuuuuggccuguaagacacuuuagagauuccuaacagaguuuacuguuguuuagaaauuugcaagggcuuuuuuucagcaaugccaccagcagauuauaaucuugucaacaguucauugucuccucuuaguaccaccagucaccugcaucauucaugcuagaagcuguguucuagccaugcaguuacaucucuuucuaaaugaggucagguuugcaaauaauaacaacaaaaaagcuuuguuuagucuuuguuuuguuuuccaggacaaaaacaagcuucccuaagcuugaauuuauaguuauaaaaugaaaacaaaaccaaaaaaagaaaaaaaaaaaagcaagacacaagaaaaaaaaauauccugggcaauaaaaauuacuuuaaaccagcuccagagccgcucuuuuccuaagccuccugugccgccuucaguuuguaggaggcagccugugugagugacagacaggaaacagaagaguagaacauacuggcagaguuuuacauuaggauauugcugucuuuucuacgauagagaaucuuuauuuguaaggaauguuucaggccuagacauacaugaaacuuauuuuugagguuuuugugcuuuugguauuuucauguguuaccugcaugugaauuucucaugacuuuguuuuucuaguuucuuuuuuuuuucuaagaagagacuuggaacgagucugauucaugguguuaauagaggcuucuuguuuuaggaagcuuugcuuacacucuggagccuuuacacucugaaggagaacuucaggguuauuccaaguacuugugugacuuggaaaaguagacuuggguugugggaacaguugauaaaguucuggaaagaugccauucauucuacagucuucccaagguguccuagucucucccaggccccugugauuuucucacauaggugucuucucaguucugucaaauuccugauguucugcaauacucagaaaauucuuugaauggcagacuuucuuuugucuguuucuaaaaugugaagcuuuaggaccaaauuguuagacagcaucaggauugcggauuaucucaaguagauuuuguuagaguucagagcacagcaucacucugaaggagucugucuuauaaauacauaauuacuguuuaagauguacacuuugcuauaguuacagaaccauugugaauuucaaagcuagcaaccuacacggugcaccagguugacuugaauaaauuuggcaaccagguuugcaagcgugcagaaacuaacuccucucucacaaaggcuuauaaaauugguguguccuauggaaauggaaagaaagauagauaagacauuucugucaauuuucaagaacuuggcuguuuaucuuuaagaaagauaaaauauauauccaaaauaauuuugugaguuauuuuccuucuggcauuuaauaccuacaugauuugugagcuacuucugccuucuccuucucugcucuuaaaccuggagacgcuugcucugccuucuccccuaucacuucaaguguuuauaccugaguuucuuaggaagaaaguaagucugauggcuuguuguuuugcuguaguuguuuugaaaagccgaaaucaaauggucaaggcugcugaggcuaaacuccagcagaguuugcagcgcugaugugugagcuggcagagcagaaucacucuucaagcgcuugcucuuacaggcagacaucguuuucucucuaaauucaguagcaguuucaucgacagugccauugaacuaugggaacauuuaugauuuucuuucaacauuaaaacugaaguuaguuuugccauuuuugaaaguauuaguaaaaucauggaauacaucacagaacagcuguccaucagugagcuuguacagugcugauuugcagcuccaacaugcgggauguucauccuccuacacagauucuuguugggugaaacagauuguccuaucacaaagcagaauucaacaaaguuaaaauuuaagauaagguuuaaaaagcuuuauuccuguuuacaauuugggaugagaagcaggcuucguuuuaaguuuauugaaaacuggcucagauguuuauaagucaagaggaaagcggcacagagaacagcacagugaagagugaaauggagaaaacucucacggugaagcagcuguuggaacuccugguauuaauggagccagagugacaugcauccuucgucugucucaucagcacuggcgucauuccuuacaguuuacagaacucauguaacuuguagcuauaaacauuuugugccauuaaagcucucacaaaaccugccugucca

SEQ ID NO: 7544 - RNA, 58437 nt, Mus musculus
caaagacgcuccgcccccucaagugacgucaccggccagccagcgggcgccauuuugaaaguggagucgccugucccugccgccgcggccgccgucgcuguccuagccgccgcugccgccgccacuacuaccgccgccgccgccgcuacugccgccgcugccgucuccaccgcgagagaaggagcacgagacgggacgccccugagugaacgccaccauccugccgaccgcuccacccgggccgcuuccuuuccgccccggucccgguccccuccccccucaggugccauccgccuccauccgcgcccucgauccccccauccccaggugugggggcugagccccggucgcggagaccccgacgagcccggcagggucaccauuugcagcgcgacauggcagguaaagaagaaacggcccuugggcggcugacagggugccgugccgcuuccucugcgcgcucuccgucacccccuagcgaccgugguggcggggccucggccuggggcgcuggccgaguguggggcgggcgggcgggccuggcacugagcugggacuguggggccuggaggccgggcccggggccuggcacuacaggaacacggcacgggugcguugggggugggagacggcguggguggggcgggugcaggcgugcagauggguccccucugcacccugcucccuccgcucuuccuuacauauucauuccucuucccggucuacugagaaccuuucuguagaaauguauucuggaccgauaagaaggaagacagcuuugcaaguuaaaauacaauggaggcauacccccacccccccaacucacggucaccccccccccaacccccagcaccacacaaacauuaaugggguaggucagguuuugaggguguaagccugaauuucguuuucgauuuugcucccuucccgugucuuauuuuuuugccacucacgaaugcuaagccuuuaauagaaguugcaaggauuggggugggggcugggugggagagaaagguaauuuaaacuuugcauuuugcacgguagcguuugggcagauguccuuuucccagaaggguuucuuggaguuaaaauaguuguggaguucgccgauauaaauagccaaagggagagggauuuuauaaaaccuugcugaggggggacggggggggugcggggggagaaagccugauugagaauaauuuagcaaggaauggguaaaggaaaagcgagguuuaaugucguuugagagucgguuaucuuuguacaauuuagucuugaagcccuuccucucauagaguaauucuggauugagauugaguuucuuuuccagaaaucccggggugcccccauccccccauuuccucuucagugcugagcagugagugucggagauuaaaccaauuuuccuuucuuuucaauauuugcauagauaauagaaccuuuaaagaaguuaugcuggacugguuuacaguuugcuauauaaacaggcugcccuuugaccuugcugaacaaugaaaugauaauuggaacuguauuguaggagaugagcaacgaauaagguugcuuuuuucuggguccuuuggaugcaguaggugaauguggcaggagcagccuccuuugaccaucucuucccaggcgugcauuuccgccccuuuuccucugucugcaaccagugauuugcuccuaacgaaugcaaagaaauggguguuguguuugcuuaguccacaugaaucauccucucaggcaguaauguucccgaaguuuucucuucguucuauauuucaugguaguuuagccuuauaacucuuuuguaggccuuuuguacauuuaaaggaaaacuaacuuuggugcuuugguugguuuuguuuuuguuuuuguuuuuuccugguagguuuuaacuugaaagguucugacugucuuuaaggagagggaaaaguggaagugagguuuuaaauaucuguaugaugauaauuacugguaggcuguaugucuuuggauauuucguaccugcagacuuguuuuuaauacacuaccaacuauuggaggccaauuugguuccaaaucugugggcucagugguaguuacauagggaguuaugaugccagccucgggaaccaucucuguguuuauaagcguaaacagaacagagcucaguuuuaauugcuauguuuucuucuuccaggagcuggaggagggaaugauauucagugguguuuuucucaggugaaaggagcaguagaugaugacguagcagaagguaagacauuuuaacagugacgacuaucgacuuaaaaguccugggugcugaaggaacucaguguuuuguguuugcuuucugagaggugggaugauagcuuuaaaaaaaaucaccuuucugaaaagucuguauaucuucuuaugucuugcuuaucuuuuuuuuuuucauugaguuaaugaaguagauguccagcagucagugcucuaagguuugugugacuaaggugucuuuguuacauacauucuacauauaaaugacuggucuucauguuuauguguuauuuuucgauaaaacagagaaacagaggccagcagcucuuagcucagaaccgcucccagcagcaccucuuacucuguggggggcucugguucuuuugaacuccacugcuuugggauguggcacuggucgacauggcugcugguccacaugauucacuuuacugugcugcagggauuugugcgugugguuaagacagauaagauagaacaaauuacuguggggacuuuuuuugagauagaaacuugcuaauuuauuucagaacguaucuaaaguuuugaaaugucaaggucuugcgugcagucugaggugaucuuuugugauagagacaaauaaucucaaaagggauucuuugcucagaaauauuuaauauaguuuguggacucuguguguguauguguguguauuugagagggagaggaugugugugugucugucugucugucugugucugucugccugucugucccuagcuggcuuugaauuugcuauguagacuagguuguucuugaauucggagauccauccgccugccucugccuccccaauaaaguuagugggauuuuucuaaauagaagucaaagaagaguauguauuucugguugucugaaaauguguaccccuuucuuuagguguggaaccuuuccuugugguucuccucugcugccauagagugcugugcugaggauuucuuuucagguggugguaggccaaagacuguugacuaggagaugcuuguguggugacauuugucuccagugugugcgugguguggugaguccuguagaaagucauuggcacacuugugcuuccagccucuguuaccuuuguuuucuggugguccuuauuccuuucucacaugagagacuggaaacuuggaaagaauuaaaggguuuagagugacucagugauggucaaucggugcugcuuuucuguggaaauaaauccuguguuggagggaggagucucgaauuccugauuuuguaacuccauuaccuguugaguaguaggcacucagguauuggauccucgguucugugcgguuguguaauacuuggcauguuaugaaagugcucucuacuuggaaaacauuucuugguugcacuguuuauucccuuaucaaacaaaggucuccugaauguugagaacggguguguggugucuagaacauaagcugucuacccuuaagaaacucuguuuacuucuuguuaaucauggggagaaagaagacuucacucaaucagaagaaauagauuuucuaaacugaauaucaauuacuuaaccaaaacaagugauaguuugugcuacuucacacauauacagaauauaugugauggaucaguuuuaauucuuccuuguaugucaguucuuacuagcuucacuuugcucccuauugauuaaauaacuuccuaggguauauguagugacagugugcuccuacuuggagugcgcgcuucagaaagaacauaacuuguuagugcugugucuucacaaguacaugcgcagcauuguuuucaaguuacacugcuuugauuugcagucucagaaacuacuugguauacuucugucugcuauguuuauuaaggggaaguuuugcuuuucuaaugcagaauaugauuauuguacauggcccauagguagggauuacaaucuuuaaaugguugcuagcuccacccuuagacugccugcuuuuuguuaaugaugcauucugauuuuuuuuauuuuugcuauuaguagcuuaugaugucugaucgugcccuuguagccagcagcagccaggacaugcugauuuauuuguguaaugcguuuaucuucuauaccugccuuggaaccuuguuuuggagaugguuucucuguaguucuggcuguccugggaccaggcuggcuuugaacucagaucuaccugcuucugccuccacagugcugggauuaaaggugugguggcuaccaugcccagcugcauuaacuucuuaaauagggaccacuuucuuccuguguuguacuucuaauuuuaaauacaauccugguuugucuucuuucuuggaaauuuucaguggaucauuggauccacuggauuagaaacuagauuucagcaggcaaacuaugacauuucuuuaguauguuccucuuaagcuauuaaggggcuacuaaacugauacuguacaagcaaacacuaugcauucuacuuuggaauguuuuugcuauucuugggauugaacccuagccuugugcaugcuaggcagaugcuacaccacuuagcuacauccccagucuguuaaucccauugauaugucagacauccuccuacaauuguuccuuagucagaaucccacucacccucagucacacuauaaccuucuaauuaccuccuguggaaaucauuuuuaaaaucuauuuuacauuacuuuguuaaauaaguauauuuaguaccuugagucuccacuguuacacuuuaagccuagugacaaagaucuuuguuucuccgaaaaugucauauguaaacugcuuggccuagaacaacaccuggcauacaguaggcauuggauaucuugagugucaguguuccuguugcuaggguuuuuaaaggggaagcagagagauagaaggucuaggauaguagaggugaacuucugaagaggucuuucuguuucuuguuugcagcuuuauaaugcagagaaggguccaacaauuuagagucuguugcucugccuugagccuuucuggguuccuguacuuagccauaaaaugaaugggacuggaugaagugauuucugcuguuucuuucugcuuuuguuaguucucagaugucagaaggagguagcgccauauucuuacuacugauaguuguuuuaagaugguuacucaguagggaccuuaauuaagaauaaugucuuuacuggacugacuuuucaaggcuuaggaguuuuauuagguauacaaaacagaguuugacacucagcuacaggcucuugcuaucuuugccuuuuuggucuuuaaggcaaggcaggacacuuauaugcuaaguuacuguuucaucuacacaggucugcaggcaugcagccuguguguuuuaccuuuggaauagcauccugagaagaaguugagguacuaaauucugucauucuaguuuuuuuaugucauggaguucucaaacucugugaggucaccauaacacuacgcauuuuaaguuuuuaauuuuucuugacuuguaacuuucuguuuugaguugguaagagcacagacucaggucuuaggcugaaguuugcaucuuccuuagucauuauucacugugguguugggcaaaucaguucacccagugaacuccauuauaaaagguuuacuaaaaaccccgacuuaguggguuuuugauguuuaaaugaaugcauaacuauuuaaaaacccacuaccuugcucauaagaauagacaggcuuguuuuguuuuagagacauaguuuuaaugaguagucccugggugaccuggaacuugcucacuauucuugaacucacagagcuccaccuccaccuggcucuuacgugccaccauaccuggccuguugguuuuugagacuaucuuucguggcuuggaacucucuuuuuuuuuaugugguauagucuuugcuggcauggaacucaaguucuucuugcuuccgugcuaaugcuucagguguacaugagcaugccuuucuuguaagucauguaaagauguauguuuauuucagugcuuagagcaagcaagggauaauuagagugaagaaacuggggguugucuuacuauuuuauguguugauguuuguacaucuuuguauugaguguguaccuuuugcgcacagaugucagacaaggguguuggauaaccccuaguuaagcaguugcagacaguuguaagcugccauguuggugccuauaaucagacugaaguucucuggaagaauagucacuguucuuauucucugagccaucucuguagcccauagaauauucuuaaaauaguuauuaauacuauguuggccaaagugaaggcuaguauguuuauguguggaaccucaaacuguacagcuguggaugaccuuaaacgucugauccuccugccuccaccucccaaaugcuaggguuauauaggacagugcuacuaccaugcuugggccuuaaaaauucuuuuaguuaguguagugaguuuaugacaucuucacauauauguaacauuguacuuugcuccuauucccuccccucacuguacacgguuuuuuauuacgcuagcagaaacuaaacgaguuguagacugaaugguagacuagagacacauacgaagcaguaagaucacaaaaacugauucauuagcauaaagcagccccucuaagcagauaggagguucugaugaaguuggggugccuuaagcaucuugaccugggugguagguguauaaauaaauguuugcuauuuuugauuaaccugaauauuucugguuuguuugguugguuuuuguuuuuucuuagacaagguuucuuugugugguuuuuguuuuuuucucagacaagguuucucuguguagcucuggcuguccuggaacucacuauagaccaggcuggccuugaacucagaucuuccugccucugccuccuaagugcuagaaucaaagguaugugccaccacagcucugccuuuuguuuuuaaauuuuuauauauuuuuauuuuaugguuauugguguuuugccugcauguaugucugaaggugccaguuucccuggaauuggagcuauaaaaauuuguaaaagagccaguguucuuaaccacugagccaucuuuucagccacuuguuuugguuuuaauacuuuaaagcauuuauguuuacuuggggaagguggcagguauuguuugguuuugaauccagugcccuaguaaugacuagaauaaagcauggcaaaaugccaugacuccuuugucugugauccugaagacacauguuaagcucuuguccuguuccuugugcucacuggcacuuggggaggaguaaaaugauaccucaguaucaguuuuacacacuugcaacucaguuuucccuccaguagaugaagacuaagcucuuuccaucaucagccccaucucuuugcccuuuagugccacaauguugcagcacauguguuugauuugggauccuguuugcauuguuuagcaccguguucauguucacuguuguaugcuuacuucauuuucccuaguuauggacuguccauuuguguguuuaucugucugaguuuuuuuuuuccccagcuuaaaaucugauagcagagcuuccgaucuuuaaggcaaguguguggaguggugugcugagcuugcacugcccaucagucacaucagcagagggcuaggccacagcugucccauuuuauacucccaccacuucaucuuuuacuauccauugcuuuuaaaauaugaauucaaaauguaaacuguaaaagaugaaacagcauuugcucuuugagacaggaucucauauagccuaggcuggccucaaacuuacuccuaaacacaaacuccuaaacucacuguaugacagaggcucccugggaacuugcauuccucuggcuuccaccucagaagugguaggauugcaggaguguaccaccacacccugcuaauuuaaucauuuuuaaaauauaaauauuuugcauauuugauagucucaagcuuuauuucauaggaaauuauuuuaggauaggauuuuguuaccugaaaccugaaucaaaaugcauucuuugcuuccuauuuugggagaauuuagacuuguggacugguucuuggaaaaacauuuuuuuuccuucuguucuucaagauagguuuucuccauguagccuuggcugucccagaacuugcucuguagaccaggcuggcccugaacucagaggucugccugacucuaccuuccaagagggaauuaaaggcaugcaccaccaccaacugcuccuucuuuguaugagauaaaccuagcaccagguuugcuacugacugaccuagucaccuucacaggacaugcugcugcucuguaaauuugcucgguaaauaacuucaguggcagucuguaguagcagaguuccuuuauuguauuuuaagguaguacuuuuuuuuucuuuuucuuuuauacauuuauucauuaaaagccuguaagaaguaguggcuacuaaaagugaguuagcuggcaucuguuucaaguuuuuaaaauaaauugaaaauuaaaauuuuauauccaauuuaaaaaucagucaaguucuuggaaaugguggaauugaauggugaaagaggggagauugcaugacucaguaggcaaauuccuauauuugcagaugugugcuugccuguuuuuuuuuucaggaugaguuguaagaacacagauaauaacauuguaaguuaguucuuuagugggacaauugaaauauugaagauagauacguagcuagcagucuuaguuguaauguuuaccuuuucuuaccugaagauugaaauuauaauugaguaauuaaggagccucaauuugcuuccuuaauagaaggaaagaaguaaaaacccagagggcuggagagauggcuuggcaguuaagagcacugguccagaggaucuggggccaauuccuaacauccauaugggagcuaagacugucuguaucuccuguuccaggggcucucacauuuuauacagacauacauacaggcagaacaccaauggacauaaauauaaacaaauuauuuuaaaaaaccaggcaguuuuggcaccuaacuuuaaucucagcagucaagaggcagagacaggcagauuucuuugaguuguaggccagccucgucuacaaagugaguucaggacagccaaggcuauuacccacagaaaucccuaaagaaccaagaaccagaaaagcaacaaaacaaagcaaacaaacaaaacccuggacacagauuagagguuuuuuuugucuaugccacgugugcagaagaguuggccugguuguuaauugacaacagcugcuaggaauguugaauuuacauauaguacacacucaugugguauacauuuuauauauauauauauuuuuuuuuccuguuuuucuuuuuucuuuuuuuuuuuuuuuuuuuuccuccuuuucccccauacaguguuucucuggccaaccuuaacuguccuggaacuugcuguguagaccaggcuggccuaguguucuuuagaacagaguuuaagauagcaguucauacugauacucccaguagagagcucuuccuuuaccguccugucuguauuuguagcucucuaucucuccuagaaaugccuagaguacccugugcugccugugguuagauuguaaacauagaaucugcaucuuugagaaugugaaguccggguuuuuuuuuuuuuaauguaagauaacaauuuuauaguaaaaugcacaugagauuuuuguuugcuuguuucugagacaggguucacugcaguccuggcuauuccagagcuugcucugccucccagagugcugggauuaaaggcgagugcuaccaccacuuggcuuauuuuuuuuuaauuauguuuauguauauaguguguguguguguguguguguguauugugcaguggcccacaugguggagaauagaggaccacuuggauugcuuuuuuaguguagguuccugaggauugaaugcagauuaucugugggaagagucuuaccacugagccaucccacuggccuuauuuuuuuguauuuggagaugcugucucauucuguugcccaggcuggcccagagcucauagcagucugcuuuccaaccagcugaggugacuggcuugagccacuccuccuggcccauugcuuuauauauauucuuucguuaaucuucacaaaagcccugugaaguaagcaggccuuguugagaagguuaauguauuaacuguaaucuugagcaaguggagccacuaagauacuuaucuugacuucauuuuccuaaugcaauuuuauuucaaaugcugaucuccaaccugagcucuauggcucuaccuguaaucauagcagucuggagguuggggcacgaggacugugaauuugaggcuagugagggauacagaccaagacccuguuaaaaaaggacaaguagauccuguuuuaauucaaguaaagauuuuauuuuauuuuauuuuauuuuuaauuuagccaaagaagagguagacuuucaaguccguccucaggcuugccccucccaaguacuaggaauauaggccaccguggucaugccugguuuugugguuuugguuuuuuguuguugguggcuuuuuuuguuuuguuuugcuuuuuugcuugguguuuacaauaugguuuguuuuagaggaagcuggugccaggaaugaaacccaggacugaggaccuugcauguaggaggcaggcauucugcugcugacccucagcccguacuuuuguuuugauaugauuucauuuuggggauuuacugaauuuccuguuaauguuauuuugaagcagauaugaacuacagauggguuagaauucuuuaugaagcuuuuaauguauauaaauuuguauuauauguguuuauacauaggcauuuuucuggucagaguuuauaaccacugugaaaauaguuguucuuaagucuuauuacucucgauguauggucuggcaaccucugaacucauugaaaacauuuaugaauucaaaguauuuucauaaugcaauuugccuuuuacacuguguuacuguuuauagaaguggugagaaagccagaugugucagccugcaggcgucuugguugguguuaaucagugcaauggcaccagcauuacuaguggucacaguaaucuuagcaacacacaugagccacugagagcauaccaauuauuauuauauuuugagacagucucuauguagucuuggcuggauuugaacucagagaucacaguucaccugccuuugccucuucccaagugcuaggcuuaaugauguguaccacugcacccagcuagaaccgaccaauucuacuucagaauagcuuuggcagaguaguaagaaguguuacuuucagcuuaaauauuugacacauaaaaguuuuauuacaaaauggaaaacacaccaaaagcauuucugcagcaggguaagguauauacuauguaagaaagagcuuugguaaagcugcuuacagagccgacugcucucuucagaacugacagcauacauuuaaucccagagacaggcagaucuccuaguuugaggcuagccuggucuacauagcuuuuuacaccagccagggcagcauaguaaaauccauucucaaaacuaaguaaauaaagagcugacaaguggugcaggccagcaagacuaagcuuggggagugggggugggaggucaggaguuugaggcuacuuuggacugcauaguuuacagcagcuugagaugugggcuuugaauaucuaucucaagaaaaucaaaccaaaacaaaaaagacuugacagagaguaguuauucaaccauggguauuugguuuucucaggugagcauuggaccuguugcuguacuaguauuuguugaucauaguaaaaucugaguuuuuaagcaaaaguugggauuuuggaaaauguaugugccaccauggacuuuugacaauugcagguucucaaaaccuuucagaugaaaucaguaguagaugcuggcugcacucguguaauaaguugugucaguguuuuggaaaaucugcaugccuaaguaaaguauuuuacaggugacuagugcaugguguguuagaaaccauuuguuggagcaaguauaagcaagaguuuuggaacugaagaugcaggccacugcucucuuuucaggucacagagcucuaagaaacuaccaucugucaggcuagagagauacucuuccguaguucugaguucaaauucucagcaaccacaugguggcucacaacuaacucuaauaagaucugaugcccucuucuggugugcaugaauacaguguacucauacaaucaaucaaucaaucuuaaagaaggaaagaaacuaccaccugucaaauuugacuccaguacccaagagcuaucacuaccccccucaagacuauuaaauaauauuuuccccuuaucagccacauugcuagacgagacuuggguuuuuuucuucuguguguguuguugauugucaugucaugagaaucuuguuaaagcaggccaggcauugaagagauuugcagcaguguuaaccacuagcucagaucugucucuuguuuuguuuugauccucuugccucaaacuaccaaauauugauauuucaggugugugcugccacaccuuguuugugacaugcuggggauugaaccuagggcuuccuccaucuaugcugggcaagcacccugacaacugagcuguaucuccagcuuuauagucgccucauaaugcuuuuguuauuguauagaguuuauuucuaugaaaaaauacucuaaaacuuuuugguuucagauacuaaaggaaauugugcuguccauagaauuuguccaacuuugcuuagucucuuaugguugaauauguguaguguauaagucugcggguaccugugccuguguacauaaaggccagagguggaugauauuuuuccuuccucagucucuccacuugcuugcugacuggauggcuggguggcuggauagauggcuugauugacaggucucacaauguaauccugacugacccuugauguagggcugguuggcauuccaaaagcaagagaucugugauggcuuaaagguauuucaaccaagccuagcucuaccuuuuugaggcagggucucacugaauuuggagcuuacugauugacuucagaagagagaaucccauaguuuaaucaauggcucacugggucuagaaaaacaccucagggguuaagaacaccuagaucuauugaaaucaggcaguuugugacaaaggagucauaaacaccuuugagaucaauuuuuaaacaggguuucacgauuguacuugaaugugauagguagaccagacuggacucauggucagacaucuggauuaaaggugugcuccaucaaguuuggguuuuuaacuuuugagucagagucuucguuugaguuguuagagcugccuggaacucaauauuugguuuagacagcucuauggcagucccccugucuccacuucuugaaugaugggaugcuguacuucuuucugcuuuaaacuuguucuuuguuugcauauauacugccuuaguuuggaagaucggugguauaacuuuugguuaugauacaguuuugagauagucucucauuguagccaaagcugaccuuguauuugcuguauaccuuaggcuggccuccagcuuaagcugaaacuccugccucaguuuccucaguacuaggauaugagcuucccuacacuggcuaagagaauauucuuucuaaagaauauugauuuuaagcugggggagggggcaguacauacuuuuaauuccagcagucaggaagcagaggcagguggaucucugaguuccagaccagccuggccuacagauugaguuccuggauagccagggcuacacaaagaaacccugucuuggaaaaacuaaaaaggaaagagagaauauugguuuuaauauuagugacauuaaucuuuagguacuagccuugacagguuuagugucgccugucccuucuguuaccugcugugucucaacaacaaaacuauuacaggaauguauugaauugaacuacuugcacauuuuauauuucauucuggggggaaggggaugaacuaaaacuccaguguuuuauauuaagaaagaaaaaucugagggcugaggaggcggcucagcgguuuagagcccugcucuuccagaggacccaacuucaauugccagcaaccauguggugccuuacaaccaucuguaaugggauuugaugccucuucuggggugucugaagagagcaacaguauacaugaaaauaaauaaauaaauagauuuuuguuuuaaaggggaagaaaauauggcugacaguguaacugggagaaccuugguauguguauaugugugguucuggguuuaucccuauuacugcaugaaagacaagacacucagaaaaaugagacuauauaaagaggacuuuguguguguuugguaauuuuaaauuuuucugaaguugugggaauguuagcuguaagcagcauugcuucugagaaccugcucuugugccacugugguccaucugcaagacuacacagagaagugcuuuggugugggcuguggcuuucuuuuguuuuuuguuuuccaguuuaccacaagguaaguuaaaagucuaagguacuaaauauaguuagauagauuucuaaagaaggauagaaggauucugcaauauuuucuguugacuacuaauaagguuguugaaaagaacaggcuauuauaggcaguaaguaaagauagcaugaaaaugauuguuacugaaaucaguagaacaguugugugucucccuagacaaaucauguucuaauggcacagugaguuccuugucuuucugucuuugauucuugucuuaggauugagaaccugggaguuuuauuuuuauuuuuuuauuauuauuauuauuuuguuuuuugagacaggguuucucuguauagcccuggcuguccuggaccgcauuuuguagaccaggcuggccucugcgacaacaccccccccccccccacacacacacacaccaccacccccccagugcugggauuaaaggcgugcgccaccacgcccggccgagaaccugggaucuuaauacuugcuaggcacuuguacugaguuuaagccuaaccuggugauaucuccagagcuuuuaauuuaaguuuuuuugagacaagguuucacuguauagcucuggcuguccucugcuuuccggguucuggaacuaaaggcaugcucccggcuccagaaauuuugauccuauaaaauugaaacucuguggcagauaauaguuccacccuucccucagccuggagaaucaccauucuauuuucaguuucuguuaauuuaacuucuuaagacaccucaaguauaggcaguagagcagucuuguuugagacagggucucacuagguaacuuuggcugucuuggaacuugcugugcagaucuagcuggccucccaaaugcggccauaaaaguguaccuucuucaagcaguguuuugugauuaguuuauuaaacuuccauggaucagguugaccuccaauucguaauucuccuguuucuaccucuaagggaccuggugcagggaaagaaaguacaggcacagacuccugaagguuguccugaccgccucucagucuguggcacacgugcaccacauauaugcacacuaaaugauuaagaucauauaaguguaaaaugucugcuaagugcuaaggaaaacagcuaacguuaagucuguuucccuguagcacuuuuuagcuaugaacucauacagcccacucagccaaccucucaggauaacucgguaucuucauuucauagguuaggaaaaccagaaauguuuucucccuauuuuuagacauggucuguuaacaucuggcucuuucugcuuuagauuucauaaaauacaugcuuuguauuauguuauuugaguuuuguuugaaugauaaauggcuauaauuguacgucuagcugguguauuuaguguagacauuugaguugaaaguuacuuauuuauccuaauuaaaaacuuuuaagacaggaucuuauguagcucaggcuagccucaaacuuaugguaauugaagauaaucuugacuuucugauccucuugccuucauacuaccaagagugcuggaaucacguaucacacuauaccugguucauacaguuccuaauacuuuauuuaggacauauuuaugaagaaauacaauuguuggaucaauacaucuguuuuugacuucugaugcauauugacaauuugccuuaggacauuaggguuggauuucuuuauugggagggaggguccguuuugauuuucaucucucagugggucauggugucuguuuccugaccccuuaauaauauguaacaagauauuaaccguauacaaacagcuuuucugguguuuuuuuuuuuuuuuuuuuuuuuuuaaauugagcguguaaguguggaauucuccacacuuaacauacauuuguguccucugucccuuuuccuuugguaccgccugccuuuucucacuguccuuuugcccugugggucaugccuucugagaaaguugcauagcaguucagagaacaaguauauugaaucuauuguguggggauagguuucuaaauaaaguaauuuuggaugggcagaaaagaagucagaggaacaaacacuugaaggugacugugguccuuacugcuauucaaaagguuaaauacaaggaugccuagccucggcacaugaagagcauucaagaagcauucaauuagcaauauuaacagacaccaucugacagagcaaucuuuuugaguuuuuugaagauuuuugcuuuucauuuuauagguauaaauguuuuauuugaauguuugucugcaugaugugccagaagagggugucagguccccugaaaguggaguuaugugggugcuaggacucgaacccugauccucuaaagagucugcugagucaucuuugcaagcucauaauagaagaaucuuaaaagcauauucaagaucacuuaauuguuuggagguuuggaacacaggaaauaaccuguugcuuuaauaagcauugcuugccuuggguggguuaggagacugggaaagccaggccaagaauauugauuguaucagaguugagguuaggcaguggaguagcacuuugacuguuuggguaauuuaaaauuaaauguuuaguaacaaaaguucaaauguggucaucuuuuuugaggaacaguuugcucuaagcagagauugggagguagaaguugggggguauugacccuaguugcugcagcucaaaaaaaaaaaaaaaaaaaaaaaaaggccuugccugaaauuucccuugcuauccaagaagauaauaguauaaaugguacauggucucuuuucuguauuccucaggaaagaaauacguguaauauuaucucacuuugccagaacguugucuagacugaugaauauauucaguguccuuaggaaauucuagagauguuugaggaacuuagaaaacaaaucguauugccagugagcauuuuacaucccccccuuuuaaauucagagucuuuguguggauaugcuuguguugugggggugagaaucagccuuugauucuucauuugugcaauuggaacauugcaggggcaccagugcaguugcuugcugccagagagacagcauaggcuuggguuuugcuuuguuuuguuuuuccagugaaagaggguucaauuacaaaaauaacaauucuuuacuuuguuucugagugaguccauugugcugaaauuguuguagaaauaaacauugucagggacuucuuuucagguauuaaacacagugggccaacuugggguuagggagauuuuuaccggcuuuuaaagagcagugagcaucgucguauacagccauuucuagauuaaacucaaguuuaguuaaaguuauaucuugcuauuuuagucaggguuguuuaugcuagauugugucccaaugugagaaugaauuuuaacaaaaucuuacucuuuauuuaauuuuaauuauccuuucacaauuucaugugaauauaugaaguaucuuugucauuuauccuuccugucucccucucaucccauucugucaaacccuuccuucccagggaguccacccucuuauuuccaugucuuuuuuuguuuacuuccuuguuuuugagacacugagucuaaauagaguugcuuuuaugaucagauuguuuauuauaguuaagucagaauauuccuguagcccaggguagccuggggcuaauuuuagcccagguugugguggauuuuuggcagucuuccuuccucagccuucaguucugagauucuaagugugagccauccaugaugccuggcucacaugcuugugcuucaccugcccuuggugaucuuccguugcuguguugaguaggaacugucucugaccagggucucucucucaaaguauuuaaucuucgauuuaguuuugguugguuuucuuuuugaacauauuuugaaaugaauacauuuuugauuuugaccuagccuuaccuugaaaugcugcucugacuucuaaaguauuugcuucuguuuucauauuuguacaauacauguaacacaacuguuuuucacaaaucagucagguauuuuaucacagcaauagaaacccuaacugugguagcagcuauauucauagugaucuucucuugcuuguaggguauaauauuauuucaugcauacucagaccagauuauucaacagggauuacugguaaaggacucaucucagcacauucaaguucacggucaaauuccuuuuaguuauuucacauaauacaaauauuuuuuaguuugaauuaggguuuaauaacauucauacuacugucagaagcagaaacaguuacaggaauuaauaguucugaguaagaguuauaagaauucucuaaaaaauuagaacaaaaaagggagacaagggggaaucagaucaguccagagucccaauaaccauguuagaggaucuccagaaagcacaaauguuagagacaagaaaagagaggaaguuacaguuugagaagguucaccuugcaccaccaucucaguuacagagcauaacaaaagcauaccacugagaaagggagaaacgcagcaaggauagcaccaagaucuucagcccuucaacugcaucauaagcagcaacaacaaaagcagugucuuccagaacacagggagaaguuaacaagccaggucaggcugugccccacacuaacccugaagcuagccagcuauguccagucuacagcacucagggcucauagcuaaagaauggggccucacuacagacugagaucuguguugugugcgguugucaagaguaaacuucauagaugacaagagucauguucccuuuucccaaauagcucuagguuucagucaaguuuacagaacucaggcagccagcagcacagcugcauaggaauuuauucuccgauccucuaccuucuuuuccaaguaaauugaagugcccuucacaaagcuuacauagcaguuuauucugauacuucagugagauccagcuccgcaggggucucccuuuaccuucuuagucuguguuuucuucccuagaaaugccucaagugucccugugcuaucuuuuguuagacuguaaauauagaaucugcaucuuuggugaugggaagccaguaaaguagccuguauuugcuuguagguuuuuuaugugagauagcaaucuuauagcaaaauacauauuagguuuuguuuguuuguuuuugagacaggguuucacuguguaguccuggguauucuggaacuuucucuaaaagacuaggguggccucaacucagagaucugucugcuucugccucccagagggcugggguuaaaggcguguucuacuacaccuggcccucaccagggauucuuaaucucuauucucagaaaauagaaugccuaucuuuaggaagguggggcuggagguaaaauguauccuguauguagggaagccuuuuaguuauuuaacccuaauuaaauguuuugugagcuagaauacauuugguaauuuaagauuugucugucauuaaguauuuucacauugcacaguacgagguaugccuaucauugagcauagaccucuguucagcaguggaugauuuaugcacccugcugagcagcugugucucugccuccuuucugacuguagauauauuguugaagagugauugagcuuauugaguuuuguaauucaaaauguuagaauucagcuacaggggcuaguguacggcucagugguuaagaacacugaugcuccuuucuggccucuaaaaguaacugcaugugugugguauacaaaccuacauguaagcaacacacacacacacacacaaacacacacacacaguuucucuguagcucuggcucacauuuuuuuuuuuaauuaaaaaacagcaauaaaacuuagcaccuaagagguagagacaguaggauuucugcaaaguucaaggcuacuguugguuguaugauuaaaauagugaguaccgggccagccagggccaaauaguaaaacucugucucagaaaauaauaauaagcugaguuuaaauugcuuuguggaguuuuugugacaguuuauauguucuaggcugcuugugacuuguaauucuccucccuuagaccacugauacuacgguuauauaugucugcuaccacaccuggccuaaacuuguguuuugaauugaguuuggugacauuuagaauucagcaguuaguaaaauuaccauagaagaaaauauccugggaauuacugaugugggugaaaacaacauuguuuuguucaagaguagaauuagacuagguaggaaaacuaauacagauuuccuaucacuuuuuaucaaaacaggcuuugaaagaaugugcaaaguaccuuagcacuauugacuugugguagugaaugaugaucuaaacccacguguuaaacacucugaaguguccaacagcauaauagggagaguucaguauccuuggaaacccuggaggagugccccaacuaagccgugagacgcacuuggcagguacacaguaguagcugggaaagaugacauuguugacugcuuuaguguuuguuuacaggguugagagcccccugaagaguaggagaagggaccgguauugauuggccuagguggaaaugauaguggucuauaggugguuagauuaaugaguauuuuguauuuugaagcagggauuaaaaauccaguagcuugagaucugggacuguaguaacuaaaugguagagugucugccucauagguccugugagguccugcaaggcccuguguuagguccucuuaaauaacagcaacagauacacaggccugugcacacaggaguugggugaggcagggaggcagcuagggcuguugaagcucaaagaugaaacugcucuaggcuucucucuuuagcuuguagucaaguuaccucguggccaugaaguucuuaacuguuuuucugugcugaccaaggaacuauagugggcacccucuaacauggcuccaauggacacugcccucugcugcucugcucuuuguauaaguuucucccuugaaugacacaccuaacaacugacuaguacaagcaugacagaagugaugacauacacuuacagaugaggcuacccaaaggucugugcuguucccuuucauuuucuuucauuuucaugaccagcuaccaugauugugaacuuuucuggaauccauguggcagagaacugguaucucaggucagcauccaggaaaaaugaugucugacagcagccaugggagugagucuguaguuggcacuuacauaguuucccucuggagcauccuuucaccugacagcccccagaaauaaggccaucggaaacaauuguuuuuauuuugaagacauuaguccaguggaguuacacagaaaaucuccaugucaucaagccuaaaauuaaauuucagcccccauugcucauauauuuuuaaguucuuuuaaaugcaguuuauggcuacugcuuuuccaaaacacugucugcuuggcuucuggaaaaacaucccaccucaccagcagcccccaacccagucaucucuucaugugguuccugcucagcugccaaggauaggaaagccucaaggcgcuuagccugcaacccugguuuucuuuaccugccccagaaggaaaucaccuugaaaugccauaugacuuugagugcuuucuguaaacuccugccagauccauuuagcugcucauacaacauucugcucaauuguaguucacucagagaugugcagauggacuauaguuuuucuuguuuuucuccugcuggguuuguuuuuacaagcuuguuacuacucuucuguauguugguccauccguccauccauccguccguccauccauccauguuucuggcagggcugccuucagaaugcauucuucugcugcuggacaguucugacucuucucaucccuuauuuaguaagaacacauucacagaguuauuugaaacauaacuuccuuugagaaguguaauggaaacaaggaauugaauuuuaaguauggcugcagaccaggucaggaaaugccuaccugauguuuuaccuaccaaaauuaagaggaaaaagaauuuuaaaaaagauccaaguagaaagaauucacuguaauuuccuuucuccuuucuguuugacuuuugagugucucaggcuagccuugaacauccuuugcaggaaauaauggcauugcauuccugauccacugccuccaccuagcuuaaguguugggaguguagguugcuaccauggcaugcuuaaauugcuguuccuauaaaggcacgugagguguuccuuugauuaaggguuugugaggaaaucagugguguaaucuuuuggauuaguuauccagcgggcuuuucuuucuuuuguuuauuugcucuuuagacgcuguuaacuggagcuucugaggcacauaucugccuauuagugaugagguccucugagccagugggaagaccuaaacuuauuuuucuugauauuuaucuuuauuuuaugcacauguuugaagauuuguucauaccugaccucuuggccucuuggccuuagauuuuucaucuguuaagucuuuguauuaauguaaacagguguaccuguuuguggugggaauuaaaugcuaguacauuacaugcagcuuaccacagcauggcacugcacugcacugcacugcacuggcucugacuacaggguugcuuacuaggauuucuaaagcaccucugcuuugcucuccuaucugcucucccuccucccgauucccagucuucuguguugcaguugacaggacacaagcugacaggguuguuguuaguuaaaacucaguguucugguuuuggauauuagaauaaagccuguaaaaaauuuuuaacauaaucuaaaaaucucuagucuuuucaucuaaauuucuuaggaguuuguaaccuaugagaaaucaaauuugaauuaagaaugacugucaagacaaauggacagugcaguguguccugauucuuauagugugauuaugacaguuguagucuguaaagcuuuuauaaauacacacaucgauagaaaccaauucugaguuuaaaagaaauuacuuugaaaauaacuuuuuuguuuuguuuuuugagguagaguuucucuguguagcccugguugucuuggaacucacucugcagaccagguuggccuuagacucagagauccaccugcccuuacuuccgagugcuggaauuaaagacauucaccaccucugcucggugggaaaaaauauuuuaugugucugcuaaauguauauauaugcgucacauucauucaggugucuggaaauuagaaaugaguguuggauccuuuggaacuggaguugugcaugguuguggguccuuagaggcaucucuucagccuugaaagaccuuucuuuuguuuuuuuaauuucaaaauuaaaaaccucuauagcuacacuucuguguguuuuuagugccguggaauauuuuaguuuucaaccauuuaaaaauauaaaaucugccagaugugguggcacaugggcuuuuuaguuccagcaaagacagaggcaggcaaguaucuuguguuugcugccagucugguccacauaguuucaggccagccaggaccacacccuaagacccuaucucaaaagugaaaguagaaacauccuugguuggugacuaagauacccauagaugugaagugugguuuguuugcauacacaccagaagaaauguuuguaucaccaccaucaguauuacuggugauuucagacugggucucacucaguagcccuugcuggcuugggguuugcuaugugacacaggcccaggcucugugugugugugaagaagcaacagagcaaggcaguugugauacuguuacuuguuugggcuguaggcucagauuucagugaacuaaaguagaguguuuggaaaacaaaggccaaggcuauauugaccauaacacccuagggacaauuaauauuuuguuuuauuuugcuguuuauaaagggucucacuguguagcccugacugggcuaggacaccucuagguaguagcagguuguccauguuugccugccugucuuugucuccuuaaugcugggguuaaggagucucuaagagcuaggcuaagcuuccuccucuaggcauaagauaaugaauggccagguaggaaaaugacagucacacuuuugguuuguuuucugugccugugcugcacuaaugugguccugagguaucguacaugagugguuucccgagugaaccuaggaagacaaaagcagcuuuaucuuaaaaaagaaugccaaccaucucauucuguccauguccugaugugaagacagugggaacgcacugacucaggcuucucuggacgcaacagagagucaagagucgaagacauuugccuccaggugcuuaccaccacugucugcccucugccucucagguaagagggaugaauggucuagucagugccaaguggggcggcuaugaaguggagggaagaaagaaaugguguggccuguuugucagggguuuaguuuugaagggaagagguuuccaaaggacagcauuaaguuggaccugcuuugcauggcacaguggcuguuucuccaacaaucagaucuguguggguuuaguggcuugaccuugggaaaacuauugaggacuuugagcucccucuagaggacaacagucuaaaaagagccuccuaaaguucuucagggaaagaaccugaagauagccaucccuuuuaaguaagaaguuacugcuuugugaacguauuaaccuccccuucguguguuagccucacaagugcuaaguuucaccccagucugagcauucccuuauauauuucugaaugagucuuucugaaaaaauuuguguuagucauaucuaaguagcuuuguggggucaaagaaaagauggugaaaauggaucgugccuuuuaauuggaauauaaguauguaccaaucucugagucuugaauggaccuugugaaauguacagagagacagauaacguguuuaccugcucuccucaauccaucucuccacaucuggaaagaacaaguacaggaagauuaacaagaugaugagcuaagguauaggcuugugccuaauuaaacaugugaacgagcugacacugacccgccuaagcuucagagccuagcuaacuaccgagcaguuuguuccaggacaaaaguguuagccguggucaaauggucugagguccauugguuauagcuuugauugugguucauccuuuuauucuuuguuuauuccucuuugcagaacuuguguaaauucaguuauuuaaaaaugcaccuauaaaaugaaauguuaauuuugugcuaaugauuugaauaaaacuguguguguguguguguguguguguguguaaguguguguaaauguccaugcuuggggagaccacugguugaggucagaugucuucuucauguuugcuuuaugugguguuggauaucaaauccaggguuucauacaugcuaagcaagcugccuaguaacugaguuacagcucccacuuuauucucuuaugugcuagcauugcccuucuucgucuucgucuucgucuccgucuccuccuccucuuccuccuccuccuccuccuccuccuccuccuccuccuccuuuucuuuauaaaguaugaggagauaugaauggugaaagcaugccaaaaggauccaaagccaacccugaaggcuuuuaauggcuaaauguugaauaauugaaauagauugaaauuauauuuaaauuuuaacaaagagcuuuaagcuuccuccaauccccuugaauuuaggcugcaccuuccuaagcacaaugugggggccuaggaguaacuuucuauaggaaaaaccuuagaugaauagagaauggacuaugucaucaguaaaucauggacauuuccacucuaaccacaaggaggauguaccacuguaauacugugacauaaacgguaugcuaacauuugugauuuuccugccaggaacccacaguugcagcauuaccuaccguuuaaaaaaaugcauuucacagucucagauugagggauuucccacugucuacugcccaggacucucaaguucaucaaagacaaggcagucugaggaacucauaggccaagggaaguaacgagacuguaguaggguaaccuggacaaaguuuuggaauggaaaaggcacgagggaacugaggaacagcacuauccaguucauuuaaaaugugccaagcugcuucccuaucugugacaaucgcaguaugaggugugaacaguagugccacuagaugaggugucuauaggacucuguaccaugugugugaccuuucuuaaaucuaaagcuggggguaaaguuucuggaagggccucuaucagcuuuaugcaguuuuguuaaguguuugugaagugagucgccuguuagucugcaugucccuguuuacaggugagcagcggcaggcuguucuguaggaaacugagggaagccugugcuacuuugaguguaguuugucuucccgagguucguguucuggcugcaugguccucaaggguaaccaugugagaaauagacugugguauauggaauguuguggucauguucuuggaagacgcuaguucaguguaguuuaugaacuccagguuuucuaacagaaagccaugguccuaggaaaaauugaauaguguuugcagauguauggcccuuucacacccuuaauuuucugaauuagacgcuuccuaauaaaacaauaguauuuucuccagccauuauacucuuguuccugcuagauagguugaaauaucuguuaaauaugucaaggcauaugcucuguugaaagacaaacccaaucgugaacacagaaaccacuacguauugguagagcagagcugggacccuauccuuagucuuuugucauccccuagugguuagugacuugcagggcauuguugagauuggugacgggaaggaggaagcuuuucaggacugaagagagggagagccuggcagccugaagaugggacagcuagcuagcuuguucucuuguagcccuuuaaggacgcagaugauagugaguauuugaauccguuacuuuaaacaugagugauguaaaguuaugaaagugaaacuugaaugacugguaauacuuacagaauacuauaugccuuagguauaccuugaaggcuuuaaaaauucagaaagcaugguaacaagugagugauauaucagauuaggauuacagaaugccugggauaggauuccaaugucuggauuuuauuacuuuccgugacaaacuuauuuucacaugguaaacauaacucuuuugauuauacagugcuauaggcuuugagaaaaaccaaucacagucauuacugcaacugguacaccaagcaguugaguugcuccagaacauucaggcccucuguagugugcaucucaucccugacccuaguaaucaacucguggucucuuguuucaacuucuguugccauuugcauuuagcuuuauucacccagcccaaggcaucucgagcuguauccugcuugcuauugcuuauaucaguaguuauuccuucuucuuacauucauauaugggugucugguuucuuagguuuuguuuuacuuggguaaguaagugcuuggguaaguaaguugcuuagucaacauguuaagaguguauuuguauuaguuuucuuguagcugacaaaaaacaacuuagggaugauaaaaagcuuggcuuacaguuugaggugauauagucucaugccagggaaggcaauaguggcuauuaaucuuguguccacagucaggaaucaaagucugcauugccccuccccugguuuuauucagcuugaaaccacagccccugagaugguugccaccaguggggucuuccuccucagcuaaaccacucccaaaacagaagacuugaggaggagguauguuucuuaggugcuguauuggcuaguuuugugucaacuugacauagccuggagcuaucacagagaaaggagcuucacuuggggagaugcuuccaugagauccagcuguaaggcauuuucucuauuagugaucaagggcggaggcccccuugugggugggaccgucucugggcugguagucuugguucuauaagagagcaggcugagcaagccaguaaagaacaucccuccauggccucugcaucagcuccugcucccugaccugcuugaguuccaguucuucuuucagugaugaacagcaauguggaaguguaagcugaauaaacccuuuuccuccccaacugcuucuuggucgugauguuuuuguccaggaauagaaacccuuacuaagacaggugcuaacgacuuuggucagguugacacugaagauucaccaucauagugcugaaguccugcacaccccuguugcguuugcaguguugugugccuauacauuacguuaagugaucugucagcagauuacugccuuuugauuucuuucucauuuaguugaguaguauauaagaguauucugguaguauuagggcaguggugaugcaugccuuuaaucccagcacuugggaggcagaggcaugcggauuucugaguucgaggccagccuggucuacagugugaguuccaggacagccagggcuacacagagaaacccugucucgaaaaaccaggggaaagaaagaaagaaagaaugaaugaaugaauucugguguuccuguagaaaugauacaguaauggcuuuccuaucucuuaccugucuauguucugguaauuuguuuucaguuuuuggauauuguccuuagaguauuaaacugcuuuguaacuuuuagaaaacugguaugauggcacuuuuaugauagagaccuuccuuuugauacugagauguucaaucacacaguaccuacccucugccaaguuacuaaaauaacacuaguucucagaaguaggauuaagaauucucuucccuugccguuuaugagacuuaaggguacaauuaaagaugcauaacagcuggacauggcucagcaugagcuuggccuuuacuuuguauuuugaaguacagcuugcaggacccuccaacccagauggcuagacacacuucagcaguuuauccaaguuaggucuucuucccuuuauuuguauucauuuacuuguugguucuggggcugaaauggguccugugugcuauaaaaaaaugugcucucccucugagcuacagucaguccuaagugcaacaugaggaggcaucucuacacauuuauuugaucuuuaugugcuaggauuaauuuuuguguuuuauauuuuuccuuugacauuacuauuaucauuuguuuguuuuuugaggcaggguuucucuguauaccucuggcuguccugguacucccucuauagagcaggguggccuugaauucauagauucuugugccucuuccuccaaagugcugggguuaaagauguguaccaccaccaccuggaauuauuuauuauuuuuaacaggguaauuguguaacucuguagccuaggucuccuauuguagaccagacugaccucaccguaccuuauuuuugagaugguauuucucaccuauagcccaucuagauaggcauuugacccaugagcuauuugucuuuacuccuuggcaguuuugugaaugugugucuagguuuucuuacucuauuuucaaacauuuauuaacuccuuaugaauauauugcacaucuuucuugcagagguggaauuuagaaugugugaucacucaguacccuuggugucuuuaauguaguggaugcuguguaaagugcuuaguuauugcucagccauuacuaagguauaaacuuguuugguucuaggugcuuuguugaguacagguacuuugucggggugaaaggaaagcagcaaauugaaugccuagacuguauuccuuuaaccuucauuucaugacuuccagaacccuaugcugccccugaaaccauauggcugcuaaauuugagucuuggcuuugacucuugacacuuguauguagcaccacccccuaacauacuugauaucuacaguuuuccauuguuccucuauacauggaaaaugaaaaacauuacaguuagugcuaugaauaggaaauagauauauuuaaugcucacuugguacacuguaguucuauauaucuguccauuaugugcuuggagucauuuuuauagaagaacuaagguugucagacuuucucaauuuacuagcuaaccagcuaguaaauuaccuuuaguuuuuaguuuuuaguuuuacuggguuccaggaagguacuuacagagagggugguaggccauaguuuucaacuugugacuacauuucccaucucuuguuuaucggguauuuagcacacguucaacuuucaguuuuagaaaucuugcauaucuguacugguugguuucuuucaaauuacuucuuugaaaagucauucuuguuucaaauuauaaaaccagcgaguaacugcauugccucacagcucggagaaaaugauagggcugagaauuugguccauugaugugcaguguuugucgcuaauuauuacaguuucuguaggccacaagcggauguuuuccuuugaguuuuaaaacaacuguuaaaguuugggauucuugucuaucuguuaucuguuuauuacgccacacgaaggacuuucagaaaaguagaugacaagaacaggcaagguaaaaauaggccacuaaugcugcugucagucacacccaccaaagaagugauuauuucaccugcaaagggcaagccuggaugguaauaguuuagaaaggagauguuguauucauagaaugaauccauuauaaacucgaauugauguaagaacugaugaagccuuuuaaagacuuugcuuuuguugcauaauuuauaaaucuauguguuuaaaauuugcugaguguuaguuggugagugaguggggaugggggauuccuuuuucccacuaaccauauuagaaugcucuuaagauuaguaagacagucuugauuguaaaauaacauuuuuauuaucuuuagaaagauuccuuuucuuugaaaagaguauuuuggucuuugacauuucauauuuaugaggacauaauguucuguacugggcaauaugucacauuuaauauaaugauucugauugcggugucacuacuauugcuuuuauaaacuacagaauaguuacuuaacuuuuuuuuccccccaugaguacacuguuguugucuucagacacaccagaagagggcaucagaucccauuacagaugguuguaagucaccaugugguugcugggaauugaacucaggaccucuggaagagcagucagugcucuuaaccacugaacuauuucuccagcccuaguuacuuaaaucuaaagaguguucccauuuugguagcuuucaugacacaguucucuuuuucagcucauuuguuaucuuuguacccaagaguguauauguagcugggcgccuuuaaucccagcacucaagaggcagaggcagguggauuucugaguuggaggccagccuggucuacaaagugaguuccaguacagccagggcuacacaaagaaacccugucucaaaaaaacaacaacaacaaaaaaacaacaacaacaacaaaagaguguauauauuacugacuuuuaagaauacaauuuggguuuacgacuauuagaauuccaucugaaauuauuaaaaauauucccucucuguaauaucuuagaguuuuguuguugguuuuugagacagguucucauguagcagaggcugauccugaugcucuugccucugccucccaaguacuggggguuacuggccugcacuacucauugguuucuuucugcccugauuuugaaggcuuugaguuuauauaaauaauccuagcagcagagguaagcucuugcuuagcauacuugagucuuccuucagaguuggaucuagaguaacccuuccagcaaacaaaaccaaaaaugucaaugucaucaugcucauuagaaguauguaaauaaagccagguauggaggcaucuaucuuuaacuccagcauucauucaagaggcugaggugguaggauagcaaguuugaggccaacuugagcuacuuagcuaauccuugucuggggaaacuaaaccaauaaaaaguauuguuagaaaauuaauaaaauaauuauuguuugaugucaucauaaaauacugcaggacuuucacgaaggaaacuaguuaugaggaguucaagaguaucccaggcuacaagagaccacuuuuccaaacaacccaccaacugggcuuucaggaugguucaguguuuguagugcaagccuggaaacuuaugugaagaugaagagaaccuguucuacaaacuugcccucugaccucuacaugcaccuguuggcuuagucccccuuuuacaagucacacauauacaugguuauaauagcaaaucccacaaauaagugucugguuucuuuuuuucauucacaaauuagugaaauauuuacaaaccuggcauuuauuauuaucuuccugauugguugaauggcuuugagucaguuuauuugggggagccucucccccaaaugaaaguguuuuauggaaauguuucugaugugcauagauggagaaugcugauaugaacauccuuagugaguugagggucaaaaacugaugucuuuuuguuuuuguuucaauuauacagcagauauaauuucuacaguagaguuuaaucauucuggagaauuacuagccacaggagauaaaggugggagaguugucaucuuucaacaagagcaggagguaaguacugacaguucaguguugccuuuucaguuugaucuugagauuggagguugugcuggaaaaauccagcuuuaacgcuggacccugaguaaauuuuugucugcagauagcuuacgguuucucuuagcucugcgugugugugcuccuguauguaugccuuuguugcuuuuauuugaaaacccauuugaauuguaaaagccuuugguagagaagagggugggaaguaguugauuaaucugagacugagccagauuugaagucuuuacccucaguaauaaguugaccucucaaggcuuagcugcucuguguaauugaggguaagguugauuggaagaaaaucagccaaauuacuuuauaaucaguucauacaaaaaccauuacuagccuuaaaugucuguguugugcuugcaccuaugugaauguaauuaaugcaucaacacagugcuagcuuuuaaaauaauuuuuuuuggauacuguucccuuuccucuuaagaaugaaaaaauuuaaauacagagucuaagguuaaguacauuucaguuuuguuuuucuuauaauuuaugcacacuuguaaaucugauugacaggauaucucauaagaauuuuguauggacacaguuugucauacuggauauuuccaagcuugcuccagucauuuuuaugucaaguugucaccuuuaagacaauuggcuuugaaacaucagucccugucugucuguaacauacucagagaauuuaauguugauaaauugcaggauucuacaaaugucuaaaucaaaacacaggguaagguuuuaaaggauuguaaaauuccuuaaauaagcaaagaaucuaguaauaauacgacuacuuugcacuucuauagcgccuuugaccugaggaucucaaagugcuuuagaaacacuaaugaauuaauccucacaacaccccagugagguagguaauuuaauuuuaaaagaaaugauuaauagugucugaaacacuaaauaugucuccuuuaauuuaaucuuugguuggaagaaaguagaaaaauaagauucaagccuuugccugacaaagagugaucuggugggaagggaggcagaaucagguuuuuuguuucuggauuuguuuugagccagggugucagauaucucagacuggccuagaacuuaacuauguagccaaggauggcuuugaacuucugacgaccuugccuccuccacuucugaagugaugggauuauggaccuauagcacuaugcugaguuuuauuuuuacuggggacggacuuuaugcaugcuaggcaagcagugugccaccugagccacauccccagcccauuuguucaaacagguggaacuugaccauaauuaucuuuaaaagaaaguaaaaugggacuucguuucuuuacaaauaaaaauauuaaguuagaaauauauagcuaaucucuagaacuuuuggcauaucuuuucuuuuucuuuuuucuuuucuuuuuuuuuuuuguuuuuuggguuuuuuuuuuuuuuuuuuuuuguuuuguuuuguuuuguuuuuugagccaggguuucucuguguagcccuggcuguccuggaacucacucuguagaccaggcuggccucgaacucagaaauccaccugccucugccucccaagugcugggauuaaaggcgugcgcgccacuacugcccggcuucuuuuucuuuuuuuaacugccuuuuguauuagauuccccccaaaugugaacguuauuuauucauucauuacuuauuuggagacaguaugucauauagcguaggccagcaaugaauuuggcagagaauuugaauuugggucaucuggcucugcuuuccaaguccugggauuaugagaauaugccacuacaacuggcuagaaagaaaguucaaaaguaauuucuguuacugugcuugaucucgcaggcaaagggcagagcauacaggcuucccauucugggguggggggugcgguuccaguucuugcugaggucacugcuauuuuaaaaugaaaguugucaacuaaaagcuaacuuggaaauauuuugcauguggaugaaguaauuuccacuuucuguagguguuaauuuguuauuaaagccaaaucagaugcaaaaaaggaugggaauuuaggauaaaugaggcaaaugaaugcuuuuguaugaguuuagcaguugucaaagcacucuagaaucuuucuaacaggaccagugauagugcuugguaacaaaaccggacaaagggaaauuguuuaaacaguuauguguaucagaaaauaagcccagcaguucauaucagagaguagucucgggguggugagacaccuuugugguuaaagguccuucagccaaaccugauaaccuacagauugauucuuagaacuuauggucaaaggaggugacagacaccuagugguucaucuggcuuccuuauggggggcuuuggcacacccccaguugaaagaaacuaguuucuuauuuucugaaaucucucaaauuucugaaaugcuauuuuaaguaaguacuguuugaggaggaaugagcagaaugggaaacuuuuugguaaucaugccaugauaugaaaaggagucuuuucauuuguuuuauaugcauuauuuugaggaucacucaguauauauaaaauguuuuuaaguuauugguuaaguaacaguaaugauuuauccccaaaccugcauguuguugauauuaauugauguguuucugcuaguuaaucuugcauagccaugucuuagaguguaacucugggucugucagugauuaauaauaagugugugcacaagcugugagggagucacaucuauauuggugaaaguguguuccuggaaaagggaaaggagcuacaauaaucuuuuccuuauuuuuagguuaaaugucccagaaaguuacauaacaaugguauauugcuuauuuuaauagagaaauugaggcacaaaaguaaagagucgugucccguccucccccccccccaggugaucauagccaugguguggucaauaaaucuuuacaguauguccuaaaguagauuacccaucuuccguauuugguuuacaauuuaaaaucgacguaucugaauguuuuguuuuuaugcuaacaguccaggcuucagaaggguuccggcugccuuuugggucugguuuuugcauggaugcucaguugagaugagcaguugcugugacugcuuugcuuuucuuuggagacauucuugucuuacugucugucacucuagcugaccuagcuguagacuggcuggccucaaacucacaaagauccuccugccucuauauucucagugcugggauuaagguauacaccacuauaguugcugguuucuuucuuuuuaaccaguauuuuuuuguuguuguuguucuuugugauuuucauucuuguauacauauuuuaacauuucuaccuugcacccuaacccuuccugucucugucuccucuacuuccuuccuucuuuuauaagcccacacacagccuaguuagugcugcccauauguauacauggguaugaggccauccacaggauucugggaaaccuaccauuguccacauccugaaagaaaaaugacuccuuucccccaccccccacccccagccuuuaccaacugccaguauaucuucagcuaggaaugggaccucauaagucccuucuccauccaaaugaaaugcugaguggcuugauucuuguuuaagucuugugcagguaaccacuucugcugugaauucacuaguguuaugguuuaaucuuguccagaaaaacauuuuacagcauccuucucaacuucuagcuuguacauucuuuccacucuuucugggauguuuauugaaaugaggguaggggugguaaguuaauauacuuagggcggaacacucauaguggcuaaauucuuagugcuuugaucaguugcuagucucucuguauuauaaacugcugcccacugcaaaaagaaccuuccccggccuaaguaaguagaguguaacuaaccuacgggcauaaacauaaauauuuagaaggcaguuugauagcaugaacauuuagcaaaauaacauaguaggaccaccccuucuaccuucagccuaugaccuucuuagccaugggccuuuggccaaguuuacagcuccacacaugaauuaccuccuguggcacaaaccucaaauucaacuaaguaguuguaccucuguaacagccauuccauugugguuaggugaguacgucuuucuuguuaagguugguguuguagcaggcaagguccagugcugauuaagagcgcugaugucuucuucccaagcaggcuguguaguaccuuuccucuauggaagcuagccaguacggacguuucuccauuaguuccagauucauuuuuuuuuuuguccuauaauuggucuaguguuuuggcagcagggucuuuccauuuaguuaugguagauagccaauuguaaaaacaauagccuguguuguuuugggugcuuuuggggccuccgucaauaaugacuuguagggaguuaagccaguuuucggacugaaauuuucauuuuauaaccuguaccuucuggaugcagcauuguccaaccaagcacccuucaaacccauuguuugaaaguuugguauaaaguuuuuauacccaaaauuauuuuauacaaaaauauauuuuuacaaaguaguagguucuggaaagcuuuuucaucuuggcguuaagcauuugagugggggucauuucccugacuuacuguuauuuuucuccggaugcuuguaacugauauuuuaauuuacacaaaaauguuuaucagaucugagagcuuuuuggugcucuuuugggucgcagguauagaaucauauuaucugguaauauuauauuaucuuccuuuauuauuauuuauuauuauuauuauuuuaauguuuauggaugguuugccugaaugaaugccuguguaccaugugcacaccuguugccugugaagcccggaagagggcagaggguguuagaucucuuggaauuggaguuagagcugggcauuuauugaccuuggguccuugagaagaguagccagugcucugacccacugagccccuggaucucuuacugcccuggcuaacuaggaauuauaucacuguauugaguaggagugaaaagaggaagcagccuugucuuuuuccuggcuuuauuguaaaugcuuugagguucuccccuuuuaauguugguuauaaguuugucuuauauacccuuuauauuguuaaaguacauucuuucuauucuaguuaucuucaggacuuuaacaugaaaggauguugaaauuugucaaaagcccuuucugcaucuauuuugauggccaugcgauuucuguccuauaguccauuuguguaauuuauaacauauuacauauauauguauauauguaauuuauaauauaucucgagccauccaucucuacaucucuggaaugaagccaacuugauaaucuguuuuguuuguauucuugaauucagguggcaagaggguuuugugucuuccuuuucuauuuuauggaaugcuuuuggaaaagcauugauguuauuugaagugaauccaugcaacucuagacuaauuuugguugagagacuuuuuuuuuuuuuuuuuaaaucauaacaagaaaggguaucacuauauaucauagccaccucuaccuacugaaagguauaugccacaaucccuggcuaaaauuauacucuguguguguguguguaucugucugucugucuuagucuaguucuauuaaugugaagagacaccaugaucauggcaacuuguauaaaggaaaguauuuaauugaggcuggcuuacaguuucaggguuuaguucauuaucgucauggugggaagcauggcagcaugcaggcagauaccgugcugagacuucuauaucuggaagggcagucagccagaagaaacugaggcaggcuuccuccgauaaggccacacucauucaauuccagcauuggcuaauggggaccauucuuauucaaacuaucaaguguguuucuggguguguguauuuguacacaugccaugugcacauggagaacagguucuuucccuuucaccauggugauuuaggaaguugaacuuugguuguuaggcuucaaggcaacuuggcugcugagcugucuuucaggccccaguugggagauguuuguuuugagacaugguuucucugccucagcuauuuuguugcuuuuguaguguuugguguuuucuucuuugucuaguuuuaacuauuacucuagugugauuuauucuuccuguggccuaguagauaaguucacuuuucccuuccuuagaaucuucuguaaagcugacuuccuugucauacauugcuuuuagucuuuuguuguuuuugauuugggacaggcuggccucugccucgauucuggagugcuaggaugaaaggugugugccaccaccuccuggcuuauuuaguccauuuuaaccauggaaauuuuuuguucuaccauuaugagagguugcuuugcuggauguaguagucagucguguuuggcauccauaaucuuucugaauugagaccuucuggcuuuucaaguuucgguuuuauaguagaugggccugccaccauauaugaguuguuuugagauuacuuucuuuguuuuguauauuugcuuuuuuaaauuacguuuugauggaggcaguuccuuucugguugucugucuguauccggaaugccucuuguauguggauugucaucuaucucuuucuuacuggacauguggcuauucacaguuaaauuuauaaagagacugcagccacgguggugaaauaaagagcaaauacauaagacaacuagguuugcagcaugcugcuguuacucccaaagccuccaccugagguucuagucacugcaucuuccauucuaaugggaugcaaucuuagagaugcugacguauguaagguauaaaauagauagggcuuggacuuuucaguagugcaguucaugaaaauaaccaauagacccauucuaaaagcugaaaaguaggugaauaaacaaaggagguagcuauuaaccccauccauuguggugcacaccuguauuccagcacagggcaggcuggugugggagaaucacagauuugaggcaagccugguuuauauagcaagaacucuggaguggaugaaugaguugagugagugaguaucccuuugauuauaguauuuuagguguucaguuuauggccagugguuaaccugugggagguaauguguuuuugagauagguccuggccuuccagggcucuacacaacaagaccaccaugggcagaauccaaacuugccucuucauauguguaguuuuuugugucuccuugucccugugcaguguagcucucugucuuacguacuaggcugugaggcuuguuagggcagucuucuguguuggggguucucuucuguuguugcucuauuggaaauaugugguuuggguuuuguacuguuuuuggugaaucuaaguaugucuuagagcuuguuuggaagcuguuucuauguugcuagcuauauauuuugcuaaguccuuucuguugcaaaugcuguuucucaggcagaaccugaaggcuccuacauuccagacacuacuaguacagguguugaggauaagccacuugugacucuguugggcaaaauuuuacgcauaaugcacaugguaaagaaaauagauuuuuguggugcucaaaaacuaagaaauuagguguauuaaaaggccaugcaagaaaacugaagcacagaacauggucaaauguaugagggcuauuuuauuucauuuuuaaaaaagauuuauuuacaugaguacacugaugcugucuucagacagaccagaagagggcaucagauaccauuacagaugguugugagccaccaugugguugcugggaauugaucucaggaccucuggcaccacugagccaucucuccaggccucauuuuuuguuuuaagugaaucccagaaagucacgugacguugauguguguugaagguaacacacuuuaccuuuuucuuuuucuucauacuuuucacgucguggguucauuagagaacagcugccaugguugcuuaaccuaagcauugguucuucuguuggaggaaaagcccagcuggcugcaagcucacgucuggagucugagggguuuuguuuuugcuuuuucagugcuaggccaucuauucuauuacuuugucuugggagugaguuucucuucuguaguguaguggcauguggcuucuuuuaaccuuaagauacuauuuucugguguaaauauuuuucccuuuagggaaaggauguuucuuauaguugccagacuccuagugguuguuuguuuguaguauguuuuuguaauagauucaaauagaucagguguggaccuugugugagauucuugaggaaucuuugaugguauccugauucuguuucugaaaauuauguuuucauagguuuaugguuuucaugaaauaacucaauguguagcuucucuuguacacuggguacuugaaggguagacuuuugauauaggggauucuguucccuuuaagccuuagauauucauaguacuauguaucauuguuuaaauaugaucuuaaaaaauaauaguaacucaauuguagauucauuuauuauuucaugcagcuguuuggguaaauuuagguguguaagacugacaacaugugauguuugaguauacagaaaaaacaaauacauuauggaauuugacaugaguguggcacaccaacacaccccauaguuggauaugcucuugguauguucugaaaauguuuugaccagcccauucacuaaugacugauguaugcaagaagaagugaacaguccggcugcauugcuagaagaaacaaaccaaagcacauguuuccaagauaauuuaacagguuucuucugauguggacgagaagauggcuauuuugcuaacuauaaauauuuuacuugauaacuugguuuucauuaaagugauuacauacaauuguauuuucauuuaaucuacuuuuccaaagauucuaguaaguuuuacuuuaauuuuuuuaugaaaguauuuccaauuguauaaucggucacaagaugaaauugugugauuauaauucuuaguuuugcuaggcuaccaguguuaauggaaacacuucucaaguaguguuuauaucaaaucccuucaauuggacgaucagcagacuggcacuaagcaucaguguguaaaguuccugugaccagaaagaacucaggaaaguaagccaugaagcaguuucaggcaggcauugacaggcugcuguuauauacuuaacuggcagcaacguuaucugaaguaggacuuggauuguuggauuuaugagagcacauuucuuacgggcuuuucaguagugaaauauagaaaggaggcuucagaaaggacaagaaggccagccaucacauuagauaacagcagacaaaauguguuccagccagcuguuucugagcagugucuuccuaauuuuaaaauuuaaauguuaucuauuacuauggguuuucaguuuucuucuuaaacaguauaaccaugcuauuuaauaugcaaguuaaucaaaucaguuuguauuuggucuacuguuucccuauuaaaugagacuuucuuaaguguuuccuucuuacucuuuauaaagcuuucuccuuuaaggccuuuaaauacagaaaacaauacaguagcauauacgauaaagcagccuaguugggguaucuacaauuuucagucuguuggaguugauugugauuugauauauuucucaacauaguccaauauuuuuuucuguuguagaacaaaauccagucucauagcagaggagaauacaauguuuacagcaccuuccagagccaugagccagaauuugacuacuugaaaagcuuagaaauagaagagaagaucaacaaaauuaggugguuaccccagaaaaaugcugcccaguuuuuauugucuaccaacgguaaguguuccucuuuugcuuucagguacuacaugggcacauguccuguagaggauauaggcccuucccuguacugaauguaaaguuauuucuaccugggcacguguccuguagaggauauaggcccuucccuuuacugaauguaaagucuacuacuuuugcuucucauauuguuaccucgcaaauuuuagauuuauggguacuacuaacuuuuauuuaggcugguuuuauuucugucuccuuuggcugacccugaauauugacuauuccuuaccagcagacauaggcagcagugucugaguuacagcacuguuaugaauauuuuacaugguaacuuggcagguagaaccaaugcucagaaaaauguuuauuuccuuuccacuuccuuuccaacucuacagaggaugaucucuaggagagcacccuccuuccuuaacuuugcuuguuacuuucuucucuaugagccgcaggaguuggagaagaaucuucucauuaguuguacuccuguaaggaaagguauuagaaagaguuagagcucugugagauguugaccaaauuuugaaguucugcaugauaaauuaagaguugaggguguguguguguguguaaaaugugacuuggcuuaucaaucaggaccuugagauugcagagguggguaugauacuuggagaucuggguguauggucuauuaaaacuuucagucugaaaucucacauuuucucaucuaacuauuaauagaagcaaaucuuagcacuuaugucuuucuguuugcacaguguauagacucaugacuacuuaggguaacacugugggagauguuuagagcccccucugugcacucuuguacccugugauuuucuguauugaguuuauaggaaugcagugcauaaagcauugccacuccugauuccaugccucguuggagacccauuuucucucaauuaaauuucuugacucucugccuuccucucuuuuuacauaaaugguauuuucuuuguauuuaugaggcaagggagguaaugaaacaguagcccaggcuagcuuugaagucuugauagccuacuucugccucccaaaucugggcaugcccacuguauccaacuucaccuauuucugaaagcaaguaacauaaccaggcugcaacgcacggcaugcuuggcagaggcgccggaugacagcuucucugaggugcuucaaguaguacuuuagacccuuguguguguguccaugugccugcaucaaguaauaacauaauuauacuauuuuugauuuuguggguuuuuuuuuuuuuuuuaacuuuuagaaacaaaugucccugggaaauguguuuuacauuguagaguuuguggcuuugaauguuuguuuucacagucaggggccuuauacacagcaagcuagguagauacacuacagucucuagaaguagugguucuccccaccccucacacccuuuuuuggagacagggacucaaccauguagcccaggcuuaccugggauuugcaaagcucugcuuccccguuuccugaguauugguauuaaagccauucagcauuauaccugguuaccuaccuacuuacuuacccugccugccugcuugccucucucccucucucugucccugucccugucccugucccugucccuauccucucucccucccgcccuuccuugaaguagauucauaguuucauguggcggucuugaguuuauuuccuaacucaagcaaauuugaccuugggaucuuucugccuuagcuuucccagguugaaaugacaagcuugggccacaaggccuauuucauggcagcucauuucuauuuuuacuuuuuacuuuuucguuuucuuuuuuucuuuuuuuucuuuuuuuuuuuuuuuuuuuuuugguuuuucgagacaggguuucucuguguaguccuggcuguccuggaacucacuuuguagaccaggcuggccucaaacucagaaauccgccugccccugccucccgagugcugggauuaaaggcgugcgccaccacgcccggcucaauuuuuacuuuuucuaaaggaaaguucaaguauaggcuuucaagaggucaaguagaaacaguagugaaugaugaggcccaguucgagagagagagagagagagagagagagacagagacagagacagagacagagacagagacagagagacaaugaauaguguuacaaauuauuuaagagccuugucuuagucacuacuucuguugcuaugaagaaacaucaagaccaaggcaacucuuuuaaaagaaagcauuaaauugggucuggcuuacaguuuuagggguuguuuguuugcuuuagagggcuucuguuuuuguuuuucucuguaacuauaagagacauaaacuaauuucguccuguuugaaaguuuggugucuugguuuucuauuugaaguauguauaagguugaugacuuucaguuggcuggagcuaguagagggggaggggcagauuugucaucuucaucuucagaaauggauuucuaaguggugucucugucuuuugaaguuaagaaaaagugugucuguauggugugugugagcaccuacugcucagucaucugucuguaagccuaauagcacacaggaaacagccuaguuacaggagaaccagacagggucuagaggcgagcuuaggggagacugugaguuacugaagccagaaguuuuauguuuacauuucaucuuguagcaagugguauaagcaggcaguagaaauggcugcacuggugucucccuguagcaguugucuuauacuacuuuuaaaauggcuucuaggcuauuuuaaaacugugguauucaauuuugcuuacguaagaucauucaaaaugucuuaguuuuguauaaaaauaccauuuuagaauuauaauuacauaaauucauauauaguaaaaaauuauacaaauaauacaaggguagauuuuauuuccaaagaauaaagugagcaggugugaaaguguguggagaagccuggcaacaucagcuaccaaccaccaauuaugcugacagaguuuguacccuuguaugaugagcuuggaggucacuucaccauuguguucuucuaaacaccccaugaaggacauucauugaagggccacaccccugcugcgcacagcugccuagauaaagacaaauuaucugagaggcagauuuaaagacuaaggagacuugauggcaaaaucaaugguguuuggauccugggacaguuaggaaaaggguguuagugggaaauguccucaagucucagggacaccuuaguuuugcuaguguuacacaugacaagcauuaccauuguugcauaagauguugacaguagagagacuggguuaaaguguauaugaaaauacaucuauauuugaaacuaggaagucuaaauguaauuccaaggugauauauguguguauauaugcacacacacauauauguaauacuauuauauauccuugaauuacagggauuuugucuuaaaguugaggauuuacuuuuagucacuguuuucaggccccuauuuuguauauagagaauuuugguccaagaggagaaaaggcaaauucaaaagaaucaugcugugcugccaaggagacuggucuuccauaagauaugcugggauaggauaugaggagcucaguaauaggcagugcugaguccauugcuuguuugugcacauaaauauguguuuauaccccugaaacaguucuaaguauuuuugagaguuagagaucuuacuuauacuuuauaaaauagcacauggcuucuuuuuguuguuauuguuaagaauagcuucugcugggaguuggggcucacucuuaauucuagcaccugagguguauacacacacacacacacacacacacacacacacacacacacacacacacacacacacacacacauauacacacauauacacacgcacauaccccaaaagccagccaugguagaccaugacuuuaaucccagcacuugggagaaagagauagggagaucuuucuuugaguuugaagccuguggucuauguagaaaguuuaaaccagccaaggcuacucacugaaacuuugucucaaaaaaguuggcaggggaggaggggcaugguauaaacuucguuuagguacaguauuugaugguguaguuaaaauggcuuuucuagcgagguuaucuuuuccugcuguuuuugaagacuuucuuaauuuuuaucccagauaaaacaauaaaauuauggaaaaucagugaaagagacaaaagaccagaaggcuauaacuugaaagaggaagauggaagauauagagauccuacuacagucacuacgcuacggguaaguacguaguuaaaaugacucucagucuuagaacaauggguagcggcagguggaucucuuaacuuuaaggccugucuggucuucguaguauguuuucugggacagccagagauguaagaagacccugccuucaaagaaaggagaaaaaaagccucugauuggguuuuugucaguauuuguguacccuggccccaagcaguucuuuaugggacauugcaucucuccauugaaacagaaacaacucuguggaggucucacuguuaaugaagucagagcagggacgcacagagacuguguuuuauucuaugcuguugacugguuuugauuuucaggguuggguccuuauuuuuguugcauagugagcuuuggaguuugugcuaaggauaaaaaaaaaacggggcuuuuccauuuuagucucauuaauugaaaccauaaauauuugcuaguuuauaccagggcuccgacuuguaaacuaguacuguuucuuccuggaaaagaaaguagguuguucauuguuuuuuuuuuuuuuuuuucccaguucagugcuuaacagaaccaacaucaguggcuuaaaaaaaaaagaaccucauuauuaauuguauucuucuaugcccuauuuucucaaaaguagaaucauggucuugugacucuuaaauacuguuuaaaaggauuuuacuuuuguaaaauguggauuuuuuucuauuuuaucugcaggugcccguauuuaggcccauggaucuaaugguggaagccaguccacggagaauauuugccaacgcccacacuuaucacaucaacucaauuucuaucaauagugauuaugaaaccuacuuaucagcagaugauuugcgaauuaaucucuggcaucuggaaauuacagacaggaguuuuaguauccacuugauuuguuuaguuuguguuugguaaagaaaucaaauuaugucuauccccauuagauuuaucuucucuccuagauauauuugaguccuugguuuauagugucuuuccaucuguguguuaucuccccauccccucuuuuuuuaaauaauugaaauugggaaaguuggaauauagaacugauuuaaagauuuauuccugccugugugugacagugcugccucacagucucaucacucagcgggcugagaguggagggucgggaguuucaggccacccugucuauagaugggaagaacucuugguaaaaaaaaaaaagauagaaaacacauuuuaacacuucugggguuugcucauaaaaaggaguaguuauugagaagcaauacuugauaguugcccuuucccaaguguagauuccuuaaugaaaugccaucuagauauuguggauaucaagccugccaauauggaagagcucacggaggugaucacggcugcagaauuucaccccaacagcuguaacacguuuguguacagcagcaguaaaggaacuauucgguuaugugacaugagggcaucugcgcucugugacaggcauucuaaacguaaguccauuucugcccuuucuuuaaaaugguuaucuacucagacuugaccugagccuguguguuguuuauuccacuggaagccuguuggugggggguggggggguggggugggggagggauaaacucucaggcaugguacgcaguuaggacuuccuuccuuuccucccuucuuauuccuuauuuucucccuaggaaagguuugucucaucuuuauaaaauguugagaaauguuauaacaugcucuuuaaaguaagugagguuggggagcuggcucagccgugaagaagaauguggcagcucagagcuguuccguaugugacaacaauuccaaaggauccaacaaugaucccucccaugggaguccugcugugcagaaucagaccccuaccucauuagcaggguuuugcacuuuguagugaucauuuucucucaagagacuuugugagaaacacguucccaaagcuggcaaauuguuuuaauuuuucugaauuagucugugauuuuaccucacuugaaugguuacuuuagaaaaugauuuauccaagcccaaauaugaaacuuuucccccucuuuuucuaguguuugaagaaccugaagaucccagcaacaggucauuuuuuucugaaaucaucuccucuauuucugauguaaaauucagccauagcggucguuauaugaugacuagagacuauuugucagucaaaauuugggacuugaauauggagaacaggcccguggagacauaccagguauuugcaguuuguuucuuuugaagaguguguccuauggaaaguggaucgaggugcuccuuccaggguuguguuaccauugccugugcaaaguauauugucuguucagggcugcacaggaacuuaauuaugugguucaguacuggcaacuuggugugcuccucuguccauggaagaaacguguggguaggagcagggcuggggaagauacucuuagcagagggcaugcuauauaaccagccaagccaugacucccuuuuggcuaacugucucaaauuuaaaaggaccugaaaucucagcauauggcuuuagaaaaaggccucuccagugcagaauguaugcucagguuuccccccagaacuaccuucuguccuugaccaguaucugugaugucacaggcaggaguaaccaaguugcacagugcugccaggccagcagggccuguggagcaggguguagagagcagucagaccacucuggaugcaguacaugcauggugcauacagaacaauuaggagacacuccucgagucuuagcuguucaaaccucuaaauauguugcauugucacaaagucagagagaauggugcuuuguuuugaauguguuggcaauguugaggagagcugcauguuguagcuguccuuccuucccaaguguugcagugagacuagcuucacagucuugucugguuuggggaagcugcacuguugugaaaugcugaguguuagggccuaccugacauguuacuugacuggcuagcuagucuucugcugccuguagaaucagauuaaugauugagaaugggagcacaucauggcagagcuauuguauuuggucaucuugcuggcuucuguggaacugaaggcuauuuuugauguuucuuuacuucucaugauaagucaguagcaguuccacuagcaaggugauggcggugcaugccuauaauaccagcacuugggaggcaguggugaguuugaggucagccagggcuacacagagaaacccugucuaaaaauaaaagaaaaaaagaaauguuuacuuaauaaacaccgcuagaaucacucacugcuuauauaaaguggauauuuauaauaagcuuaggucugagaaugcagugcauacacauaauaucagaacucaggaacaugaagcaggagguuuguuagagccccuaaguuugagaccaaccuaggcaacaaaugaaauacuaguuuccuauugguggcugucauuucuuccuuuuaagggucucauucagcaaaaacagaaaugguuaauaauugucucagcauacaaaggaagggccaucagugcagaaaugugccaugugccaugcuucuugacuaccuuuuaaagagcagacuuacuuacuuuuauguuuauccaauuuacuuuccaaaauuacucuuuuugugaaauacuaguaaauguagaauuauaauucaaaaagagcuaacaucuucauuaccuaauaauaugaagcaacacucauguuuuauuguauauauuuguauaugugcgugagaaugcuaugcacacacaugggagucagaauaaccuauaggauucugcucuuucuacuauguauccugggacucaggccaucagacuucauggcaagcauuacucacuggccacauaucucacugcucaccacuggauuuuuauugaaugauguaggugcaugaaagccaagagaaaucaguccaucacuaagccaaagccuuccugcacuguauauguaauuagaaauaauagaccaaaguuaaauuugugcucagagaaugauacuuaaaggcaaggaagcagcauucuuacuagcagucgugggcugagugcuaagaaguggaaauggaauucugccccaacguuauuuuguuagucuccuaccuguccuuuucaaauacuuucugacuuagguguugucuccuuuaguguucuguugaugugaagagacaccaugaccaaggcacucaggggccagaggcaggcagaucucugugaggccagucuggucuucauaguggggaaaugugggcugcaggcaggcauggugcuggaguaguaacauuugcaagcaggggaugagagagacugguccuggcuugggcuuuuaaaaccucaaagcccacuccuaguuucaacccucuuccaaaaggccacaccacuauauucuuccuaaauagaccaccagcugugaaccccagacauggugagccuuggggcuagcaggguugugcauucuucugugagugauuguaggauguuuuauuuaugcuucucagggugcacugcaauacccagaaagguggguuuucuuaguugugucauggaaagugugaguaaggguugucaaaaguacagagggacguguaauucuguauaaacaguaagucuauggaauuuuagucauguuccugauuugagaagagaaugauauaaacuuaguauauauuuucucugcagguacaugaauaccucagaaguaaacuuugcucacuguaugaaaacgacugcauauuugacaaauuugaauguuguuggaaugggucugacagguaaggaaagaaacuggcuauuucaucucucuuguuuguuauauaaauauaaccucaguuuuuuuuuuuguuuguuuuuuuuguuuuuuugaaagcaguuaagagucacuuuucuuccagguagcugugaauaacuaguaaugaguagagccauaaugacaaaaacuaagcccggauccucaaagcaauguaaagcaaaggagaucuauagcaagaagcuaucgggacuuaaaauuauuauuuuaaaaacuuuuaccccuuuuguaagccaaauaauaauauugcuagccagguacaaugugugccuauagucccaccuccuugggcagcugaggcaggaggauuguuucagcucaggggucugagcccagccugaguaacacagacaaugauaaaagaaacauuuaaaauaaagucacagcucugcucugccagcaguuaguuaaaagaguggcuuuucaugugauugcuguugcgcuguuuggagcgcugccgagugugcagauacuugaugcagugucuuguuaccacuccauucauuucacagaagggacaaguggauguuauggcaagcacuuccugcuuacuguguucuaauuaaagcauaauuuugaaguuacuuuaguccauaucuaaagcaauuagaggugcuuuacuuggcaguagucgaauuuaaaagguuugauauguuuuacuuuuuaaguuguuauuaccaaguuuuacaugagacccaaaaauaggcuggccacacuacucacaagccugcuguuggcuaagcacuugccauguugcugcuaaacaugaggccaggaaggacagauaugaagagaacauacugguguguaagugugguguguucuaugguuagcaguucucaguucccuuccauuaugaaggaaguuauucucaacauuaaggacacuuucuggggcuggagagcuggcucagugguuaagagcaccuacugcucuuccagaguucaauucccagcaaccacaugguggcucacaaccaucuguaaugggaucugaugcccucuucuggugugucugaagacagcugccgaggacucauauaaauuaaaaauaaaucuuaaaagauaaaagaacaacaaaaaacacuuucacaggguuggcaggaugacugauggagcaaaagaccgccaagcuuaacaaacugaguuggauuccugaaacucacaagggaaagaaaaccaauucuuaaagguuguccucugaccuccauguaccacacacacacaccccacaaucagucaaccgauagauagauagauagauagauagauagauagauagacagacagacagacagacagacagacagacacacacacacacacacacagagacacagagacacagagacagauagagaauuaaaggaaaaaaguuaauuacuuacuaaauuccaaacuauuucuuaugguguuuauuuuaauuuuauguguaugaauguuugacugcguguguguauguguguguguguguguguguguguagcauguuugugcccugguacccauggaggccagaagaggcuugcaggucuccuggaacugaguaaaaggugguguagucaggagucaugguggguugcugggaauagaaccugggccucuauaaaagcagcaagugcucuuaaucaccaaacccucaagguucccacacugcuuccuaacugcacggcuaugaccucacucagugcuagcuucucaagucagcauugucuacagagcuuacuggcccagcagguggucucaguuccuuccgccagagagaagccuguucuuaaucuuacaugaugucauaucucagcuuguuuacuuuuauucuccuucagucuuuucaagucuuucauaaccuuggcauuuuguguuaaacaauaacauaaauacuuauagacuuucucagugugagcauugcaauucuucauuaaauacauguuauauacaaauauuacaaagcuagauacugggaggaguggguauaccagauuaacuuaugugauucucucucaucuccccagcaaggauuuuuuuugagguagcccuggaaugugaauuauuuuuaaagaaacaguuucauuguugcuagagacauguaccaacuugaauuuaauuuagaucguuuguuguucuuugagggaccaacguuccgaauaggaaagguuucagaugucaagauuugccuuugaagauauuuagugaaaauuuaaaaaguuuuuuuuuuuuuuuuuuuuuuuuuuuuuuuuuuuuuuuugagacaggguuucucuguauagcccuggcuguccugcaacucacuuuguagaccaggcuggccucgaacucagaaauccgccugccucugccucccgagugcugggauuaaaggcgugcgccaccacgcccggcuaaaaaguuuuugguuaagauaauuucagaaaauaggucuccugugauauauugagaaggacagaggggucagggauccagugucaucuacauacugaguuuugggaccauuguugguuucaugaggauuucaaaaguuguuuuguauaacagguacaauaauuuucuguuaaugacgauacauuuugguuuuuaaccaggucuauuacaagcauucacgaaacaucugaacuuggcauaguaaacccaugccuauaauccuugcauaggagugcugaggguugggauuucuaggccaaucuugguugcauaaugagaccgcaucucaaaaccaaaaccaaaaaauuaucugacaagaaaggccauaauuugcaucaugaaacuuugcuuccuuagaaacagguaacucagacgaagaagaaaaaugugcuuaggugcugucaacuuuguucaguuuuuuagauuuguuuuuuggaaggaggguuugaauguuugugguuuaauaucaacagcuucuauguccuaacucaaauaaacugaagagaaguugcuuccuauaaagugcugggccaggauggucacugacuucuuacaguaaacacagucucucucuuguuaacauguuugacuggguguucugccuuuacaguguugucaugacuggauccuacaauaauuucuucagaauguucgacaggaacacaaagcgggauauaacccuagaagcaucacgagagaacaauaagccucgcacgguuuugaagccacgcaaagucugugcaaguggcaagcgaaagaaagaugaaauaaguguugacagccuagacuucaacaagaaaauccuucauacagccuggcaucccaaggaaaacaucauugcuguagcaacuacaaacaaucuguauauauuucaagacaaagugaauuaggcuggcauucucugcagaggagccacuuccugcuuagugagauaguugaaucuagcauucauaccuauaagagagcgguccauuguggcgccccuuuccaguguuugacagugugccauucaacaacacauuugauagccucauggagaaagcuguguggaugcaucccaggcuguuuuccaugucugcuagccauuuagggaagggaagggcacuuuuaauuuaaugacuucuugcaccaucuugccugguggacuggacuggacugugucagcauugauguacuccacuuuuuaugccuuccauugugaugacgucaaacacagugaacgccuucagucaugcuauggaauuuguguauccucauuacuguaucauuugugggguacaccccuccccucuuuuuuaaauuaaauacagcucauucuuacuguggcuuguagcauuccuccucucuggccuccuggacucuucccuccaucucucacccuugcccuuuccaccuugucucggugguggcguauucaaaaaaggaagaacgaaagcacacaaaaugggucagguuggggucagugguaaugggggaauauguuacgaacaaauguuuuaauaacaguuggcuguaaucacuccuugccaugucuggcacugaaaauaaggaaaaaaaaaaaaacuacuacugaauaaaagugacaaagaauggagaaucugguuuucuuuuucuuuuucaucuaccucuuuaaaccaauguuuugugucauauccuugggcgcaaugaaaugaaguggguuucuauugucuccuugguuuuuuuugugaacuauuuuuaacgaguguucuuuuccauggagccugggagaggaucaugguucugugcguccauguguuugaauauacaugacuguuaagaguucacagucuagaaauggcuagaagguucugggguuuuuguuuuguuuuuguuuuuaugugucugugcuugauuuaucuguuaacaaaguugcugucaaugagaaccacaguugaggagcuucacucugaagucuucuuccagugcuucauuucuuugccuuaggaaauaccaaguagacaaguugacuuuucucgcuguucaggcacaguagacuggaauuccgucuggaaguaacgugguagaugaaaccggaugcugcacuaaagagcuguuuuguacuaauugcuguggaaucacugaauuguacuuugccauagauacgucuuuugguuuuccaaagguauauucgggacaagcuuuuaaagguacggugaugcauggacugcaacagcugcguaagcaccagaugugugaugauccacaguguuccagugcugaggcccuagccaaagauggagagugucccaguuagugugggauggaccguggucaguccugcaggaagcuuuauggagagagaauggacuuuauuuuuaaaagaugaaugagcaggcauuuauaugagaaugguaguauauuuugauugaacaguaauauaacaauguugaauauagaggacucugcgugcuuauauauucccacugccuauuguucuucaguaaugaaaaugauuaaacaacuccaccacaauucccucuacacuuacacauauauuaugucuuguacguuaauauuuuuagcgcacaggagaaauuuuauguaauaaaguuacuguaucuuuuggaguuaaauuugaauuuguauuuaaacaaaaugucugauaauucuuaauggcacuuuuacuaauuuauuuggggguugugggugcauucuuaaucucuuucuuucuuuggcuuguauaguugcgaaucuagaaggauccacaauacaaaguuuugaugggauaauuucucauauccuuugggauaguggcauuccuaugguuuggcuuugagccaccaagcagucaguagaagucuuuuuuuuuuuuuuucucaaaugguaguuuuuaugauucucacccaucacuauaaggcuuaguuuuguauaguuggaagagaccugucaacuuaagauaucaggaaugcuauuaauaaccuauaauaauuguuuuucuaauauauuugguguagcaaacuaagcccagccacucauuuuauauagucaacuuuuuauuaauaaaacuuauagaauaaaugucuugucaacuugauuguauuuugcuaaucucugacgauccauacaaauauuuaacccucuuguaauguuuuugaagugcuggaauuuuuuugaagaucucucauucuguuaaaagucaguuuucacuugguggcugggcaauaaaaauugguaauauauaaaccuau

SEQ ID NO: 7545 - RNA, 693 nt, Mus musculus
ucgcguugaugguguacccuaacuccaggucuuuaauuucaggcuuaaaggggaggcaggguggcuugagguacaguugaguguaagaaaauaagaggccuaguugcauucggcaguuauccaacaaaagagggagggugggggagaaaauggucgagauaagauccaccucugcucuuucagcugcgcaguucaguuacacaagacuuuacggauaauugcgaccccaggaaaaacuaaccacccagagucuucgagcugggccugcucguuuuuguuuugguuugguuuuaguuuuaguuuuguuuuguuuuuguuuuuuuuaagucugcugaauuuaacuaaucucuuguccuucuuucuugucccggccauguucccagcugggcaaggccucagguuccucggugaagaguguggaccagccaaugagcccuccgacguguggaugaaacggcuggcuuuuguuuaguuuuguuuuaaccuccccaaggagacuuugaucagcuccaccucgaaaauguucgcgaaagaugcggagagccugagggacugcggggcagcaacgggcuccggccuagcccggcccgccggcccccagaggcuccagguuaaagggcagagccaaggucgcugacgccucuuuucucaccaguaacagcugccgcccaaauuauaccccucaggaagcga

SEQ ID NO: 7546 - RNA, 9506 nt, Mus musculus
cagagacucagagagagaagacagacagagacagagacagagucagagacagaccagaaaaaaacuggucuaguuuaaggaacuugucuaugcaguuguaggcuuacaagugugggauuuguguggcagagcaacaggugggaagcagaagcaagaguugaugauaagaaucuugaguaaugauuucuucuuuucucagaaaccucaguguuugcucuaaaggcuuuccaaaugacugagggaacucucucucauucucucucucucucucucucucucucacacacacacacacacacacacacacacacacuccucacugggaugcgucccuucacugaacgccaucugacuacagguguuacaaguaccuuuagggaaucaccccagccaauguugacacugcucccuggacagguugucauuuaagauuccacauauugcuggauuggugcuguuaucaugguguaguuuggaagagguucugucacuucaagccuguaacuacaccuucauuuggacuuauuuugcuaagucucuugcuugcuguuauugucaccagaggaaaaccuagaagguaagcugccucuaguacuuugacucuaaccuaaccuguuucaggaaggccuugccacagauucguacugguuaccugauacucagcacuaagugagaacugaaaacaacgucuaaugaggucccaagccuugauucaacgcaagaacacagaacuucaugggcacacaucaaguccuaguuuugugggaaucauguccuuuuguucuuacaacauucuuguggugguacugggccauuuauguacccaaaauaaauauguaaauaaucucaagaguggccaagagcugauacaaaccgccaauugauaaccuggcuccguucucagugaaugugaugcuuuggggaaugauggagucuguaaacaguagagucuaguaugaggcaauuagcucauuggguagcuguccucugaaagggacugauggaguucucacaagacccagguugauuuccacaagauuuagucaugaugaaaagagcaaacccaggucccacuucucucugguguccuguuucaucauguagcucuucaacauguguuucugucacugugaugccauguccacuuuauagccuccaaaacugugaguaaaucccuguucuguguaaagaaccuagccucuuguaauagcaucaaaaauggaccaaugcuuguuucuaaacccuuccacugcagcccaguuucugacuuuagacaucaccugcccagcauguccugguccaguauuguaugcacaugauaagccuugccaaggagagcauacaucugaagaccugagaacaugcaaccuuggcuaggaagcaagaaucauaaaugagcucacuuggggucuccacuccuacuugacaaaggacaccacaggcggcgauagguguaugcagcuuucuuuguuacugacgcugaaguccuugauuuuuagagucaaguuagaacacauuggggaaagcauccuucacuggcuuauucccccaaguauucaucuugccaacacaguccuccaauaggcagaaagcagcccaguguuuccaugagagaccugaagcauuugcccgaggcuccgugucuccuugucccuucucugccuccuccagcugcucccucugccaagggcucuucuccucugccauucugauggaugucaaggugaggcuccacguucagcugucacuuugccggucgcugccaucaaucaucuuuccuguguucccaccaaggaauggcccccuccacauuuccuacaucaaaauguaucuugugggauggaaucucagugcuguuuccuguuucucuuuaacuucaucccaugcccaaguccucugacaguuuucuuaacugaauuuaucuucagccugguacccagcucuaagccaacacagauggcccagcuaggaaauccucuguguuuuguuuaaauuauauauauauguauauauauauauauauauauauagucauugaauauaagaacugucugugcuaauuagcauaggcucuuaaacuuggaagccaguaaaacaugaaucaaaguagaaaagaauuuagccugguauaugcacauaccccuugggcacaacuaucaggaugccaacuccauaggccugaggagagggccaguuuuguaagaugcuuauuauacaugaaguacaguacuuuuuccugaaaagucagcaguggguuucucagaagagcugguuacuuucugugccuaucucuuuucacucagcgauucagggaagagauauauucuugggccccagccacaagcagacauaaagacagcaagauccuaaccauuugcucuauguuuucaaaagcaagaggagcgaaggcaccagggcacaggaagcaagugacucuugccacgugugacacagacaucucugggcaugcccagcuuccgaccuauuucuguuugucaagcuacaagcucugcuuauuggccuccaaaauaugaucaccuugguuacaggugacccggugcaaugugagauccuuaucaggguuccauuucuuagauggugucaaacaugacugagcucuacccagcaguccauuccaugagucaucggaccgagaaugagacagugcaguuaccagaugguucugcuaauaauuagaaacacauuucuauauuucacaggacgaaggcaaggaaaacaucacuagggaaauguuacaugugggggcaauuauucaauagguccuuggcugggauuuguggauaugaacauaauucagaggcaagaaugaaaugccuggacuaagacauggagagauccuuuauugaaacacaacuccagaacgcaggcauuauacauccagccaaguccugauuacucaagcagugaccgauucgucaauuaccaaacuuuuccuucucauucucagccccauagucuggcacuucucaaaucuguaaaauugauuuggaaauuaagaauuuuguauuaauaaaaagaaaaaaaaagaaaagaaaagauucuugaaaggccauuggaguguuccuuacauuuuaauugggcuggaucuugcacaaagcuaaaacuaaagaucacauccucacgccuuucugugugcuuguuucaaucgaagaaauuuacaaaguacgaagagucaaaaaucaauacagucaauauuaaaagcauuaauuuacagugauggaugguguuguuuuaaaaaaacaaaacaaaacaacgcugaggaacggcaccuuccagggagaccaaagagaacccaccuuuggguucaggguugaagguccacaccccuauggccuccacaggacaucagcuucuuguuagaggguuuauggcauuucuagcuccaagaaugccacuuuugugugaguaaaguugauuuucuaaccuuucuguguccugggaauauuagugacuuuucucauuguuaggaccaaaauaccugacaggaagcaaccugaguagagacuuggguuuggcuuugaggucuagcagguauagugcauccugcuggggagggagagucuuggcaacaggaacaacacuguaucucagcaaucaggagcagagaggaaacaggaaguggcacagggauauaagcccucaaggcccacccacuucuuuuauggaggcgcuacuucccaaagguuccacagucuucccaaacagcaccaccaucugaugaccaaguguucagacgugaauuugguguggggcauuuucacauucaaacuacaaaacucaugaaaugaaaaagaugaggggguuuagagugaguuguagauuucaaagagguaaacuuuggacuuucuacacacacacacacacacacacacacacacacacacacacaccucauagaccuuaaccuguuuccuaugcaacuccuuucaaaaggcuugccuacugcacagggcgagcugucuaugucaagcaggccacgccucuuccagaacucucacucugacuuucaggagacaggaacauggguauuaggagccugauuggguuaguagacccaguugaaggagcagccaucucaugaauugugauguaaauaaugcuguucccacagucugaucuuguaccuccaaacacgauuguuucaaagacacugucuaauuaauaauccucuuuucugugcagccgaggaggaguuguaagaaaagaggaacguguggcucuucagauaagcacgcgugaauguuuaucacgggcuaagggaggagaaacaaaaacacagugagcuaaauaguuguugugucugacuuuucacauucgugguuuuuacucaaaccuuaccacaaucucgacggcacaaggaccuuggcguaaaggucuccccuccacuuuuccagacaagggaaacugaaauuuguaaguauacuuuucugauaaucaguugcugugagggguggggcuaggguugggguuugggucugcgggcuuucaagacuccaguuccuucugcacuuccacagaaggcagagggucgcauuuccauugccuacuuguuauccucacuauuugcaguagggcuauugauaucuuuugcauuuuauuauuuguguguguguguguguguguguguguguguguguguguguccucaugaaaucagagacagcacuggauccccuggagcugcaaguucagaugguugugaacuguccuguguggauucugggaaucagaucggaguucuuugugagaccugcaagcccccgaacccggggcuaccuccccagugguacuauuaagguuuagcagucauaacauuccaaacuucugaggccucacucagggcagcccuugugauucuaugugaccacugugcucuuucucaguucagaaaugguaaauaguuggauuggaugcuagaagucauuuuggucucauuccugucuuaaaagcaauuuuucaugggcucaaacucuuggacuugaaggaaaaaaaaaucuggaauugaaaacaaugugagcuuuguccucaaaaagucaaacccacaacacagcagauguuucagccuaugacaaaaagcguucuuauuaacuuuguaaugagggaaagcauaggcuguuguuagggcuuaucaucccugagaccugggaccauggcuucuccugcaugggccacuuuccaccaagcucauggaugccagaacaguguuucuccaugcuggugccuauuguucuaccccaguuuucccuggaccaaagggcacaaggcagaacaaugcucccauugcuauucguuguuuuacccacaaauggucagaguaaacccuguacggugggugcuucucuucucagcccuugagaggaacagcugugguucuucagaugcaggagcagccaagcacugaguccuccuuaaagacgaaccugaggaugcugggcauccuuguuccuuccuuccauuggcaggaagcaaaacuaggauucccauccccaagucgugugaauguuacugcugacuuacagagccucuggagggugcggcccuucugucuuccuguuagaacuauauccucugacuguuuccuuccaggggagugugucuuguuccuuuccuaugacuuaaagauaggccuuguguagccaggugugauggcacacaccuuuaaaccccagcacuugggaggcagaggcaggcggauuucugaguucgaggccagccuggucuacaaagugaguuccaggacagccagggcuauacagagaaagccugucuugaaaaacaaaacaaaacaaaacaaaacaaaaccccaaaagcuaggccuugugguuuugugccuccaacucuucaugcagugucucaaaugucaacuuauauuuguucaauagaugaucucaacccacaguagaccaccaaccucaggacuuccaugcaucugacaccagcagagcaaaacaguccuaugaaucuggggaggaugaugaaagaaucugaccuauggacacauggcagaggcaugcagaaaacugguaucaccacaucucuuccuuauuucaucaucuugaucucauacuucaauuugagcaaaaguuuugauaaguuuuccuuaaccagaggagaaggugagugacucaaagucaucagaagcuaccacccgacaacuccccaauuacauuucuuccacacacacaaaaaaagcaaagauaauuuuuacaguacaaaaauuuuauuuuuuuguuaggauaauuuaaaguuuaaaacugaaguagacauauucauuuuacaaacaagauauucuuucauaaggaagaccauuaaaaacaguaaacaaaaaaagcugucuuuacaaaaagcucugugcauagcaacuuuauacuguauguaacugacaaagcaagaaaacaaacaaacaaacaaaaaaaaaaacccaaaacuauacaguuuggaaaugaggccuuacuguacaaaagguaaagguaaugguguuuaaaccaugcauguugaaaugugcaaagaaaaacugggaagaauuucgaugcuguaaccaaagaaaugagauaaugcaguaaguuguaccuuuaaaugaaaaaaaucuuacacagcuccucucaaaaauagaacagaauuuuugucauuaccuauagagauacuugucugccaaguggcauaaaaauaaccugggaccagaaucauuuaauagcaaugacuaaagaggacagaguggcuuuguuuuuaauuuauuaguacacuaaaaauaacccuuacacacguuuguacaauuaaauagaucuguggcugccgauguccuagugaauggucaaagauguccaguauuuaguuacacacagucuucgguguaaagcuacugacagauucuacgaucauucuggagacagaacugcacuaauccucaugcaagagaaagauucacagguucuaaaagcuaugcuacuuuuuaaaaaaagaaagagagagagagagaaagaaagaaaaaguucuuagguuggguuggcucaaagccaggucuaaacaugcuuaauuguauucugccuccauugugggaugguaaugcucguauuccacacguucuuucccuguaccagguuguuagccagggagguuuuucucaugcauuuccguauaguuuggcgcugugagcccugccuaugaaggacugucagcagugguuauaagcaugccagguuucuaaaauuguggauucucaugugcauagaaaaaaaaugucauaguggguaauucuagcaaacugaaggcaaauaauccaguugaggguuggaugaggacaugugccagucgggcaaugagagggucaucuaaaauuggcucagaaguacuaaugaugguuuuguuuuuuuuuucuuuuuuuuuuccgugaaagacacaucaauuuccaaugcuagaagccuaaccaagaaccccaagcuaagucauuggaaucaaagagaagacaccuggaaaaucaugacauccuauuggcaagccaagcaagucuagaugcaucuccaggaccacacacauuuucaagagucuaccacuguuagcaacuacugcaagguuuucccugcuaagaacuagguagguagcacaaggcucccagggcaggcuggguaacugcaccgcuuggaacacagcugccacgaaucucccaauaagagagccacuuaggggguuuugaguucguuccucuucaccccacccugcucaucucagaaacagugucaggugagauacaugcuuuuccaagggaguuuacuaacauaaaagaaaaacucugcauagaaaggaaacagucaaagacugagucuuaagaguccaagaaacacaaccaagcuccccaaguucuuucuccaaaguucuauggagcuuccugccuccaugccugaaucgaguacccaaagaggaaggacuguggggcucuguuggagagaaauucugaagaguccuuggucaguguagccauggggcuuugacucuccuuagaggugagauacuucuugccugaggauguucaaagcugagaggguaacauggggacucccugcauugcucagggaggaauguauuuuuucaaaacgcuucaccaagauuggacaccauaagggaucugugaacuagaaagcagaucugggaauggagugguggauugaaguguuggugugcuggcguuuaucugagucugguuucugugguggauucugugggaaucugcacaaguuacacauucuugugcauggguugauaaagugauggaaaaagaggggggugugggauguaggauaagaaucuaauaagcaacuguaauaacaacacaccuuuaaaacuggucacuacgugugucaauuucauuuuacaucaggaagagaaauucuucucuucuuaaaaaaggucuuaauuucuaccucuacuuacaauaaguuacacguuuauuuauuuaaauaacuguaaaacauuuuaaauuuuuuucccuuuuuuuuuaaaagagcuuaaaguauaagcaaacacacauacaacauuuccucauucaauucagguuucauuuuaagaaagucuuccaugcugguacccuguuuuguucaauuuuuuucugcauaaacuaaauugguaucugaaaggauucauagaaaauagaaacuuucaacuuuuuuuuccuacaaagaaaaacaaauaguauccaaaauauuaagcaugaauguuugccaauguuuuucuuaaauauuuuacaaacauaggaaggugguuuuuguaauguucauaacaaagaauugcugcucuuagcacugaccacgucaaugacauuucucugcucuugucuccaaaagggucaguuuguguagugacugucaaugcuucaugaggaacacgagaccaagauggcggcucucugccuucccaaaucuguccaacauggccgcuugggggcgcaacucuccccaacaagcucagagugcuuccuucauaauugguccaucggaauaaguaguuuugugcuaugagaaagcaguucuucuuccgcuuuacaucgggggaacaacaaguccugucauggcugcaagaaaagaacaacacaggauugaaacaucaagacuuuuuuggugaaacugaucacagagaggggaggcaggaguggggaugauagacccuaauacaacccagggagauggcgagguguucauaugcgagugcauuuucuccaggauuggguuaacagaagcuuuggugcuagcaaccuauauuauccuuguuuggcaggugcuuacgauuucuguauguugaugggucaucuuggaacgacggaaguaaacauguaaacuaaauugugauagacauguccugcaucacuagguggaaccaguagaaaaacccagaugcugaaccugcuggguuccuaggcaucaguuauaaaaaaccaggcuuuucucuccauccuuagggucuucaugaacauuguacccucaacuggauuagugcuu

SEQ ID NO: 7547 - RNA, 1932 nt, Mus musculus
cuuaaagaauauuaaggggccuaaucuaccauaucucgcccguaucagaugcuuaguguaaaguuaacuucugugucugaucacaguugcuacauccauccccucccucaugucuuuucauuaaugguaaaccgaaaaugcuauuucuuugcuuuaaaucuuuuuuuuucuagaaguagcuaacccuggaugcuuaccuuagacugucucuggucuuccuugauucuguccuugcagauauucucauuucuuccagaagauggcagugugguuccugcaauuuuccuucccugggcaaacaugaaggccagggcugcuuguaccuacuguggcuugaacuucucuuauauuuucccucaguuuuuaucagaaauugaugaguauguguggggaaaucagaggacaaauaauuuaaaugaaguauaaacaacuuucuguguacagaaacucagcugucaugccucuuccagacaucuugugcccaucaagugugguuugccaguguugucuauacaugcaugcauacacacacacacauguauuacguauguauggauacauuagauagauagauagauagauagauagauagauguuaauuugcagccucuacuccacagagucucaugacugucaguguuacugaggacagcccuguugcccucagucucucagccuuauguggaauuauugccuuuggacaaaugaggaugugaguuguuuccuucuuuuugguucuaggaguugaugacagagcugaagugauagcuagauucucuucuguagauucuggaaaguuccucugacauagagcuagcaucucaaguaaaccagcuuacaaaugcugaccuuuugaaaagaacauacuguuugaacuuuggaaaauguauaugguuacacaccaccuugacgucagaguaauaucaugucugacaacccaacccucaccccuagcucuuacagcuaaugauuugaauucaguuguacuuuuugcuuuuuuuagaaugucacagaaaaggaaucucagaugauugauugauuggucaaucguuugugccuauguuuuaaacagcauaaugcuuuugagauuuaucuguguuccauguuguaaaugguuccugcuuauugcuggaugucacuucacucugcauauuuagguuauaagauuuggggcuuuguuaaggauaaaguuauauacuguucaaauguuucuuuuuacaaauacacauucccguucaucauggagacuuacuuagagcuagaaucuugauuugugucucucaguggcugguaacgaacauuucccucuguuugcuguccuugugcccuugucuguuggggugucuuacccaggauguuuguuauuaguacugaguugaaaguuuguugcauacuuuuugcauuuuugcauacaacuccuuuacuaaguuuuuucuuacuaauauuuuccccauuccauggcuuauuuuuuugucuguuuucuugguauuaucacuuuaagaaaagguuuucauuuuguugaaguuugaauuuauuuauuuuucuuuucuucuuuucuuuaaugauucaugucuuuuguguccuaaggauagccaggcaugguguuucaugucaguaaucucagcacuggagaggcagcaauuauugugaguucaaagguagccuaggauauuuagugaguucuaaucuuuuccugucugucucaaaagacaaaaagauaaaaaaaagacauuuccccagaucaagagcacaaagauuuuucuagaaguuucaugguuauauuucuugauucgguuuucuaucuacuuggaguucauuucugugugccauagaugcuggaguggccuuuuguuuaaguggaaaucagcaggcaccauuuguuuaaaagcucaucuguucauuaaauugugucaauaccuuugcugaaaucau

SEQ ID NO: 7548 - RNA, 907 nt, Mus musculus
cucccuugagcgaggguuuucucuugcagucugguggcuggguggcacuguuagcaucugugaggguagacccacaaaggcuucuccucuuccuagguagcgcagaagaaccaacacccuggcucucacugcccgagacagcgggcagcggcccuggguuuuguccugaggauauggucucuucuuuggaggauggacauucaaauccccugcugucuaaggugcagaucgucauucuccuucugggcuucugcaaaguggaaggacuuggagacagccacacaagcccuguauuuuccaagucucucuggagccuugugcugcgucucaccuugguuuuacugcuuguucucugaaagcuuugcucuaugguguuagacagcucuucaaucagcugcacgcuuucuaaacuaauuuccacaaaguuuuccccacugcaggaagacgcaggguucccauuuuguuccagguaugaacucugacccccacaacacacugugcgucuucuccauuuccucucucucccacugccagggcugccauucccugcacauuuccuucccacauucucacuguggcuugcggguucuuuuauauuuugaaugaggacaucuucugaacaguuaaggucucuuuuugagucaguagagacagggcugcccugcagacuccccuguggagcuaagcauucacucucuuucucacacuuuagauucauacuuucugaaacaauaaggaucucacaaggauuuuccaaauuuugaccagccuugaaaagguccuggcucugagggcugcccagagguuuuggauucuuggacacgaugugaucuugggucacagaagcccgaggcacaagaccgcuuuccaucuuggucccggguuuuggcuccuuugcacuuugaca

SEQ ID NO: 7549 - RNA, 907 nt, Mus musculus
ugucaaagugcaaaggagccaaaacccgggaccaagauggaaagcggucuugugccucgggcuucugugacccaagaucacaucguguccaagaauccaaaaccucugggcagcccucagagccaggaccuuuucaaggcuggucaaaauuuggaaaauccuugugagauccuuauuguuucagaaaguaugaaucuaaagugugagaaagagagugaaugcuuagcuccacaggggagucugcagggcagcccugucucuacugacucaaaaagagaccuuaacuguucagaagauguccucauucaaaauauaaaagaacccgcaagccacagugagaaugugggaaggaaaugugcagggaauggcagcccuggcagugggagagagaggaaauggagaagacgcacaguguguugugggggucagaguucauaccuggaacaaaaugggaacccugcgucuuccugcaguggggaaaacuuuguggaaauuaguuuagaaagcgugcagcugauugaagagcugucuaacaccauagagcaaagcuuucagagaacaagcaguaaaaccaaggugagacgcagcacaaggcuccagagagacuuggaaaauacagggcuuguguggcugucuccaaguccuuccacuuugcagaagcccagaaggagaaugacgaucugcaccuuagacagcaggggauuugaauguccauccuccaaagaagagaccauauccucaggacaaaacccagggccgcugcccgcugucucgggcagugagagccaggguguugguucuucugcgcuaccuaggaagaggagaagccuuugugggucuacccucacagaugcuaacagugccacccagccaccagacugcaagagaaaacccucgcucaagggag

SEQ ID NO: 7550 - RNA, 324 nt, Mus musculus
cggcuggaggugucaugucgggccgggaaggugguaaaaagaagccucugaaacagcccgagaagcaggccaaggagauggacgaggaagacaaggcuuucaagcagaaauaaaaggaggaacagaagaaacucgaggagcuaaaagccaaggcugccgagcagggugcccuggccacagguggaaugaagaaaucuggcaaaaaguaagcuguuccucacaucuggggugauggugacccuccucuuccauuccuauuuagacaucuggauucccugccauagcaucuuugccaccuacagcuagaaugaaauguuauccuga

SEQ ID NO: 7551 - RNA, 12434 nt, Mus musculus
acacacacacacacacagacaaauucuuccucaaauccucaccuaagcuuucaguauauccagauccacaucuucacucaagccgggagagggaaagaggaaagggggggaggaaaaaaaaaagccaacaacuuagcggaaacuucucagagaaugcuccaaaacucagcagugauucuggcgcuggucaucagugcagcugcagcgcacgaggcggaacaaaaugauucugugagccccagaaaaucccggguggcggcucaaaauucagguaagcaagaaaacccaggaccgguuucuccccccaaagaucuguccucauuugccucucucacuuuugcaugugucucugugacggcugaucucaguaauaaaugugcuucaugccuggugauaaugaacugccaguguaauccuauagccuuaggaaguggaguuccuuuguuuaauaaauugcaugcaacuaacgaagaagcugggcgcucugcugaggguauuucauugcauaagccuagccugauugccugaaaucuggcacguacccucuuguuggggggagggggcggggaaaggcuugaauguuggcacgccucacagcggcucucucuacuccacaagcuuguguuaagguaaugaguggcuuaccugcugccaugccucucccugcuccuuuaagaccuuguaacuugacuucucuaccucuccagacagcacacagacaagcccccuccucacacugauuuguggaaccauaauccucaagucugaaaaaaagaaauuuuuuucagggcgcauucagaaaaggggugggaggaccuacacaccccguucccuauaagccugccugucuccuuccucgcucucagaggcuccauucaaucgcccaugcagcccguggucccuagaaggaagugcauuuguaaaacgaagcauuucuuucuccauggggaaggucuuacuuuccgcccgacucccgcaccaguuaacuguauaugguccuggccuccggaggcaaagaagcauuaggaccccuaugucccuugacuucuagauccucgcaaacuccucuccccaacuguuaacagagaugggaccccgcaggugucaaaaugcugcagaugcucccccuuggaagagcgcaggucccugccagaggaggccuuuugccuggcuuccuuuuguacuuaguugcuauagcgaugccgugauucacaauucgagcuugccuaaaacaauagcagcccuaaugcauauuaaaacugcuuaaagcaaaguuauaauuugaacccguggaaauauauaauuagggaaaugacuuguaacaucccagaggcugcggguggugggagggggggcggggaagccuaaccuaaccaaaccaugcuuuugaucugggaggagaauccuacgguaugaaggcuacagaucauugcuugccgagcugccugccagaacaccccuccuucugugggagagaaauuacuuuuauggcagaucuuauccagaaugcagaaaacccggugcaaguucuuugcgguuuucuuccagccuuucacaaggagugccuugaacccgucacuccacaccuguguuucuccuuuuuugaaaagaagccuuuuuaauaugagagauuauucauaccucuaagcgcuggacggugguuggggggcuggguggauacaaagggcucagauuccuugucugccagugccuucauggguuaaaagcucucuuugggaagggucucccuccaaauggacucagcaaauuauucucugccauuuggguuaaaauaccaugcuuuuuacucuagacugcauuuuucagagggcagauagauucucucugguccucccccaacuccaucaugagccugaccuucagucacugccuacagccuacccaagcucucaaguuccaagggacagccuuugauuccugucaccaacagaagacacuaugcauuacaaggucucuauccuuaauucucuagccaucaaaaugcauagaagggugagacccagagagagcacgugccuaagggagaagacacuaccccuaucaugagucucagaaggaaaaacguccuucccccaaccucuuucucaccccaauuuucuuccaauuguuguauuuaauggaaucccaaaucaaauuccgaggguaaguuaagaucaugugcccuugguauuagacuuuuacaccuacuggauucuaccagagcccccuuggcuugacccagacugguucugcuugucucuuccagcugaagugguucgcugccucaacagugcccugcagguuggcugcggggcuuuugcaugccuggaaaacuccacaugugacacagaugggauguacgacauuuguaaauccuucuuguacagugcugcuaaauuugacacucagguaacuggaccuugccuuuagcucccacuggcugcuugucuuuuuaacagagugcuuguuacucuucuuaagagccccaaaagccaaccuugcuccccagccuucuaaccaggcucaucccaggcuugcaaacaugcuccagaacgcaugcguguguguaugcgcacagauacaccaacacagguugggggcauaugcacaccaaguuuagaccaggaauaaaggguuggcagaggcuggcuuauaauaugagggaugauuagcagaaaagcauuuuugcuuugagaggaaauaaaaauguccuccucugagugaccuggcaugcuaucugaaauucccaguuaccagucuuaaccccaagaacauaaaacugauucugaccaucuucacaucugggaggaguugaugaugucucucuccuaucucguuuccuguccguggagcugaguguucaagauaguccaagagagaagagauuuuucucuuuugauucucagccaugcuguguccccuugaaagacuccugugucauagacccagaccucuuuuagaaggucaaacucaugcuuaucuucuuaucccuggcagggaaaagcauuugucaaagagagcuuaaagugcaucgccaaugggaucaccuccaagguauuccuugccauucggagguguucgacuuuccagaggaugaucgccgaggugcaggaggacugcuacagcaagcuuaacguuugcagcaucgccaagcgcaacccggaagccaucacugaagucauacagcugcccaaucacuucuccaacagguacccgaggguccucuucuucacagcauggggggggggguaggguggggguuggccaccauaaccagaguagcaaucuuucccucugguguuauaacaaucuuccuacacagcuagcagagagaugguuugcaguuuuccugggugaguuucucuguccaguucuuaccauaagccugaaggaaacaaggaagcuucuggaaaguaccuuuugagacaucagguuuggcugaaacaaugacugagcaacagaauaauaggccauggggggaaaaaaacuuagucaaaugucaaaaugcagacuuuuauuaaaucuguauauuuggaguuagucccaaagccagauauuucaguaacuaaugaucuuaucuccagaacaagucaucuuauuuacgcagaaccagauucauuuuacucuaugaaaaguaaaauggcuucagggagccauucuuguauucccuucaaagcauuaugucaacccaacccacuagcccaagauuucccagaaggaaaagcugguggcuacccaaguaucauuugcaucucaggugacccaaagcuacuggguucacaccaucugaccuccaggccugccugugucauugguuuugaagccuuugccaaauaggaaugaaccccugauauguaagagauccugcauccugguccacuguggguaucaaagaugucuagcaagaggugagggaugaugcuuggguaguacauagacagacagaaucaguaguuaacuauaagucaguugucaacagccugcggagaugcucgaagccaaauccuaugaauggaugaaaucccaugauucccugacucucccaccaagucucuauguauucacaaggaauaguucuguuacucugguccccuaagaguuaucacacaucuaagcugaugacucuccuagccaaauaaccccauccuucugagacagacagcugucuuuaccccuaacaugaaacuucugugacauauaggagccauucucaacuaccauacagcccuugaaugcaagucuaucugacuuuucagaacaggaaaaaucaacuccguuuuccucaaauaucuugucuuucuauaucaaccucaauuuuaacaauucuccuaggaagauucuuguugagggagggaaggguuaauacuucacugguuguuguagacuaacccuuugccauagggggaagagaugaagaguucuugcuuggacaaugguuaggcacaaaagauguaauuauguagcauuuuaaagggagguguguuagcagagucaguacaaguuuagauuguuaaagauccuauacacauaggaucucuaaaguggcagguagccgauuucaaggcuauacagaguuggcuauuucaguucaagccucauucucccuugugaugagagagucaugguagaaaggaagcuacagagguugaaccaaagauucccacuuauccaagaggaaacuuugaaaagguguccuuagcuagaccauucuucuucuuccaaaguauccuguuugcaaugccuucaaaaaauaauccaggcacaggcccuuuaucuccuccugcugguguuuaguagaaaaggucaaugggaaaaggguggaaucgucuucaacgucauaaucgcucaugcaacucuuaccuuuuuccaaguauuuuaccacaguguucaggacuagugcaauuuccucugcaggcggggcuugcucugcucuauuucaacuccucagcgcccgaaacauccuggcuucccagccucggucccaacauagacacacgcaaagucccugccaguuggcaaagaauugcaaagggaaguaguuacagguucauuccaccuuccugugguuuuucuagcaugagacuuaggucugggagaguccaaaagccugauuggacugaaaggcagaauggggcugugugcauaugacaaaggugcaugcagggaaagaaggugguugggaauguccccugcccugauuugcaacccacacuuucagucuugagggaagcaggaaggauugaugaggcaggcaaggcaccaugaagcuugggaaccaaugagaccaacccagauccagagugggaaaagugacaaagcguccaacucucuagggcauggauugggaacaggaaacagaagaauaauauugaucaagggaaacaaaggacuauuuauaaacucucacacagaacguuccuaggcagaauguguguauuuggguaagcauggcugaaacuguagccauggagaaugucugaucuuauucuucaccaagcacauggggugugggggguggggucgaggauggaauuuucaaaguuagaagaaagaugcaugcuuugugcaagguccuuccaggcugggaggccagaaggcuuaaucugcuauuucaaugcggugugcaacaccauggcauaaagccuaucaaggcuuaaagauagggaacaucccaucuccccuuacaaggcggauuucuucugcugagcuguacugguuuuuguuagcuugagaaggaaaaugcaugcugaguccauagaaacaaaauaugauagcugaugggaaagguuauccagcccuacuuccccaucuaacugacugaaggacaagguucagugggauaagcaaccugcuaaaggucucacagcuuggacccucauacccaauaggguccagaauucauauggccuugagccaagcuauuuugaauucuacuucaaaagaaggcagccagaaaaacccugcaagaagucccugaaaccccaaaauagaauaccaugaauaauaauauacacacaccaugguguucagcaaggaauuuugugugugcucucuccuaaaagaaaagacauaucaucucuccucguagcuaguguaacuauauguucuugguacaaaagggugcucaauaaauauauggcaauugcuaagucaacuuuugcugaaagcacaaaccucuuaaagcaucuguguugcuuagcaacccaaaguaaaggucuccucauuguccugcaaaguccagagaugagagucacauuucuggcucacuggagacaacaggguuagcugguagcaggcagccuggcuuuagcuuugaggagcuccuaacugagccaucuauaguuuucuacuuuacaauauagaaaagucuuugccuucuccacuaaguuaccaaagcccccucagggaauaggaguuccuacuaagagcagguaggccaaccuaagaguaggucagguauucugucuagucuaucagagacacagagacacaacagaaaaaggaaaugcccucagagucaggcagcauuagggcccccaaagaugcaggcuacacaagcugaauuucuuuaaggggcuuagaguucuccaaccagacaagagcuuccaauucugccaaagaagaaacuuugcauucuuucuguuucuaaagagcaauccuauuuuccaggccacuuguggacaaaugcaucaugaaaaaguucuuucuagauguggaaggguuaacuucucugggcuauaaaguccuuaagggaacuguauccuccaagaacuaaaauaccuucuaaaguagaccccaagauguaggggagccaaguccuggaagagcccagaaguuaguuaauaccuggagaugaaugaagguauagauggcuaaaagcuguugcgacaucacaguuucggucucaguuuuuccaaaacuaguucucucccccauuuccccacccaagugaaccucagcuuaacucauguacuugguaauuccaaagguuuggaaaagauuccucugggccagagaagcccaauuucacucacagcuagauagaauugucccugacaagagggcuauagccaggacuaugggcaaggcagaggauguuccccucucuccacccccagcuucacuccucucacucaaagaaaggugaccgacuggcuuccucacucacgaucuacucuuguuuacuguccauccuucaaaggaccucucuaagggggucaaguuauucuagaaagauguuugcucaugugcucugggaguugaguuaaaaauaaccaggauuccuccccuccccaguugauccuguggcccccaugacacccugaccacuccuagaaaagggucucuccacaucagcacagcaggucacugucaccagggaaagagcauagagcuaauggguuuauacaaccauugagucaaaacaggccagaaauuccccaagucacuuuggagaauaccugaacuguacaaguuguuuagaaguuuugaacauagaugguuugguccauucacagcgauaacacuuggcuauguuguuugggacagucagaggaauuuguugcauaaauagaagucacuuauacuacacauaaaagucuuugucguuaggguuuuuguuuguuugcuuagaaaucuacaacaucacagaucauuuuucuucaaaacauuaaggcaucuuuuugugcaacagaagaauguccuuaugcucuuuccauugaugucaaaguucaguugauauaguaagaagauauuccaauauaaauagaagcauaggggcagguggugagaacuaagagaaggucaaugguacacaugcaggaagaagguggaugugaucuucccagacagaaaagccacccuguuauuuaaauucuaguuccucauuuuuaaaaagugugaauuacugagcagacaauacagucugaugccacucagcuacugggauaacaagacuaaggacauccuacccugcccuugaaaaguucaaagucuagccagggaaaaagagaucaucaugaggccaucaaauguuggugcuugaggcgacaacuaaagucuaugaggcauccaaagaaggaagaggccauaaaauccuaagcaacaugagaggguuucacagacucacagaaggaugguccuuuaaaggucacucaucuuuuccuucaagcacccuugcuuccuuguguuugccugcuggaagccacuauaugccuuugaaggaagcugcaaaauagaguuggucaguuaucagccucuucaagacuggcuggguggguguaaggaaaguagcuuucgcaagaaaaugcauggcuauagauugaggcuuaguuagaacgugcauuaguggcgcacgccuugaaucccagcacuugggaggcagaggcaggcgaauuucugaguucgaggccagccuggucuacagagugaguuccaggacagccagagcuauacagagaaacccugucucgaaaaaaaaaaaaaaaaaaaaaaaaaacaaaaaacaaaaaacaacaacaagaacgugcauuaguauguaccuacucuugagcacacacaucccugggacagagggaaguugcagaagucauccaaauaacugucaguccauuugcagugauguagugcuaacacaagcuuagcgucuacggcccaccaauucuauucauuuuauuugaauagaauaaugccauuaauucguuguaugacuuugagcaagcaccccaguuucuucccuacaauaugagagcauuuuggguccuuuaucccugagagccauuguuuuccaggauuucagacauaagagucagcuuccuauaguucagugugaucuaacucucuugaaaucuaaacauggagauggacauucuaguguuaucuggugaacccagagcuccgaaggaagcaaaagccaccuucagcuuugcauagagcauuggugucugaaccugcuccugccuuuguuuucucuaaugagaaucuuuuccccaaugcagauacuacaacagacuuguccgaagccuucuggaaugugaugaagacacggucaguacaaucagagacagccugauggagaagaucgggcccaacauggccagccucuuccacauccugcagacagaccacugugcccagacacaccccagagcugacuucaauaggaggcgcacaaaugagccacagaagcugaaaguccuccucaggaaccuccgaggugagggggacucucccucacacaucaaacgcaccucccaagagagugcguaagcagggagagguauucacagccucaccaaacuaauagcauuuuagggguguugacacaccaacuuugaguguacugugccugguuugauuuuuuuuaaguaguaccuauuuucuauccccccguuaaagaaaaauugcaugaaacuaggcuuccauaaucaauaucccaacauucugcaaugacagcauucuuaccaacagaauacauguguggucauucugccucuccucaagagagaauguacccucuuccauccccccucucucugaauucuuuucccagaucccuaucuacucuccgcaaacacaaaccauucauguaacuacccagucauuguaaucugaaaauguagaucccuuuagaauggucaccugguagaguuagccaauacaaaacaacuuuauuuaaaugcaugucuuaaaugcucauaaauauguuaaauggaauucguguuaugaaucugugcuggccauggacgaauaugaaugucauguuugaauucuugaucucuaacgagucuuauggucucuauccuccaaugucuaauuuccuuucugacauauuuaccaaauugcucaaaccugguucuccaaccagacuuugagcuagcaucuucuugcaucuaaugaaaaacaaaaaagcuaacaucuuuauguacuguaacugcucagagcuuuaaaaguaucuuuaacaauugucuuaaaaaacggagaaucuuaaggucuaacuguggaauauaaauagcugaaaacuauuguacuguacauaaauuccagaggacucugcuuaacagagcagucuauaauaacuuuauugcauauagauuuaguuuuguaccuuagcuuuauuuuccuuuuccugggaauggaauaacuaucucacuuccagauauccacauucaugcuccuuguggccuuuuuuauaacuaaggggguagaaguaguuuuaacucaacaucagaacuuaagaugggccuauacuugacaggaaaacccaacagguuaucugaaggaccccagguaagacguuaaucucccagcccaccucaacccggaggcuacguuugacuuagauguauccugaaacagcucugucacauccaacugggaauaacaagaaucaaaaagaccaucccuuugggcuuggaccacuuggugugacaaggccuacuauccccuuggaaguggcaguucuuggcucaucgccuuccaucagugccuggcacucugguaaaugauggagugggauauuguuccacuaagccaaucaggaaugagucaaucagccuuugggucuuuaguccgggaaacuugggcuuaaggggguaugaauaacccugggcuguccagccuuaauagacuccucuuacaucuuuuguccuguaacaugcugccugccaaaguaguccuggcagcuggaccaucucuguaggaucuuuaaaaaaaaagaaaaaaagaaaaaaaaaagaaaaaauauagagagaaugaaggagggcauaagcgcuggugguuugaucauuucugcugugauguuuacaggaugguagccaccaaagccaaaugauuaaccugucuacgaacaacaguaguuucucagggucauuguccuugaacccaacagccccaauuaugagugucacugcucaccaaaggucaaugcugagagaggaagagggaggggcugcuccaaacucauuuggguagaaacuaucggugcuugacucucacuaggcuacaccccagaguugaccaaauugagugauagggacccuggugggaggagggagggcaccucuccagggaaaucaaaagcaauacaacuuuaccacaaagccuuuaaaaccaguaacauagugcucaaggaccaagaucaagcguagcagcugcagcugcagcagcggccccaaggcugcagccucuguccccacacagccucgaagcgcgcugacaucagauuguuaagggcauuuucauacuuagaacugucccauccccaggucccaaacaaauggacacugccuuagccucuuggaaaucagguagcacauauucuaagcuagauucaccccucucccccacccccaacuucccaccccaggcaaggcugacuucuuugaaccagaaaagcuagucaaguguguguguguugugcauuguugcaaacccacuaagccagaagcccaaaguggcaaauagcuuaugagaauuccuaguacaauucucuuaaguucaguaaacuuucuuucucucuuuucucuuuuuuuuuauuuuuuuuauuuuugcugugaccuuuucaaucugugauauacccuccuuucuccccacagugacauugguauauguaccaacaaugcacauaucuacacauaugaaaagaagcaguucucacaacguugcuggguuuuuguuuuguuuuguuuuuugguuuuuguuuuuuguuuuuugcuucuuuuuucccccucccccugccccucuccaccuccuucuugaacuuccaaagcuuugucucguguuugcugcagagcgauucggggacugaccuagaccuguuugcaugaucuccucucuugugauuugguugcacuuuagaacauuuuugugccguauuauuugcauuauguauuuauaauuuaaaugauauuuagguuuuuggcugaguacuggaauaaacagugagcauaucugguauaugucauuauuuauuguuaaauuacauuuuuaagcuccaugugcauauaaaaguuaugaaacauaucaugguaaugacagaugcaaguuauuuuauuugcuuauuuuuauaauuaaagaugccauagcauaauuugaagccuuuggugaauuccuucuacgauaauaauaauaauaauaaaguguuaacguuuuauuuguucccccucccccacgucuuucauuguuauucuuugaaaacuucuuggaccagcaagaugaguaaaugagcuugccuuccaaacuuguugaccuaaguucaauccccagaucccacauaaagguagaaaagaagaacagacuccacaaggcuguccuucaaccucuauguagucauugugugcacacgucuauacacacacacacacauacagacaugcauacaugcauacaugcacaugcaaagacaacaauaauaauaauauuucuuuuucaaauuu

SEQ ID NO: 7552 - RNA, 12434 nt, Mus musculus
aaauuugaaaaagaaauauuauuauuauuguugucuuugcaugugcauguaugcauguaugcaugucuguauguguguguguguguauagacgugugcacacaaugacuacauagagguugaaggacagccuuguggagucuguucuucuuuucuaccuuuaugugggaucuggggauugaacuuaggucaacaaguuuggaaggcaagcucauuuacucaucuugcugguccaagaaguuuucaaagaauaacaaugaaagacgugggggagggggaacaaauaaaacguuaacacuuuauuauuauuauuauuaucguagaaggaauucaccaaaggcuucaaauuaugcuauggcaucuuuaauuauaaaaauaagcaaauaaaauaacuugcaucugucauuaccaugauauguuucauaacuuuuauaugcacauggagcuuaaaaauguaauuuaacaauaaauaaugacauauaccagauaugcucacuguuuauuccaguacucagccaaaaaccuaaauaucauuuaaauuauaaauacauaaugcaaauaauacggcacaaaaauguucuaaagugcaaccaaaucacaagagaggagaucaugcaaacaggucuaggucaguccccgaaucgcucugcagcaaacacgagacaaagcuuuggaaguucaagaaggagguggagaggggcagggggagggggaaaaaagaagcaaaaaacaaaaaacaaaaaccaaaaaacaaaacaaaacaaaaacccagcaacguugugagaacugcuucuuuucauauguguagauaugugcauuguugguacauauaccaaugucacuguggggagaaaggaggguauaucacagauugaaaaggucacagcaaaaauaaaaaaaauaaaaaaaaagagaaaagagagaaagaaaguuuacugaacuuaagagaauuguacuaggaauucucauaagcuauuugccacuuugggcuucuggcuuaguggguuugcaacaaugcacaacacacacacacuugacuagcuuuucugguucaaagaagucagccuugccuggggugggaaguugggggugggggagaggggugaaucuagcuuagaauaugugcuaccugauuuccaagaggcuaaggcaguguccauuuguuugggaccuggggaugggacaguucuaaguaugaaaaugcccuuaacaaucugaugucagcgcgcuucgaggcuguguggggacagaggcugcagccuuggggccgcugcugcagcugcagcugcuacgcuugaucuugguccuugagcacuauguuacugguuuuaaaggcuuugugguaaaguuguauugcuuuugauuucccuggagaggugcccucccuccucccaccagggucccuaucacucaauuuggucaacucugggguguagccuagugagagucaagcaccgauaguuucuacccaaaugaguuuggagcagccccucccucuuccucucucagcauugaccuuuggugagcagugacacucauaauuggggcuguuggguucaaggacaaugacccugagaaacuacuguuguucguagacagguuaaucauuuggcuuugguggcuaccauccuguaaacaucacagcagaaaugaucaaaccaccagcgcuuaugcccuccuucauucucucuauauuuuuucuuuuuuuuuucuuuuuuucuuuuuuuuuaaagauccuacagagaugguccagcugccaggacuacuuuggcaggcagcauguuacaggacaaaagauguaagaggagucuauuaaggcuggacagcccaggguuauucauacccccuuaagcccaaguuucccggacuaaagacccaaaggcugauugacucauuccugauuggcuuaguggaacaauaucccacuccaucauuuaccagagugccaggcacugauggaaggcgaugagccaagaacugccacuuccaaggggauaguaggccuugucacaccaagugguccaagcccaaagggauggucuuuuugauucuuguuauucccaguuggaugugacagagcuguuucaggauacaucuaagucaaacguagccuccggguugaggugggcugggagauuaacgucuuaccugggguccuucagauaaccuguuggguuuuccugucaaguauaggcccaucuuaaguucugauguugaguuaaaacuacuucuacccccuuaguuauaaaaaaggccacaaggagcaugaauguggauaucuggaagugagauaguuauuccauucccaggaaaaggaaaauaaagcuaagguacaaaacuaaaucuauaugcaauaaaguuauuauagacugcucuguuaagcagaguccucuggaauuuauguacaguacaauaguuuucagcuauuuauauuccacaguuagaccuuaagauucuccguuuuuuaagacaauuguuaaagauacuuuuaaagcucugagcaguuacaguacauaaagauguuagcuuuuuuguuuuucauuagaugcaagaagaugcuagcucaaagucugguuggagaaccagguuugagcaauuugguaaauaugucagaaaggaaauuagacauuggaggauagagaccauaagacucguuagagaucaagaauucaaacaugacauucauauucguccauggccagcacagauucauaacacgaauuccauuuaacauauuuaugagcauuuaagacaugcauuuaaauaaaguuguuuuguauuggcuaacucuaccaggugaccauucuaaagggaucuacauuuucagauuacaaugacuggguaguuacaugaaugguuuguguuugcggagaguagauagggaucugggaaaagaauucagagagaggggggauggaagaggguacauucucucuugaggagaggcagaaugaccacacauguauucuguugguaagaaugcugucauugcagaauguugggauauugauuauggaagccuaguuucaugcaauuuuucuuuaacggggggauagaaaauagguacuacuuaaaaaaaaucaaaccaggcacaguacacucaaaguuggugugucaacaccccuaaaaugcuauuaguuuggugaggcugugaauaccucucccugcuuacgcacucucuugggaggugcguuugaugugugagggagagucccccucaccucggagguuccugaggaggacuuucagcuucuguggcucauuugugcgccuccuauugaagucagcucuggggugugucugggcacaguggucugucugcaggauguggaagaggcuggccauguugggcccgaucuucuccaucaggcugucucugauuguacugaccgugucuucaucacauuccagaaggcuucggacaagucuguuguaguaucugcauuggggaaaagauucucauuagagaaaacaaaggcaggagcagguucagacaccaaugcucuaugcaaagcugaagguggcuuuugcuuccuucggagcucuggguucaccagauaacacuagaauguccaucuccauguuuagauuucaagagaguuagaucacacugaacuauaggaagcugacucuuaugucugaaauccuggaaaacaauggcucucagggauaaaggacccaaaaugcucucauauuguagggaagaaacuggggugcuugcucaaagucauacaacgaauuaauggcauuauucuauucaaauaaaaugaauagaauuggugggccguagacgcuaagcuuguguuagcacuacaucacugcaaauggacugacaguuauuuggaugacuucugcaacuucccucugucccagggaugugugugcucaagaguagguacauacuaaugcacguucuuguuguuguuuuuuguuuuuuguuuuuuuuuuuuuuuuuuuuuuuuuucgagacaggguuucucuguauagcucuggcuguccuggaacucacucuguagaccaggcuggccucgaacucagaaauucgccugccucugccucccaagugcugggauucaaggcgugcgccacuaaugcacguucuaacuaagccucaaucuauagccaugcauuuucuugcgaaagcuacuuuccuuacacccacccagccagucuugaagaggcugauaacugaccaacucuauuuugcagcuuccuucaaaggcauauaguggcuuccagcaggcaaacacaaggaagcaagggugcuugaaggaaaagaugagugaccuuuaaaggaccauccuucugugagucugugaaacccucucauguugcuuaggauuuuauggccucuuccuucuuuggaugccucauagacuuuaguugucgccucaagcaccaacauuugauggccucaugaugaucucuuuuucccuggcuagacuuugaacuuuucaagggcaggguaggauguccuuagucuuguuaucccaguagcugaguggcaucagacuguauugucugcucaguaauucacacuuuuuaaaaaugaggaacuagaauuuaaauaacaggguggcuuuucugucugggaagaucacauccaccuucuuccugcauguguaccauugaccuucucuuaguucucaccaccugccccuaugcuucuauuuauauuggaauaucuucuuacuauaucaacugaacuuugacaucaauggaaagagcauaaggacauucuucuguugcacaaaaagaugccuuaauguuuugaagaaaaaugaucugugauguuguagauuucuaagcaaacaaacaaaaacccuaacgacaaagacuuuuauguguaguauaagugacuucuauuuaugcaacaaauuccucugacugucccaaacaacauagccaaguguuaucgcugugaauggaccaaaccaucuauguucaaaacuucuaaacaacuuguacaguucagguauucuccaaagugacuuggggaauuucuggccuguuuugacucaaugguuguauaaacccauuagcucuaugcucuuucccuggugacagugaccugcugugcugauguggagagacccuuuucuaggaguggucagggugucaugggggccacaggaucaacuggggaggggaggaauccugguuauuuuuaacucaacucccagagcacaugagcaaacaucuuucuagaauaacuugacccccuuagagagguccuuugaaggauggacaguaaacaagaguagaucgugagugaggaagccagucggucaccuuucuuugagugagaggagugaagcuggggguggagagaggggaacauccucugccuugcccauaguccuggcuauagcccucuugucagggacaauucuaucuagcugugagugaaauugggcuucucuggcccagaggaaucuuuuccaaaccuuuggaauuaccaaguacaugaguuaagcugagguucacuuggguggggaaaugggggagagaacuaguuuuggaaaaacugagaccgaaacugugaugucgcaacagcuuuuagccaucuauaccuucauucaucuccagguauuaacuaacuucugggcucuuccaggacuuggcuccccuacaucuuggggucuacuuuagaagguauuuuaguucuuggaggauacaguucccuuaaggacuuuauagcccagagaaguuaacccuuccacaucuagaaagaacuuuuucaugaugcauuuguccacaaguggccuggaaaauaggauugcucuuuagaaacagaaagaaugcaaaguuucuucuuuggcagaauuggaagcucuugucugguuggagaacucuaagccccuuaaagaaauucagcuuguguagccugcaucuuugggggcccuaaugcugccugacucugagggcauuuccuuuuucuguugugucucugugucucugauagacuagacagaauaccugaccuacucuuagguuggccuaccugcucuuaguaggaacuccuauucccugagggggcuuugguaacuuaguggagaaggcaaagacuuuucuauauuguaaaguagaaaacuauagauggcucaguuaggagcuccucaaagcuaaagccaggcugccugcuaccagcuaacccuguugucuccagugagccagaaaugugacucucaucucuggacuuugcaggacaaugaggagaccuuuacuuuggguugcuaagcaacacagaugcuuuaagagguuugugcuuucagcaaaaguugacuuagcaauugccauauauuuauugagcacccuuuuguaccaagaacauauaguuacacuagcuacgaggagagaugauaugucuuuucuuuuaggagagagcacacacaaaauuccuugcugaacaccaugguguguguauauuauuauucaugguauucuauuuugggguuucagggacuucuugcaggguuuuucuggcugccuucuuuugaaguagaauucaaaauagcuuggcucaaggccauaugaauucuggacccuauuggguaugaggguccaagcugugagaccuuuagcagguugcuuaucccacugaaccuuguccuucagucaguuagauggggaaguagggcuggauaaccuuucccaucagcuaucauauuuuguuucuauggacucagcaugcauuuuccuucucaagcuaacaaaaaccaguacagcucagcagaagaaauccgccuuguaaggggagaugggauguucccuaucuuuaagccuugauaggcuuuaugccaugguguugcacaccgcauugaaauagcagauuaagccuucuggccucccagccuggaaggaccuugcacaaagcaugcaucuuucuucuaacuuugaaaauuccauccucgaccccaccccccacaccccaugugcuuggugaagaauaagaucagacauucuccauggcuacaguuucagccaugcuuacccaaauacacacauucugccuaggaacguucugugugagaguuuauaaauaguccuuuguuucccuugaucaauauuauucuucuguuuccuguucccaauccaugcccuagagaguuggacgcuuugucacuuuucccacucuggaucuggguuggucucauugguucccaagcuucauggugccuugccugccucaucaauccuuccugcuucccucaagacugaaaguguggguugcaaaucagggcaggggacauucccaaccaccuucuuucccugcaugcaccuuugucauaugcacacagccccauucugccuuucaguccaaucaggcuuuuggacucucccagaccuaagucucaugcuagaaaaaccacaggaagguggaaugaaccuguaacuacuucccuuugcaauucuuugccaacuggcagggacuuugcgugugucuauguugggaccgaggcugggaagccaggauguuucgggcgcugaggaguugaaauagagcagagcaagccccgccugcagaggaaauugcacuaguccugaacacugugguaaaauacuuggaaaaagguaagaguugcaugagcgauuaugacguugaagacgauuccacccuuuucccauugaccuuuucuacuaaacaccagcaggaggagauaaagggccugugccuggauuauuuuuugaaggcauugcaaacaggauacuuuggaagaagaagaauggucuagcuaaggacaccuuuucaaaguuuccucuuggauaagugggaaucuuugguucaaccucuguagcuuccuuucuaccaugacucucucaucacaagggagaaugaggcuugaacugaaauagccaacucuguauagccuugaaaucggcuaccugccacuuuagagauccuauguguauaggaucuuuaacaaucuaaacuuguacugacucugcuaacacaccucccuuuaaaaugcuacauaauuacaucuuuugugccuaaccauuguccaagcaagaacucuucaucucuucccccuauggcaaaggguuagucuacaacaaccagugaaguauuaacccuucccucccucaacaagaaucuuccuaggagaauuguuaaaauugagguugauauagaaagacaagauauuugaggaaaacggaguugauuuuuccuguucugaaaagucagauagacuugcauucaagggcuguaugguaguugagaauggcuccuauaugucacagaaguuucauguuagggguaaagacagcugucugucucagaaggaugggguuauuuggcuaggagagucaucagcuuagaugugugauaacucuuaggggaccagaguaacagaacuauuccuugugaauacauagagacuuggugggagagucagggaaucaugggauuucauccauucauaggauuuggcuucgagcaucuccgcaggcuguugacaacugacuuauaguuaacuacugauucugucugucuauguacuacccaagcaucaucccucaccucuugcuagacaucuuugauacccacaguggaccaggaugcaggaucucuuacauaucagggguucauuccuauuuggcaaaggcuucaaaaccaaugacacaggcaggccuggaggucagauggugugaacccaguagcuuugggucaccugagaugcaaaugauacuuggguagccaccagcuuuuccuucugggaaaucuugggcuaguggguuggguugacauaaugcuuugaagggaauacaagaauggcucccugaagccauuuuacuuuucauagaguaaaaugaaucugguucugcguaaauaagaugacuuguucuggagauaagaucauuaguuacugaaauaucuggcuuugggacuaacuccaaauauacagauuuaauaaaagucugcauuuugacauuugacuaaguuuuuuuccccccauggccuauuauucuguugcucagucauuguuucagccaaaccugaugucucaaaagguacuuuccagaagcuuccuuguuuccuucaggcuuaugguaagaacuggacagagaaacucacccaggaaaacugcaaaccaucucucugcuagcuguguaggaagauuguuauaacaccagagggaaagauugcuacucugguuaugguggccaacccccacccuacccccccccccaugcugugaagaagaggacccucggguaccuguuggagaagugauugggcagcuguaugacuucagugauggcuuccggguugcgcuuggcgaugcugcaaacguuaagcuugcuguagcaguccuccugcaccucggcgaucauccucuggaaagucgaacaccuccgaauggcaaggaauaccuuggaggugaucccauuggcgaugcacuuuaagcucucuuugacaaaugcuuuucccugccagggauaagaagauaagcaugaguuugaccuucuaaaagaggucugggucuaugacacaggagucuuucaaggggacacagcauggcugagaaucaaaagagaaaaaucucuucucucuuggacuaucuugaacacucagcuccacggacaggaaacgagauaggagagagacaucaucaacuccucccagaugugaagauggucagaaucaguuuuauguucuugggguuaagacugguaacugggaauuucagauagcaugccaggucacucagaggaggacauuuuuauuuccucucaaagcaaaaaugcuuuucugcuaaucaucccucauauuauaagccagccucugccaacccuuuauuccuggucuaaacuuggugugcauaugcccccaaccuguguugguguaucugugcgcauacacacacgcaugcguucuggagcauguuugcaagccugggaugagccugguuagaaggcuggggagcaagguuggcuuuuggggcucuuaagaagaguaacaagcacucuguuaaaaagacaagcagccagugggagcuaaaggcaagguccaguuaccugagugucaaauuuagcagcacuguacaagaaggauuuacaaaugucguacaucccaucugugucacauguggaguuuuccaggcaugcaaaagccccgcagccaaccugcagggcacuguugaggcagcgaaccacuucagcuggaagagacaagcagaaccagucugggucaagccaagggggcucugguagaauccaguagguguaaaagucuaauaccaagggcacaugaucuuaacuuacccucggaauuugauuugggauuccauuaaauacaacaauuggaagaaaauuggggugagaaagagguugggggaaggacguuuuuccuucugagacucaugauagggguagugucuucucccuuaggcacgugcucucucugggucucacccuucuaugcauuuugauggcuagagaauuaaggauagagaccuuguaaugcauagugucuucuguuggugacaggaaucaaaggcugucccuuggaacuugagagcuuggguaggcuguaggcagugacugaaggucaggcucaugauggaguugggggaggaccagagagaaucuaucugcccucugaaaaaugcagucuagaguaaaaagcaugguauuuuaacccaaauggcagagaauaauuugcugaguccauuuggagggagacccuucccaaagagagcuuuuaacccaugaaggcacuggcagacaaggaaucugagcccuuuguauccacccagccccccaaccaccguccagcgcuuagagguaugaauaaucucucauauuaaaaaggcuucuuuucaaaaaaggagaaacacagguguggagugacggguucaaggcacuccuugugaaaggcuggaagaaaaccgcaaagaacuugcaccggguuuucugcauucuggauaagaucugccauaaaaguaauuucucucccacagaaggagggguguucuggcaggcagcucggcaagcaaugaucuguagccuucauaccguaggauucuccucccagaucaaaagcaugguuugguuagguuaggcuuccccgcccccccucccaccacccgcagccucugggauguuacaagucauuucccuaauuauauauuuccacggguucaaauuauaacuuugcuuuaagcaguuuuaauaugcauuagggcugcuauuguuuuaggcaagcucgaauugugaaucacggcaucgcuauagcaacuaaguacaaaaggaagccaggcaaaaggccuccucuggcagggaccugcgcucuuccaagggggagcaucugcagcauuuugacaccugcggggucccaucucuguuaacaguuggggagaggaguuugcgaggaucuagaagucaagggacauagggguccuaaugcuucuuugccuccggaggccaggaccauauacaguuaacuggugcgggagucgggcggaaaguaagaccuuccccauggagaaagaaaugcuucguuuuacaaaugcacuuccuucuagggaccacgggcugcaugggcgauugaauggagccucugagagcgaggaaggagacaggcaggcuuauagggaacgggguguguagguccucccaccccuuuucugaaugcgcccugaaaaaaauuucuuuuuuucagacuugaggauuaugguuccacaaaucagugugaggagggggcuugucugugugcugucuggagagguagagaagucaaguuacaaggucuuaaaggagcagggagaggcauggcagcagguaagccacucauuaccuuaacacaagcuuguggaguagagagagccgcugugaggcgugccaacauucaagccuuuccccgcccccuccccccaacaagaggguacgugccagauuucaggcaaucaggcuaggcuuaugcaaugaaauacccucagcagagcgcccagcuucuucguuaguugcaugcaauuuauuaaacaaaggaacuccacuuccuaaggcuauaggauuacacuggcaguucauuaucaccaggcaugaagcacauuuauuacugagaucagccgucacagagacacaugcaaaagugagagaggcaaaugaggacagaucuuuggggggagaaaccgguccuggguuuucuugcuuaccugaauuuugagccgccacccgggauuuucuggggcucacagaaucauuuuguuccgccucgugcgcugcagcugcacugaugaccagcgccagaaucacugcugaguuuuggagcauucucugagaaguuuccgcuaaguuguuggcuuuuuuuuuuccucccccccuuuccucuuucccucucccggcuugagugaagauguggaucuggauauacugaaagcuuaggugaggauuugaggaagaauuugucugugugugugugugugu

SEQ ID NO: 7553 - RNA, 3266 nt, Mus musculus
cuuugcugguuauaaaucacaaauuuauuauacaagaguucuuuuguaugcauauaacuuuuucauuuguuaaggauuaaaucaaguuugggucgcuaggguuucuauugcuaugaccaaaagcaacuugaggagggagggguuuauuucacuuaaagguuuccuaccaucacugaggaaaagaagguaggccaaaaacucagggcagggaccuggaggcaagacuugaagcagaggccguggagaggggccuacuuacugacuugcucuucauggcuuggucaaccugcuuucuuauagcacgcaggaccaccugcccugggauggcaccacucucaaggaacuggguggacccucccacguuaauuauaagucaagaaguacacccaccacaggcuugcccacgggccaaucugguaggggcauuuucuuaguugaaguucccucuuccaaaaggacucuagugugugucaaguuaacagaaaaacuagcuaacacauauacuaauaaaaugggugcacuguuuauuuuugcauaaagaaauaaaucuugaugaauaagaguugaccaguaccuugauauauaauuauugaugcuaagaaugccauuugcauaaauacaaaauacagaacaacagaaguauguuuagagccaucucggagaugauuggaaaucuguccuuaucucaaaccaaaguuccuuuaacacuguuuuaaaaauuaaauucaagucagcaucucaagcaacauguuugaaauagaacauucuaacacaguacaauuaaggacaugcugaugugacauuuacaaauagaaaaauauuaaaagucuuuguuccugucauugaaccauguuucuacaagaacagaaaacuuauguauagcaaaagcacuguaacucauaacauauggaaaucuugaauaugcaccaagguauuucaagcuguguugccuaugugacauauacaauguuguauguucaaaaccgaggcugucaucacaauacaacauggguuucuagcaagaaacaccucagccucguuguacauuugauuuuuuuaauuaauuuccagacauuguguguucagaaaccuuuuacuguucccaaaauuuucaagacccccacauucacuuacacagcuuuguauggggucucaacccacaguuucuagagcuaggccucagauguuguugugaaauguucucugacauggaugcuuuaagcacaugcuuuuuaggaggccugcaguucacauuuguagaaagagguucccugcccccccccccccaacacgggcaacauccuuucugcacaagcucugugccacacuguaaggaaaggaaaggaauaaaacucugagaagccaccuuggcaauaugcaucaaagccuuaaaaaucaggcaguucuuucuccaugaaacuucucugcuagaaauucaucuaugcuagagauacagucuaaagaagagaaaagcacauacacaaauauaaacacacacacacacacaauuuagguccggauugacuauaggauauugaucacaggcuugucauuaauuuaaaaagauuuccaagcauccaagguauagcaacccuaaaagauagaaguugguggugaaggaaauauuacagaaccauaaaauaaaugucgcaauguucagacaucaacaauaaagguacauuuuaagggggacagcauuaguagaccauaaaucugcaugcauacuagaagagauagaaucagaccaugggugagcagugucucccuucgaggcuguuuuucugcucuuuaucauggaacaucugagggguccuugaaaauagagagaauggucugaggagcccuugggugccuaucacccacuaugugucaguaucuugcccacccacacugguaacugaaggggaguguuaagaagacuuccggcaaaaugaaaguguaauugggggugacaugaagguagcauggggagcccuaggccagcuccagaagggcauguaaaacgagggcacuuuucucaggggugcccucggaagggguuuccucuuugacccaugucugucuucugcagcugcaccugaccuggugcuuaaugcugagauuguccagcagacugccuaccuggaggacaggcccauguccuugcugcagugugccauggaggagaacugccucuccgccuccgcugugcacaccgaccccaccagaggccaccggcgccuuuuacgcuucuccucccagauccacaacaauggccagucugacuuccgccccaagaauggccgccaugcguggauuuggcacgacugccacagguaagucaccugucucuugguuagucaguuacccagccugguguuccagcucaggaaggcacugacccaugaucuaggcaaaagauuagucugcaccucuggaagccauucuccacccccagcucacuggcugccccucccccuuuugcugagucccugccucuuggcuccagugcuuuugauccuaggagacauggcgauugaucagagugccagugccuuccagggaccuugucggcagcuuccaagugcaugcacaauacauuugugcucuacagggaauguucgccuauacagucuugaacccuguguccauauagaaauauauuuugcaugcuaauaugagauuauuuuuagguuaacauuuaaaguuagccuccaaagcagugggucccacgauggcauuuguauucacacggucacacuuuuaaugcucccuccccccgcugccacugcacaucucccuugggccuccuguuuuacuuaguauuuuuugauaucucuagcaagacaggagguauggagagaggaacuccaggacucagagucaugagaccugguguaagccugcuaauccacugaccaacaacaaccugacaguaaggccaacugggucacauugccugggaguucugggcucccuuccagcuugucuguggcugggaugcaggugcugcgaagacaggaucaggacaguagaauagagggaaauccuacagccaaucccaccauggcccauggaugcucucuggaccuccucucuccuuuuuuuccuuugcucuucuugacuugaaucggauucagauauuuuguucucggucugggcaaguagaggacacugcuugcacaugguuggaaaagcagcugccauuccuugcaccaggaaucccucuucuagagguccgcaaacuucuaauagauccucuucucuggacucaaauaauccaucug

SEQ ID NO: 7554 - RNA, 3266 nt, Mus musculus
cagauggauuauuugaguccagagaagaggaucuauuagaaguuugcggaccucuagaagagggauuccuggugcaaggaauggcagcugcuuuuccaaccaugugcaagcaguguccucuacuugcccagaccgagaacaaaauaucugaauccgauucaagucaagaagagcaaaggaaaaaaaggagagaggagguccagagagcauccaugggccauggugggauuggcuguaggauuucccucuauucuacuguccugauccugucuucgcagcaccugcaucccagccacagacaagcuggaagggagcccagaacucccaggcaaugugacccaguuggccuuacugucagguuguuguuggucaguggauuagcaggcuuacaccaggucucaugacucugaguccuggaguuccucucuccauaccuccugucuugcuagagauaucaaaaaauacuaaguaaaacaggaggcccaagggagaugugcaguggcagcggggggagggagcauuaaaagugugaccgugugaauacaaaugccaucgugggacccacugcuuuggaggcuaacuuuaaauguuaaccuaaaaauaaucucauauuagcaugcaaaauauauuucuauauggacacaggguucaagacuguauaggcgaacauucccuguagagcacaaauguauugugcaugcacuuggaagcugccgacaaggucccuggaaggcacuggcacucugaucaaucgccaugucuccuaggaucaaaagcacuggagccaagaggcagggacucagcaaaagggggaggggcagccagugagcuggggguggagaauggcuuccagaggugcagacuaaucuuuugccuagaucaugggucagugccuuccugagcuggaacaccaggcuggguaacugacuaaccaagagacaggugacuuaccuguggcagucgugccaaauccacgcauggcggccauucuuggggcggaagucagacuggccauuguuguggaucugggaggagaagcguaaaaggcgccgguggccucugguggggucggugugcacagcggaggcggagaggcaguucuccuccauggcacacugcagcaaggacaugggccuguccuccagguaggcagucugcuggacaaucucagcauuaagcaccaggucaggugcagcugcagaagacagacaugggucaaagaggaaaccccuuccgagggcaccccugagaaaagugcccucguuuuacaugcccuucuggagcuggccuagggcuccccaugcuaccuucaugucacccccaauuacacuuucauuuugccggaagucuucuuaacacuccccuucaguuaccagugugggugggcaagauacugacacauagugggugauaggcacccaagggcuccucagaccauucucucuauuuucaaggaccccucagauguuccaugauaaagagcagaaaaacagccucgaagggagacacugcucacccauggucugauucuaucucuucuaguaugcaugcagauuuauggucuacuaaugcugucccccuuaaaauguaccuuuauuguugaugucugaacauugcgacauuuauuuuaugguucuguaauauuuccuucaccaccaacuucuaucuuuuaggguugcuauaccuuggaugcuuggaaaucuuuuuaaauuaaugacaagccugugaucaauauccuauagucaauccggaccuaaauuguguguguguguguguuuauauuuguguaugugcuuuucucuucuuuagacuguaucucuagcauagaugaauuucuagcagagaaguuucauggagaaagaacugccugauuuuuaaggcuuugaugcauauugccaagguggcuucucagaguuuuauuccuuuccuuuccuuacaguguggcacagagcuugugcagaaaggauguugcccguguugggggggggggggcagggaaccucuuucuacaaaugugaacugcaggccuccuaaaaagcaugugcuuaaagcauccaugucagagaacauuucacaacaacaucugaggccuagcucuagaaacuguggguugagaccccauacaaagcuguguaagugaaugugggggucuugaaaauuuugggaacaguaaaagguuucugaacacacaaugucuggaaauuaauuaaaaaaaucaaauguacaacgaggcugagguguuucuugcuagaaacccauguuguauugugaugacagccucgguuuugaacauacaacauuguauaugucacauaggcaacacagcuugaaauaccuuggugcauauucaagauuuccauauguuaugaguuacagugcuuuugcuauacauaaguuuucuguucuuguagaaacaugguucaaugacaggaacaaagacuuuuaauauuuuucuauuuguaaaugucacaucagcauguccuuaauuguacuguguuagaauguucuauuucaaacauguugcuugagaugcugacuugaauuuaauuuuuaaaacaguguuaaaggaacuuugguuugagauaaggacagauuuccaaucaucuccgagauggcucuaaacauacuucuguuguucuguauuuuguauuuaugcaaauggcauucuuagcaucaauaauuauauaucaagguacuggucaacucuuauucaucaagauuuauuucuuuaugcaaaaauaaacagugcacccauuuuauuaguauauguguuagcuaguuuuucuguuaacuugacacacacuagaguccuuuuggaagagggaacuucaacuaagaaaaugccccuaccagauuggcccgugggcaagccugugguggguguacuucuugacuuauaauuaacgugggaggguccacccaguuccuugagaguggugccaucccagggcaggugguccugcgugcuauaagaaagcagguugaccaagccaugaagagcaagucaguaaguaggccccucuccacggccucugcuucaagucuugccuccaggucccugcccugaguuuuuggccuaccuucuuuuccucagugaugguaggaaaccuuuaagugaaauaaaccccucccuccucaaguugcuuuuggucauagcaauagaaacccuagcgacccaaacuugauuuaauccuuaacaaaugaaaaaguuauaugcauacaaaagaacucuuguauaauaaauuugugauuuauaaccagcaaag

SEQ ID NO: 7555 - RNA, 1435 nt, Mus musculus
aacauguagguuuuuauuugaggacagcauuagagacagaauuuagucguuggaggaguggaguuguuugcaauuggucuccagcacucccagcauuuagaaagaguucaguacaccaggacacagguuccuuagcagucuaggaaugggagaggugaccgcuucaagccaggcucccccacacaacuucugucuuuccuucuuauccuugacuggauucagauggagagaugaaguauuuuccuuuggggaagggguucuaauguccuaaggcuucuuauucuuggacacuuagaacuuucgugcggacaucauucugauucaccgcccgcagccccggccccucccuugggguuccugaccccgcgcugacucucaguugagcgcaguggcccgggaauguguagcggauuagcuaguugcgcagugggcaagaacuuuuaggggcgaggguaugaggguuuuguuguuguuguuguuguuguggagauuaggaaagagugaaguuuaggggauagaaaacacgugcaccaaauaauucccagauaaauucccuaacgguucuaaagcaaaccccuuuggccacaggauggcaggagggcccagcaggccggggcacagucgcuaucuacugcagccggcgaagggcuugcggcugaguuacugcgggaagaugugaaacccacagauucuaagccaccaaggcggucuccuccagucucuacucucugucucccgcaggguuguccucauugcugccugagggugccuugcagucaagggcggcccccugugccgacccagggugcugucaccucgacagcggaucccgggggugggugauguguuccccgaggccugcuccugaagcgcgcagccuggcugagagcgagggggaggagagggagggagcacggaggcgcgaccccgaaucacaccggguuggcgggggaggauucccuccucaguggccgcgugggcgcggugaaucccgcggcccccgcuggagagucgggguugggggaacuugcaucucucagggggagugggaguguugacaagaaggaagagaggauccccgggccucacgccgugggagguccaugcggggccgggggacgcgugggaggaacucccuagcugcgcauugugauggggguggaugacaaccucacucccucuucccuccccucaguuuggaggagaacauugggugggaagggcccagacucccccggaucuccucuagcucuuagggaaggagggauucccgccgcccgugagcccccaucucugccacccccaccuccucucccuccaggcuacccauuccugugcucuagaggcuuugcgcccccggguucuccuccgcccgcgcggcgcggggagacugcgcgcugcagcggucccgggcuucggccggaaucagggcaug

SEQ ID NO: 7556 - RNA, 5304 nt, Mus musculus
agacccaggccaaaccaaaacuuuauaccaugaaaacaagaaauaaaaugagauuuaaagcccggcugauugucagcaaacacaauauauuuacuguauuggcauuugcucacaaggcaaauggggcaacauuacaccgcuucaauauuugcuuuuaaaaaugcuguuuucauuaacuauauuauauuggcauaacaaugugacaagaaguaaaugaaauguuggugaagaaccucaccuuuucacaauaucaagcauuuuuuuaaccuuaguauaagguacuauaaauccaagaaauaaaaacauccacaaaauauauuacaucugguuugucuuuuucuaaguacucaacuguauacaaaagucuuucaaaaaauaucauuccccauagguuuuccuguuuaaaaccugauuuuuucucucaguucacauaaguuagagugcauuuucuuuuguuuuuuaaacaugcagacauauaaaaaaaucgggauagcacaaccuuuuggcaacaaaguuuuuuuuucucuuaguuuagcuuaaaugucugagaacaguuuuauuaaaacaaaggaaaagucagaguuaucaugcagugacaugcauauuccagaaggaggaagaaaaaauauuaaaggauauuugauuccuccuuccagcuuugaacugaccaaauuuuguguguguuuuuuaaauaaucaucacauuauaaaaaguauucagcaaaauacugucucugcaaagaaagauuuuacccuucagcugaaaaaauaugggcccuccuggcaaacuucuccuucuacaaaaagcccgaguaccuggaaauucacaaucccccauaaucccccgcaauccccgcucuucgaguuuuuccucccuugcacuagaguccuuuuaguauuauuuauccaccaccaaaagacggugcuuuuuuaauuaaaaaaaaaaaaaacgugggaaacgcauaaagugacuuuaaaaacagacauucuguaaacuccagaccuuuugucgcuucucucugggcagcuuacuggccacaggagaaguggugcuaaauaggaaggauacauucagucaagacugcuggaagcugugucagagagcacccuucucuuaagucuccacuucaaaagggccacccuguguggaagggcuggacaggacaacugggguugagggcuccugagaagaggugagguagggcagggaggugcgauggggccauggaacagaugugccucauucagcaacacagauucaugcaaaaauccccaucuauuuuuuugaggaaaauuugaacagaauguguaugcauauacacacacgagugcacauauauccacacacauacacaaguagauauaaucucaucaguuaacauuuucauaaaaauaaaucauuuaagcuguauaugccuacaaauucucuuuauuccagugcacugcgcuggcuaaccaaaugccuuagguuugaucuugcuaggaauacggaguguguguuauguaaauauaugugucuaaagaaacacacacauacaucuacauacacacgcaaauaucauauacauacacuucacuucuaucuguuguguuggugaucagagagggcaaaugaauagagccagccuucccaggaauggggaguggguaugugacagagacaaacucuugggugguugauugaggccugccuuucuggguaaagaucuugagagacucagugagaaccugagagggaaaaagagaagaugggagagagaaaggcagagggcaagcucaagaacauagauuuugaaaagugggacggagcaaugauuucuuuuuuuaaaagguggcucuuucucccccaaagaucaaccuguccugaggccuaagagggaagcgcucggaaagggagggggcucuaaggggccaaacccgaggcggcggcagcagcaccacugcagcugcagcauccgaggcauuucuguaagaaacauuauuuaaggagcagauggaagaccaucuccuccggucacaugcagguccuuagcuugggacaucucccaacggcuuggggacccuaugugaagaagaguuuagggguagacacagcccaguucagcucaagagucucacacacgcgugcgcgcgcgcacacaccgcacucacucacacacacacacauacacacgcacacuacacacaggcgagcacgcacacacucgcgcgcaucaccgcacgcaagcgcgcgugcgugcggcgggcagcaagcucugcgcuuuggugcgcuccuuacccccucccccucucggguguucgagggggaacacagggagacacuggagggggaaaacagugaggugcuugggucuggcgaagguuagaugggccccgccuucagucccccguagguccuuggcguggcucagcggccccuggaucaaggcgauccuaacugaacaaagcgggcuagacgccaccuuuccgcccccacgccuuggcuaagaggggggcagcaaggagaaagugccuccagcccuagcccccaaccgccggccggugugaaaggguggaaauggggggcgucgaagggggaggcaagggggccgcacguccagggcgagaucagggcgcggccccugcgccucagugacuggcuuuccccucugcuuucaggcgaccagccaggaggcacuggaagggaaaagaagggaucugggugccggauccucaggcgcagguggugaccacaggggccagggacacggugggcgccgaggaugcagagggcgcacccccuuucuccgacuucuucuccuuuugcuugagguggaucuuggcguggcgcuugcgcucgucgcugcgcgcaaacuugcgcccacagaacucacaggcaaagggcuucuccccggugugcgugcggaugugaguggugagguggucgcugcggcugaagcugcgcaugcagauccgacacuggaagggcuuguggcccguguggaugcgcaggugccgggucagcucgucugagcggcugaaacggcggucacagccuuccgcgggacacgcguggggccgcucguggagcggggucuugcuaggccgauugggguacuugcggggccggaugggcuugagagugagcggcgguuggggcaggcugccgaaucccggguggaucugcuugucuuugaaggccuugauggucuccagugggguaauaggggguggguugacccggaugggguccaugcccuggaagggcuuauguuccggaauggagcccaugucguugggauggugguacagguuguagucaggaaucauggggaaaagauugcuguccaaggccggcuuggccgauugguaauccuggggggaauaggcgagcccaggguuucccugggggucguggaaagacacgggcuccgaguagagaucgccgcaguuggaauaaggaggcagcgccggauacauggccuccacgucucccugaggaggcugcaccaugcuagccguggacgucugcguacugagcgccccugaggccgggggcacccccaagaugccggcacucaugaggcuaaugauguuguccuggcaccaguuggaaggagagucgaaagcgaacuuucccaaguaggucacggucuuguugccgggggcuggcuggaaagagcucgaauaagagaguuccggauugggcuucucguuggucagaccgauguccaucacauucucugcggagagcgggggagagaggggaggggugagugaagccgagccggcucccggccgcggcgcccagguccuugcccaggaguagagggugcggccggcuggagugcgcagcgcgugggguaagaggaacgccgagcccggcgcaaagcgggcggugccgcgcuccccggcgcaaccuggauacagcaaaauacuacggaucgggguguggaguggcuccggcacacacaccgcacacgccgcgcacacacucacguaccacacacagacacgcacgcgcgcaagagagcauuguuguucuucccgagguggggcggacagguagcugcagcuacagguaguuucagacccggagcgcgcccggcucucgcucuccagcacacacaacucggccucuucccccggcccugucuacuccaagacgccgcgccuucaugccccaagcgaggucccccuacgcgcgcugagcccggguggccgacccaaagagcuucgacgcuuuuguccucggagcgcagaagggugccgcccguaaagggagccucucccggccccagucuccucccggccugaaggagcuuucugcucgggcuggaggggaaaagccuaaacccagcuaaggagaguggagagcggcggaaaaccagcccaugucuccacggcgggagcggccgccguucccaagcucccgggucccaggaucgcccccgguggcaaacccuuucccccgccccgugggugagcccccucccucuccccaccguccccacacccccaauggcuuugcugaacgccccggaaaggcagcgucgcaguaccucucccaccguggggacuccacgccgcacauggcuccaucccgggugggaggcugagggaguaaggaggggggagagcgcgggugaaaaagacgcugggcuccucccgagaaagggggcuacagcaccacgccuugcacgcagcccagcgaucgggcccccugcguggggagggagaaccccagagcugcucgcaccuaccucccuccagucggcggcugcccccacccgggagaaccgaagccucaaccguggcgucuccaaccaagccuucccgaucucggagggcgggaggagugggugggaaaagcaacucgccccccagaaaauucccagcgcgccccccaucuuuccauccgucucuccauccauccauuucugcauccaucgauaugugcauccaucgcuagcucgcucccuccuccucguccucccccuuuccuuccucgcugccucgccgccucaccgccacccuuaccuguagccaucugauuguaaugggcuaccgagucgcugcugccggagaagagguugagcgcgcuggggaucuccucgggguacagauugucaggcaauugauuuagcaaacugcucauggucaccggcagcuucucggcgaguuugccggucauagcacucccgagcuaccgccgccaccgccgccgccgccaccgccgccgccgccuguuccuaacgcagcuuccaggcgagcggcauccgagaggcgauccguggugcaggggaaaagcaugcgagagggaaag

SEQ ID NO: 7557 - RNA, 5367 nt, Mus musculus
ucaguuuccuuguuuuacuuaguuuauacuuaaaagguuuuuguuguuguuuaaauuuuuuacuuuugucugauuuaccuguguggacuggauggggaagucaaacgaggggcucagagcccuuggauuggaguuucgaacacccauguaggugcugggaacccaagacccacccaagacccacccaacgcccaucuucuggaaaaguaguauuuuaaaauacugaaucauugauccaacuccaaaaacuuccauuugucacaugaucauccuuucuugcuuaaaaaaacaaaauuauucuaaaugauuauaauugccagccgggcaugguggcacaugccuuuaaucccagcacuugggaggcagagacaggcgaauuucugaguucaaggccagccuggucuagagagugaguuccaggacaaccuggaacacagagaaacccuuggggagggggcauuguuuuuauugcugcugcugcuauuucuguuuugcagugugaggaugggacccagugcccugugugugcacucucugaaagcucucacagggucacaucucagccccaguugcugucauuuuuaccaguguccucauaaacucuaggcgauaccucauucugcuuccuggugugucagggacuccagauagcacuguguagccccguccuucacuucgcucuuucucccucccauauccaggaaguccgaggcacuuagacuugauuguuucaggugaaucuuaguuaagggucucuuaagcuaucugcauugcuguuugucaugacuugcaaggacuuugccuaccacaugcuggaaguguagguuucuguuggcugucaacaauuguuauaagaacccuaucuauacaucuuccaagcaaggcuggaacuuuaucccaguggggaugggguuguccugugucuuuguucaccacugguacaggacacaccuccucaagggaaugcuguugagugcuaggaaugcuggaggcguugagggcauccugcccagcuugauacggauucuccuuacagauggggccuuugaggaccuggcacaaggcuguguggugccaggagucacuugcaccuacagacggauaccagacaacacucacgaauguucacuggacuucagggagggacagaaugagcugagaggucuggagagacagaugccacuucugaaacuggcuucccaggacucgggcauggagaugguuguuggggacagcuccuuggcuaccuuaucaggacuuucucaagauucucugaaccuugagcccauggggagcccugagcugccuccugcucagcuagaccggcugcuggccagacagaagcuggaggaggugcuggagagaucucgagaguuucccagcuugucugcgcagcguggcccccugcaacugcugaacaagccuguagauggagugcccaucuuugcaggagaacaggaguccacggaggcagacacugagcuagaggcuggucuggaagaagcaaaggaggcgaguauucaucuuggcuaaagugcaguggaguggggcaggguggggugggguggagaaagcccugagguguggcucauggggacccuuccccccauuuucccuggagcucucucgggguggggcaucccuugucccuaauugaugguugugucauugcuuucugucucacuucgcacccagcaguauguagccacccccacagaggaggcagacagguaugggugacaugcucagcuggccacuggggaagccagccaagugugucuuucuuggcuugucugcuguguuccauuuuguuggcucagugcagccugacuacccagaaugggaguuuuggcugacucugaaggucuuccuaccuuaacgugucccacagguugguaauauggagucugcagccuguaccugccuuccaggucagggcuugcgcuaucuggaacaccugugccuugugcuggagcagauggugaggcuccagcagcuguaccugcagcugcagacccagagacccucuagggugagugauguacaggugcagguggccaggucaguuagggaggaaaguggggggagggugggaccccuggagcaugaaugccuucugaacagccucagcuuucgagugagucucugcuuguuccaucuugccugccucaggauccugaggaggaaguauuggcuccagcucuuucaucaucacauaucccagacaauaggguccaggagcacagagaggagcuaagccagacaaaggacccagguaaggggcaacugugucuuccucugcauucugcugccuaugugccugcccagggucccaucagcagaccccuaaaccguagcuuaguggggcugcuuccugcuuguuucuggccccagaugauguaguucucuuucagaaggugcagaggcagcuucacuuccagaagugggggugcuugucaccagccccucuaggcugccagaggccuugcuggaaccaacccacauccuuccacccucccaggaacccaagguagugauggauauauguggagcagguaguagaauggugcagggugggggaacaugggaauguguaagugcaaugacagggaaaugacaggauugcuguuuggagcaggugauuugcuugggcagugaaguuccugguagcuucauuagggauguauaguauauagauguacuauaauaagaugagcccuuauucucuguucagcaggaucucucccacugggauaaggucaaaguucugcucaaucggcuccguuggaggagcccucgacuuccugagccuccuguucccccugaugguucuggauccaggugagucuugugccugauuuagauuuaggcaguggggagagacugcugggcgaggauguugguaguguccugucuuguaguuaagaugccccauuuggccgggcuugguggcgcacgccuuuaaucccagcacucaggaggcagaggcaggcagauuucugaguucgaggccagccuggucuacagagugaguuccagggcagccagggcuacacagagaaacccugacuugaaaaaaaacaaaacaaaacaaaacaacccccccaaaaaaaacccaacuaaacaaaaauaugcccuauuuguuggugaagagacagaagaugacaugagauugggaacaguggcuuucccgaagccacuaccagauugugggcggcauguucauccucacgugucaagcccucacuccuuaccacugaaauuuaggggcugguaagguagacacacaggcaaaguauuuuacuguaggugaagucugucugucaugguuggcagcuucuccucaggagguaugcaaagcuucuugucuguuuucuuucucuucuugucuaacuuuccuuugcuuuucuauaggauggaguuuagaaaccucucugacaggacuccgugccauucccaacggaagaccuuuauaccagcauuggugguuaagaagccacgagcaaaaaaucuuucuguaugaccucuugguguaccuggugaccuugggaagaagucccucacauuuuggcuuacugcugcuucucugcacugccaagaaaagcuauuggugcuugcuccucuucaaggugaaggccaaauccaucucuaagcaucgaagcaaggagcccuggauccccaagagguuccugagugcaguuccagcacucuuccagggcucuuccuccucaucagaaaucucugggcuuaggcaaugugaauugacuuauuuaucaggugcucauagagcauguuuaguaugggagugugucagcauguugcagauguaaguuuaugcaaucuuuguuggacuuccgucugccccaucugauggaaucauucguccaaaggguugguguuuggggugucacuggaaggauggcaccgaucuucauuccacaaugaacaguuacuaauguggacuucuaaugucuuccucauaccugagacggcagcccuaggaccaagaacaacauugccuuggguaccuuuguagugagucacggcucuggaguacagccccugaaggcugaaugagggauggggggaaggucaagaacauugagaggaacaacacauaacuugcaaggucaacucuaagaugcuguguucuauccuggaguuuaaccauagcgaagucucuuaauuucugagccacagcuuccuacuugggaccaugauacccaccuuaccuaccucauaagcuuguuaggaggaugaaguaacauuaaacauucucaaugugugcugugacuguuaaaugaccugggaagggugugaugcuggaggcaaacaggaguggggagaugggaggccagaaguuaaaggaagguguguguguguucacuguuaauaguugugaaaauagccacauuucuggcaagauuuuggauagagccacuucauuaagaucguguacguuucauauuugagagucuggguauagauuucggauaugcuuaccccuugcugauggugcagucaagaaaaggacaggaauagggauggggguggggugggguggucauuggcuuuagucagaagacuauccccuggaaauggacccccaguaggcacgcuccuccucuagccaauggaggcccugcuucuuuuguugcuguagucuuggggguuaguagagcacagcaggguguguaagugguaguccccuuccuuguguuugugggaguggguccaguuccagucauuuugagaccuggaaccaaugguucgagcuuacuuuucugaugggacacuugagagaggacaccaccgagcucggcuuccgaaggcauuaucggaucugggaaggcgcacuuccguuccacaguuggagcgggauggcaggcuggugugggggaagggagaggucgauggagaagagggagguaccauauccgggagaguggcagcuuccgaccaguggucucucuuccggagaggcguuuccgguggugguggcagcggcggcugcggugguuccgggugucuuugucccccuggugucguggcccuggcccgcagguggguugggggccuccugcugcgcccccgccucuccgucucucucggguggcgaggcugcgggguccgaacggcgaagaugcgccagucgcggaaagagccgagccccucuggacugcaagcuccgucgcccuggcaacggccucggcccugggggcgggcgggaggaggagaaaccucgcgccgugaaccucccacgguggcuucucgguggcccggcccggaaagcucugcgcaggcggcugcggaggccggagccuagggucgggaccuaggaggagggagcggcgugcaggccgcuug

SEQ ID NO: 7558 - RNA, 1465 nt, Mus musculus
gcgcagcaauggagucauggugggaguugagguucuggggaacugcagaggccuguuuguagcugaggcuuggcacccgcaacuuuccucuccugacauuucaccagcccccagcucacgggcucuggcuccccugaagcccugggugacuucacuaugcuucgacggaaaccgacccgcuuggagcucaagcucgacgacauugaggaguuugagagcauucggaaggaccuggaggcccguaagaagcagaaggaagauguggaagguguaggaaccagcgauggagaaggagcugcugggcucagcagugaccccaaaagccgggaacaaaugauuaaugaucgaauugguuauaaaccccaacucaagagcaacaaccgcacaucucaguuuggaaacuuugaauuuuagagauggauucucuuguaugccagaccccugggacagaauacaaugaugacaggaguaccaaccagauuuagagaauuaagugugugcaaccaagcagaagcuuuucugucuccugcagggagaggugacuucugugugaaauuacugcuguccaaccuuucugauuggcuggaagccaaauucuggcuucuuccuggaaaguuggaccgcagaaggcuuaacugauuuuuguuuuuaaaaauaaauuuauuuuuggaaaaaaugugagacguccuuaaagguaguagcacugcuaaucgccagcucugacagguaacuacuacaagugacaucauucuccuugucuuuacaaaaagaccccagaccccaaacacuugcaguugauccccugggcugacuuaacuuguuuauucacugucugcugaccauccuucaagcaacagagaucccagaugagugugcucaggcugcaauccagcacuugggaggcugaaguaggaaucucaaagagucaaaggcuagucugggcuacagagcaaaacccugucucaaaauaucaaaaacaaacaaacaaacaaacaaacaaacuggagacuggauucaaaugaucagauugucagaaucaaacccacuuccaggaagcuuuacacggggggaagcacaagcagcuguacagugagagacauucuguucuucacuugggacuucacuugcgcagcacccaucugagagcugcucuggauacuuucauaccaugcccuauuuuuaccauaaaacccagggacagaaccaccagcuguggaagccagaacaucuggaaucaaguuucaaagaaacuccuuagcugggauuuacccaggauuuuggauaguucaagagugaugugaaugggaagguagagacagagggagauguauaguucccucuucugcuccaagcuuuucuacaaaaccuuuauucuaguuuuauugaugacuucuaaguccuguuaucuuccugucuuagaacacaauaaaacccccaagacacaggcuguaaaaaaaaaaaaaau

SEQ ID NO: 7559 - RNA, 1878 nt, Mus musculus
uauuugugugugcauaugucauggcacauguguggagguuugagacagaaccacagaauugguucucucucuuucuaccauguagagaagucccaggaauuaaauuuaggcuugagacuaggcaacagguccuuuacccacugaagcacagcacugcccugacccuaaguguuaaauuuuaaugagaaccuagaagcaaucuuaaagaguuguuuccaaaaguauuaugucagcuggguguggugguacaugccucuaaugccagcacuuugaggcaaagugaggaugaucaggaguucaaggccaguuucuucuacauaacaaguucaaagcaagucugagcuacaugaaauucuguuucaaaagacaaagaagaaaaaaaaaaagaaguacuucuuauucucaucagaggggcagcaaaucccaacaccaucauagagccaccacccuauggaggcuaccugccuuuaaccgugcuauaggcagcaaagggccaaccaaagacuuaguucaggaaccuauuaugguuaugagggcccaaggaugcaaauacaugucuauacaaaacaauucccaccugccacaaucacuuugcaaucuaugagcucaugaggcacauuaaaguaaaacacaauaccauuguacaccuacaaggcaaagucacaagggcugaaccuacaaggcaaagucacaagggcucaaagcccaacccacaagguuggccugauccuuucuucuucccagaagagggagggacauuuccguuggaccaauuuucucacauuuguuuaguauuguagguguugaccaaaacacauacgauuugcacauuucuuuauucuuucaaccacaacuuacugcauccaucauguucaaggaacuauuuuaugugcuaaaauauaguucaugccuaagacucaccuguacucuguggucauagacuaucagugggaucucagauaagaaaugaaaggaugacaaaugcuguggagagaagggaaacagugaagaggagcaaaaagcaccagaggggugaguuuuagauuuaccuggaccugacucuguagcacaggcuagccucaaacucauacccgcuggcuauaguauccuaagugcuggcaacaagcggagcacauugcacccgaguuagcuaauuuauguagaguggccagggaaucucagagaacugaaggauuucagaaguaagaccuagaaacaucuggauaaaguugagucuagaccugagggaaaggacauggggugggggaagggugcagcuugcccacugugacagggcagcaaggucuguguggcugggaaaaguugcagaaaucacagaaggguccuaugcuuuauagagcauaaacaacacauauuggcuuaauaaaagcuugcugaucacacaugucucuuacuggacuuaucugauacucaauaaagucuuuacaaucacucuaauuuaaaagcaaaaggggaagggaaagggacuagagagauggcucagauuaagagcacauauucuugcagcagaccugguuuggguucccaguauccaugugguagcucccaaccauccauaacugaaguuccagaaaaucugaugcccuuuuuugaccuccagacacuaggcaugcacuuaguacacacacauacauacaggaaaauuacucagaacacucaaaucuuuuuauaaaaaaauaaaagcaaacuaggaaacugguucaguggguaaaaguccuuggcugcacuugauaacuugaaccccacauucaaagcagcagcagaaacaagagauccuguaucaacagggcauaaaguugagagcugacuccuaaaaauugucuucugaccuccacaucuacguacccccaacucaug

SEQ ID NO: 7560 - RNA, 1878 nt, Mus musculus
caugaguuggggguacguagauguggaggucagaagacaauuuuuaggagucagcucucaacuuuaugcccuguugauacaggaucucuuguuucugcugcugcuuugaaugugggguucaaguuaucaagugcagccaaggacuuuuacccacugaaccaguuuccuaguuugcuuuuauuuuuuuauaaaaagauuugaguguucugaguaauuuuccuguauguauguguguguacuaagugcaugccuagugucuggaggucaaaaaagggcaucagauuuucuggaacuucaguuauggaugguugggagcuaccacauggauacugggaacccaaaccaggucugcugcaagaauaugugcucuuaaucugagccaucucucuagucccuuucccuuccccuuuugcuuuuaaauuagagugauuguaaagacuuuauugaguaucagauaaguccaguaagagacaugugugaucagcaagcuuuuauuaagccaauauguguuguuuaugcucuauaaagcauaggacccuucugugauuucugcaacuuuucccagccacacagaccuugcugcccugucacagugggcaagcugcacccuucccccaccccauguccuuucccucaggucuagacucaacuuuauccagauguuucuaggucuuacuucugaaauccuucaguucucugagauucccuggccacucuacauaaauuagcuaacucgggugcaaugugcuccgcuuguugccagcacuuaggauacuauagccagcggguaugaguuugaggcuagccugugcuacagagucagguccagguaaaucuaaaacucaccccucuggugcuuuuugcuccucuucacuguuucccuucucuccacagcauuugucauccuuucauuucuuaucugagaucccacugauagucuaugaccacagaguacaggugagucuuaggcaugaacuauauuuuagcacauaaaauaguuccuugaacaugauggaugcaguaaguugugguugaaagaauaaagaaaugugcaaaucguauguguuuuggucaacaccuacaauacuaaacaaaugugagaaaauugguccaacggaaaugucccucccucuucugggaagaagaaaggaucaggccaaccuuguggguugggcuuugagcccuugugacuuugccuuguagguucagcccuugugacuuugccuuguagguguacaaugguauuguguuuuacuuuaaugugccucaugagcucauagauugcaaagugauuguggcaggugggaauuguuuuguauagacauguauuugcauccuugggcccucauaaccauaauagguuccugaacuaagucuuugguuggcccuuugcugccuauagcacgguuaaaggcagguagccuccauagggugguggcucuaugaugguguugggauuugcugccccucugaugagaauaagaaguacuucuuuuuuuuuuucuucuuugucuuuugaaacagaauuucauguagcucagacuugcuuugaacuuguuauguagaagaaacuggccuugaacuccugaucauccucacuuugccucaaagugcuggcauuagaggcauguaccaccacacccagcugacauaauacuuuuggaaacaacucuuuaagauugcuucuagguucucauuaaaauuuaacacuuagggucagggcagugcugugcuucaguggguaaaggaccuguugccuagucucaagccuaaauuuaauuccugggacuucucuacaugguagaaagagagagaaccaauucugugguucugucucaaaccuccacacaugugccaugacauaugcacacacaaaua

SEQ ID NO: 7561 - RNA, 46611 nt, Mus musculus
uggagaguuggggcgcuuugccacguccuuucuaagagugauggagguuugguccuaccccagguaauggggaacagagcaaaaggcagggacagaggacgggaccugggugccauacacggguguuaggcgcccuccagcgguguguccacaaggaaggacagcgacagagacaggcagggagacagcuagacagagagacagugagaagcgagagagccgagaucuaagacagacagacucuggagucucugggagagaacgaucgaucgcugauccagugucuaagaggaaggaacggaccugacagcgugucccgugcccggaggcacuccgccugguacaggacagcggccuguagggggccccucgcggagcggugccuccgggcaucccuggcccgcgcccccuccccggccccugccccagucccaggcagcggauuccccuccggggcgggcggugcuacucucguccuccccgcccggcuggcgugcuucccggcccggccgagcacggucccggccccgaggggggcugagcugggcgaaaacccgcccuccagcgagcucauuucccuaaaagggggggugggguggggagugggagggcggcgagaaaagaaagggagcgaccgagaggagggcgaggggacgccggagcccagggccggagagagccgggccgagcggggggcgggagacaggaaacgggacgggaagagguggccucggggggagagcgccuccccuucgccuucagcgcucccuuccccgucgccccgcucccgcguccgggcgcgaccgccaccgccaccgccgcccgccagcaugcccggcguggcccgcccgccgcugccgcugcugucgcugccgcugcuacugcugcugcugcugcucccgcgcgccggccggccgcuggacuuggccgacuacaccuacgaccugggcgaggaggacgccccggagcuccucaacuacaaagacccuugcaaggcgggugagcgacccccggcucccccagggcgcacggaagccgggcgugggcaggcugggaucgaggcucccggccgggcagggguugggguugggguuguaguugggguugggggaggacaguccagugugggaagcugggagcugcuugguuggcaaugcagugggggaacaaaagaccgagggagaaagggagggggaaguuugggggacuuuuaggacugaaguuuugcugcuguuuguggaaacugcugcggcugccguucgccuucacagaggaauccuggggaaaccucccucggucccagcgaaucccgcuggcaaggaggcuuuuucuccaccgggaaacuuuacuggccaaacuguguguguguguguguguguguguguguguguguguguguccguccguccguccguccgugucccuucuccccuaucccuccugcuuuguggaauacugguguuugccugcuugucuguuugccauagugccgcacagcacaucugucugguuugaugcccagaaagaaggccugcagcuccaaagggauagauuuucccggcuucucagcccaguggaaggagaaaguuuuucaggagguucuauggaauacuucuucauaggcaauccuaugaaucuagccagcagcaggagcucucugaacacucaagagacagcugucaaagucagagaaauuggcggcaggggugggggcuuggggggcacagggggacuuaccugugccuuugugugccaggagagcuuugccagagcucaguuagguuagcaaaugagucucacaaagaggucucagauauucuacaucagcucucucgcccuacagacaccugaggcuaauuagucaagucagggcuucuagugugugugugugugugugugugugugugugugugugugugugugugugugaucuuuguucaugaggacucuccugcugugauucccuuggagugaccagaugaccagacacacucaggccauuggccuaauugauguucccaagcaggcugucuggaauacacuggggacaaguuaucacaacuuuuccucgacuucccgcuucugacuucagccugucugcgaagagcuagagccagggauugggacacaagaaauggacacaaaguuuugggacaggcagcuacaaucuugagcacagaggaccuaaucagggacucuccuugcuccauccacccuuagguaggauagggaccauuuuacaggacaggacaaaccaaacccuucagucuuuccucuuccaugccugguaugcuguaggcaaaccaggacaguaaaagucuccaucacaucgugcgugguaggagggcaggaggaagaaugagcaaggcaugaaaucugaaggacucauuagccaccaggaaggcugagcacagucucugaacuuaaguuccucauuagagaacuagcugguggguaagggcuaaaucugagaacauauauaauucacuuauuauuaacacacagcagacacuauauaaauguucauuuccugugcucugugccuccagcucuugaucaaugucuuugagaggguguggauuuggauuuuagaaaaagcuaacaucucucugacccuguacggugucucauauccauucagugauguucguuucuugauaugucucagggcuggguuugauguugugggaggugcagagaguugccagacagaucucgguccuuaaagagaucacguucuaagcaaguguccaagagcacacuaauguuacacagcauaauucaggaagauuagggucccucaucaucucuucguuccuggugauggggagggcagagcaaagugguuugaaggugugugggaagguuuguagaguggagauuuuuuguggaggcaccaggacaggagcacagccucaaagaauggauaggaagcuaugcucauguugagaaugggagugauuuuugggaauagcaauaggcucagggcuccaucccuagucucagauuucaugcuaggguggggcuggcugaguuggaacuucaagcaagggcucuggagaaaguucucuaccagggugaugugaggcugguggggagcucggccaggccugagguggcugagagguccuagagccugccagggccuagcuucagggucagaucaggccuucuucuugggugugacugaugcuaggcccuguggaucaucccugcaggaaacuggacugguauacauauacaucugccgagcccugucuccugccccccuccagcuacaggcccaccaaaucuuucuuugugcugcugcuuccugcuagguuugcuucuuggacccauccauagccuugaccccagaugcuaggggugcuuguggcgggugucugccuuagccuccuuuggaagggacugauacaccgucuucuuucucuuccuccuccucccuccuccuccuuccuucuccucccuccucccuccuccucugccucuucuacauccuccugcuuccucuucccacacagagaacuagcacugaaaacucuuugauucucccagcucaaacgggaccuugcaguuuauucuaaacauagcugggcaucaacguagucugaaaugauugcuuuaguuacugucugcauuagacuuauuuauuuacuuuuguagauggggucucaccaaauuguccuugaacccaucauccucugcccauagccucccacaugcgaagauuauuauaggggugagccaccacauccacuuauggcugcuguuaaaguaaggacaaaauuuaagacccuugauguucuggggaaaguccugaacuucugggcuagaagccaaccuggggaaugggugugcuuaaggcugauucuuccaagucugcgcucagguuauuuacuggaaacucugguuucuuacguugaaggccaagccauggaagaggauuuuggagauucccagccuagugucuugccacugacacaucuggcuuuuacuuagaccucaggcaacagccaguuuguugucugcaggagagguggacuguauuuacaggucccucuugccucccucacuccugggacuuuguggcccagguauggaauccagaggaagcacaugaucuuaucucucaccagaccacauucccucuuccagacauccugagugagucacuccgcucaacuaagacccugcucccugccugagucacccucacuuuuagaugcccuaagggucgaggaaaacaucucuaugggcccuaauggagagggacgggugagaugccucaggaugagaggacucuucuuuuguuuugagacuugaccucacuguguagcuguggcuggccuggaacucacagagaucuuccugucucugccucucuugagugcugggauuaaagcgugccccaccacugcuggcagaagaagggacucaugaauucuguuucuccagugauuuggggaaaaacucuaguguugguggcggggagcaggccaccuccugaagagguauaugggguuuaguggcucuuucuuccuccugacacaugugcacgccucuguccauuccaagcagccccuuuccuuugaggaaaugcuuuugcuuucuuuuucuuauugguaagaacacacuggaacucgcacagggaauugguuguauauauuggugugugagucuuugcuucauagcaggucuguucaccuguguguguugggcccuugugcgagcacaggcacagaugugcgcugguguguaaguggaugagggaaugagucuauuuguauagucugggccuguaaguacuuccucccuuggcuacaagucugcauucauugagggaaaugcaugccuguccugcauacaagcccuuggagcuccaucacaccaaccaggcuucacucaggaggugagaccuggccaugccaaggggaggggacuuuggaguccagaagcugaccugggguacaaagauugcuugcuuucuagguccacaugcauauugauaugugugucucucugaucuuuccccuccagcacugggccuggcuacagagccucaagugcuuccugccugguuuauagccagacaacaaaacaaaaacuugugauacuguguugaaaacaguugcuucuuugacccugaccuugaccccggggcuuccuuugggccaggaaagcauccugaacucucuugcaucuggauuguccggcuuccuaagguuaggaucccagauuggacuagcugucagcccaacuccuggccauaaacuccccucccaccccacccugcccccauucuguucccaugcauucuucagccgugacaucucuaccacagggcauccagcugagcucuguagccaacccugcuccuucuacuugcccugcccuggucccacacugccuggacucauaggccaacaugguucuguaguguguccauagauucguucagauggggagugagugcaagagacccagcaugucuagggaagguuuggagcugacuuugagucuccaggauugguguggcaagcacagugaacuggauguuucgcuguugcuuucugugcucuaggcuugggugcuagacgcuucauagacauguccuuauuccguaaaguaaucucaggagaugcauuauaucauguguuuucuuuggaugggauaaaacagagguuucagaaaguuuacaugaaugucagcuagugggagccaaacuagauucaaagacuaguuucaccuucuaaagacuccgcucuuugcuuaucuuccagcaugggcucgacugccuucuguaaggugcaaaguuggucuggacagaaucucuacagacuuugucauuauugccuaagaaaugcaguguaauagcuacuuggcauuuacauuguauuaagcauuauacgucaucuagaaaugaucuaaaguauagaggaggggugaagauauuugguagcaugcuuaccuagcaugcacaaacuuugaguucgaacaaguauggugugguucauaucuguagaucuagcauuugggaaauagaggcaggaggaucagaauuuccagaucaucuuuggcuauauugggaguuugaagucagaaugggccacauaagacccugucucaaaaaagaaaaagaagaaaaagggagagaauauaggagggacauggguagggucuaugcaaacacaaugcuacuuuauauauggacccgaguaugucaagauucuaugcagucuguagggguccuggaaucgacauuuagggagacugaggaacagcugugccuggugaugcccaugggugugugagcaaaagccuggacguaccacguacaagcaaaaguacaaaguauacagcugugugaggugguccugggauacugucacauaggaguccuccagaccccuuugugcacgccacugagaaucuucuugugucucugugacaucaguuacaaagccugggucauggagggugucaucuuaagagaagccuucccaaacacaacuaguuaccagcuggugaccuuggacuuacaccucccucucuggccccaggguccugaucucugaagucaaggaagggggcuggcaucgagcuucaauguuaucucuccagaugucugaaguaggacacuccuaggggugccuuguggcuuacugagcaguugugggcgggccaggauuaaauggacucauuaaugagugaacacuuugugaacuggaagacgcuggguaaauuucaacagacauuuacacaaggugucauuauugcuacuauuacuggcuuaaugaguucagagcuugccacuggcuuguguguguuggagcuuguauguuuuuuaagaacucuguguguauuguguaugugugugugucuauuuuuguauauacauauuuacaauguggguuccggagagguaauggacuuggguaaauccaccgggcuaggaaugaugaagcccgaauauaaaucaauccuuccagagacuuaguauaguuuaacuuaagccaguuuccuuuugggccucaguuuccuagauuguuaaaugagagauuagcuugaugcugcugaggucacugcuacauccaguuggucugugucuaagugagugugugucucugcacauguauuugcagaccagaggaaagcuggcaugauauuccauucauucauucauucauucauucauuccgauauguucuuucuaucccgaauccaaugcugaaugcugcucacauaugcagaggcggagucucugaccucaguggcucugcacagacagcauaagauuggaugucaccauaugcccaucgggacauuacccaucugugucugacuaagugugugauaaaguaaauguauacguauccacccaguggggccaaccggggaggaggaacccguguguaaggccucaagguuaaaacaauuuguguaaugcugacucugcggggaugagaagcagaugucaccacggcugcagggaagccgccgcuguguuuccaccuccagcuuggccuccugccucccugggcccagcccagcccagugugaagcuuacaucugggcuccuuccaaagcaggcagugcugugucucugcuuccucuuacccuagaugucucagaaagaggagaggcuguucaacccaucucuccugaagcuucucuucccaggcucagaaguggaaaugaccuccuggggauggggguagugguggaguuguccuaccccuaggccuuuccucucuagagggaggacccagaaguguaggguuuggcuggcaacuguugcaccuuucccuguuagcuaggaacuucuugguguuaagucuuggccuccuagauuuaccuaacccaugccaaaucuuauugggucaggcaagcauauuagacaaauuacaauagucuauauccucccugauaugguuaaaauggcaucuacuauguaaugcuacaugcuuagcacaggcucaaaacagacggcuggucagucaacuuucugacacuguaacaaaacaccggagaggaccgacugacacuggagagaacugacugacaccggagaggacagacugacuuagagaauagguuuauuuuggcucacaguucccaaguuuccaguccaagauaguggagaauaugguucuggagccucuuauaggcagcaggucauggugggagccuuuggcagagcaaaaugggaugaggaaaggauaaggucucacaauccccuuuaagggcaggcauacacacacacacacacacacacacacacgcacacgcacacgcacacgcacacgcacgcgcacgcgcacgcgcacgcgcacgcacacacacacgcacuuacacguacacacauauacacagagugacauaaguaccuauaagggugcacagauucucccaguagcaccaccuucaggaccaaaccuuuuaacacaugugcuuucagacaguacagucucuuugcuucaaagugucucacagucagagcacuugucucucuguagaauucucugagucauuacuuguaugaacuuuguauuguaaagauuagcaccaacagggcuaggggccucuucugcguugcuagucuuugacuuaaugaccagcccauaauagguacuaauuagcauuuguugaagcugggaaaggugacacaauugugucuucuuggaacuauuuauuaacauuuuuauuuacuccuuucucuccucccaccaugaguuuguguguguguguguguguguguguguguguguguguguguguagaucagaggacagcuugcaggaguugguucucuccuuccuuaggucaucagguuuggggguaagcacuuuugcucacugagccaucccacuguuuaagcgauaggguagguuuuguucuauuacucaggcuagccuccaaacucuggacccaaguggucccucugcuucaguugccugaauagcucuggcuaucagcgagugucauaacccuucacuauuguugggauuugaaguaaaaggcaaguguaaucuauaaagagauucuagaagcuguucugucuuucucaugugauauuggagaaucagaauggcuauagggucagggcuauaaguacaaugagugcagcccaggguaagaggauuaacucagccuccggcuucuuuuuucuccagcugccuuccuuggggacauugcccuggaugaggaggacuugagggccuuccaggugcagcaggcugcaguucucagacagcaaacagcccgaaggccauccaucaaagcugcagguaugcucggcuaggcuggcgcucugugucccagaaauguuuuagauuugggaaacaagaacugcccccccuuuccagucagguccucccagaacagaggcuaugaacuugaacccaacacaggggcuugccuuccuuugggauauauuuauccuccucccagaagagaaauaaauauugacacccaugggagcccaaaagcaguauuuuucugacauauagcucacaaaguacuuuuaaaaguauuauccaacuugauuaucuccacgcaccucuaagagugucauaguuaguguuuccauugcugugauaaaacacugugaggaaaagcaacuuagggaggaaagggcuuacaucaucguacaccucucagguuauacucuaucacugagagaagguagagcaggaacucaaggcagaaaucugagacaagaguagaagcagaggccauggaggagugcugcuuacugucuugcuccuccugacuugcucaguuugcuuucuuacacacccaagaccacuugcccagggguggcaccccccacaguaagugggcccucccacaaaagucauuaaucaagacaauaccugauagacuuaccucuaaggccaaucuuauugggacauuuucucaagagguccucuucccagauagaugacccuagcuuguaucaaauugacaaaaacuccaaccaggacaagugauaaaugucaggacuccccauguuuuucagaagcugagacaaagccucacaaagcuaaagugauuugccccguaucacacacaguguguaggugacagggcugaaacuaacacccaaaccuuuguuucccgauccaugaugcuauagccaauggucuccuggucucagcgugcaagcuucuauguguucucuggagccguucuccugagcuucuucaggaucccaaacugucuccaagacuuaacgcuucaccuuuaacugcgguguucuuuuguccuauguguacaguugguaucuuuccaugccacauagaaaggacuuauguacaugucccaaagcugggcucaaagcucuuuguucccugguggcucaagcaccaaccacccuguguggcacuggugauggggaaagaggucgacugaauuggcuucucccaaccuucauacugcugugcugaggggcagucuaucaucaggauagcacuagaucaugguucagaaagcccauauggggcucucccauugcucaagcaaggguuuccuauugagguucaguucugggcagagguaggugugccaggccaccuuccuuguccagcaggagggaugguccugguguaaacaauuuagggauuuuaagcuaacuacccaggagggcagguggcaucaaaggguacucugguaucuuauugacuaaagaaguuugguggagauuaaugaagauagcacagggggaaguuuuaccagggccuagggccagaccaccaggugaucugggggaaaccuuuguccuaagucuccucuacauccaggaacagacaguggcacuugcccaauuccauggagcuucagugucaugugggaauucaggcucagaaucccugagaaagcacauagcuuuuauccaaacuucagcucccuuggguccccacaguuccugggaaaugagugccucauugucuuaguuuggaguccucgcccauuccugcucccuggggcaucuccagacacuuagaacacagccucacagcucuuacagaacuuuauaguuauuuuacacagauaccacgaagagugaauuagcagauaccgagucauugcuccuaggagaaacguaagcuuccaccagacuuuggucacauuuuuuuuuuuuuuuuuuuugguaaacugaucauuauaugaccacauuuauguguguuucacuuaaagacaccuuauuuaauauaaaguuaguucauuaauacugaacucacagcuagcagcauugacuucagcccaagcaaauauauugaauguguguguuucuugggaagguuuaucccagcuuuuguguuauguuuuuguauguguguguguuaauggagauugaaccuggggccucaugcauuccaggcaagcauuuaccacugaggugcauacccagcuccauuuuuacguucuuguuuugagauaggggcucucuaaguugcccaggauggcuuuaaacucagugugaacauaggcuggccuugaacucauaacccuccugucucaccguuucaggagcuggaugacagguuugcaucaccaugagcccagcuuugggaacacaagacagcgcaugagcacuuugcuuaggaaccauuuuaaauaaccaaaauuuuuaaaaaauuuuuuuacaaagugguucucaguucaccuaaaagaaacaggcagacagaacaccuuguucgaccuuggcugggcuguguacacauugauuggaucauccaacuuuuuuuuuuuuuuuuuucugcccuguacuugucgauggauguucacgaaagccugaccguaucgauuugagacuagcaaguaaauuuuuagcaaaguaggcagauuugcgaauccagaaucuacaaauaaugggucgcauuauccugugucuccuccucccccuggcuacucacuagcugccgcugacucuguccucauuccauuccaggaaacucuucugcccuggguggucagggcacuaguggacagccgcagagggaaagcaggggcagauggagaggcaggccucggagcaggcgggcagcgacguccagaccggagcggguguggcccgauggggucaucccguuugugauuggagggaauuucaccggugagugugcugcugugagccuauaccuggccuuggccuuguugccuuuggcuggugcgcagccuccuggccaggcagugugccugcggacuggcuguaacacuguaucagugggugaaagugcccccaacucccacucacuugacagugcgacagcccagcuuauccuuccacaggcagccagagggcagucuuccggcaggccaugagacacugggagaagcauaccugugucaccuucuuggagcgcacagaugaggacagcuauauuguauucaccuaccgacccugcgggugagcagggaccccugggcucugauccccuugguggugauccccagccagguucugcccuaggcauucuugcugccccuaagcugggccugccucuccccucucccugcuaugggcaucugccauugauauggcucagacccuggcaaaaagccugcgcauugggugcccagggccauccgcaccccugcgcaaccccccagcagccuggcccagccccugaguggaugcacucccccagcucgggaccaccccccugagcuggccccgcccuccaggugcugcuccuacgugggucgccgaggugggggcccccaggccaucuccaucggcaagaacugugacaaguuuggcaucgugguccaugagcugggccaugucauuggcuucuggcacgagcacacgcggcccgaccgggaccgccaugucucuauuguacgcgagaacauacagccagguacacacaucccagggacuggaucccauccuagggcuucuagagcugcuuaggggucuaacacuggucauggacaugggggucagguugaguagccagaaaccagcucuucuggugugaaggcuggacuacagucagcuugucccuggauauccccacaggcuuaccuguuccccaucucccacccuuugcuaguucuguuuuucuucauggcccugugagucucuguccuuccuccuuauuuguggucuccugauccucccuucagcaaguucuccaggcuuuucugcugggaaggacuccucuauagacgucccuguccccuuccccccucuacuccccuuucaccuucagagaggcagcccccuuccagguacagguacugaaggacacaggcuacucccucgaccccacccccacuuuucucacggucuuuguagggcaggaguauaacuucuugaagauggagguucaagaaguggaguccuugggagagaccuaugacuuugacaguaucaugcacuaugcccggaacacauucuccaggugagaaaugguccaguccuucuggaagccauuuuccugcagacuuccucuuuuugguguccugcccugcuccagcagacgacaaagacaaggauagucuucuggaugccugcagcuccuagacaaagggcuaguggcugugucugccuuaguagucucugccauuagugaggggcuggcaggcuagcccauugcuguguugaagcaaagauuuguggccuagaagacuaaacaccugaguucuccgguccugcuguguggggucuccaaagugugccaacccaaaggagccaggcuugucccacaucugccaccacggcaguuuauuuuucugguggugcccagaggggaucaccuccuucuaguuaucugcccucucugccuuguuuuguuuuacaguacuaagaauugaaccuaaggccuuaugauaccaggcaaaugcuguuccucugucuuaugugcccaguucuauuaauuuuaauuuuuuaaauuuuauuuuaugugcauuaguguuuuaccugcaugugugucugucagauuuccuggaacuagaauuacagacaguugugagcugcuacgugggugcugggaauugaaccuggguccccuggaagagcagucagugcucuuaacugcugagccaucucuccagcccccuaauuuuuauuuuuuaaagaggguugcaccaaguuacccagacugaccuugaguucacuauguaacccuggcaggauuugaacauaaaauuauuucuuucucucuuacacauauauauauuuuuauauguaugugcacauuacaugccacguggcaccuguggcagucagaggacaaaugcaggagccguuucgcuccuuccacaauguggguucuggagaucaaacuccauuuauuggccuugguggcaagugucuuggccacugagcugccccgccaaccugcagaccuugaacgcuugauugucuugcuucagcagaggucauagagcaggaccggcuuggucuauuuugugacuggcuacuuugcacaaagcuugacuuuugcccuggacugguccccauagccaguucacaggauaucuucuuaaccagggcuugauaggagaagaccccuccugcaggacuaggaggaauguucccaccucuccucacaccccuuccuggacuggcuuuccugcacccauguccccaucugggugguggcuuuccucccuuccuucuaugcuccuccugacccuuucuuccagcucaggaccugggaauggagagggagacaggggaggggagaggggguuggugcugguggugaugagcucauucagccccccacccccacagacccuccuucuauuucccaucaugcucacaccccccugcuggguccuucccagcuggauaugagucagggacccuggggaggggagaacugcugucucucuuuguucugcuccucccaaauggaaagacagagauuagcaggaaggaguugagaaagagggacacugugcccugugagcuggcuagccacuguggaagcugccgcuaguuacccuuuggccuuacuccaaucgcagccaugucgagaggguaaugaguugacccugggaagucaagagaggagucuauugggacugaauuugaggucuggagguggaagcuggcugguauugcagagaugacaaaugagggcccaaagcuuucccagggcugcgguuugaagccagucugagcauaaggcccugggucccugaucuuucaaagcauuucugcccccucccccccagccccugugguauagcugccacggaacaggguggcugcuggucagugggcagcuuaaugacagggugagacaucuccgcccuucccugacccuguugaggaaugucuggguccuggcagagcaaugcccuguggcuguagaugaacacgccacccuccuucuucacccaccucccggcagacucacguccucagucuccucauguccuucuuaggggcaucuucuuggacaccauuguucccaaguaugaggugaauggggugaagccuuccauuggccaaaggacccgacucagcaagggggacaucgcucaggcccggaagcucuacaaaugcccagguuggcgcagggaagggacagaccagaagggauggaagguaggguccaaggaagacagaggucagggcccaggaaccccuagaacgugacugcuauaagucuccgggauggguguugggaaggagggauaauagagaaacacaguauucugguuaaggaucaaccugagcuaggcugguagaugcuaggaagagccuagaaaaaugaggaggcagaaaggaggcagaaagaggagcaacuagccucuccccuggacagugaggaggaggugaggcccaccaaacgaguuugaccucaacucuggaauccauguuuccuugacaacagggcaucugguuacccugguagcacuagaccagggaaguaggaugguuuaugcuuauguguaaggaggagggguacaucuuaaagggacagaacaccuuucuucagccacucuugucucccuuaaggguuccgacaaggcucaggggugagcuggggaucuggcaccugcagucagcagcuuaguuacuauuuuuuuccccuugacagccuguggcgagacccuccaagacagcacuggcaacuucuccuccccugaguaucccaauggcuacucugcccacaugcacuguguauggcgcaucucugucacaccuggggagaagguaacugugauugaucaccugucugagucuauuaagaccccagcaaugggguagcaucacccuccagggggcccagcccugggacuucuggcagaagggugaccuaccucaucaccugcauuaaguauguaaugaggaggguugcucugccucccuccuccucacugagcuguacauuagugcuaauccaaagauagaguugcuauguacgguuaccauguaguucuguugugauugucuagcucuucuugggugcuuuuuaaagugcuugucacauggcuccucuuuuuauuuuuauggccacccugggucuucguuucacagaggaagaaacugaguuacaggaagauuaauuagguaauuuguccaggucauacaguuaaccagggcagaguaggauguaaagccuuccucgggcuggguucaagcccagccuauucugggaugccuuggguagacuugggugaaccagucagcccuaguccuuggcucucucuucuguauagucagagcuugagucagggauucccaaagggcccuucucaauucucaaaagcugugguccugagaacagcugagaacaaagcaaaugcuuccagcaagaugcuuucuggucauggcuagccuuccucccccucuuuuuccuugcuguucugggaccuucagguccuugcuugucugcuacccauucaggugagcagaguacacaccaaaugcaugaagggcccauaacucauggaguucaaccucccacugcaugauugacuagccuuguuugaauaccugagcuuaugaggucuugggaccccucuuacuuuucuauucuguucucucuccaacucucaaugcuacagaguuucagagaaaggggggagugucuaucccugaaaacccucagagcuucucaagaguaguuccuuguaacucaccuccugguuagucaccuucucaaaguaggaaggcccuucuccuucuuucuuuuuuaauuuuuauuauuuguauggggaggagcagaagguauaugcaugugacuguagaugcccaaggaggguggagacaucagcuccuccuggagcugaaguuacaggcaguugugaacugucugauaagggcacucggaaccaaacuuccauccucuguaagagcagaaacagcucuccagcccuucccaugacuucuuagguccaggcauggccuuugucacaugaagucuagauuucucagcccaccuuggaucuucuguguccuucacuuuuuuauuguucccaagagcgagcugcuacauucuuucccauaauuggaaugugacguuuaauuugguguuacauuguuuucauggagccuugcaacaccuccugcaaagaggguuuagaaccagagaguuccacuguccagcaaguccuacuagccucucaccuccuccauugccuguuggauaagugugucaccugugaugcuguccugagcuuuaaucagaaucuugagcaggacacaagccaaaguaaguuucaaacucccauugacccacuaaguugcagguuuucgagacuuagcaauggucuuugaugacauuaucccuagucacaggcugccaccuguugcacuccucugacgccucugaugucuucuuccccuagcauaggaaccucuccagcagugaugaauacagagcuggaaugcauuaccaaaucacacucacugucccaacaguccagaaaaagucccuaucaaaaggagaggaaauguacucgccaaugagccuuguuucaguagaccacacuccaccccucgaacacacaucccccagugguucuuuccuaaguagccaaaggcuaucuuuuuaguuggggauugauguucaacuccaugguuagcaguucccagaaucucguagcugccuuuccacaugcacacgcacgcgagcacacacauucaugcuucaaagcugagaaagcguuugcugugagcuguugagauuacacgugcugaucacaucugcaaguuauuugacuguccucugacgucaucugugaggcccagagacgaacgucaacuuagagaggagcuccuugcucucccucugucugggcgguggcuuuccagacggugcaugcauggcuuuuguuuucguagcuuaaggaucaugcuuucugugacggacucuuuacuaagaauuugguaauucugcuaucccuccuuuagcuggcauccugcugucuucccucaaaagccaucucaucccuuguucuucuuauucccaaacugcaagucuuucugcuauuuuuuuuccuggucuuucgagacaggguuucucuguauagcccuggcuguccuggaacucuguagaccaggcuggccucgaacucagaaauccgccugccucugccucccgagugcugggauuaaaggcaugcaccaccaugcccggucuuucugcuauuuugaaugggcugagcccucacugccuucccaagggucuccacuacuccaggcuuuggaaaucucauucauaaguauaaauaauaauagugaugaugaugaugauaauaauaauagcuuauaguuauugagcuuaugagucaaacaugaguucagggaucucuguguguuauguucuuguucuugauucuugggaaucaagcccaggguuaguuaggcaaaggcuuuacugagcuguaauucgcagcccacgccgcgccuuugaauuagcacggcuacaucauagucuugguacugacauggucccuguucugcuuaugagaaaaugaacuuacaaaagucaguccccagcccaaggucacguggaagcugcaucuggacacacuggucugugauuauaaaacugugguguucugaggcccugaugcagcauuucaauaguuguucuggugcucuucagcaaaccuacgaaguguaauccuagugcuuaguacagggccaaggaccagagaugugcagauucacagaaaagcccgguccuugaggaacaucgaagguugcacauggcuuccuuuccuggucaggaacaugcaugacccagccaucacaugaggccacguagccuagaucagcuuucuuuucaguaguuucugacugcaugggccagugagcucucaugucucuaaauggucacagggcccugguucaggagccucccuggccuguaagcccuccaugauucccagaagaccuucauccccuuucgggacccugcucagagcuccagggaaagaagaggauucaagauaaaaauuauaaacacaccagugcaugguuguagaaauguaucaauaaaaaaaaaaaaagaaaucuaucauuuuuuuaaaaaagugaauccagguaucacccugacacaggcuuuuagucucagcacugguaagcagaaccagauggaucuuuacauaguaaguuucagaacugucauuguaaaaccuugucugaaaaaaaaaauccaagauggcaccccggggccaugagccuugaaaggaccccuagaggcuggcacuuucagaaugaggucuacuuucuauuauucuuguucugucucucacuugaaaauuggaaccuugggcccuggauuuguuguuagaacgacuaugugccaagcaaugaaucaggcccaugacacacacagucucuucaagcuuauagucaucuuuaagcuugucauugcaguguagaccagggaagggaggcucacagagcuuacauauaaaucugaccaggcuugcccagggaaaugccugauuugucugcaguaaagccaccuccccaagcgauuggacuuugacaucaaaucuggcagagagaaaguuguuuuccacucacucucuagugcuuaccuuagggccagaagugcggaugauaggcccaucuuggcaugucaccuucgagaaagaggcccuuauggugaaccaugaguuugucaacacucauguaauuagcaguugaccuugggacuugccaguacuucccagaccaugaaacacccugugccuuuguuuuccuaccuggaaaacgggcucaguaauuuguggauuuauaugaggauggaagagacucauauccagaaagagcuugugcaguacauaauaugcaaagguuggcuacaguuguccucucuguauccccaguggguagauggguaagcgccagucaguuuccagauguccuacugucucucccuacuuccaggauucugaucugaaccacugcguguccagguguccuaaagcuuagagugguggcagaggacugggcucccauggagggcuagcaauaugcaacucagugacaggguguuugcccagcaugcacaaggcacaggauucccuguccagugccacaaagacuuaaguaaauuucuaaaagagaaauucaugcuuacugucugccugccuugcaccagaugacacaguaagcuuuauucaucuuauuccccuuaagcccugugagacagguccuauuauccagucacagcuaggaaaaacagcaccaaggaauccagugaugagucuaagauugugggugagaccaccuugaagccggugaguugucuaaggggugaugugguuaauggccucaggaacuccuucccaagugagaaggguauaguacucuguugguucauccuugagagcaccaucaugugugagggaaccuuuucacagacagauacaccuuacauaauccccaugucucuagugcaacccuugagacucccuccaaucuguagaugaauauaggcucaaggaaguggaacuaaacuccccaaguccucagcuaggaaaugguagagcuggccagauuuucuuuggcaaagggcagugcccuugccaccagggcacagcugcguccacaugacagaagucaguacaacucuuaauuagacaugucuggucucaauauagcccaugcugugucucccuggaggaugcuacugaccaccaacacaggucucuuccucccaagucaggugaccaccgcugucugucuaaccccuugggaggucuugggugggccuucugggguucuggccaucugggcguggugacuuuggagcucauccuucauguucaucugugugagggaaaguagguguuuguucucauuccagcugcugggcggcccagggggcggccugcgugaggggcagagggugugagugugggagucagggugcugcgccucagcuucccgcaucccuuccuccaucuggcauuccgugacggauauuuuugucauuuguuagauauauaaaaauaacaugugccugauauaaaaugccugaacaguccauaaacacaauguaaaaaagagagagagagaauauucuccuccuuaaucuuuuauaucccacuucucaacagggaccaagcaugaggaaugcuuugaugugucugugugacacacauaaagccaaaagggacuucacagucacauaguggauuucugcagcuugccuugcccuuagcaguagauccuguccuugcuuugggucagcucgaauagauuugccucaucuguuuucauggcugcucauccaucaguccuugucauuucucucugugucugugucugugucugugucugugucugugucugugucugugucugugucugugucugugucugugucugucucugucucugucucugucucugucucugugucucuccauccgucccucacucacuccuuccuuccuucucugguuuuucaggacaggguuguucuguauagccuuggcugucuugaaacucuguagaucaggcuggccucaaacucacagaguucacagaagcucaccucugacuccugccugcugggaucaaaggugugggcuaccagcaccuagcucuucuucuucuucuucuucuucuucuucuucuucuucuucuucuucuucuucuucuucuucuucuucuucuucuuuguuuuguuuuuuguuuuuugagacaggguuucucuguauagcccuggcuguccuggaacucacucuguagaccaggcuagccuugaacucagagauccaccugccucugccucgcaggugcugggauuaaaggcgugugcugcuaccacugccuggugccuagcuuucuucuagugaaggauaguugauuuuaaguuuuuucaaguuuucacuauuacccaaaaugcuucaguagacauacacuuccauguuuauagauuuaggcaagccugacugaagauuccuaaaagcaaaaucauacuugagacauaguuauuaaguuccuacuaagugcuacauguggaggggggacaagugagauuucugccugucuggguuugcauuucuguguuggaggagaagcagauaaagaaugcaucagcaagucccugagaacagggggaugguggugcacucuggggaggaauccacagaggagacagugacucaugugggguuuucagagaaguccccauucauggcaggcaugucgaaacuggggcagcaucugcaggcaccaggggagagcuuccaacagugaguacaaaguuccugagacaggcuuggugucaggaccaagaugaagauggguaugguccaugugccuugagccuaguaaggaggaauggcaggagaagaggucagagguaacagagaugagauggggaaagauccuucaaagugaggacuugggaguuuauucugaguuacuaugcauauguuauguguauuaaaggacuuugagccaaggguggaucuggccaggcagacauaauaaaaccuugacucugauugcuguggcucagguagggcagagccaagaacaaggaauaagcuuaguguggaucuaggaugggaggauggucagaagguguggcuggaagagagaagaauggugggagguuguggguagaaggugaugagacuuagcucaucagugccaagggcucagugguacugucaugcacagguacgggcagguguggccguccauaccgacagaagucaaugaucugggugugaccagcuuguaguuuuuaggugagaacaguuaagugggaagaggagugugagucugggguucauaccacagagguugagugugaggaggugccggugcagacuggcaaucgccucacuuugaaggcugccaugccagcccuuggcugcuucccucuguggaagcauuuggucauuuucuucaaagggauaaugaguuggauggagggguuuauacuuucaaaacagagccagauggauggaucgccauaagccuugucuacauagggaguuccaggccaacuggaggcggguaccgaggagcugagggaaugggauaugugacaugugacacuguggcuccaugcaaagagcuagaauggauuggcagcuucacuuuuuuuuuuuuuuuugguuuuuguuuuuuugagacaggguuucucuguauagcccuggcuguccuggaacucacuuuguagaccaggcuggccucgaacucaaaaauccgccugucucugccucccgagugcugggauuaaaggcuugcaccaccaugcccggcggcagcuucacuucucaaaaaugccgauguuaguagugauagcaauaacuuuccauaauaaugaaagauaauuuugcacauauacaauucacuucaaaaauaaaguucauuccgauacauccgaaguuacuacaauugacaaaacuuacacgaauacaguaagaaacaauagugaguagagacuguggaccaaggagugggcaaggaggggugauagaaacaucuuagucuuguuuggucacggugggaacuucuggcagggugagcuaggaaagauagagugcugagaugggagcaggguccuaggaguggagacuauggaaggggugugugcucaugaaugagccuagggcauggugugcugggguauggcccagagggacacagagacuaggacagaugccauggaacgagaggccuggcaaaagggcugaguaggugaugauuaaaagcacucaguagggcuagcaaaaugacuuuacaccaagcuugucaacuugaguuugauacucggaaaccauaugauggaacaagagaacugacuccugagagcuguccucugaccuccacacgccugugcguaugcgcaccaaagaaauaaaaaaaccaacauacauccagacccagcacugacaaagcuggcucgggagagcauccaggaaccagugcuguugacggugaugcagaccuuuguuccuaaugcuugccuugggaucugucuuauucuauccccugugcucagcauuuagcuuuccacugaagcccggggggugggggaaggcaguggaguguguguggcuuugucccuucuuuuucaggaaagcccacuagcugaguauccaaccacacauaccccacaggucacaacaagccugacccuggaaccuuucagggacucugacagcacaggggccuuagggaucaaucuggauauuuccaagcaagcucauucccuuauagggaaagccucugccuuuuaaaaauccauuguccuggggcuggagagauagcucagcacuuaggagacccauguuugauucgcaguacccgcauggguuggcucacaaccaccuguaauucuaguuugagggacucaugccuucuucuggccacugcaggcaauuuacaaacacgugauacauacgcauauacucagguacacacagguacacauaaacuauacuugauuuuuauauauuaucucucuguguagucccaccugcccuagaacucaauauguagaccaggcuggccucauacucauggauauccuccugccucugucucuccaguucugagacuaaaggcaugcacuaccaugcucaguucuaaaguaaaaucuuuucuaaaaaguucuuggcagccgggcgugauggcgcacaccuuuaauuccagcacuugggaggcagagacagaugaauuucugaguucaaggucagcuuggucuauagagagaguuccaggacagucagggcuauacagagaaacccugucucgaggaaaaaaacaaaaaaacaaaaaacaccaaaagaacaaaacaaaaacaaaaacaaaacaaaacaaaacaguucuugguuauggcuauggagccuugagacuuaccaaagggcuauggccauugucaggaugauaguaggauucuuucugucuccagggaauacuguggugucaaaggcuaucaugggagcuggcugacccuagggcuuaaaaggaaauauagggcugauucaaagcaaggcccuugggcuggaguuuacauuuuuuucuguacagucaucauacuuauguacuccuguucauacacuccauaaggacagagauauauauuaaacccauuccccagagggacugugaucugacauuagucccugcagauaccaugcuccuucuaggaaucagggcccagggaauuuguaugacuggugucucaacuuuuguucuggccccuucuuucccaucucagaacccccaguacccucacacucuucugagcccuuccuggcccugcucucuucccuacggacauuauuauuaauauugacugugaggaaaccugacuggcuauuuaagccagcauaguagcucuauacuggggaggggaaugcaaggcaguggaagcccugagcccccaugguguuugguaaugggaacggcagacagguguuuucaguuagucugaugagggccauauguguacaaugcuggccguggcuggugauggccaacuuuccuuccugcuaggcaguggacaugaaccugacugaccccaggggcaggcacagagugggagccauguaaccuucucuccucacccuuuauucuuccccuagauuauucuaaacuucacauccauggaccuguaccguagccgccugugcugguaugacuauguggaggugcgggauggcuucuggagaaaggcgccccuccgagguaaagggccccucagccucuucagccgccugguucuuuguuggaacccguuggggcccaauacccuaagcagggugacauccccauaugagaucuacaaacucugauguaguuggucccagcuagucccaacacuaauuagugccgugacagugggcgaauucuguuugggaugccacaggcuuucaguucuuggugcuggcuuuaggucuacccucuggaaauguucuuucacugugaggguuggggagucaaaggaauauacaaagaugucugacaggcugcucuucacauccuguagcucuaggcucacacccucacugggauuuccuugauaacugcaggccuggagcaauggccuggcucuguuuguucaagauacuuugucacuaauuguauauguguuugcacacacacacacacacacacacacacacacacacacacguaugaaguaagugggauaaagacugcgcaaagccacagggcaaagcaaggcauaguaguguuguacuucuaacucuggggaagccagaggcagagugauccugaguuugaggauagccugggcuacauagcaagauccuaucuuaacaagaacgaaaucuaaagcaccauuggacacaaaggcagcucaguggacacaaaauucgagcaaagggaacaucugcaucaagccugaaguguugugugacgcuguucauuguucugucuguagucggaagugauugggggcuaccuacccaccucagcaucuuugucccauugucugggagaagcagccacaugcuuucggaugauuaucccucacgucugcuucugauauucuaguagaccuauuugucacccaaagcaacugaugugacaucuccucugcuguguguuaggucucugagauuacaauuuuuuuucauaacugacaccccuaggccagcacccacuuucugucccuugcuugaaacgugagaaaacacugucuuucaggaacacacaaaucaucuccaauuaguucuugacugcaaagaauuuuacagauaacgagccucaccccauguguugauucuuauugaguuugauuugaacaggauugccuucuggcccuguccaaagauucuggaguuugggcuccaaaggcauucccuggauuugguccaguggugucaugccuggaagagcaugcuaugacauuaccugcagagaaagcugccucuauuucccucucauuucuucuuugcauggaggucgcauaaagaucaguaacaaugguaaauuuacuuuaaaaaugucaauaaugccgggcagugguggcacacgccuuuaaucccagcacucaggagggaggcgaaucucugugaauuugaggccagccaggagaaacucugucuugaaaaaccaaaauaaauaaacaaacaaaaaauaggucaauaaaacuuuaacccaggacuuuggaggcugagaccagaaguucaaggccagggucuggaguguugcucaucugauagaguauuugcacaaacccaugcuucaguuaaguugcugaggucuauaaucucagcacuggggaggcugaagccuugagcuuuugacuuggccagcuagccuggccaaaauagugagaucuuuucuaaaacaaauaacaaaaacaucccccaaacacguguccccccccccccaauaccaaagcaaaccaguaaaacacacauguccuucagcuccugcccugucucuuaaaggguuucugagucuuucuccuagaaaguuggggcuuaucugaggacacucggaacucgagcaucauuugucuuuacugucugcaggccgguucugugggggcaaacuccccgagcccaucgucuccaccgacagccgccucuggguggaauuccgaagcagcagcaacuggguuggaaagggcuucuuugcugucuaugaagguacugagggagaggaaggggguccuuggacauuccagagccacucccuccuguugccuccagagccccuuauggggguucuccaucagggacagcaggggugggaaauggggagcaagcgggguuauguugggagaguggggaaggggcccuuacucaugggcaagccugcugaccgccauuauccugugcuccaucucauugccacacuauccuguguucccauagccauuugcgguggcgaugugaaaaaggauaauggccauauccagucucccaauuacccagacgauuaucggcccagcaaagucugcaucuggcggauccaggugucugaggguuuccacgugggccucacguuccaguccuuugagguagccacggacccuuuaaucuacucuaccaugccuuuguugguuuccaggacagucuaccuuccugaaggcucuagggauggggguccuggaaaccagagccccuuucccugacagagccccugacuccuagauugagcgucacgacaguugugccuacgacuaccuggaaguccgugaugggcacagcgagagcagcaaccucauugggcgcuacuguggcuaugagaagccugaugacaucaaaagcacauccagucggcucuggcucaaguucgucucugacggguccauuaacaaagcuggcuucgcagucaacuuuuucaaagguacuuccuccccugucccacguucuccuucuguggaugcucagucccuuaucucuuuauucuucauucauucagugugaagacuccaugagagagauagaggugcagggauacuguuaaaacacuguggguaaacacuagcaaaggucacaggucauccccgugaggcacagcacuguggagggaacgagcaggacaggaguauguuuuuaaaccgauguggccuaggacauucuauuucuucaggccucaacucuucaccuauacaguggauacaguagcuacccucauacuaggugucaugaaguuaaugaaggagaaacgagagggcuuuggugggacugguacauaaggggugauauggcugccagcuagccugaaugaucagaagaggguucuguaggauuuccuuguggguucucagcugccacugaaauauugggguagcuaagggcuaaacagacaagugaggcuuuugguucacuccucucugcaacauggggagaggggccauaggaacuugaaccucaagcucagagcaggaggaaggcgugaaguccagccugugguuggugacacccguucuuucuuccccauagagguggaugaguguucaaggcccaaccgcgggggcugugagcagcggugccugaacacccugggcagcuacaagugcagcugugacccuggcuaugagcuggccccagacaagcgucggugugagggugagugccccacuauccagagcuauuggcuucuuuccuguauccuuggucaagcaaaguucgggacaagcuagagagguucucuagugccauucucagccaugaaugagaaagauguccuacaagucagcccccagaacacuggcagggugugauacacacuggcguuaggggcuuucauucugacugcuuuguuaauauugaucuugaccugguaauugaugucaccaccuuucaaaagggucgugauccacaguuuaaugccacuguuugcggagucucagacuguaugcuaguggcaacacuucaggauagcaguuccagaucaggcuggucuuacugccuugggccagcuccucuggaugccucccaggacugcccauuuauacacauuuuccaggcccuucuguguccccucccaucagauuccuggaccaucuuccagaagaggaaguagaaaugauuauauacacacacccuucugcucuuaaaauuugggcucaccuuccaaggccccuacuaucugccccaugccuccaaauuguggucccacagacucacaucucccuuugacugcugcccaaccuugagccccuagaguggggacuccuggugggugaugccaccucccuugucccuccagcugccugugguggauuccucaccaagcucaauggcuccaucaccagccccgguuggcccaaagaguacccucccaacaaaaacugcaucuggcaguugguggcccccacccaguaccguaucucccugcaauuugacuucuucgagacugagggcaaugauguaagugccucuggagccaagguggguaggaaggugggguguaggggcuuggcucagugccugccuccuaccacugggagaauuagauaauagggcucugagaacagaaacuucccaguacacagaagcucagagggcuugcggggucgcaaaggaggcucugcagaugaggguggacauuaguuggaagccuguggaaugaggaagggcuuggggccagcugcccuggggcucugcgguacacacagcagcguuuuguuggggagcgcagaugcuuagccugacacuuucccagggagugaguaguccggagagaggcagccuccagagcuaggcucuccugcaggugugcaaguacgacuuuguggaggugcgcagcggacucacggcggacucuaagcugcauggcaaguucugcggcuccgagaagccagaggucaucacuucccaguacaacaauaugcguguggaguucaagucugacaauacuguguccaaaaagggcuucaaggcccacuucuucucagguaacucuggaguccuugcucucuagccccaccuccccaaaacuggagcucccccgccuucccuggucuccuaagcccccugucuccccaacuuauuauccuccaucaguacagccccuggggcaucugaauaucuuuauuggguagccuuuaaaaucuuaguuaugccaggccuagggaggggcagagcauuuaagugcagaaaugaggaggcuggcaagccaaggccugaaaggggagguccuaggacagggaguucaauugccugagaacacggggauagagaagagggaggugucugccuuggacugugucgggcaguucaucuugcugcagcugcacuucuaaucaggcaccgcccacccaagcccacuggguucaugccaggccuucccaaaagaggagucgccucugcccuuucauaacaaaacugcccauuccccugcccguggaaggccuggcuucauccaucccuuagcuuuaucuggccauuuugcagucccucucugggugguccaaacccagccuucccaagcuggaccucuagggucuugggagaccucuccccugcucuaggaaucccuaagucuuuggccccucaggccaguaggaggucaggagcaaaagggcccagacucagcagugaaugguggaaaugcucuccagugggguguggagagagcaggaagccagugggcaggcuggagcagguggcucauggaaggguggguuagggaccuucagccugacuucuccuggcgggguggacguagggugggcagaaccaggaagcccaugacuucguccaugcugccucccuucuccccuccuuacccaggguccugcauccuucagcccccuauguggcugcccugcacccuugccugucccacccggaugccaugcaccuguccccgugcacugguucccugcuuggcacugccagcugcccugcucugcuuaacauguucuguugagccauugaccccaguccccugucccaucgcuugcugagacccucuccguguaacaccaagcccauccuucccuaggcccacuuagaccaaaaaaaaaaaaaaauaguccuuuccagagggcugaggggauagaauaccuaccacaguguccuucuuagagaaaccauuaccugcuuacucuugucugucucugcccuucugcugcuccagucuuggagaggauaugggggauaccgguguuuguuuggagccucugccuugucucccuacuacauaguacucaacaccaugcaagggauguacaugcauguacaugugcucacaacauaugcauacacacaugcgugcacacaauaugcauugccccuugcacaagaaaccugcagaggacucucaucgaugggcaucagaguucagccucggggccuggggcaugugacucuggcccucaggagggggcuguauggacuauugggacacccaucgaggagacccuaagacaagaaggagaagcaagacccugaagaccuucagucugaccccagcaccuccggggcauuugggcacuguagggugagugccaucuccuuguuggggucugugccaccucccuugccccgguccccugcaaugucuucuccagucacagaaugggccguucacucuucagggugggccagagcccccucccagauguucaggcagccauccacagaacugacauccacacauuacuuuagucuuucacuuacccauccacucauuggauuaacaguuuucuuuugccccaccugugucccaagcacuggacuagauauuugggagagcauacaugaagaaggcacgaggguccaaacauacuagggaagccauggcuuacuucgugagcugagcucccuggagcuccuaccagagucucaggagaggcacaccauagggccugucucacagacggguacaauggcagcucucucggucaggcucugcucuccugaggaggagccucuggcaaggggcuugacaacucuaccucaagucuagcccaccugagcaugaaauagggccuucugggagucagggcuacagcccucaggguccugcccucagcuuaggaacuguccacuuaccacaaagcugccuugucaguggaaugccaacagccaucuucccacuucguggcucaucucuggaauucuggguguaauugggauccacacacuuguccugagugccugcuccuaugcuaggcacgugggcuuagaacaaugguguggcacacagaagucuguaacugugugccugugugugccugucagcaugcgagcagcucuacgugaaaugcccacaugaugggcuugaacacacucugcauauaugugugucugaauucacuuuggguccuugugucaccguguaugcagguuucuccgucuuccuauaugugucugcuccugcccgugcguuucucucucuguaugcuuccacacacauauagaguaggucacaugggucuuguguguacacccacacacagaugguugugugugcaugacuauggcuuugugucugagccuucgugguauacuauaggugucugccucugugugugugugugugugugugugugugugugugugugugugugugugauaccuaacauguauacauguuuaccuguguuuccauguuuguacagcagaccuuucauguacagggcuguguuuacgguuguguucuugggugugcaugucuguuucucacacacucuguaggcagcugucacaaggagggugagcagugagcccuuuccaccgcuccccucuacucugaguuucucuucccccgugugcacgccucagagugugccaucccuccagcccuaccucuugccacagccucagucuuguccccuguugcugugccuccugcuaacccagccguagugacauggccauucugcauguggaucugccugcccuccugcccucuucccuguccgccugucuggagacccugggucuaguuuuuauugauuuccuucccugguuccugcccuccacccucuucacccccacuccuuugucccuuuucuccuucucucucucauuucagaaaagaggccagcucugcagcccccucggggacgcccccaccagcucaaauuccgagugcagaaaagaaaccggaccccccaaugaggccugccaggcccccagacccuucauuacucaggaagcucaccucggacggagugggcugggggcuuuggagcccacccguucccugccuccacucugccauuccggccgccuccuuuggcuggacagaacuggugcucuccucucccccccgcccccucccauuuugauggugucugugacauuuccuguugugaaguaaaagagggaccccugcguccugcuccuuucucuugcagucugcuugucccugugucuguuuuuccacuuguccgucuguccaguaagcagguaaugguagagguucccaugcuggucagcuccagaccccagcccucccuccacccuucugcccaccucuaccuucucugcccagagcggaggcccacccagcuggccccacugaagcagugaccagagcuccaucgucacccucaccucccacucugcacccagccccccugugcgagcacgcccucccacaggaggaagccccaccaggccucccacuuccccuggggugagcagaccucagcccacacagacccacugcucucguuugcacccuacagauaaggaugaauguuccaaggacaaugguggaugccagcaagacugugugaacacguucggcagcuacgagugucagugccgcaguggcuucguccuucacgacaacaaacaugacuguaaagaagguaagaccugcguagagggcgaggaggauggagagggggaccagggcuugcugagcaccucacacugcccagagacuuccccaugcagacaucuccauccugagcaagggaaagcuagaaccucccguguggugcacggaccacccucccucgcugugguacccuggucacaugcacagguccucuccccugguccacaucaggagaagagucuuacggaugcugaagguccauuucuaggagucuuaaaaccugaaucuagccugggugugguggcacgugucuuuaaucccagcacuugguaggcagagauugauggaucucugugaguucgaggccaaccuggucuacauaguuccaggauagccagggcuacagagagaaacccuaucuugaacccugccccccucaaaaagguaaaaaacaaaacagaaaaacccugaauccaagacuuccuguuuguuacggccuucucugacacacagcacagauaagauagcagcuaagaacacagacucugaggcuaggcggccuggccuggaucugucacuuggguaacugugugcucuugaguggccugcuuagucacucuguuucugugcaaaaugaugaucacgcucauuccuaaaagagagcggcgaguggggcugggaaguuuuggaguugucccagccacacaguuaaguguauugccaucacccgccggccacacuuuucacccuggggacucugagcugggcugccacuuucugaugagcacugauccugaauauacaugauaagcaccccaaccugaauauucaaaauccagaauguucuaaaaaucugacuuuuuuuuaacauucucaugauacuacaaauaggagauucuaccccuaaccucaugcgauugguuguaaucaaaucacaggcacacaaaaauaugauggaaaauaccuucauucagagauuggcaagauggcucagccuaaguucaucccuagaaaccugcauaagguggaagcagagaaccaacuccacagaauugcccucgaugaugaugaugaugauauuauuauuuuaaauuuuuauuuuuaauuggggggggggcauguaugugcacaugacugcaguuaccaguggaggccagaagagggcauuggauucuccugaagcuggaaacuugauguggaugcugggagcugaacuuugacccucuggaagagcaguauguguucuuagccaauaagccaucucuuuagccccaaauuuuacaaaguuaagaagaagcuucaggcuguguucauaggguagauaugaaaugugaaugaauuuagcugagacuugagugccgucuuaucgcccauuaccuacucuccuccacugccaacccuucuagucacaagcauuuugcauaagggauguucagacuauuuaaagcaccuccccuuuacacacaaggcacccgaugccucuuuggacacgauacaaugcuacuguucugacuccuaaguucugugcccuguacugguaggcuugagcaauugcaaucccaacagccuaacacccugucuccaccaccgaaugugugacuccgaggggugaaucauuuaaccccucagaggcuguuucuucauucauugcaugauaaacaaaaucccugcucuuccgagcgcugagccguaauagcuauuauuauucugcucacugagguggucgcuaacaaaggacucuucgcuaucauuaagugaacagcccaagaauaaauaaagacacaucugagcagaauuaagagaacugaagcacccgguggugaagcugcgugaagcccagagcuuccaccaagcacugagggugccgggguauagaacuucugacucacagagcacccgcugcucucagcuagcugaacccaguccucugcauuucuaagccacguucuccuccuacaguuuagauagaaagggaugguggcuugcuucucacugcaccuucuggcgcacucagaaacacucacgcuuccucccuuggagguaggcuaaugcagaucaggucucaugccuggcccccauggaagagcuaauucuacuaaagguucuuuuggggcuugugcacagagauggcacccagccugagaagagaugugggcacccaugggagguagaacaggaaagcccguguggagguggggugggcagagaggccaccagaagcugcaggugagugguggggacagccccccuccccaacaacagcaaagagucaggcucuacacacacacacacacacacacacacacacacacacacacacacucacauacacacacacucucauauacagagagagagagagagaaagaaugauucgaggacuuaagaguuagaugaaccucgacucuggucuccauguguagccugugucuaccugucucuuuucccuugacaaccccaccacacauugauggauugcuuucugcauccagccuuguaucaccuaaaaacuaucugaagaaaagaacuuaaagagggcaaguuuuaucuuggcucaggaaagguuugguccauagucccuuggcuccaucacuuugaacuucaggcaaggccaaaaccauggcaagaaguucaugauggagcaaggagcaaagcugcucaacuuauggugacccagaaggguaugggggagcagaaaggcagaaagaggcagcaguggccaggaacgagauaugagcccuucaaggacacauccuuacaaggaugcucuuucuccaggcuccaaccccaagaguuuucaacccccuucccacccaacagucugucugguuauaaacacaucagugggucaauccauugaguagaucagauucccucaccauccagugacaguacaaaagucauauugcugcccuggggacaaaaccuuuaucucucgaguguauaggggacauuuagaucugaaucauacacuugucucuaaggguuccgccacucuaugcucauggauagaucugaucauuggcuuuugcuuuguuuugggauggggccucacaccauggucuaggccagccuuuaccugaccuugcggcagugagcauuggcuuuuaaauguguguuugggaggcugccuugcuuuguguggauguagauagaggagguauaggugaggagcuugugaugguggggagauaauggggagaccagccggaaagaaacaagcaagagacaugggagagugucuucaggaguucacgggcuccagaacugggaggaggugauccucuuuguguaagguuucccuggcuacugacagcagugaaccccagcuuccaaaaggacaguccauuuccauugagagguggacucucagaggccccaggauaggaggaaagaaaagucaaggagggcucucaucugagggccucguuucuucaugccucaggagggagacugauuggcugccaggagggaagguacuggagaccguagauugaccaggcuggagguuugggacaguugcugauagauggacuuagugaggaacggguguaauaagggucuaaugaucugggggcccuggugaggcaggacaccacaaacggccuuucuauuucuuuauuuugucuguguauguguucaaguguguguguguguguguguguguguguguguguguguguguuugcauguggaugccacagguugacaucaggagccucccucaaucacucuccaccauauuucuugagauagggucuuuuuuuuuuuuaaaagauuuauuuauuuuauuauauguaaguacacuguagcugucuucagccacaccagaagagggcaucagaucccauuacagaugguugugagccaccaugugguugcuggaauuuaacucaggaccucaguagucagugcucuuaaccacugagccaucucuccagcccccgagacagggucuuuuacugagccugggguccaaugauuuggcuagacuagauggccagcaaguuccagggacccuccuguccgugccacagcgguguugagauuuuaggugcgugguaucacaccuggcuuuuaugugggugcuggggauuguauuuauauggcaaacauguauuuguuuguuuugggcuuuuuccccccuucaagauaggguuucucuguauagccuuggcuguccuggaacucacucuguagagcaggcuggccucgaacucagaaauccaccugccucugccuccugagugcugggauuaaaggcgugcaccaccacugccuggcuggugagcacuuuauuaacugagcuaccccucuagaauccucuugcuuauuugugcguuugcuuuguauugaagauugaacuuagggccuuacacaucccaggcaaguguucuaccacugagcuccauucccgggucucuuuuuguuuuuuauuuugagggaaacgucuugcugaacugccugaucuggcuuuuaacuuacucuguaacuagcuggacuugcgauccuucugucuugaccucccuuguagcuggauacaccauaugcugcuaccaggccagcugaaugggcucucuagcaugucagcuuuuuggugaucagccauguaguucagcugcagagggcaaccaacucgucuauacuacaguggaagacagacuucuaggugaugggucugugcccugaauucaagcaaccucuaucugaaaauauaguuagucccaugauggguccaucuguauuaauguggcucagauuuuuuuuuucuugucauuguuccucaaacagugcaguaaauugcugaauguggugguccacagcuguaaccucagugcucaggagcccaaaggaugaugagugcgagccuuguaugagcuauguagaaagacccccagcuaaacaaacaaaugaacaacccauuuacauuauguuaaauaugauauaaggaccccccccccaagauuuaaagugcacagaaugugcugagaauauaguucaaaguuuuuugcccagcaugcacaauacccuggguuugauucucaggaccauauaaacuggucaugaugccaauaaucccagcacuuaggagauggaggcagggacauuagaaguucaagaacauccugagcuaugugagacugauaggguuggaggagggaggaaaggaagaagggagggagagagggagagagaggacaaugaugggaagguaugugugggggccucuauuuuauaauagagacuugagaauuguggguuuugguaguugugagggguucuagaucaaaucccguguggauacuuagggaccucuaagcuggagaaaagaaaaacgcaagagggugauacauacuggaaaaaccuagagugagguuguaaggagagauaugaaccagaaaaacugagaaaaaucagcagucagagaggccaugauggguggcaucacuuguccguugcugucaccugugauggaagugggaguggaguuuggggaugacugagucgggugccaaagucgcuggugacuguggaggucgcuggggcccaaaagaugacagcgccucacagugcaccuagguucccagguugcugagcggagaaagagugugacaguugggcagaagugguguggccaggaggucacaaaaaggguaguggaccucucugcugaccuuaggggucucaaccaaggcuucauuagaaaccaaaucauuaaauuccuccaagggguaacugaaugaagaagaaauggugugcaucuucaguccauuuuaugaauggaggagaagaggcaaagccacagaguggacaggaggggugccccuucuucauaggaggcacuggggugggaggucccuugucauccccuugugucacucacaucuuucagcuggcugugaacacaaggugacauccaccaguggcaccaucaccagccccaacuggccugacaaguaccccagcaagaaggaguguacgugggcuaucuccagcaccccugggcaccggguaaagcugguaagauaccacuugacacccuguauggacaccuugaccccaugccauguggccauuugcuucugccaucuacaaagacuugugugaguccaagguauuggcuguacaggggggccuggcaaagccuagggacauucccaucuauguggaaacaagucuucuggaacaggagcccucuuucuucugaauaauauauuggggugucucugacacugcccauuccugaguccucccucucugacauuccuguguccucccucaccaucaucccacagcccuuauuucaaccaugguuguguaugagcuggaggccagaggugcagagaucugaggacuccuccccacuagcugcccuggccauaccacucucuaaucugaacucuuguauccuccagacuuucguggagauggauauugagucucagcccgagugugcuuaugaccaccuggagguguucgauggacgugaugccaaggcaccaguccuuggacgauucuguggcaguaagaagccugagccaguccuggcuacaggcaaccgcauguucuugcgcuucuacucagacaacucgguacagaggaaagguuuccaggcaucccacuccacaggugaggccagccuugggcuaggcgacaccuaccccuacacugcuguuugcucuggauacacugcugacucugguugccaacccuggucuugaguuuacaaaaagggccuuuguggguccauagagcagagcccuguagccccaggaccaguauuguguucugaggacgagaucaucggagugaacacucagggacugagaagaaguuguagggauuacaaaagucauuaaauagaguucugcgacagcaaucagaggaaccuaggagcaaggagagcaucauucuaaguacaggucagaaaaugagccuagcaggagccgaucccggcccgggaggagcuuguccugcuuuugucuauuugaccaaguggcagucaaugaaccgccgcccaccccaggaacucccagucuagcagagagauaagccaggcacugaugauuauagucaaagcaugacgaggguaaaagaaacaggaaaaaaaaaaaccgaccucagggggcugguuagagucauuccacauggugggggagagggugcagaguuccagcggggcucaggguacacacagguagacagcaagucaccuggucugacuagagcagagagggugugggguggcggugaggaugcagagagaagcuagggaccaguccuggggugggggccagaaggcaggccaaggauauccguauuggauuuccuugucuacuggugggucuugggcaucccagaacugauagguccacagacaccaccacccccccccccauucucugugccucuuucaaggcucccuucccaccucucccacagaaacggagccuaggguguaagaggaaguccagggacacacaggggagaguggcugcuguguccaggccuugcuuacaauuugccuugcccagcacaaguucacaaaccagaggcuggaacuccaucuggcuugcaaacuucagcguuugagccgccguggaggaguuggguuuauuuguuuguuguuguuugguugauguguguuuuguuuguuuguuuaaacuugagccaacccuuaaagaccaguucacacaccaaacccaaaggcauagcuuuucucuuccacgcuagcucucagcuagaacacagaagcaguuucuucucaaguaaagcuagccucucccgacaccacugcuugacgcuaccucuuacuuagggucucacucuagaguguccccuagccuccuccuuggguuuccauccagagguggcauagcaagggcauuugcuugaggcuaagccagaucccacccagcacuggccacauggccucccguagugggaaucugucuccgugguucggggugguacugcacaggacugggaaugugguggucagccuugugaccaaucaucacacacugaucggucaucaguggugaucaaucuugucauccacucccugcagagugugggggccaagugcgggcagaugugaagaccaaagaccuuuauucccaugcccaguucggcgauaacaacuacccuggagggguggacugcgagugggucaucguggccgaggaaggcuauggcguggagcugguguuccagaccuucgagguggaggaggagacugacuguggcuaugacuacauagagcucuuugauggcuacgacagcacagcucccagacuggggcgcuacugugguucuggggugagcacccuucucaccccauauugccuuugaacccucacccaaacccccagcacugaugcagcuagcaucccuggagaccuaggguacuaggcugaguggaagggcuugcccggcccucugagaagcuaauaugcaaaaccuggggccacucacagagaccaucacacccgggcauccuuacccaggaaaccaggguccuuuccggguaguguaaagguuuccaccaacuccuggccugggccccacccagaccuaggcucccaugggaccaguuuggucugacuugcagaacugcaugaaucuggaaaugggggugauaggguucuuccugaaccacucaacccuugaccccaucgccaccacuucccugggcugaacugguugggggaugagggacagagguuagggccggaaccagaagcaggggcccugagcuaggcucucacuagacugguuggaccacgccauugucucuuucccauggugagagccuauuguguccuaaagccuuugcugcugcuauucuagcaggccccuagggguugcuucugagucugucuagagagggucugcugaagcugugugcacaaucacuuuggcagguuuguaagaaagaccaggcccagcccauggauacauuuaucuuccucccaguaacagauuagggucucugucucugucucucugucucucucuguuuccuucccucccuccccuucccuucccuccuuucucccgccauccuucaccacuucccucacauguauccaugcucccuggccccugccccucucuccucucauuugcugccccaagaaaggcuaaacuucccuggagcagucucagcugccagcccuggcuggaccuccccuuaggggcugagcugcagccuagcaugagcagcagagacugggccaaagaagaacaggcuggggggggggugagggggaagagaggcuauccauguacagcugucagcccaccuaugucucuggcaucucuggcugccaaauuagugcuuccuaccugcauagacacacaacaaaugagaugucuccaggggaagucuuccagggauauccccaggcuggggccagcagaggggaugugggagaggaacucaggcagggcuucuucuuggcacaguuacuggaaaucucuucaaggcuguggagaauggcuccuucuaugauuggagggccaaggcauaaagucacuucagaaggacauugccugucucccucagucccuggcccuuggcuuuaggcaacacuucaggaucuggagucagagcaaacauugggucuagagccauaacuggggcaggagaggaaugaagucaaggacagcagagcccauacuuggguucccugccuagccugauagacagagaagggguggcccauccucucugaguggcaugugcuuggaagcccagaaccagagagacagagacaggcagaccccuggggcucacuggccaaccacuacguggcaaguuccaggccagugggauccuaucucacuaauuaauuaauugugauuggcaccugaggauagagguuacccucuaacccucuacacacacacacacacacacacacacacacacacacacacagagugagagagagacagagagaauacguaaauaaauuaauaaauaaauaaaagcaauggcuggcucugcucugagcuuagcuuggugaguugguuuuguuuugagguagggugucacuauguaaaacugguuggacuugaacguacagagaucugccuaccucugccuccuaagugucccaaaugcagagauaaaggccacugcaccuguccagcucugauucugaucuucaaacaagcuaccaucuuccagauuucaccuuaaaauccugguagcaugaaacuguuucauuuaaaaagaauguuuuuaauuguguggguggggcuggggaggggcgcuugugcaguaccugaaaaggcuagacagaggcaccggaucuucgagaacuagaguuauaggugguugugagccacccauugugggaacugaacucagggucucuagagauaaggaaguacucuuaacuacugagccaucccuucagcccuacauccaucaaucuugaucucuucucuucucuucucuucucuucucuucucuucucuucucuucucuucucuucucuucucuucucuucucuucuccucuccucuccucuccucuccucuccucuccucuccucuccucuccucuccucuccucuccuaucuucucuuuucccuucccuucccuucccuucccuucccuucccuucccuucccuucuccuucuccuuccuuccuuccuuccuuccuuccuuccuuccuucucucucccauccuaacacacacacacacacacacacacacacacacacaccccaaguggucucauucucacuggagagcccagacuguucuccagcaugucuugaguggugggauugcaggcaagcaccaccugcuucauggggaaucuugagacacccaggaccucagggagggaagccagcaagcacaguccuaucccaacuccucauguccauccuucucccuggcagccucccgaggaaguguacucggcuggagauucuguccuggugaaguuccacucugacgacaccaucuccaagaaaggcuuccaccugcgguacacaagcaccaaguuccaggacacacuccacagcaggaagugaccucugccccugcuugguagcgggaacuggaguccugcuucccucaaucacccagacuggacagcaggggugacaggcagauggugacacauugucccucacccccaggcaccagggccagugggccaggugucaacaggaggcaagggacuuggacucccuguaagccaguuccccaugcccuccugucaguggggccggggaaccggagcuuucacugagacacuugaagugaccauuccuccuuggggcccugccugggguaagacagucucugugcaggacccugcgggcuucucugccgucuuuacacacuguauuguguauagccggugucccuaaucuuuauuguaacguacauuuccugccccuucuccagccuugauuugguuuuauauugacccaccacuucuaugcuuccuggguauccccugggagccgugacggggagcuagagaagagagaguggaugaauaagacagggcuucucuuaggcccacuggcucaucagccacaccagggcaccccagccaauaaacagaaaguguuacagccaauauccugugccagaugcugucuaugaugcgggggcauggugguuucuuccagauguucuagcuuucugggugucugaagccaguauggagccaaaacaccugguuuugcuggcugcccuucccucucaacauuccagaacuccuaagggugugauuucgcacugggguggacacacacacacacacacacacacacacacacacacacgcugcuuauaguucucccacacaacaggaguagaacauucuauaaagaggcugucuggaggagggaggaggcauauaaaagaggcuuagggua

SEQ ID NO: 7562 - RNA, 7643 nt, Mus musculus
uggagaucagacacagagccugguggccugguagggcacgcugcggacgggugcaaccacuccauccuuuggcugcucucccgcgggcgccgggccugggccuccccgcuccgcccccacgcgcgcccccgccgccugcgccgcaguccgcguccaccagccccggcagccaguaguugcggucccaguuccgcgcagcgcuccggagcugaaaggacugcaaucagcgcccgaggucaggaggaauagguggcgccuagagagcggguggcaccagaguugcggcagcccggagguggaagcucucgagaggggcagaacagccugcagggagcagcggggcgccggcaggcugguguggggggagacccugcaggagucauggccgggcuacgagccaggcggggcccugggcgcaggcuacugguguuguccacgcuggguuuuugccuaaugcugcaagucagugccaagagaccuccuaagacgccccccugcccacccagcugcuccugcaccagggacaccgccuucugcguggacucuaagucggugcccaagaaccugccuucagaggucaucucccugugagugucuaccuagccuuggggguggggaaaggaaagaaggcacagaaagcucuggaagagagaaacccugcuccucuuuugagaggauauggaccaggagcacucccagguauccucagaacuggagacuccaggccccagucugcagggagcgcugcaaucuguacagcagccauagcuuggguaaaccagaauucauggccaaggaugaaucaucaccaucagcagcgcaaugagaccuacuguguguggguuggagggagugucuacaagagcaugcuggccccacccugugaggucacaccaaggacagaaagcaggacuaauagcagcagggggaggggugacaaguaugcuugcccucgugguaccuuggcauggaccagacuccugccacugggucugcuauugugcacacagcugggccagccucacuugcagcaacuggcccaugacucccaccccuuugccuguggggcuagagagacugugaggucccccuucuugcugccccaucucucagcagcaccaagacauuguggguguuggguaauggugcugaugcugguaauggaaccugcucuuggcugagagggaaggugagccucgggccacugucgcuucuggaggcagcagggggagaagaauggaggacauugaguuuuggggaagaaaggguagcugcaggugggggcuagggcugcugaacacagaagccacugcccuguccaccucuguccacaguacagguccuucagacacuuacacagucuuggcuccuguguucccugcaggacgcuggugaaugcugccuucucagagauccaggauggagccuucucccaucugccguuguugcaguucuuguauggauagcuuuguggaagaggggguuggggggaacgugguagaaccugacagaugcugaaccugggugagaguagguggagggaggguuugaaaaugcagaugucccgauagaagcagaagguggagugacaugaggucaggaguccggguagcagggaaacugcacacagaagccaagagagggggauauacagagcauuagacuccacuucucuagggggucuagggaguuggguugaaauggccuggcccagugccagaaccuggacacuucagaggagaggguugugcuaaacacaggugagcccaggggucagaguucgggaggcaugguggacagcugucggugcagggcuagggugaguuaaggugaggaugagaagacuggacaaggagaugccauggaagugggccaggagccagcucggcaggauaacguugccucccaccauauucaggagcuaacagggaucuuggggcauggaaacaaguucacacccggccuugcugaccagggguccugagggaugagggaagggcagccaggucuugaggaagcucacgggugaggcaguaggcaugggcagcaggcacacccucacaaagucuaauuccugcuuugucuucccagguuacucaacucuaacaaguucacacugauuggagacaaugccuucauaggacugucgcaccugcaguaccugugugugggagggaagggucaagggcaggguggaaggagggggcccagucccuagugggaugggagggaaagugcagggggaaggcugggaguggggugggagggacaagcccugagugcccugacuguaggaugggcaagggggucauuucucucaugccccugucaucuugccuaauaccccaucacuacuacggugugacauuauugcacauguggaagccugucacuggcuccugugcaucuggccugagauguaaggaaaucaccacuggggggaugguuuugggacucugaguggcaacuaagucaagcuguuauuuucuccagcuucauagagaacaaugacaucugggcucucuccaaguuuaccuucagaggacugaaguccuugacacaccugugaguaccugacaccuguacccacaugggacuggagacccugugaccucuggauuuggucacgaucuuuaagugaucccaggcucuuucuugcaguucucuggccaacaauaaccugcagacacugcccagagacaucuuccguccccuggacauccugagugacuuguaaggccugaacccugccucuucccacaaugccacagagggcacacccuucugaauccagucccgcagagagcauaccccuggagggagagguguggggucaggguuagggugcucagagacggggaggacuuggguuugagggcuucgugaaggugaagucaaguuagauguaacuaacugagagccuuccaaacugggauucuucaaggaccacacagccuuucucaaaugcacauuagauguguaggguaaaccuguguguuuguuugaauguuugguugauuugaauuaacauuaaagaacgcaagcauaucugcagccauuugcuauuauuuacaucaaaauaaguuaagauaaaauggaagcuccugaauccugaggaagagggaugugacauagagugggauagguugcccauugcaaaaagugccugcaaguguacaggccuggaaucucagcuacucaggaggaugaagcauaagggucagaaacaguaaaaaguugccuccugccgggcggugguggcgcacgccuuuaaucccagcacucgggaagcagaggcaggcggauuucugaguucgaggccagccuggucuacaaagugaguuccaggacagccagggccauacagagaaacccugucuugaaaaaaacaaacaaacaaacaaacaaacaaaccaaaaaaaaguugccuccugauuaagaaguaaaaacagggcuggugauguagagccuagaaugugcacaguccuggguuccaauccccagcguuacaaaaauuaaaauucuaaguuaagcagggcaugcagagacuuaggcagaugcugugggggccugguccaaccuagcuaugugugagccuuccauggcagcuucugaaggccagguaggcuggugggcagagcagcuaagggucugccccgcucugugucccgcccucacaauccagagaccuccggggcaacgcacuuaacugugacugcaagguaaaguggcugguggaguggcuggcacacaccaacaccacgguggcucccaucuacugcgccagcccgccccgcuuccaggaacacaaggugcaggacuugccucuucgagaauucgacugcaucaccacugguaggaugugccuccccuccggcugaaggccacccagcugggcacacccagcuacuauagccagguuccuacuaccacccaguggguuggugccuuauuccuugagguugauuccaccaaccuacaucucucgucccugcagauuuuguccucuaccagacccuguccuucccagcagugucugcggaaccuuuccuuuacucuagugaccucuacuuggcucuggcccagccaggugccagcgccugcaccauccucaagugggacuauguggaacgacagcuucgagacuaugacagaauuccagguaccuagguguggccugccucugcugguccuauccugcagggaaggcgauaggaggcucuuuugucuaacuccagucaauuccuaaaggaagaggaagggaugaaaagugguuucugccuauaaggaauucauaacaaaugaacacuuugaaccaauucuagcccugacacacaucaauacaccuauuuuauaacauaaauuaaaacauuuuagcugggcagugguggugcacaccuuuaaucccagcacuugggaggcagaggcagguggauuucugaguuugaggccagccuggucuacagagugaguuccgggacagccagggcuacacagagaaacccugucucgaaaaaccaaaauaauaaaauaauaaauaaauaaauaaauaaauaaauaaauaaauaaaugggcuggugagauggcucagcaguuaggagcacugacugcucuucugaagguccugaguucaaaucccagcaaccacaugguggcucacaaccaucuguaaugagaccugaugcccucuccuggugugucugaauacagcuacaguguacuuacauauaacaauaaauaaaucuuaaaaaaaauacacauaaagugaauuaauuuauaaauaaaugaaacauuuaacugaaaaaauauuggagaaagaaacuauccuaccaggauuauccuauucuuugaagaaggccaguauauacaaaauaauaucuauaauguacaugccuuaaccccagcauuugggaggcaagacaggcagguuucugugaguuuaaggucagccagaucugcauaauagaaagacuccaccucuaaauaaauaaauaaauaaacuaaccaacaaacgaauuauuuaauuaaguaaguaauugaauacugagagcuagggauaaagcccaguugguagaaugcuugccuagcgugcacaaagccccucgguucaugauuguucaaaccuauaaucccaguauuucagagaugaaggcaggaaucuggagaguucaagaccagacuugacuauauagugauaaccgucucaaagaaaagaauaaaacaaagcaaagcuuaccaggguaugguggcucacacuugggauccagagcacuugggaugcagcgaaagaugaucgcugcaaguucaagaccagccuggucuauauuguaagguccaggccagccgggcuuucuugucucaacaaacuaaacuaagcuaauuauggacccugaguccugggugggacugcacugggagcagaacucuauagcagaucucaguugcggagcauguucggaagcuggccuuucacgugggugggugggugggguuacccaacacugccuaaccccgagugcuucuguccuggcagccccuucagcugugcacugcaagccgauggugguggauggccagcucuaugucguuguggcccagcuguuugguggcucauacauuuaccacugggaccccaacaccacacguuucaccaaguugcaggacaucgacccacagcgcgugcgcaaacccaaugaccuggaagccuuccgcaucgacggugacugguuuuucgcaguggcugacagcuccaaggcaggugccaccagccucuaccguuggcaccagaauggcuucuauucccaccaggcccugcacgccuggcaccgcgacaccgaccuggaguuuguggacggugagggcaaaccacgguuaauugugucuagcagcucgcaagcaccugucaucuaucaauggagucguucucagaaacaguuuguggcucagggagaggugacucagguaccugaugcccaggccgugaaacacuuucgugcuggccgagacagcuaccugugccuuagccgcuacauuggcgacuccaagauccugcgcugggaagguacccguuucucugaggugcaagcccuucccucccgaggcucgcuggcccuacagcccuuccugguggguggucaccgcuaccuggcccugggcagugacuucuccuucacccagaucuaccagugggaugaggggcgacagaaauuuguacgguuccaagagcuggcaguacaggcaccccgggccuucugcuacaugccugcuggagaugcccagcugcuccuggcccccaguuucaagggacaaacacugguguaccgacauguugugguggaccuuagugccuagaggggggcuaaguccuuuggguuccucaggguggcacuguacgauggguggggaccucugugagcaacuuguggccccaagugaagucacagguggccagccugucuauguagcuacacacacauacacaaagaagugggccugggcacacaccagggacuagcccaggggagccauucccauuacuguaauaagcaccuacguaugcaccaggcacccaguguccaggcucucuaugugcgcaccaacagccccugaucuucaguguucccugcucugcuccguugcuagcgugucugaguaacaaagcgagugcaggaaggggugagccacagccuucucuucucagcuuagcuuucugcucucuggccucuggaugcccgaggugcuuguguaccuguuuggcauccacaguugcagccccccugcaggugugcccacacuuccaagugugccugcccacgccaugcuccuucugcaugcaccuguggacacugauggacaaacucagcugcauacuugugcauaccccaccacacuucugauucuguaucugcacacgucuggggguguguacgugagcggacuaggugcugggcaaaccggcguccuugauaccccguagcugcucuucuuggagggugccuacagcacccacacuuucucugcucuccccagugugcccccuguguggcucauaaggauagcaacagaaaacgugaccauggccucguggggacaaagccacuucauccagaagcaauaauaacaagaggcagcagcaacuggguucuucacagugcaguauagcucuccucacuagaguuuucuuccacgacucagucccagcucaaagggacacgggugggaaggcuuucucuggauagcuauugcuuuuucaagcucgggccaucuccucucucacccuaucuuugagaugcggaucccaaagugugauugcuccuugacuggauauauaaaaaaaaaucagccaaggcaagaauccugagacagccugagcuacuugugugggcgccaggaacauguuggucgcccuggcaccccuccaugccauggagaugccccccggaggcacagcucgguggaggcuggaugaggauggcagggagggacaccugggaaccaggccucugcugcccucugcuguccucugggagcagcagcccugaaguaggaaaugaucaggcugagaggauuucuugcggccugaugcaccuggggauaaugcuaagauuccuuugcuucgaauaaaguuccaccccacugcuagc

SEQ ID NO: 7563 - RNA, 3809 nt, Mus musculus
gagcuugagcgcugggguugggcaggaucugguuccgugcaacuuuuaagugaguuacaaacuccgccccgagaccggugcagguggucgggcgcucugccacccgggcggcaggugagagcugagguccggccugccacccggacccgagaccagcagcgccgcccucgacgggggacgaacgguucuccgcggcaggaauugugggacugagccgccaggauucggcgaggcggagggacgcgcccucccgccucgaucacaaggcggcuuccucugcuaggcccucgguccccugguuccggguucuccuggcuccccgcacugcggggucgaagucagggguggugaucuccgccuacaccgagggagagguguacugcagcaccacucacccccuugucccagcuccugagugagcgucccuccgcuugucucuuggggucaucccccuaggcugucaggaugguguccuggaugaucugucgccugguagugugaguauggucacugugagacaccuccccccucccuuuugucccaggaugccaaccugccuuuggguggaaacuggggacguuuguaaagaagggaaaauuuaaagacuucaugaccccguuucccagcacacacuuaacgguccugggggucugaagugggaccuggucacugcauaccuuguuuccacccugcagccuucuggucugacagagacccuuccugcagacaggugcugcuagggcucagggcuuuuaccaccuacaguccugugagaaggugauuagguacugcugugggcggagaaucuaggugccuccuucccaucugagcagccacaugacccaccacccuagcuucagcuucugcagccugcaccucacuuuuggauaucccaauaccuggcucaaaugucccucacugcaugcuggugguccugggccugauuacguguagugggagcggacagccuaguguucucacccaccuuguguguucucagucuguccuguacccaugggccaccagcgcaggccuaggcaggcuugguauguuuguaaacagccggguggggaggcagccuccggggcacugacucaggcacccaggguugugcaagccaagcgggaaaaacagggcaggcacugccaucucgcacccaggucagggggagcagccaccuggcagggagaggguggggcaugguccccucacacuuccugugacugcuguuccaggcucauauuuggcaugcuguauccugcguaugcuuccuacaaggccgugaagagcaagaacauucgagaauaugugagugcaaagagugggguagacgacaacauugaggaauggucagggaggugguaggacuuggugaugcuggagggccuggccugucagacuccaggggcucgaucgaugguggaacagaucucaaguagaguggucuaguggaaggaaggccagccauuauuaacaauagccauggaggaucucgugggcgaagcaugcugggggggggggcacuggaacggaaggcaguuucucaggggcuccugucuaagcagaugugggaaacuguagccagcaaugcagugggacuggcuuugaggaaucucuggguugggcaggcugggggcggguccuggcggcuuaggcucgugagcugagcucugcacucugacccacagguacgguggaugauguauuggauugucuuugcgaucuucauggcagcagaaaccuucacagacaucuucauuuccugguccggcccaaggauuggcaggccaugggguugggaagggccucaccaccaccaccaccaccaccuggccucuggcucacacaaaccccuccccuugcuuacacacagguucccguuuuauuacgaguucaagauggcuuuugugcuguggcugcucucaccuuacaccaagggggccagccugcuuuaccgaaaguuuguccacccaucccuaucccgccaugagaagguaccucugagggagauagagcagaaacaggagggugugucagggcagugugucagagcgaaagcccuguaucucagguucaggcagccagaggugccugggucuuauucccugucccucuauaguuuugcugugggacugugaaagggguuggcuuuccccauccaccuggaugauacauauggacgaccuuuaggguuaugacaagccagcaggaaguugacgugggcauggaagaauggaagggacacccacuaaguuguggagaggguguguaguuggggaguccugcuuucaguuguucugaaccuaaaucuguggcuccuggguccuggguagggcucaugggauuaugacaaccaguggcuucuuggggucugcaaagacggugguucuuucguugaucugagcucuccgcccugggucugcaggagaucgacgcguguaucgugcaggcaaaggagcgcagcuaugaaaccaugcucaguuuugggaagcggagccucaacaucgcugccucagcugcugugcaggcugcuaccaaggugccgugggccccggugaucacagcgccucccccgcucccagaucaguucugaaucuugugccccagagauuagcugaagggcagcuuccccguuacagcccuuccccucgcagcccuccucuggaguuaacagcggcucccaucccucaccuccuagagucaaggcgcucuagcuggaaggcugcggaguuucucuaugcaagaccugcgcucuaucccugacaccccuguccccaccuaccaagauccccucuaccuggaagaccagguaccccgacguagacccccuauugguaaguggaaagagggggagcugaccucucugaggacuagaggcaagcugggcgugacccuaggcuuguauaagugcucagcuuugcccugcgggccucucuuuggcaggauaccggccaggcggccugcagggcagugacacagaggaugaguguuggucagacaaugagaucgucccccagccaccuguucggccccgagagaagccucuaggccgcagccagagccuucggguggucaagaggaagccauugacucgagagguaaguguguuggaaggacggcaugagggggguguggauggagcugcagugcccacaccacucaagguauacuggcuuucucuucccaagggcaccucacgcucccugaagguccgaacccggaaaaaggccaugcccucagacauggacagcuagagucugcagauugaggccaccuuaccucuggagccagcaggggaccuuucgcugcuacaccagcuaccgggguucugcuccgucuggcuugugccuaaauggcacauggcgugguacccugcacagggagacauucacuauaccaaagcagcccaggccuggggccuauuuauugccuuccucugccuuuuacuuucucagacacgggaccagagccccaccagucccuaccgacgaaaccaaaaguccaaccagcuguguucauuccuucuuguccuucaaaauacuugacagccuuuuccaaggccugguguguguguguguguguguguguguguguguuuacguacacuagcugcauguuucguguuggugagugaggucaggcuuaugaauauuuuuauauaaauaaauaccaaacaguguuuggccucuccuaauuugucucuucacaucucauauuguagcuaacaacucacugcaggcucuggcaaaggguguagagacugcuggaagaucucugugccccaucccagcagcaguauucuuacaguu

SEQ ID NO: 7564 - RNA, 3809 nt, Mus musculus
aacuguaagaauacugcugcugggauggggcacagagaucuuccagcagucucuacacccuuugccagagccugcagugaguuguuagcuacaauaugagaugugaagagacaaauuaggagaggccaaacacuguuugguauuuauuuauauaaaaauauucauaagccugaccucacucaccaacacgaaacaugcagcuaguguacguaaacacacacacacacacacacacacacacacaccaggccuuggaaaaggcugucaaguauuuugaaggacaagaaggaaugaacacagcugguuggacuuuugguuucgucgguagggacugguggggcucuggucccgugucugagaaaguaaaaggcagaggaaggcaauaaauaggccccaggccugggcugcuuugguauagugaaugucucccugugcaggguaccacgccaugugccauuuaggcacaagccagacggagcagaaccccgguagcugguguagcagcgaaagguccccugcuggcuccagagguaagguggccucaaucugcagacucuagcuguccaugucugagggcauggccuuuuuccggguucggaccuucagggagcgugaggugcccuugggaagagaaagccaguauaccuugaguggugugggcacugcagcuccauccacaccccccucaugccguccuuccaacacacuuaccucucgagucaauggcuuccucuugaccacccgaaggcucuggcugcggccuagaggcuucucucggggccgaacagguggcugggggacgaucucauugucugaccaacacucauccucugugucacugcccugcaggccgccuggccgguauccugccaaagagaggcccgcagggcaaagcugagcacuuauacaagccuagggucacgcccagcuugccucuaguccucagagaggucagcucccccucuuuccacuuaccaauagggggucuacgucgggguaccuggucuuccagguagaggggaucuugguagguggggacaggggugucagggauagagcgcaggucuugcauagagaaacuccgcagccuuccagcuagagcgccuugacucuaggaggugagggaugggagccgcuguuaacuccagaggagggcugcgaggggaagggcuguaacggggaagcugcccuucagcuaaucucuggggcacaagauucagaacugaucugggagcgggggaggcgcugugaucaccggggcccacggcaccuugguagcagccugcacagcagcugaggcagcgauguugaggcuccgcuucccaaaacugagcaugguuucauagcugcgcuccuuugccugcacgauacacgcgucgaucuccugcagacccagggcggagagcucagaucaacgaaagaaccaccgucuuugcagaccccaagaagccacugguugucauaaucccaugagcccuacccaggacccaggagccacagauuuagguucagaacaacugaaagcaggacuccccaacuacacacccucuccacaacuuagugggugucccuuccauucuuccaugcccacgucaacuuccugcuggcuugucauaacccuaaaggucguccauauguaucauccagguggauggggaaagccaaccccuuucacagucccacagcaaaacuauagagggacagggaauaagacccaggcaccucuggcugccugaaccugagauacagggcuuucgcucugacacacugcccugacacacccuccuguuucugcucuaucucccucagagguaccuucucauggcgggauagggauggguggacaaacuuucgguaaagcaggcuggcccccuugguguaaggugagagcagccacagcacaaaagccaucuugaacucguaauaaaacgggaaccuguguguaagcaaggggagggguuugugugagccagaggccaggugguggugguggugguggugaggcccuucccaaccccauggccugccaauccuugggccggaccaggaaaugaagaugucugugaagguuucugcugccaugaagaucgcaaagacaauccaauacaucauccaccguaccugugggucagagugcagagcucagcucacgagccuaagccgccaggacccgcccccagccugcccaacccagagauuccucaaagccagucccacugcauugcuggcuacaguuucccacaucugcuuagacaggagccccugagaaacugccuuccguuccagugcccccccccccagcaugcuucgcccacgagauccuccauggcuauuguuaauaauggcuggccuuccuuccacuagaccacucuacuugagaucuguuccaccaucgaucgagccccuggagucugacaggccaggcccuccagcaucaccaaguccuaccaccucccugaccauuccucaauguugucgucuaccccacucuuugcacucacauauucucgaauguucuugcucuucacggccuuguaggaagcauacgcaggauacagcaugccaaauaugagccuggaacagcagucacaggaagugugaggggaccaugccccacccucucccugccagguggcugcucccccugaccugggugcgagauggcagugccugcccuguuuuucccgcuuggcuugcacaacccugggugccugagucagugccccggaggcugccuccccacccggcuguuuacaaacauaccaagccugccuaggccugcgcugguggcccauggguacaggacagacugagaacacacaaggugggugagaacacuaggcuguccgcucccacuacacguaaucaggcccaggaccaccagcaugcagugagggacauuugagccagguauugggauauccaaaagugaggugcaggcugcagaagcugaagcuaggguggugggucauguggcugcucagaugggaaggaggcaccuagauucuccgcccacagcaguaccuaaucaccuucucacaggacuguaggugguaaaagcccugagcccuagcagcaccugucugcaggaagggucucugucagaccagaaggcugcaggguggaaacaagguaugcagugaccaggucccacuucagacccccaggaccguuaagugugugcugggaaacggggucaugaagucuuuaaauuuucccuucuuuacaaacguccccaguuuccacccaaaggcagguuggcauccugggacaaaagggaggggggaggugucucacagugaccauacucacacuaccaggcgacagaucauccaggacaccauccugacagccuagggggaugaccccaagagacaagcggagggacgcucacucaggagcugggacaagggggugaguggugcugcaguacaccucucccucgguguaggcggagaucaccaccccugacuucgaccccgcagugcggggagccaggagaacccggaaccaggggaccgagggccuagcagaggaagccgccuugugaucgaggcgggagggcgcgucccuccgccucgccgaauccuggcggcucagucccacaauuccugccgcggagaaccguucgucccccgucgagggcggcgcugcuggucucggguccggguggcaggccggaccucagcucucaccugccgcccggguggcagagcgcccgaccaccugcaccggucucggggcggaguuuguaacucacuuaaaaguugcacggaaccagauccugcccaaccccagcgcucaagcuc

SEQ ID NO: 7565 - RNA, 5054 nt, Mus musculus
caagugcgugcugggugaauuagcuaaucgcuagggagagugugaagugaggcugaaacccaggagaggagggggcagagggaggaucccggcgccccgcccucccgauaaccgcugcgagcuggccaauccgggcaggccgcagugacgcgcagccuaucagcgaccaggucucucccggagguuccguguuagucuuggcccucaagucaggggagggggcgagggcgccgcggcccaccgcagcucaggucccggccgcuugccuccgggggucuggcaggucccggcuugccaccuccccggagacuugauggccacggagggccuggcaggggcgcuugccaccgugcuggggggaaagggguugcuggugcagagcugugacucggagccggcugggaagccgcuguuucccgugcggcugcggaagaaugucugcuacguggugcuggccguguuccucaacgagcaggugagcguccgaccggccgcuggccuucggcuggucucgggagcgugccgccugcccugaucugaacaggcgagccaacggccgcugccuguauguggcgcuucccaauguugcaaagcacucucaacacuagcagcugagcugagaucguccuucuguagacucuauaauauggaaggagaagccgaggucccggggcgguuuaucucauccacuagaccucgccccccaccaggagaggccuguaauaugcccccuuccuuuccaggagucuagacucucccggcgccucgggagaguaauggggagcuuacaugcaggccuccgauccugugagaguucuuuuuagugaucacuucugcacaagucagcguuauaaaauccuggccaagaagggguagguugguauagggguggagcuaaguuucaaagccucagacccuagauugaggacuugacacaggcgguuuguaagucccaugggaacaagagcaagacaguggcauaaaugagucaguauaggagugguggcaaccuucaggaggaagccuccuagagcaacgcccaagguccucagccccuuucuacaacagaagucccucuggguuugaguuacagcaaagcggagacagccacugcuuucagccauaucagggccugacuccugaggauccagcauccuaaaggugucugucuaccaagaagggagcuuugggcugccauccagguaggggcuacucuucugaagcccccagacuggcuggguaggagugaagauugucucacuucccucccucccaggaugagguguugaugauacaggaggccaagagggaaugccgggggacaugguaccucccugcaggaagaauggaaccaggagaaaccaucguggaggccaugcagcgggaggugaaggaggaggcagggcugcucugugagccagugacacugcuguccguggaggagaggggcgccuccuggauccgcuuuguguuccucgcucgaccaacagguaucccccaccuagugacauuucucacggucccucauccauagccagccauacugugggcuucugcuuauggccauugaccuacuacgggcuaagagcuuuugggggucucucucucucuggaguguugggguggccauuuacucucucaggcucaacccuucucauacuggcccucuucccaccccaccccccaaaucucuccuaggcggaguucucaagacuuccaaagaugcugauucugagucccuccaggccggcugguacccacgggucucccugcccacaccgcuuagagcccaugauguucugcaccugguagagcuaggcgccaaauucugccaacaagccaugcacccucucauucugccucaagagcuccccugcaguguggucugccaacggcuggugaccaccuucacaacaguccagucgguguggguguuggugggcacgguggggacaccucacuugcccaucacugccuguggcuuuaccccuauggaacaaaggggcggcaucaagguggccaucuugaggcuccuacaggagugucugacucugcacaguuuggcaguggagaccaagggguugcuuggguugcaacaccuaggcagagaccauguggauggugucugccugaaugugcuggugaccguggcuuuucggaacccaggaauccaagacgagcccccaaagauucggggugaaaacuacuuuugguggaagguauuagaggaagauuuacaaaaacugcuucuguacagacuccaggaaucuucugugaucccccugagcagauagagagauuccagcagggaccaaaagcugagcugcccccucccucugaggcagagaaaaggcuggcagucagggaucucauugcacauuuugagggggcagggaccacacauugagcccaaagggagggugucuugaauccacuuuucaagggcucaguucugagggcacacaguacuugucuuuuaaguuggugaggaacuuuuugaacccuaaauggcaccaucuuuguccacuuuggaaaaggcugcaugucaauccuuccaaccccauaggaauguagagagggaugggacaugggggacgcaucccucagggcagaguccucauugcugaguaaaaagguauugcuuaaccugccugcuugccuaaaugucuguguggggaggauauggggcacugucccacccacagucacccaggucuuuccucaccguguacacacugaugcuaugcagggauguaaggauccugaggcagacaucgaugcucgcugaagccucgacccacccaggcucuuuuuaguguuccuguccugucagggcgggcgugggacuuugaagugaccacaccccuaauaaaagcacagcucagaccuguccagguguugaacgguucggucuggugaaacugccuagggaacaagaaagagcugaggaugacacguuggccucugccagucuuuuucucuuugagcuuccugggcucugaccuguuccgugugcucucggaccuggcuuuuugguuuuuguucaugucccuguccucaguucaugucgcccaggcagacugugaacucuuauaauguagcuggugaugaccuugacucauccagauucugcagaagucaagcccuuuuaucaauggguuacacucccaggccagcacaggauucuguuuucuugagauagacucugcccacauagaccaggcugaccucaaucaaguuuguugugaucuuccugccuccaauucuugaguccugggaauacagaugugcuccagcaugcugcugcuuaucauuagcaucauuauuauuaucugaugaaagcuucggagcuggcgagguggcuccgcucagcaguuaagagcauaugcggcuggcucaugcugaggaccugaguuugguuuccaguccuugcaccaaguggcucacaaccaccuccagcuucaggcuuucugaaacccucucuagccucugagggcacucacucaauguguacaucuccuaugcagacauacauaauuaaaaauagaaaugaaaaugaaaaucaaaagcaguuggagcaaaggaaauguaucccauguugcuaaucaucacauuagauuucugauucugagcaaggagacgcacuuccuagcauugcuuuucacagaggacaguagcuugaggagccagaaaaacuccuugauccuuuuccuagugccccaggccucuuugguaaccaucuugucuggucucuagaaagaggaauccuccuuagacucccugaggacauaguuuccaaaugauaaaccaaagcgagguaugauggcacacaccuuuuaucccagcauucgggaggcagaggcaggaggaucucuaggaaucuauauagcaaguuccaggacagccaguacuacauagugaggcccuauuucaaaaacuagaacaaaauaaaugaagucuuuucuauuuuauuuuuggagugcuguggguugaacccaggggcucacacauuuuggguuaagcaggcuaccuaauggucucacugaaaaccaaaaccuuuuauucaggucaggacuccuccaguucccccacacacagagaagggcagugacauucacugccaccauuuagccugguggcuuuugauccugaguacacaucacugucacccagacaguucucaguucuguccacccacuagggugacuaagcugcugaaaccagcugggagcuggcgugugugugugugugugugugugugugugugugugugugucuguccaagcgcaugagcaggcacaugcaugcacauaagcaagagaaggagggugucgggagcccuguucuauugcuuucuacuuuauucccgugagacagggucuggucuaucacugaaccuggagcuagacuggcacacugcaagcuccagugauccuccugucuccuuuacccauggcucuaggacgucagauguguacgcagccacaccuuggcuucuuaccugggugaugggaauacagagaaacccauggcucuguuggcacuuucacccccugagccaucuccccagcugggcaccaguaucucagaaagaagccuagauuauucuuaaaaggucuuuuuagauuucuguuuaugugugugugugugcacacucaagugcaggcccucagaggcaucagauccccuggagcuggcgcuuugggcaguugaaggcuuccuuacauuggugcugggaagcaaacuuagguccucugcaguaaguguguuacucacuaagcugccucuccaagugguucuaguaggcacuauugaaacccugcugaggaccugcuucucaaaucuccauugcccgacccccuggauacucuuuaugauucagaauacucauucccauaccauuuagaaaacagccgaugugggaguugggcaccggaguacacaccuguaacuccagcacucaggaggcugagacgaaagggucccuauccaguucaaagccauccuggacauguauggagcaugacccucucaaaaguccaacccaccaacca

SEQ ID NO: 7566 - RNA, 16546 nt, Mus musculus
auguccacacaaucacaauguuuauugcugugcuguugugaagacaccaugcaaaugccaaagugcauugaguauugcccagccucucaaacgaguacaaaucucaaguguagacccacuccaccaagaucugcuccugucccacaccagcacccauguguacucacagcucucucucucucucucucucucucacacacacacacacacacacucacauucauucauagcucgcucucucucucucucucucacacacacacacacacacacacacucacauucauucauagcucgcucucucucucacacacacacacacacacacucacauucauucauagcucgcuuucucucucucucucucacacacacacacacauauacacacacacucacacacacacacacacacacacacucacucacacacacacacacacauacacacacacacacacauauacacacacauacacacacacacacacacacacacacacacacacucacacacacacacaggagugcaugauguucuucggagcagcagagaaguccucccccgcugggaggacugcgggggauguagaggucauggaguuuccuccucuuucaugucaccuccuggcaaccugugcccggcuucgagagguggcaugggcaggaaaaggaagcaaaaggggcucuggccugcuccuccuugcccaggagggaagccaacaacugcaggccuguugugagguaaugccuggcgccgcccgagugcucuugcagguugagacagauucaggccgggugagguagcagccccagccauggaggacauacgaagaacaaugccagagcuaucugcuugugucucggccuagccucacuaggcuucugggguuuggaguuggggugcccugucccaucuguaccuugaguuccuauaguccccaggaccacauuccaccuggaccccugggcacugggcaggauucagagggcaagggcccccaucccuggucaaugaccucucugcccagguguuucggacuugcugagacggguucagaaggcgccagagaggaaccagcuggagcuggagcuggagccuggcacccagcuccaaggcucucgccugcccuggcugcagcugcgccagggcucuuguuagcagcugcccccgccugggcgcagagcauacuuugggccucugccaggaggcaguugggaauuuugcaacagccuccaggaggguagagcaggaagagggggcuuccccucagccuccuccucugucuccuccacuacuguucgugaagccucggagaaaccugccgagucuuagcagcuuccaugauaccuaauguaacagacaggguucuugcucccccccuccccaucucucuggacuggauuguuuuuuuagccagccucaaagacagcaguucaucucccuggccccuggaguugucucauguuguggcccuggucacaauauagcagagauagucacgcaacacaugcagggcagcaucuaggcgcucacuggccauccucuagcuccucuaaaaggcuccaagaauaccacugccuuaggagccagcaccuccuugaaaccucagcucguggggucaacaggugagguguccugcagcugaaguccccggcauggaggacagaguggcagcauggccaggcaggagacugcccgugggcagaaguacacaggcaggaaucuucccccacccgucaugcuccuggcucagacuugcccuucuggagguggagagaaguucagguaaggaccgugugggggaaacuugacaaacgcaauggcagccagcuccuugcagaauuccucaaguacuaccacacccuggaguagggucugaugguccagacuguggagagacaguggcagguaagggacgauggcauggcugggugucaacaggugugcuaauagcaugacagcccauguccacaaggcuugacccagggccaacuccucagggcugcccucccaaccccgggcaccgcuucccuggcuacuuacugcucuccgggaaccuggcccaucaguugcuugcguaccaggagcaguuugcccgaaaacugggguacccucugaauucuuugcauuaagucaccgaucaccuagagcccagaaaggaguaagaugagaagugaccaugucccacagcugccccuggcucuaccaugaggcagaaggacaagacuggaaaaccugugcuuuuccugauacuggaaaggguaccaaggcagucccgccccuugccuugcucuguccuuuccuaucacacccucauccuuacccugacaagcacagagaacaggcuccugcagccaggggccaggcugauguagggauccaggagguacucauggauaugggggugggggaacaaggcgagccgggacaagacugaggucacuuguagguucaggcuguacggcuggagggaacaagauggacaacgcugagggcuggcaaccgaggcugagcauguuugcacuccccaagcgaggcgccuggcugcugugagugugugcgggggugggaggcucacgugauaugucuaugucauggauucccuggggcugagggccagagcauguuagggcgugugaagaagaggcgagacagggcuucccgccuggggaaagguaaaggggcuguggagcugaggaaccaaagagggguccaccccggucaccagccccuacaaggcccagccgggagcuucccuaggcguggucuuuauggcuaccugauccaaaauccgggcgauucgaucaaagagcacuuggaggaagcgacccucaaagaaaggccuuucaggcucaugagaguccaagggcgcugggccuaggggccaaccccagugggccacacgggagcugcacuccuggaacugaagccgaggagaggaagaguugagugaauagacccagaaaggccuaguugagggaccuuauaaaaacagugugggguugagauuguauuagggggauaucaaagagccuagaaggggagggaagccuucacucaccaagccguaggcaucgugcacguaugugucauauccauucuccuccaggaaggcugaugucuuggcuuccucagggaccaggcaaaggaagcuaagagacaggggccuagguguggaggcgccuccccagguuucccccacucucugcuguucacagggucccaaagaaagaauaugauucaggugacuccaacugccuaaccuucuucccaccuguuaacaaucuccgucacugcuguuuugccauccgaacugguggcgggagcugggggaggcuuuguggagggcugaaggccagaaucgaggaagccaucggugaaguaggggucuuccuccagaucucugcaggcagggagaucaccaugccccgaggaacagauggaugagugggugugcaugcgugcacugaguccugggcagcacccugccucccucucugcuucacuuacaggguauccucauagcucuccggcuccggcgagccccgggccacguacaggcggcccucgagguucugcaggaccagacugcggauggccugcucauggggcuucugcagcagcuccucaaauagccucagcguggcaaugcugaucuggaacgagugagaggcagcggggacccaccugucacccuccuagcuccucucucucucucucucucucucucucaaaaagacaggguuucucuguguggcccuugcuguccuggaacucacucuguagaccaggcuggccucaaacucagagauccaccugccucugccucccaagugcugggauuaaaggcacgagccaacacugccuggcuccucuugguuucucagugcccgagaaccaaugccagauaaauuccucuaagguggggucacuucccuuguuggcuaggggcuaaagaagggguuccauuuuucaucugauguaccaucucuaaaugccuuggcuucucugugccuugguuucugaauuagaagaaaaaaugggacuacuucacagagagcuccagucuccaaaagcugaacucauagaaaagcagauugcaaaauacacagaaaaccaugacagagacaacagggcugucaaucauauacugucacugcuuuggcuugaggccugaggcugagccaccugggccagcaggaaaggcucuggcagccuugugugggcugugguacaaacugaguugaaggcuuaccucgucugagagauggucacagugcaugaugagguguguacccagaguaugggggcuguccucuauggcugcaggaugcuggucagugccuaagaggaaggucauggccuccugcagcagugcaggggagcgcagcugacgcagcaaggcugucagcagggcaguggaggucaggaugcucugcucagaucuguggggacagacacagagcaggggugagugggugggcaugcagaaccuuuccauuuuccuuccauuguuagcuaacaccccccacacacguggccccaucccucugagauccuauaguuaaaguggggaggcugugcuucagcccagggcccuuagagccugguagggugggcuggacacagacaagagccauggacaaaggacugaacagacacuuacacaugcaggagcuggggcugcagggucucuacaaacagcuucucagccacagccuuugccaaggcaucugcaaccaccuaggagccagagagcaugucuccugcauucaaaccccaucauagucacuccuaaaaaauccugugcccucacacagcccccagauaugucagagagcccugguuaaccagggccaagcuggcaucuggccccaagucaccuuguguccgcucuacuacuccaucacugccaugagaccauuguggagcaaggaagaacccuggucacaccugccccacucaccgugugugccucugugaugagguggucacaguaaucaaaccagcccaggaaggcagccagagccuccuugccagggaaagcggucucaucagauggggcacuggguaaccuaagagaaagggaagcgagaaucuggaggacgggcaaaaaagcuucagggucuuucugaaagacagcugagcgguggucuccaucccaucuguugcuguggucagauugcagaagugaggcucgugggaggcugggaagggcccuugggacuggcucuccccccaggaagaagggagccagacuagcagccccugaagguauuucccagucucccuaggccaggaacccaccuccagcugaugcccucuaaaguggcaaugucugcugggucaaggcaggcuggcauggaccgguacaguuggcagaggugcucagcuaucgccauacagcaggagguacucugugucagguagguggcagcugcuggugaggccacgcuuaccagcagcaguauguucuccugugccuucagggccagccgacucuucuaggggaugggaagaugacgucugagacaacaguucccuccaccccucccacccuugccggcucuguagucagaccuugcucuugcacagucccagcagggaggugauaagauugcucuccccaggcccguuuucuggccccucagucucagcgggcagguggaugcucagugcugggacaccacagugcuccuuauccaguccaggaucccuguugagagcaucacuguggggacaguccuugucccuguagccagcuaugucuuuaggcggagcuguagacucucuggcuguuuucuucuuaccuauaauuuuuuuacccugaaagaagguagggugaggccgaggucagaaaggagaucacuccaucccacaaggugcuuccuugugaguccaggguuaagagucaagagguaguggagcaucccuguaaucuuggaaggcagagagaggagggucacaaguucaaguccagccuggacaacacagucucacuguguauccugccagacaucauaauaaauauuguaacuucagaacuugagaggcugaggcaggaggauuauaagauugagucaaaccugggguguguguguguguaugaaaacagauagauagauagauagagagagagacagacaaauagacagacauagcaccugccuccaacagccaaaauaagggccaaaacagauggcucaucaaguaaaggcauuugcuacaggagacucagcgacuugaguacaauccccaaaacucauguaaaaguggaaggagagaacugacucuacagacuugcacucugaccuaaacaugcucauauacacucacacauacacacucacacacacacacauacacacucacacucacauacagacacacacacucacacacauacucauauacacaugcacacccacacucacacauacaagauaggggcuggaaauauggcucaguugguauggugcuugccuagaacacaugaagcccuagguucaauucucagcccauaaacuggaacauagugguacacgccuacaacucaacacuagugagaagaguuaagaggaaucagacauucaaggucauccuugacaugacacagugaguuugaagccagccuggacuauaagagacaccucccaccucgucccacuaaaaauccaaaaugcaggaaaaagaaugggaaaaaacaaacaaacaaccaccaagacucaucccagagugcuugugggcaccgacuucuucugcuuccucugcagggucaagagggcuuccucuggggcugugcaccucacucgguuccccacagaagcgcuuaccucuagaauauaggccagcagcucuggauccugcuguaucuuagagcagaggacacuggugaacugaacuucuuccuuuucugugagggauccagggacugucccuccaagucggagaaguuucugaaggggaagagcacagaggcccagagggauggguguuggaaagggaagcccuccgcccgacgccaucugagcccuugguccucaccugcacaggccugugcacacucagguagugcagcagugggugcugcaccuggcucaggaccuugcugaagaacuggaacaccuguugucgcaugccugggggguacugagacggaacaucccgucagaggccugaaacccuccucugcagcgagccacugggcucagagccuucuucccuuccacacaguguguaaaacagaucuucccuucuugccccaaaccccuuuccugacugagcuccuuucaugacuggguuauuacugagcacggcgcuccaucuguaucugcuggguuuguaucuauggguucguucagccucaggucaaaaguauucagaaacauguacagaccuucuucuuacuaccuaauuacuguagcuccauagguuucauagcauuuauauuuauuaauuauaagcaaccuagagaugacuuaaagguacaggagagccaggcagugguggcgcacgccuuuaaucccagcacucgggaggcagaggcaggcggauuugugaguucgaggccagccuggucuacagagugaguuccaggacagccaaggcuauacagagaagcccugucucaaaaaaaaaaaaaaaaaaaaaaaaaaaaaaaagguacaggugauguaggcuaucuaaaaacacagucuucucuggauaucugugggacaucagcucugggaaucugucuguuaucuaccaaucuguccaucaucucucugucccucucuuucuuucuggagccuaugcaaaauuuuauuuuauuuacuuuauguauguaugugugcacacacacauauaugugccacauugcacaugaggaggucaagggacaacuugccauucucuccuaccauggggaucccaagagcuaaaaucaaguugucaggcuugguggcaagcaccuuucccacugagccaucuugcuggcccucagaucucauuuuauaagugacuugaacagccacagauuuuggaucugagggaaaaaguagcaggguccugggaccaauccccugggauaacaaggacccaguguguguggcuaugcuggcccgcaaucucggcaccaagcaccuugaauagagcccagcgaauggcugagugauggagugaguuauggcaauuagucacgggaauuguuccauuagauggaggagcacugguaggaaagcaugggaugaggguuagacugggguggaaguuuccagaugcccaggagcauugcccaccuccgcuuugcccagagugcacagggucuccaggaucuuguguuguagcaaguauuccagacaggguccagccucaccagaggaugccugcugcuucuccucauacaccaggauguccaacaucugcuucagucgccaggggauaucuguuuucuuggcugggguguuuucaucuaaucgagguuaaggagacacaagggugggugacaggaggagcagcagacccucucaugacaagcccagaagaagucaugccugagaugggcugagugccaccgggaaauggaaguuugcagcugauacuuguauacuuaaaaagacagaguggcaggggauaaggcccuggacacgagcugcuggaugagagugugcucgguccagugugacaucaaguguacagcaacauuuccuauuaaagugaggauagggaccccuuaggagcccacaggaaggcacgaguccauagaagauguuuugagagcucucuaucuauuucaggcuucugugggcagcuacagagcccagugauugcccaggccacguuuuaucagcuuccuuccuagcaucucccagggccuggccuugccccuuuuacauuguggggagucacaggaaagcacagacaaucccugggucagaugggugcugcaccuagguagagaaagguucccagcuggccuuggagcacccccuagcuuuccuuuaaggcaauggcuguuaagcaacgcagcuugcuucacccucucccuggaacucuggucuagagaccacgcuagaaauuaaaggccuagaugcagaaaaaggcccagaucagguggagggcucuuaaaacagcuuucggcugggcuugguggcauagacuguaaucgcagcuucucacgaagcuggcgaggcaggaguauuaaaaguucaaggccagucuagacaaccuaugugaaaucuuguuucaaaauaaaaauuaaaagggcucacaggauguagcucaguggggcauggagauaggaggguugcucuggguucaaccaguucccaauacagagagagaaauagcauaugacuuaguauaaacgacuggcuuccaacuggaaagaaauucuucccccaccccgaagcaucugucaagagaccuuuauggaugucacaguugagagagaugauauuagaaucaaguggggagaagucagaauugcugcucaacagacaacacaauuauuuacccuuccauacaaacagcccugucucaguguccauaugcccagacugaaggaauccuggccuaacagaaaccccaagguccccccacccacccacccagaguugcucaaaggccauuuuaauuucaugggcuggcucaagcuggaaagaaagccucuagaagacauaggcccaaacacagucugaaaucagggggaugaaaagcuaaagauaccggaucugguuaccuggcaaccagguuuacugacuacuaagcacccaaucagauucuguaccucucugcgucauggaguguuggcgcaugaaugcuuuggcccuuugggaugucagucgggagagaaggcacccaagaaugguccaagccuuagcucuccuccuuguacuucuccuuaaaauuuuuuuuacauuuauuuuaugcauaugaguacacuguagcugucuucagacaccagaagagggcaucggaucccauuacagauggcucugagacaccauaugguugcugagaaucgaacucaggaccucuggaaaagcagucagucagugcucuuaacugcugagccaucucuccagcccucaccuuguacuucuuaagguagccauggcaaaaggauuuauuaagcaucuuucuccuuucccaacuuucuaagacaaggugucauguaucccaggguaaccuugaacuucccauccucuugcucccauguccuaggcacuugaugacaggcaugcaccauugccugguuuaagcagugagggcugaaggcugggcaagcauguucagcuacauccaagcccugcugcauuuccuuuaaucaacaguccuagugacaagcacuugggaugaaggccuaaggacugcacccagucaaaaacuaaagcaagcggagucaccuuuaccacugagguccccaaccuccuuguucucacuuaucacucacacagcuccucccccaaaaaggucagaguggggucaacaacuuaaccaugaagaccagcaaccauuagggcuccgggucuuacucccauuugucuguaucucuagcucagcgaugauggcucacgacaguccugguguccagagcccugacaugaccuucccaagauaccuguggucauucucuacccuuucuccccaccucuguccucgggucccaggcugggaagcagcaggcuuaccugugcucucgauauaguagugugugaugccuuuccaauguuccacgaaggccugcagcaggucaaugcugggcucccgcugcagagagagcagacgcggucuuugugggggugccaaccaagggcccacuagcaccagcgcucacaggaacaggcccaugagccugaccagugcccagugaguucuagguccuagaaaaagcauucuguccccaacuucucaaagagaagaguaauucaucucuccaggacucagcagcauagucucccacaugucccuaccccacaggcucuguccccaacaaguaagcaugcugaaggaggaauagacacaaguauuucugcacaguccauaauccauaagcaugcuacaacauagggccugccaucaguacaggaaggggcacaugagaagaaagauaacgagaaugauacacguggaaaucgcauuugaguuccucucuguuggaauccgggaaagccuguguucaaggacauuguaagcucuacuuagacagcuaacacuucuauacccuauaaaggaaaggccuuacuuauagagagcuucagucccagaccgaggucuacaccccuaacucuaggggcuucagacucuguucucugcaagccccucaacucccccucccccaaaguauucucuccauuauugguuggugucagucauaggugcugcaguagagagaaaagcucaccaagaugcuaagccuucauuucugaaugagcagagggguucagccuucucgggaaaaacugacacccagcuaacucacuccaguuacuuuauucaaacuuacaaggcuaacuggggcugggaaagguuccagcuacagaguuauccugcccuuugcugcucccacaggaaucucagucccuuuagaccacgccuagccauaaucaaaaggaagaacuccagguuugccaggaguaccuuaggaacacgguugguggagcugcaagcucucacguagcaccaagugcagauucucuaaagacauuucaagauuuggucucauaacauuuucuaagccucuacuaauugacccaaacauagcaaaggcuuuguugaaacauuuuacucaaaggcauacacauacucaaaggcuuuacuauacauaucucuacgcuccaaccucgcucucuagugggcacuggccuugaaccgagggugauaaacuggccugagaaaaaaacaaaacaaaacaaaacaaacaaacaaacaaccccuucuuuccuuguacaauaaauguuuuuagggagaaaugcagaaaagaaccgacaguggcuucccagcccugacacaaccauaaugcacccuacgccuaagguuugggaaacacugcagaaagggguuaaucaagacaauaugaguuggcaugccaacacagaagaggggaaguucaagaugaaaagcuacagacaguugcuagcugcugagagucugcgaaugucuuccccagggacuaacacccugacagauuauccaauagcagauggucagccccuaaaugugcgcauaugagcaacauaggauggacucagcaagggaggggugugugugugugugugugugugugugugugcacauauaacaauuaaagaagagaucauuagugugaaaggggcuggggacaugggaaaguuuguagggggaagguaagaggucaaaaugaucuaaauacaguaccccuaagaaucugaaaaaaaaaaaaaccaaaacaaaacauuuuuuaaaggaaaaacuaauuguuaccagggcaggaaugcaucaacaguuccuaccauagguguuaacuuccucuaggucucugcucaggccacaguguccugggggccauugcuccuuuacucuugucuaggucuugagauuccuccgugaggucaguguaagggcugggcagcuccguaaaagccuugguaccacagagaaggcaucuucuagaaccagucauuugguguacaucuugugaguaccuucuaggugcaggcugcugugcugugugccacaagcaaucuagcuaacuagaccuccaguaaauaggcugucaccaagaaaagaauacaaaauugcaccccaaaccaguugucucugaggaagcagcagaaguagaaagggacaugguaaagggagucacugcuaggggcuagagcgauggcucagugacgagcacucgacaggagcuggcuucccagaacccacgucagaugcuucacaacuccagccccuuggaucuaacccccucguguagcuuccacgggcaccugcacacauguagccuagauuugcaugcauauauauauauguauauauauauauauauauguauauauauauauauauauauauauauauauauauauaaaauaaaauaagucuugggcuggagagauggcucagcgguuaagagcacugacugcucuuccagagguccugaguucaaaucccaccaacuacaugguggcucacaaccaucuguaaggagaucggaugcccucuucuggugugucuaaaggcagcuacaguguacuuacauauaauauaaaaauaaaucucuuuaaaaaaaaaaagucuuaagaaaagaagagcugcuaauggaucccuuucaagauccuaccaaagaacagaagcuccaaguggaccaaauuucggcagugcaagggggacgggaaagaucugggcagaggguaugaggggaaaggauaugaggagcaugugggucuccaaggccaggucaagaagucuguuuuuguuuuuaaggcugcaaggucgguuacaacuucagaggaguuuuggaaggaucugucugguagugucacacggaagaggagacaaaggaggaagacguuuagguggccauggcaacaguggaguaaggaacaacuaagucagagacuuugaaacucuccccacccuccuugcagacaguaggcuccucuuucaaaaguaauugucaucauguguggugacagcaaaccuuuaauccuaguggucagagggcagaggcaggaagaucucuaugaauucaaggcuagucuggccuacaaaacaaacuacaggauaucaagaacuacaaagagggauccugucucaaaacuagaaagauuagcuuagggucagugacucuuccagaaaggcauuacccacaguccuucaagauacuucaucccaggcugguaagguguccucugaccucagacccaggaucucugaccuccacaugcaugcuguggcacaccccuccccccauccacacuaaacaacuguaauaauaagauacuucacccuaaaggagcaacccaacucaucauauccauuugccacaguuauucaggcucugauagacugugcgcuuccagagggcagggcugcggguuuuuucauuuguuuguuuucuuguuuuuuuuuuuuuuuuuuugauacaggguuucucuguguagcccuggcuguccuggaacuccaucugucagccaggauggccuugaauucagagagcugccugccucuacccccagagugcugggauucaaaguguauguugccaugggccaguuuagggcuguuuuuuuuaaucuggcaaccccagagagcuuuuaccaacucucugaaagcuccugaagacacuccugccauacuuucuuauccuagaaaguccuuggauccucggccagcaccccggugaccucaaagcuucugugaaagggucuuaucuagccuuagauuucaucuguaaguuccaaaaaacuuugugccaggcucagugaaaaagacuacucauagagaugcagggaagggggggggggggaggggacagccaucaaauccuggggcagaugagagcagggcagagcucuccaccugcagcugcuacuagcuaccagaccaaaaaaacuaccaggcaaguuccucuaaacaauagcaauauuuuuuagaaagagacacaaggaucucuacuguuggguccggaaggggcagaaagccguacucugagugguucauauuccacuuggauguuccaaccugagggaagaccaaacuccccagacaguggauggagcugaaaagagauuccuauguggcauaaagcacacuuucugaacauggucuguauguugcacacugcagguaaccugccuaaaaauaugucccuccgcucucuucaucugcagccccuggugcuucagcuuucuguacucagaguguaagcaucaaggacgcuuagggcuguccccacugccaacccuccuugacaauugagcuguguccagaaggaugaauuaguguaucagauugcuuucuaagaugacacuuguuuuuauuugggacaggaaggagaagaaaaggugaaaaggucauuuuggaaacucccucuuggggguacccuaggcccuguuccucacagcagagcuggacaguggggggaggggagguuacagaagugccucccucuccuuuaaccaguucuccuaaggcugagccaauugauaugaacaauagcagccuagcauggugauuucaucccagcacucgggaggcagaggcggguggaucucugaguucgaggccagccuggucuacagagggaguuaaagaauacagggcuacauagagacaaccugucucaaacaaacaaacaccaaacaccaaaaacaaugaagguucugacuggggggggggggggggcgucagaccuaagauuguuucucaggacacaauuugauagacuaaacccaucaauuagacaguguucuuauacaaugagaaaaaaauaauuaacuuuucaaauagcuucuugcaaggcugcugaaugaagugaccagggacaugcacuuccagaaaaaaggggccuaaacacaaacugagagagagagagagagagagagagagagagaggagagagaggagagagagaagguaaaagagagagcgcaagcaagcuagcuuugcauggaaacaacucuuccauucaaagccccuccggcaggcugaagucccuaacucaaggucagcuggcucaguggcuugagauaagccugcagagggcuacuuccggguucucgcgaccacccaccccugcaaaggucucuaucaccuucuuccugggacuuaugucacucagggcugcaacucccaugcuaagagggaacucagugcgggaaccccugcucccaguaguugucuggcagcuaagagaggaaggggaaggcuguugucaaucccaggugaggaggaauggaggaacgucaggaacgagaaaggaaggcugccgggcggaggaggaggcgugggggcagaucugggagaaagggcuggugacaagggaaccuuuggggagagaagaguuacaaagcuagcggaagcucucgaggcacagggaacguuaaagaagccgagcggagcgcaggcucgggggaccgagucgcaggucagggagugggacacaggaagcacaacaggaagcagugcggaggccggaucgagggaucgggacucaggaucaagggagcauggcucaggaucacgagagucgggcuuaggaucagaagagcgaggcgcaagaucgagggagccggucggucuggagagaaccccggagcuaggcgcuccuggcggccgcgacgcgggacuguacccgaagacgaagcccggaagcggcgucggggccaggggaggggcccugcccaaggggcccgcaccucacccgcccgccccccugcccgcgcccgccccuccgguccgaccagggcccggccucaccgcccccacggccuccugcagcagugccccgagccggcucagcaugauggcggcccggcccggcucgcggcccggcucccgguggcggcgcagcgg

SEQ ID NO: 7567 - RNA, 850 nt, Mus musculus
gggagugggacacaggaagcacaacaggaagcagugcggaggccggaucgagggaucgggacucaggaucaagggagcauggcucaggaucacgagagucgggcuuaggaucagaagagcgaggcgcaagaucgagggagccggucggucuggagagaaccccggagcuaggcgcuccuggcggccgcgacgcgggacuguacccgaagacgaagcccggaagcggcgucggggccaggggaggggcccugcccaaggggcccgcaccucacccgcccgccccccugcccgcgcccgccccuccgguccgaccagggcccggccucaccgcccccacggccuccugcagcagugccccgagccggcucagcaugauggcggcccggcccggcucgcggcccggcucccgguggcggcgcagcgguggcggaggaggcggcccaacgggcgggaggcgggacccggcucugaaaccccgccccugccggagggcucgggggcgcucuaagcccagggcugggcagguccugauggagggcgguggggagcacccugggagcugaugaccuaagauuccuuugaguaacacccagagacuucuaauuccucgugcacccucacaauccuaccaacacaguagcccuggacacacacggcucuggaguguuuaaaaugaccuggcccugacaagcugugucaaggacacuccagaaggcaaagacauagugggaagaauugacgacauguuuaaauguaauggauuaggaauauuggaauagguuauggcuaauauuaauuucacccuguuguucaguacuuuuauaaaaaaaaaaaaaaaggucguuauugg

SEQ ID NO: 7568 - RNA, 34790 nt, Mus musculus
guugacacauuguuuuuuuuuuaauuaucagauauuuuuguuguucauugauuucaugacuguaaagucaacucuuguuuucuuuuuucaagacagggucucauauggaccaggauagacucaaacuuacuguguagcugagguugaccuuggacucccaaucuuccuuuccuuaguguugggaucuggcauaugccugguguguccacugcuaacaagagagcccagggcucaugcaugcuaagcaagcgcucugugcugcauucuaagcccucagcuccugacucuaaauggugagguguuuaguaaauaaaaccaaaacaaaagcuucgggaaccaauaaaguugcccagguuuuacaucuuugugucaugagaaggacgcaugaaggacucucccuaaggcuuuguuuuagggggucaagagccucacuuugaaggaaucuaaauucucaggagcuccaaauccuuuaggacuuagugucaaaauuuguccuaccacaaacauuuccagucaaucugaucauauguugcuucccuugguaaccagugaacuuucuacagcgcccggcugugaguucuaaguaaacaggguccgcuuuauaaucacauaguccauguugucugauaacauaugcggaacccaguccugcuuccccuggaaaaauggcuauaucucuccagugcugggcagcuggagauguagcuggcucugcaguagagugcuugccuagcaggcccaagacccuggcuuugaucuccugaaugcccuccccccaaaaugagauaggacacugcccucagccccccaacacacacacacaccacacauauugguuuuaugaagccuuggguuucagguaaaacgcucucucguuuguugggucaaacaaaccuugcucucgcaggucuguuucaaggauaaugcuguaaacauaagccgacuuuacuuaaaaucauuguucauucgggagcugagaauguaggucuuucaggcagagugucuacuuagcacacacaaagccuggguuggcucccuagccccaaaugaagcaggcguaaugguguccaccugucaucucaacacgcaggagguagaagcagagggaggcgauucaaggcagucuucagcuguaaacuccauuccaaugguaagaaaaucauuguuuugaaugguucucaucuauuugcuuuggggccagcugguccucuuccccugugcaagcccaucccgucuucuuuuugaucuuccaaucaaacugcacacucagccccaccuugggcacgcagcuccauagugguugcaggcagaaggcuucaccaaggcagucagaggccaucaaggcaccaaggcaccauuugucccucaguuaccaggucuccguuccugcuuccucugcucagugcuuggcagccaggugguaaccuccugguaacguuuucugcugggcuucccugaugcagaggcaccuuggguccuagggaggccgguguguuugaggucaucuucugaggcucugucaagcucucucuagcuacaaaagauagcuuucugucucauagagccccuggaaagguggcaaguagcagucucucuaggccagcccuugcuccugcguccuagagaggaacgggacuaugguauugucucuaagcccacucuggcucacaugaaaccugaugucaccugucccuaugucucagggcuaguggcuuauaaagaaacaaacguggguuaucaauguggcucaguugguagagcacacaccuagcaagcaagagacccuggguuccauccccagcacggaauaaaccauggcugucaguguauuccagcacuugugaggcagaggcaaggcggaugggaaguucaaccucagauacaaguaaguuugaggccagugugagcuaugugagacaaauaagauccacaaauaugcgauauaugccugugaucccagcacucggaaaggcaaaugcuggaucagggguucaagaccagccuuugcuaugggacaccuuauuucaaacaaaacaacaaaacagaauaaaugaauagauaguucaggcugcuggccuaagccuaugcguccagcuacuugauacugaaccaagaaggccaaaacuuccugggcuacagagugagaggucaggucuagccugggcaacuaaagagguaagacuagcccagcaguagugguacaugcuuuaaucccagcacuugggaggcagaggcaggaggauuucugaguucuaggccagccuggucuacagagugaguuccaggaccgccagggcuauacagagaaacccugucuugaaaaagaaaaaaagaaaaaaaaaagagguaagacaacugguugugguacagugcuugucugauaugcacaggcauggauagaaacaauagauuuagggacccagugcaaccuuuuaauuccaagcaguuaccccucccagcaugaucacacacacaguggacagggagugccagggucuggguaaaaacgaaacccagaccugggcaaaauagauauauauauauguauaauuauauacacguacauauguggacagacaggacuggaagugcaauuagguagggcagggagucagggaagcagcagagggugccccaauaaauuacauucuguagagagcacaguaggagaugcauggcaauggagggaccugggagcugggacucuccaucccaucuuagggaggcugaggccugggcucgguggucccuggacaggugcuagaacggugcauccuaucugguuuugccuggaggcuggugguggugaggcguugugugaacagcgucucugcucuuagccacagcuuugaauaagucuugggucuugagcaagagguuugaagcuuagggguugcaaaguacaggacauacaagcuagagggaggaugaccucccagcuggagguccagguagagccugcuucugccaguuagagaagcaucaggcccaagugcaggaaacugccaggagugcagcuggcuggagccuuuggguggacaggcacagggucccagagcugccgccucccccuguacaggacagcagaccgaccuccccgcuaagcccccuucguuucuccucacugucuucuggggacucucauguggggugacagacagggaacgggugcaaacauugugugcuggaguccgggcuggguuugucuaggcaguagagcccagggaaaugguaaggcccccuggcccaucguggggaaggaaguccacgccucgugacucugggacugugcacuucuuggcucucuccgugaggaauggagcccaacguuucugcccugccucccgcugcucccagccagcagaggaagaggacacuguagggaagggucucacagccccagcuucagggccucgaagcagcagaaggaagguacugucacggacagggcgagccgaaucgagccgagccggcagggaugucagaagagggaagcuuucuucuuaaguucguuccgcuuccacagggccagcuugccaaacuccucgggagacauggcgaagacccuagagaaguccucugcugacaaaugccucuguggggacauggguaacggagugacuuaaggagguagccccuacagccucaaagucaaaggcagccccacgggguggccccucccccaugccacgcaucuuucuuucauaccucaagccucaugcgguccacacccggaggcagcuuaguucuccccuuauuggucaccaccagcaucucauagggauagaucuggaggggcagagaaagcccucuuaggugccuaguccuggguccuccuaacccucgugacuccccuggucccgcugcagaggccacugggguucaugccaucucgccauucaucuccuucggcuucccugcugcccccaccccccaccccgucaucuccaggagcacccugagcgcauucagcuuggugggcuccaccaccccccugaagcccaccccacugugguggucagguccccugcccucaccuucugcuccagcacacagggcagggaguucccccgauccauccucccccucuggcccucuccguucuggggagaccaaagccgcagugagccagagugggucagggggaccuucucaaccuuacccuaggcgucuucagucuucgccaagcaacucgucggcccgugccccccucccccaccaguccccaugccuggcucugguuucccgagcuucuccugcuccccuccagggggcacucaccugcaggccuaaggagacaagagccacgguuuagagacagcuucagaaauugcaccuacaccugaucuuaaaccacugcccacacuggacaucggcucucuauaaagucuguggaggaccgcgucccaacgacgugugaccccauugcucaccugggcucccagccucacuucccgaugggcugaauucuguggacuguagcuaggaaaaugauacacagacaucagaggaagccuucaacagucuccuuuacucugagggcuucccccccgccccagaaucuccaagcgcuuggccacccagaagcaugguggacacacaccaggcagcccugcucgguccuaaggccuuacccggcucagggugguccugccauaggaaggaagcgaagaggauuuagauguucccgaaugcaaggcugaaagagagcaagagagggcccagguuuagucccuugguccugacaguccuuccuaagagagcugccuccacggcuuucccuguccagaaccuagcaaggcuucuacggacuuucacagugacgcuguggcuuuugcugaacguguaucuucccucuccucuccaacuagaagugagccaaaagccuagugugaaccccaggcaacguugaggcucauuucacuucagccaccaugaaguaaguuugagaucuacaaacacaugacagcucuaagugaaaucucgaagguaugacaaugguauuaacagcggucaacuucuagccauuuugacagcacaguucugacacugucaucuuagcacagugaaugcagucaggauaguucccauuugaggcuauguagcugccucaguagguaagagggcuugcucuacaaguaugaagaccugaguuuggauucuaggacacacauaaaaagcagagcauggcuguguacaccuguaaccacagcacuguguggggucgagacagggggaucacugccaguucagcuuccacgucuaguaaggcagagagcaacagugcaggaugcccaauguccucuccuggccuccacuuauaacauaccugaauaguuguuugucuacacuacacacacacacauauacauacacacuuccuauuggcguaacugaagaucauuugcaacuugugccuuuuguaaaucacuaaauuuuuaacacuacuaguuauaauuucagagauuaguuugcaacaagguuuuuuuguuguuuuguuuuuuguuuuaaauccaggggucucaagaucugccugccucagccccccuaagugcugcaaguacagggaugugccauggcgucuagaaacuaacauucccuuugugguuucuugagacaggguuucucuauguagcccuagcuguccuggaacucacuuuguagaucagguuggccucaaacucacaaagaccugccugccuuagccuccugaaugcugggauuaaagguauuuaccaccacacagagacaaaauagaagcuaccauucuuagagugggccagccucaaagcuccuuugucuguaacuaguagaaauggcuggcaucccauugcaguugcuucaacaggcauuuguuaaauguccagcuuacaguucaacaccauaagcaucaggccucuaaagucuaccggaaguucagugccugagaacaaaauagguuuggggaaccugguguuuauucucaauuaaguuuagcaucucuaaacugaaaguucaaaaucugaaauccacucuccccugaauuccaaacuucuucagucuuguugguaggguucucaguuuuggauuuggaaauguugguuucagauuuugcaguuuuggauugggggaggucgucuccaauuugguaaaguuuuuucaaauacucuaaaauccaggaaaugaaacaaaacccucuuuaagucugaaacccuucaaauccuaagcauuuuggauaaggaaugauaagccugaguagggaaugagcagcucucagggcuggggauuggcucggggucgugugcugucagacaagaaccugaguuugggcgaggggagggcaaaagaaagucacugauucucacagucagcgcucauugcugaaguaugcuauguacuaguaauaauuaggagcauuuuuauuuuuauggacagaauuacaaugccaucagguacauauaaacauuuuccaccccaaaucacuuucaggauguaugcuggcuguuuuuaugucaacuugacacuaccuacauucaccugggaaaggggagccucaauucggaaaauguccucaacagacuggccuguggguaaccuauggggacagguucucaacugaugauugaugugggagggcccagcccacuguggguggugcuaccacuaugcagguggucauggauaguauaaaaacacaaaccaggcaagccaggaggagcaguccuccguggccucuucaccaguuccugacuccagguuccugcccugccuucccugaaugauggacuacaagcuguacgacaaaauaaacccuuuccuugccaaguugcuuuugaucguggcauuuuaucaccgcaauggaaacuucaacuaggacagaagguuuguguuugaaagugacgauuccaagguaaugccuguucaugacucugagcuguugagccugaugagaucugucaggaaccugcacaaccacaugacauacauauccauggucuugugccaaaguaaggaaggcacuugacuauuaaaccuuacaaagccaaaagggaagucacagaagcucauuucuuuagcugaauagaagaaucuggaacacugagacuguaucuacccauugggacgguuuuguaauacucuuguucuccaggccucaacuacagacuuuauauucuuuaaaaugcccuuugcaaaucgucucacccaccccaaaccugaguccuggugcucuucaugcauccuagccauggucacuuuaccgcuccuucaguuccggauguggcagcaaaugucuauaaucacagcacuugagaggcaaaggcaggaggacagagaguucaaggccacccucagcaaaacaggaguuugaggcuagcaucaguuaccuaagauugaacauuuaaggcaucuggcauaaugguacaugccuuucaucucaguacuuuauaggcagagauauagaggcauaccuccaaccaaccaaccaaccaaccaaccaaagaagcaaacaaacaagcaacaaccccuaccaaaaacaaacaaaccaacccaacugaagccgaaacaacaacaacaaaaaccaaagcaaauaaauuccaguccuacuacgccucucuguuccagucuucuacacucuuccaaagaguucugcccuggagccaguugccuagcacugcagucccuuagcacccuccuuaccagacacuagccacagaugagcccaucccuccucucuuacucccucagcuaugaauuagcaucaccacaaaggaaagaccuugcgguaguccccguggagaaggucucccauggccgcaucccgagcacacggcuccauuuccuccccaggcuccucagucuagauuuuccuucucuuaaagacaggcucacaauguagcccuugaacacaugggucauggcugagcaugcuagcuaaggcacucacguucugcaggccuggucacccaauuucccuuuccuuucuccaugaguaaucuuuucccauuuccuacacauauuagcugcagacccuccagcuucugguuugccaaugucaguucccaaccauuugcucuacacagauaaagcccugacaccucucucccuuauucacccuucucauggguccuaggauucacuuuaguggauuugaucugagcauuucucacauccauccccucuucucugaaccccaaaggaugugcuauucuuaggauaugguuucagcauauugcaaagcuucaaaaauugugagaaguuaaaaagguauaguaauagggcuggagagauggcucaagggguaaagaaaggcaaaugccuugcaacccugacaauguaaauuugacuccuugaacccacauagaaguagaaaacaauugaaaugacucuacaaaguuguucucugauaucuacccccaacacacauacaucauacacacacacacacacacacacuuuuuuaaaaaaaagauuuauuucucauauguauguaaguaugcuguugcugucuucagguacaccagaagaggguacucaauccaauuacagaugguugugagccaccauguggugguugcugggaauugaacucaggaccucuggaagagcagugggugcucuuagccgcugucuacuccccacccuccaaccccccccccccccacacacacaccuuguuuuguuuuguuuugcuuugcuuugcuuugcuuuguuuuuuguuuuucugagacagguauagcccuggcuguccuggaacucacuuuguagaccagauuggccucaaacucagagauccgccugccucugccucccaagugcugggauuaaaggcaugcgccaccacgcccggccacacacaccuuuuuaaaagguagaaacuuggaacuagagagauggcucaguggcugcucuucuggaugacccccaguucgguucccugcacccacacugcagcucacaaccaugcaguccuaggggaaaucucugugcaugcauccagugcacagacauacaugcagacaaaacagccauaaauaaaacaaauaauguuuaacaggucucacuaugccacucuagaugacuuggaacuccccaucuaggucacgguggcuucgaacucacaaagaucugccuaugucugcuucuaagcaccaggauuaaaggugggcaccaccaaaccaggcucugauaguuuuuguuaguuuguuuguuuaaaugguuuauuuccuuuuuuauauguggguuaguguucugccugcauguaugucugugugagggugucggaucuuuaggaacugaaguuauacaggaggaggaagaggagaaggaagaggaauugucucaggguuaagggcaaacccuaugugagaugccaugugggggcugggaauugaaccuggguucucuagaaaagaagccagugcucuuaacugcugaguuaucucuccagcccugcuccaaaagguuuuuagugugaaacagagucuauuaaguugucuaggcuacauucauacucaauuugagccuugguaggccuuaaacuuuuuucucuuccuuccuuccuuccuuccuuccuuccuuccuuccuuccuuccuuaugucuucaagacagggucucuccuuguagcccuggcuguccuggggcucucuauguaggacaggcccgucuuaaacucagagagauccaccugucucugccuacaaaguacugggauuaaaggcaugcaccacuaugcccagaugccuuaaauguuuaauucucuugcuucagucugcugagcagcucagauuacaggccugcuccacaggucuagccacauauuucauacagcgacagaaggcugacuaauauguacaucuacaagccagcuuggaagauuguuuccagagaugaccuguaacucucuccauauaccuugcuuccuuuuugcaaugaaaccuuguaauuccuugaaucugggacagaaccuauuccaccuugagucuaguuucauuucuagaaaaccuacauuuuuguuauuguuguugauuuggagauagugucugugguaguuugaauaagaaucaucgcccuauaggccccauauauuugaaugcuuaguccccagagaguggcucuguugaaaaggauuagaagaauuaggaggcauggccuuguuagaggaagugugucaauggaggugagcuuuugagguuucaaaagcccaugcuaggccuagguguucgcuuuucucugccuuuggaucaggauguagcucucggccacugcuccagugucaugagugucaccauguucccugccaugaugauaauagaguaagccucagaaaauguaacccagcuccaauuaaaugcuuucuuugauuaguugcuuuguucauggugccuccucacagcaacagaacggugauuaagauagggucuuuuauuuuuuccuccccagcccaggcuagacuccuaguuuugggauuaaacuugugccaccuugccagcuuuggugccuugacuaauggaaugcaaaaacagugacccgucauggcucccaaggucaggucuuaagaguucucaugccucucccuuggggugcuuagcucugucccucccaucuccagcuaccaggcucuagggaaguccagacuaguugggguugcucagaggcccagaacucaaggcccccuucacccaccgcaugcuacucggugcccaugcucucugugcugccacacuagcucaagcucccggccuuugcucccacgcuguccuugacaucuggaaggaccuucugcaccauuuauuugccucuucuaagacuuaggggaggcuagagagguggcucagugauuaaaaucacuggcuguuauuccagaggaccuggguucaauucccagcaccugugguagcucacaacugucuguagcuccaggggaucugacacacucacugacacauguaaguaagcaaaacaccaaugcacauuaaauaaauaaauaaauaaauaaauaaauaaauaaauaaaugguuaaagaaaauacuuaggggagccuaccaggccuccucacuggccuuucaaagcacucguugauacucuguccccauugccugccacacugcucaaaagucacacggauuuacacauuacuuuccccuuggcuggaggaaauggcuguaucuuucacucacaaugaccccagugcuuagcaugucccucaguaaguguccauuaaaugaagucaaggcucucacgcugcuuguaccaggaaucucuaccuguucuggcuaucagggcauauuuuugcccuaaaggaguacaccugugggccucacccccagacugagccuuuaaguauaaugguucaauagccacacacacauccguccaccccacacccaccccuggccagaugacccggagcacacuccacagcacucacagguauggaaggguguccggucaggcagagagcguguuuuccuccggaugggcaaugacuuuuccaucucuucuuucaagaucaucuuucccaaguuggaaguaaccuguuuggggguagaggagaauggugcccagccgaagacaccagauucccaucucugaaaagugcaaacuugggauucaaagcaggaggguuagcgauggcuuucccagguggcugguccacaccuggagcccguugaucuuacugggcacucaagcaaauuguuugcugaagauguucagugguagccuuccacuguggcuucucuauucuaggucaccaugucaagagcacaaccaauggccuucccaagacuccuuauucucucuccuccccuaggccagccugcugaaaccgggugcuggugcaccccucucuuuccugugcucuggaucuuaauguccaggaccacuguuccaaaagcagccuaaagcacaggacuccugguaaagaagaggcaccucccaccaggucaaaugcagauguuucuauggcacuagccuuuuagacuggcucuggggacagaauauuuaucaccuagauggcaugaggguggcggggguggggaggggcaagaugcuaccuuacugagcuccucuuucugccguucccugauggccuuaaucuccucuucagagucaucgucuuccucuuccuccucuuccucugcccccuuucgagaugccuuccguuuccuccauucugucucuaggagauagaggccccagaaacaauguggccacucagccaugggcuucuccagcuuguggaacagggcuggaacaaagucugucugucugccuuucuuucuuucuuccuuccuuucuuucuuucuuucuuucuuucuuucuuucuuuacaccuugagucuaguuucauuucuagaaaaccuacauuuuuguuauuguuguugauuuggagauagugucugugguaguuugaauaagaaucaucccccuauaggccccauauauuugaaugcuuaguccccagaaaauucauaaacuggauaagaaacacauauuuaaauucccuggagaguaagacccuucucucauuuacuucucuuuuccaaaucuccuaucacagggucuggcuauagcaagaacuugagagauguccauuaagugacaggagcuagagagauggcuaagugguuaaggccaugcacuguucuuccagaggaccugaguuccauuugcaacccgcacggggugccuucacagcccccuguaacuuugccuugggccuccuaggcacugcacuuccaugcacauacccucccacacacauacacacauguacauauaguucaaaucaaauaaaaccuuaaaaaauaauaaugagggcuggagagauggcucagugguuaagagcacugacugcucuuccagagguccuggguucaguucccagcaaccacaugguggcucacaaccaucuguaauaggauccgaugcccucuucuggugugucugaagaguacaccaguguacucacauacauaaaauaaauaaaacaaaucuuuaaaaaaauaauaaugagggcuggcgagauggcucagcgauuaagaacaccgacugcucuucugaagguccugaguucaaaucccagcaaccacaugguggcucacaaccauccauaaugagaucugaugcccucuucuggaauaucugaagacaguuacagugugcuuacauauaauaaauaaauaaaucuuaaaaaagaaauaauaaugagggccaggcguggugggccaugccuuuaaccccagcacucuggaggcagaggcagauggaccucugaguuuaggcuagccugguguacaaagugaguucuaggauagccagggcuguuacacagggaaacccugacucaaaaaaccaaaugaugaugauggugguggugguaaugauaaugagcaagaggagaagaaauggugaccaggcugugcacaguaacacaaagaaguacaggggagagguaagaaaugaacugucaauaggggaaaguacaaaagacugagaagaaacaaacaggcuugaggugggcugggacuggguucaccgggccaagaaagagaagugaacggggacccuuggccuccucuccuuuccccggguuuuccuacccacaacggccagcgacgggggacauggccaguagucagucucuaucuuggcuggcugguuggggucagggggcugcgcugcaggaaacuuggaggauucgaugaugagguccucgaugaggugcuugcucugagggcugccucccacggauucugcagacagauccagggucaguccacacaccuaccaccccugcuaaccacgcagccacccucagcuccagcucugucaccucuccuucacacccacggagaacucagcugauccacgggagagagccccgggccuuacaggccuggagaagcuuuucuuccaucccuucccggcucucagcaccaccccaccgcgaugugccaggagaagcacggaggaagucaggggaacccucaccucucuguuuguagauggguggcuucuuguagauguuggaauccgggcggguagucucugagagacagaacaagaucagcugagaaaggggacacgaugacaggggugguggcucugggcacaaaauggagguaaaaugaacagggccauaagcucagaccacaccuugugaaggcagggacuuccugcacuuuucuggguaggugagaagagauagcaagaccacuaucaccgcuaguucugccuggcauccuaguaccguaggguccagcuagaucuaaacccaaagaguagggaccagagaguaaggggucuggggguccugaaggagaauugaagucccaaggaaagaacguagcuaggcugauaauaaaaccuaccagggugguggaaguggggcaggcugguccugggggucccugugguccuugggguugaagccugagagaugauuccaagaguccggcucuccgcccacaccuaugcagaaguaugcagccuguagccuacaccccauaccccuucccacucccaugugcauggcuuuaccucaggcuaccuuucccauccuccuacaccagcguccccacuucccaaccccagggcaaugucacgggcagaggaagcacauuccaggacuccaucugcccgcucagggugccuacccagagaaaaaggguuaaagagagucccugggucuggcagacagaugaguuggccagggaccaaccagccaggauuugcugacucuaucauccccuggacuuugcugggcuggggcuaggcauguugggggagggggcugagggcccaaacaaagcaggacgaaagccaacugaccucuggagacggugggggggauguggauuugggugacagugagcacugugaacggagagaaugaucagagucacagguagguuuaaacccuagacccucagagggaccauuucacccccaucuacgcagcuuccccuacuguccuaaccaaccugcuucccucuggagucccugccaaucucuggccuggccuucauccuucuucugcccaguauucucucugucuuuucaugugaagcuuggauaugggaacagugugccucgugcccuguacuaaguaugacccugguggcagagccugguaaggaauggagggaccaaagccacagagcagcucuggaagagucagaucuccugggccacucgguacucaaguuuuccagggugacagcuguucacuccaauaugaccucuuuuguuuccuaaaauucaaauuguauuguuuugauauuuacuuugcgugagugugggcacgcacaugccacagcacauguguggagggcaggggacagcuuccagggcucaguucuuuccuucuaccauugguucugggaucccacuuaagucagccggcuuacaugcauccaagugcuuucaccugcggagccaccuggccacaccuuacuuuaauagucucucucucucucucucucucucucucucucucucucucucucucucucucucagacaagguuucacuauguagccuuuugcccacuacacagaccacuuucuuucuuucuuucugagacaaaguuucacucuguagcccuuugcccacuacacagaccaggcuggcuuccaaacccuggagaucugcuugccuuugccucugcauacagggaucaaagguaagcaucgccaugaccaugaccccuuccuugaagacaggugacaaagcaccugaccaagcauugccccauauacugcuuucugagguucauaagaagaaccagcucuucuaugugacagagggcaaacugaggcuaaaauguuuccccucucccuugccuagaauuucuggagcuguuucuguguauuuuguucucccagccuuucccuauaggaccucuccccaugucaccacuguccagcugggggcugaacagugcucacuccugcgcauagccugugccugccuccaaggaggacugccaggaagauccccgcucagcuccccucacgccugcacacgugaucccuucucaccucccggcuucugggcagcucuacauguuccaggagggaauagguaaaguggggcucauagaucaugaggucaggucgcucaauguccaggauggccuuguccuuggggauggcagccagauccuuguagcccaacaccugguuguccaucuuggccugaagggaaaugguccaaauggaagaguuccccauagcaucacuaggacacuggacucacuggcuggacuuaguuaucagaaaaacauguuauucaucaauucucuuauuagcagcucuauucuguuccuucuaaggaccuaaaauaagugcuuauuuuaauuucugagacagcauuucaucuaguuaaggcuugccucaaacccucucuauagcugcaucuggccuugaacuuccuuacuucccaaacgcugggacuauagggacuuaggccccuuaaaaaaaaaaaaaaaaaaaaaaaaaagcucugugccucugaggcucucugcaacuagaccagcccuucccaagacagccuccgcugggaucucugggucuuuccaccugcaagaguucacaggaccucccuccaugccggagggggagacaggagggggggcggggagggguagugaaggggauccgccccucccuccucccagcugaggugcagguggccaacauaaguacucaccacgaugcuggagggagagccgggcacacuggagucucuggaggagcugacgcuccccggggagguaagagguugcuggagagagcgagaagguggcggagugggcaugcgcgugggugcgagggugugggagugggucuugcccuaggccucaggaugggguggggugggguggggaaacccggcgugcuacguggagguggccaccagguggcgccggcgacucuagcacggaccugggagagcagcgguccccacccuggcccggggugcaagccgcucaccuucugcagacguuccaugcggcagccacuggccggccgcucccucgggggccggugcgcacuuggagaggacagacgucaggcucggcccggcuccugcagcgagggcgucacagcgcucugugguguccucaucccuugggccucucugggcugcugaccgcggguggcuggaaggacagugagccccaguaagggcguuaggcugucagguuccgcggcgcugaguucagccccagggaguugugcgugcauguggccaggcgguggcugcgugagucggcugcacuuguuuuuucagccauuguucucuggcuucagaggaaaugacggcaggggucagcuggcaucccaggguggacagacggcuauauccucaagcuugucaccccugcccuggcccugcucuggcccgggcccucucccaaguggugcuggccccucccacuccagccacugguuucacuccccagaguuugcucagccaaaucuuuauuuuccccagaagguuaacacggggacauugagucauuagcuaagacuggaagcacagggagccagaggcccgaggaagaaaacccacggggaucgguugggguggugaagcuaugggcaugaccaagagcugcugguggucccccccgaagcuagcgagcgcacuugccuuuucuguucccuacaggcaggcaguaugcuauguagacacuguaaaauaccucugccaccacaaagugcccagagcauucucaggggcugucacacugcucuaugagggcugcuuggucaccuuucacacugucugucccuaggauaggccagucuauguacuaggugauggcuacaguccauguccucuccuucuuggccacgcccucagcucuccuccuuucccuucucccaguccucagccacagacugaggagagcuguguacagaagggaaaggaggaugguguggugguuucaagcaagaccucucaagccgggaugccugccuggccuuaagcagugacuauuacuccgaugugguggguaagucauuuacacucugcacauccuagcacuugggaggcugacgcaggaggauugcuuugaauuccaggcuagcauggguuacauagagaguuccaaucagcuuugaauuuugaaaccuugucuaaagcauuuuugaaaccuugucauaggcugcucagacaagucaauaauaguauuuauuuacuuaucuuuauguguaugaguguguugucagacuguuaugucugugugucacaugcaugccugcuguucauggaguccagaagagggcaucggauccccuggaacuggaguuacagaugaguggccaugugaauguuaagaaccaaaccuggguccucugaaagagcagacaaugcucuuaacuacugagcugucucuccagccccaaagaaguagcuaaguuagugcauacacggugaauaaaacaugcucuauuucauguagaggguaagcuauuaauaguauuucuaucuccccagggauuaaugaauugagggggcuuuuucuguagccagucaugaaagaaugaagccccugcuuuguuucucucuuucuggggggcaaaaccauguccucuuaagucuccccaccucucuucuccucacaggguugcacugcacugcccuggccaaccucaaauucucaguccuucuaccucaggccaggcucccauaggcugggauaagaggcgugcugcaaaaaaaaaaaaaaaaaaaaaaaaaaaaaaaaaaaaaaauaagggcuggugagauggcucaguggguaagagcacccgacugcucuuccgaagguccggaguucaaaucccagcaaccacaugguggcucacaaccaucuguaacaagaucugacucccucuucuggagugucugaagacagcuacaguguacuuacauauaauaaauaaauaaaucuuaaaaaaaaaaaaaaaaagaggcgugcugcaugaccaugcccggcucugccaaucuuuuucaucuguauguuaccucuaccauuccgcugcccgugucucaccaaaagccguccuuaucccacuucuaaaccucggccuacaucuacucccuuccguccaccccugggccucccucagaccucucauucuccuagauccacauggaagccuuugccgccauccuguccuagugccuccugcuagugcuaacccuuagcugaaaagcaaacuuuguggagaaggugauacuuaaugcuggaugcgguucuucagccauggaaugccuugcucccugaaacgaacuggccacugacuucccagcgggcaacugugacaccccagcuaucaccgauagacacauuuaccuucugaacuagagacugugugugugcacucaugaaaugcccggagcuugaauuuagugugcucuucuccugagccacagacucugucuucuauuuuuuguuuugauuuauuuauuuauuauuuauuuuuauuuugagacaggguccgaguuaguuacucgggcuggcuuuggaauacucuaugauccaggcaggccuuuuagcuugugauucuuuccugcuuccgcucucaaauagcugugcuagcuacuguaugcuggauacaggucaacaacuacaacuauucuaaugcguucuuacaagaguucugcaggcuagaccaauuucacagcugcggaaacccaggcuuagggagacuaagguccaguccaaggucaacuaacucaagugaaauaaaugccuuuggcauggcauggugcagagugucugcccaguaaugugccaugugagucuuuuuagaguucuagaaccagaggugaaaucuguggagguguacgccuuuaauccuagaacucaggacacagaggcagaggcaggcagauuucugaguucgagaccagccuggucuacaaagugaguuccaggacagccaggccuacacagagaaacccugucuugaaacaaaacaaaacaaaacaaaacaaaacaaaacaaaacaaaacaagaauucuagccgguugugguggcccaugccuuuaaucccagcacucaggaggcagaggcaggcagauuucugaguucgaggccagccuggucuaccaagugaguuccaggacagccagggcuauacagagaaacccugucucgaaaaaccaaaaaaaacaaaaacaaaaacaaaaaacaagaauucuagcaccaaggcaucuccaucagacugccaggaggaauguggaguuugugauaacaggauucuccuucuagaguaucaggcuucuccagccuucucacugcugaugugaaaugcuuaaacuaggugucugaugagcaacaugcgcugugguacacacugaagggcugucagugcucucucacuaggcccugaauuuuacucugcuaauagccauugucccaaggucuauacccauggcuuagcccuagaagcgaacacuuguccccccauccacccaucucccaccauguaguagauaugcuucuggcuuucccacccauccacguuggagcaucucuuccccacggaacacaguaccaagcuuugugcccccaagccucauggagaacagaucggugaacgaaaggacugauuccggcccuccaggaagaacucgcucauagauaaguucuacacaaaguggagaggcacacaccccagauaaggcagcgggcugcagaaagucaggaaagggugucucuggaggaauggagaaguuuuuuuguuggaggccuuaaagcagugguucucaaccucccuagugcuuccuaaauagacccuuucuuuaauacaguuccucacgcuguaacccuaaauccuaaaguuauuuucauugcuacuucauaacugcaauuuugcuacuguuaugaauuguaauauaaauaucugauaugcagauaguuuuaggugaccccugugaaagggucgucugaccccaaaaggaggucaugccccacagaccuagagguaggggucuaaaugugaaauugcuagcagggaaagaaagucgaaugccaucccaggacccacuuugggguggggaggggucaguacaucacaugaaguauggaauaaacgcugaagggaagggaagaccagcaaagccagaggccagaggaagugaggaggcucccagagaagugagggaagaaggccacguccacgggaggaauggagcuucugcaaaguccuggguuugaggcugcagcaggguggcugacagggaacaaaggauugucagcaccggggcgggcgggagggccagcggaggacaggcucuggagaaaacacuugcuucucacugagaaggggaaggaccggaaguuggguuguaacagaacagggcacagggaggcagcuggucagagggccucuccguuuuaccaggaaggcggccuagagcgcaggggagcuguaaugggcauucuggagagcaaagaccgacaggaggaauaauguucuagcaccucacccagaacaccaggcguggggcgcuucacggagcaaaggguccccgggguuguggccagacaugaaagccaugguuacauaugaacaagcaccagcaugccuacacacagccgccacucaggaacccgauugcaaacaccaguggacagaguuauauaauaguugauauuuacagacuaucaugauugacuguggacuccggauuucacgguccugccuuucacccucaccacgccgucucaguccugugaacuguucccucaguuguagcauggguugcauguagcguggugaaaugagacuucaguaaguacugggucaagggcacacuuaagcucacugaccacaguaccacuucagguugaguuauugugcuccucugucccuuccccuugccaggcccuccacagcugggcccugccugaggcgcccccacagcacuaguggggcuccccaggcuccaucuggguccugcaucccugugugguaccagagcacacaaaucagcgccuuuugggaaagugcuaaaaggcagagccuuagggacauuugcauuugaaugaaagguuuuagcagugggugcuuuguugguuuguuuuagauaagaguuuucacuguagcccaggcuggucuccaacuacuuaaucccaaccuaggaugaccuucaacuucaccucuggaaagcccgaaccuuuggcgcuaccuagccuggcuucacuuggucguggggaucagcccaggggcgucaugcacaccaggcacuagguaacuaaacuauaaccccgggcuaugaauaagguucuugcuggggacauuugaggcugucagaaggccagcaggggaaaccauuuuuuuggaguggaagacgagaaaggaaagaugggagugggugggaaggagguguguggggagggagggugauuuuucagcuuccguuuagucacacugcacaggcaucugccuaccgcacccacgugaaguccccucacccaagcuaauuucucacauuccuccuccgggccugaucccucuccauccuccgucauggccccgcuuacuucauucagaacacuccccaaguucuguaacuucuguggauacggacuaaaaggucaggcugcagcaggaagggaaggggaaagaaggggagggguggggguacggcaccauagaggaagccaguccaggugucggaagacccccuucaaccucccaggcucaggucaauagccagcaggcuucccauccuuccaucucagccgcacccaccuucagcuggccgccccagccuuaucugagccaccagccaggccccaccucaaaccacccacccucucauuuccacggcaaccagagcuuugcagcuccccaggauaugggugauaagacuugcccacagggaucuccagguuggcaccuacccaucccaggcagggauggauccagauuaaaagcccuggacuuggagaaaugaaauguagaaaguucagcaggcacagagauccaccaucucaggugggggucuaguccagcccuuguuuccauccgaagccaccgcuacuuucuacuuaacacauuggcauuuuguucccuuacagaugagaacaaaaaagaacuaagaggugagcuuacccagggccacccaaaagaaggcaagcuggaugaaauuccaaccgggcugaauuuaagccaaaggaauuuccuaucuuuccaaugcauccccaaagauuccauuuuaauaugaacuugggucucucuaccucucaccugacccguacagcaggagcugggagucaggauugggugagaguguaggaucuggcccugggacaacugagcaucgucaagccaugcuggagaguuaguucaugaguuaacaggccugccaugugggcuaggucaggcaggugggaggcccauucucugccucuguuuccuucagugucucugucuuucuuccugccuuccuuuucccuucuucuucuuuucucccucucccucucccccucccagccccacuugcacaguugcuguggcaacaacaacgcaaugccagaaauaaagacaggcuccagcuaggucacccguucccaaaacagcauccuagggugggagaagggugguguagucaauagggcgggaacugggcgcgcacuacagugaauguguguauuguaggguggggugagacacgggacagcaggguuugggccugcuuaggccaguggcucaucaaaagccuuacuuaagucaaguuuaucccuggccuuuucucaggccaccaaggcccuguuacuuucucuucucuuguuuucucucucucucucucuuucucucucucucucucucucucgcucaugcaaaugcuuucugauccuuuuccuauugcuuuggacuaugcauuccucauaccaacucugaaugacaccugucccauugaacaagaucaggcagcuucaggaguagauaacggaguccgucuguuccaggaccugccuacccacucucagugacaagagugcuccuuucccuuugacccccccuccugccucccuccccugcaaacaugccugagcucauuagaguuuucuuagguuccccucuugaccgaguuaguggccauuucugugcucuuuccucagaagagguaaguuucucuuuucuagcuaggucccuccacugcucaggcuugcuuuguccaaacacguuccuuauagaucugaguccugagguauauauagcuggaucggcagaucuggggaggagaggaaacucccacccuaaauccagauucuagaauucaggagagguccccauuccacucuccccacacgugagcucugaaagaauucugcagacauugcccaccaguggguagacagaugcucuccuagccucagaaagaccaacuagcuguauggagacaagacucccaggagcauacaugcagaagacagaagagcucugcccaacacauggcugcugacagaacugcacaugggugcacacagggacucugccgcccuccuugccagagcacucgcccacucucccugccagacccccacacaaugacacauggugcuaaggacaccuacuugcacccacccacugauccuccccuuggcacccgucaucugugcucacagcucccuggcauggccugcugaacccaucccuguucugagcacgugaaccccaauacucccagugcccucaccugacccauccccacaucccuccacucccacugcaccguugccuugcuugucuuagaccuacagccuggcaaccagucuucugggaggagacgcacaggugugccugcccagcaaaggaguauggcgugucuggugccgagaaaggaaucccuuaggacccccggggcucuccagguuuauucagcacccagucucucucaguacacuagcugcucgcaggcagagagccaggcuaagcucugcagucacacccugcuacacagccucauucuucgacgaaucccuacccuaaccaggcuaaccucagcuaggaggggcuccagagugggcuggaaaccagcggcuuuggcccccucaauggaccccugccacuccagagggcaccuggccuggcgggagggaggcugccaaagaugucuugcaucauucagcaaaaagcuaacagcucccuccacagacugugccccaugcucccaccccuugaaauucuggccacagaagcuuggggggggggguguccaugaaagggaaugcuggggcccauauggacucuuugcacggcaacagccuagauccuuccucccaaauaaaaagggaguuugaucgggucaaacccagcugagcaccuugucuggccaccuaggccuauucucccacugaccauuuuccaaagcugacccuguccuagcaucucugauaucacccaaaaccauggccagauccagagguacagcccaaaauaccuacguaaagaaagagaggcaaaagacccugucaccuaccuccucccagacaguggggcccaggcucucugaagccccaggaagcaaaaggcuaggcccuggucgacuggguggccgcguuuucucaggaaucuagguaagaggcagcuucuccaggaacccagccgcgcuuuacgaagcacaaauaacaggaagaaagccggcuuaggguggguggguggggugggagcuggcgaaggaggggagcuggucucagcucagcggucugaucucccuccugaacccccacccgcuucaccaguccccugcugcucugcaagccaccggcuuggguucccggagcuggggaguccgagucuggugucuggugggcgggcaggacgaggagcggucucugggcgggcgggccccgggccccuccccaccaacaacugauaguggcgggccccagggugugugagugugugcguuugggcguguugcugguccaguucaucucagcugcugcugcugcagcugauccauuucaaacaaggggcucauucgcuggcaucaugacgaagcagaaucggcugcgcugcguuuucccccuuucccauaucccggcucugcaauauccacacucagagccucuccagcagaguucaaguuagcggcuguuacugauaacugaggggagcuaugcccacccggcucuccaagaaccugcaauucaaaccccauucauaaugcuccaccaucuuccagaagcagaugagaggcucugugggggauccccccaccucugggacagggaacagcaggggcacccgaauuggccauccaaacauuaacccucucugaggaggacagauagaaggauggaaggaaccaggucauaaauacaucagauucagauuggauuuucuguaaacuugauccccuggggaucguaguaggggccagggagagaaugaaggaccgauuuuucccaggaaagcuguuuuugcaaaaggaagcuuucuaucagauggcauccauauuccaaagagacaugccuucucucuguggcaaaacuucaaccauuccaggccuccaauguuggcuuuggggugcaucuagaaagccuagcccucuaaccccuauuagcacuaacuggccucuuccccaccuccaugucggcugcagacuugccuaccuaggcagccuugccguugcccugguaaccacugcccacagccggucagcugaugauagcagcagcuauuggggcaaagcuaggaucuggagagggggcucugggguuucugaauggaaaaaaaaaucucagggggaggggcuugaaggagacagguaagacuauggccucagcauccgaccgaccgaccgaccgaccgaccgucuucaaagaaaagaggacuggaggagacaggaagggagggguguaucuggaguagcagaggacagggacgacuguaaccugaagguggcuugggcagaaggagaaaugacagaaggcagguagcugaguggccgugaaagggggaaggaggaccgggaauccaggcuuagcugcugggaugcagccacugugggcccuguggaaggggcagacaaacagaaacaaaaccaaacaaacaaaaccccaccugggcuaggggagggacauccagucccaaggagaucugcgugggguauaccuuuaauguguaggaaggggacacagccuuggaggaggagcuaccaguccuucuccauagcuagcccuguccucagccuagccucucacugucccuucaaccccacccuugccggccagccugcccgccccagucugggucugaaagagugguggggagggaggccuacuccuaagcauuccccaucccucuggaagaccaaggacccagggaucugacacucggcaggcccuucagauuccugacucugcuccugccuaguuuccucaucccuugauuagcagucccuuccagaccccacuccaggagacauguuuuccaguauaagggucuccagagguaugcugggaacgagaugaugucagaaaggagagcuguagacaggaguguagaaugagguggguuaagagcccuggguaggagucaaagauccaggaggggcgucccugccugacggaagaaaucagccuaugaggcaggggaagagagaguccagggaaagggccaggaggaggggagcaugaaggaggguucucaguaccuucaagggcccggggcguggggcaggaacacagcagccucugcggugacauacaccuccaucccucagcgcaucuccucuccgccucccguugccaagacaaccuccuggcagcccaggcccagcucagcagcgaugggagggggaggagaaaacgcaacuccuauugcuucuuccucagggaagggagggggccugcagagccuauaaugccccuaacuguaccauaccaaggugugcccgccucccacucccuccuaagccaggauaggcuacaggagugcucuggagggaaccguaauucagggccagacaacaggcuggauggcaagaggacugccuuauuccaggcagcccauccgguagguggggaaaggugaaagggacacaggauucacagcccuggugucaaaaaaccacauuccagaaggucacuggcugggcuggacauguggccaugggcuucuaccucuaccuggguaccucuuucaaguccccaaccucccccuaccuagacaaaagucugaguccaagagagccucuucuagucucucuaggcccaaauccacuccuccacaccucagucacacagugcuuggcaaugcccccaacccccaucagccagacaucuccggcaggcaggaauaguucuagagcccaguuggcccaggagccaagaggcccagggaguuagagcucccccuaucguccgcauguugucaaggucauccguugcuaggaggaaugugguguggagguggggaugagugcauggugagggaugguggagguuagcugggccaggagacccuucucuugauagccccauucucugaucaucucuguccugcaguccugcccuaucuguggagaacaggguucccuccagcccaguccuccaaggcccaacuuccuuuggaaguccagauaaucugaguuuccuuuucugccccucuuuccucccugucauacaaaucuucucccccgggagcuggcaacacuaacccugggugccgguugacucugacccuaggugagcuucguccauacccucaaccaaccggcaaggaggccucccucagacaggacagguauaccuuuggaagcucucgggucuugcgaguucacauuagcaaucccagcagaggauggucacucuccccucuggaagaaagaagguuccaggcccagacuucugggcuacuucugggcuucguucuccauaaaggucacuggugccacaguuccugagaggacuguggcccaggcagcaggcgucucuguccaugucucacuccagugcccaggccccaccccuugcaccgaccuguuggggaaggguaacaccaggggugccccugugcugucuaaauauuaacuccuggaaagguugagccuggacauugcaaaggaaggagagagcacaaggacccaggccugagaaagaaaaggagggugaaggcccaaaguagccaguuuaggguggguguggcaucauauguccguaaucucaacacuugggaggcugaggcagaaggaucgcugugaauuuaaggccagcccaggcuacccagcuugauuucaaauaaauaaguaaacaaacaaacaaauaaauaaauggaauaagaaaaggagagguagccgggagugguagugcacgccucuaaucccagcacucgggaggcagaggcaggcggauuucugaguucaaggccagccuggucuacaaaguggguuccaggacagccagggcuacacagagaaacccugucucaaaaaaccaaaaaaaaaaaaaaaaaaaaaaaaaaaaaaaaaaaaagaaaaaaagaaaaaagagagagagagaaaaaggaaagaaaaacaagaacaaauaauuuaaaaagugacuuucucagcagagacugaaagcaacuuccucuuccugcuagagcaguggucuucaaccguccuaaggcugugaccuuuuaauacagauccuuucguuguggugagcccccaaucauagaauuauuuucauugcuacuucaugacuguaauuuugcuaguguuaugaaucuuguaauguaaauaaauaucugugcuuuccaauggucuuaggugacuucugggaaaagguuacucgaccccccaagggucacacaauccacaaguggaggacugaagagcuagaaacuguucucuuaucuucuaagaccccagggauguagcgcuggaacaccgaguuugucacucacuucucagagacccuuuagucucuuccuugcugcacacagcagcaaaaccaaccuucauacuuugacccgacauuccagcuaauuuucccguaagcucucagcuccagccauacugggcuugggcagggagcacugaguuccugcagacagcaaggauccugacugcaggacucccuugggugagaauaguucucacagcaugacuaagucaguucaugugagccugccugcaugugugcugccuggcagagcucuagaguucaguugcuuaguuccaaaacuuuuguccuuuugagacuccauagcgcagccucaaagguccaccacccaguccuuucuaagccuccuaaguguugguguuaaagacacgaguaggaugcccagcuugauuuccaaaacuucugaucuacuauucggugaucuuuuucuuuuuaagagagagucucauuauauaaguagccuagguuggccuugaacuugaaauacucaugccucaaaucccugauucccaagugauugaauuacaggcuugugcuaccacaccuggaugcucuuuuaucuuaauuuuaagaaggagagagaauuccaaaaauugaaugaaagaaccaugcuuuuauggguuaaucucuccaauuaaauucaagggucccgaaagcuccaucuucuccaacauuuuaauuaaccggaggaucagcacaguaccgaagggaggaaaugaauacuuaauucaaaguaacuguagacagagucuacccaagggcucuggcuucccauccugucugcauuguggcagacagacagacagacggcauagugcuggggauuggccagacaagagcacaggaggcagguggaccucagaacugagagaugcaguggcccacaccugggauccuagcaccugggggccugagucaggaaacccgcggcacaugugaagucagccugggcuguguagugaggucuaggacaaugugcccuucagaguaaaaccuugucucaugagacuguauguguguaugugcauauguuguguguacaggcauggagagugacagaggaagacaccugacuaaccucagccucugaucuguuauacagcaugcacgcacacaugcacacacaaaaauaaaacaacaaaaaccaaggggcuaaaaagauggcucagcggggcuggagagauggcucagugguuaaggguacggacugcuuuuccagagauccugaauuuaauucucagcaaccacaugguggcucacaaccaucuguaaugggguguggugcccucuucuggugugccugaagagagcaauggugguguaagcauaugcacaaaauaaauaaauaaaucuucacagccgggcgugguagcacacaccuuuaaucucagcacucaggaggcagaggcaggcagauuucugaguucaaggccagccuggucuacaaagugaguuccaggauagccagggcuauacagagaaacccugucucgaaaaacaaaaaaaaaacaaaaaaacaaaaacaaaaaaaaaaagauggcucagcauugaagagcacuugcuguucuuugggaggacuuaaguucagcucccagcacccauuucaagugguucacccugcccgugacucuaacuucaggguaucuagcccccacuucuauuuucugaaggaaccaggcacacaguggugcacagacauacaugcagacaaaacacauaaaacaaacauaauuuuaucaaaaaacaaaacaaaaccaaaaaaccaaaacaaaaacaaaaacagggccaucgagcuaacucagcagguaaagacacucacuggcugucaagccugaagcccugaauuugauggcugggacccacauaaagguggaauaagagcaccaacuccagcuguucuucacgugaaugcuguggaaaguguguccacacauauaccaugcauacacacacacaauaguaaaauaagcaaaacagaggguguguguguguguguguucuuguuuugcuagugucuauaaaagcuucacauggagguuugaacacagugcuaguggggagccucacagacguguguguuuggcgaguaagaggaugcacagauguggcuaggcagacgcuucauuuuacagacccacaggaggucugccaaggagccuugccaaagcaguguacgcaagggaguggcagcugaggggugcccauggcuuccaaggugacaacacucagaagagaaaaccacagaaagacuuagagagggcuagagagauggcucagugguuaagagcacugacugcucuuccaaagguccugaguucaauucccagcaacccaaauguccacuacccaguccuuucuaaguauagagccaccuuuucuccucccccacucccuccugaccagaaguuuuggaaaucaagcugggcauuggacucaugucugcaugguagcucacaaccacccguaaugagaucugacgcccucuucuggugcaucugaagacagcuacaguguacucacauauaauaauaaauaaauaaaucuuaaaaaaaaaaagacuuagagagguuucuacagggacagggcagcgaagucagggaagacagccuauugcaggcuaaggcgaagacuggaacaagauucuagcuugguaaguguggagggggugggggcgggcuggcuacuagcauccacuggacauuguugaacaaugugacuuaaguagaaccagcuguguggcaucggaagugacuggacaucguuccugacuaccuugcaucugauccucuggagaggauggcgaaggaacggacagaggcagcauggaguacuguggaguaacacuacaucacaggacuggggucaggucucccuggauggguucaucuggcccccuauagcaagaagccauugucagagagucuguuugcaagucucuggggcugcucaaguauaugauaugauaugauaugauaugauaugauaugauaugauaugauaugauauuaucaagaagccacuuuccugucacaaauuccuauguuaauauccaaugucccucacccccccccccccccagggacccauuccuuuuaaccugcuccauuuguaguuuuuuuuuuuuuucuuuuuguauuuaauuauuugggcagggucucagucuucuugucuuagcuucgagaggaccaggauugcauggguaagccaccacguuuggcucugccuucuccauuguuuuuuccugucaaaccuguccagaaggcugugggaugugaaaagcuaccuaggguagggagccugccugcugggcagacacacugagagguguggugaggaguggguugugggcccaacuccggaugggauggguggaagauccucugagaugcccuggcuuccuguauaauccugcucucccaagcugcucuucacucuuuggcauacauacucugucccugccugccaggccucaccucaaaaaagcaagaaaggaaacagugagggcuuucuggagcuggccccaagaggcuugucugugcuggggaggucaaagagggagggaggggccgagaaaggccugagaagaaagccggggccagacaaagggcccaauccaccuuugaagcugucuccagcccaagagggaggguggggggugggccaaggcccggcuggaaaggcagucuagagucuuaaagaaugucucaaauuccugcaauaaucggagggaucagaccccccccccucuccucagaguccucccagccccccaaagucccaauacuccacaccuugggggcccaacucuuuguccucaaguaauugcuggguguugccccaguuuuaaagucccauugaacucuccaguuaucaacugcagcccuagaccacccgcccuacacacaccccagaaaacuaccccccacacguccggcggucuucacugggauuaaggcucuuugugauggggggacagaaaaaaaagcaaccuggugaaagcaauuaugacgagcuggaaggagaaugucaguccuuaggcccucggaaccucccucuuggcuguugucggcuccaccuucuaaauggcccaggguuggggguuggggggcggugucaggcuccgucccagcucugaguugguucugucugcugcagcccaccuccgguucggacuauaucagugcccucgcccuacaacuucuguucuggacuuuuugaaguaguucuuaggagaaguggaaggagauuagcuuuuaucucuuuucaucuugcuucauaauucuccucucccacguuuuucuuaaacgggaaaccuaggcugaggauuccaucagcacuagaagaguacugagaggagggucccagacacaagaaccucuuccccuugacaagauuaaaagacgaagcaccaugggaaaggugguuuuaugguuuccaccccuaggcgcaccuggaagucucugggaaagcccacccgagaagcucggugggggcugggcgcccuccuccuccauucccagccugcaaccgcuucuaauugaggcuugcccucaggugugcccccgccuccgccccuagggggacgggggaaagaacaaggggacacauucuugcccccacccgcuuccgcucgccccagaccuccucccacucccagcccagcucaccggaaaaaagcaaucuugcucccugcgaggugacuucuggcguccccaggcugugauccugccaccccccuccucccccgggccugggccccacaggacgcccgucccugccagcggccgcucagggccgcgccuagggguuggguuuucuucucuccuacagguagcagagacgcgucgcgugagccuggacaucggagcccgcggagggaggggccgccauccccccc

SEQ ID NO: 7569 - RNA, 34790 nt, Mus musculus
gggggggauggcggccccucccuccgcgggcuccgauguccaggcucacgcgacgcgucucugcuaccuguaggagagaagaaaacccaaccccuaggcgcggcccugagcggccgcuggcagggacgggcguccuguggggcccaggcccgggggaggagggggguggcaggaucacagccuggggacgccagaagucaccucgcagggagcaagauugcuuuuuuccggugagcugggcugggagugggaggaggucuggggcgagcggaagcgggugggggcaagaauguguccccuuguucuuucccccgucccccuaggggcggaggcgggggcacaccugagggcaagccucaauuagaagcgguugcaggcugggaauggaggaggagggcgcccagcccccaccgagcuucucgggugggcuuucccagagacuuccaggugcgccuagggguggaaaccauaaaaccaccuuucccauggugcuucgucuuuuaaucuugucaaggggaagagguucuugugucugggacccuccucucaguacucuucuagugcugauggaauccucagccuagguuucccguuuaagaaaaacgugggagaggagaauuaugaagcaagaugaaaagagauaaaagcuaaucuccuuccacuucuccuaagaacuacuucaaaaaguccagaacagaaguuguagggcgagggcacugauauaguccgaaccggaggugggcugcagcagacagaaccaacucagagcugggacggagccugacaccgccccccaacccccaacccugggccauuuagaagguggagccgacaacagccaagagggagguuccgagggccuaaggacugacauucuccuuccagcucgucauaauugcuuucaccagguugcuuuuuuuucuguccccccaucacaaagagccuuaaucccagugaagaccgccggacgugugggggguaguuuucugggguguguguagggcggguggucuagggcugcaguugauaacuggagaguucaaugggacuuuaaaacuggggcaacacccagcaauuacuugaggacaaagaguugggcccccaagguguggaguauugggacuuuggggggcugggaggacucugaggagaggggggggggucugaucccuccgauuauugcaggaauuugagacauucuuuaagacucuagacugccuuuccagccgggccuuggcccaccccccacccucccucuugggcuggagacagcuucaaagguggauugggcccuuugucuggccccggcuuucuucucaggccuuucucggccccucccucccucuuugaccuccccagcacagacaagccucuuggggccagcuccagaaagcccucacuguuuccuuucuugcuuuuuugaggugaggccuggcaggcagggacagaguauguaugccaaagagugaagagcagcuugggagagcaggauuauacaggaagccagggcaucucagaggaucuuccacccaucccauccggaguugggcccacaacccacuccucaccacaccucucagugugucugcccagcaggcaggcucccuacccuagguagcuuuucacaucccacagccuucuggacagguuugacaggaaaaaacaauggagaaggcagagccaaacgugguggcuuacccaugcaauccugguccucucgaagcuaagacaagaagacugagacccugcccaaauaauuaaauacaaaaagaaaaaaaaaaaaaacuacaaauggagcagguuaaaaggaaugggucccugggggggggggggggugagggacauuggauauuaacauaggaauuugugacaggaaaguggcuucuugauaauaucauaucauaucauaucauaucauaucauaucauaucauaucauaucauauacuugagcagccccagagacuugcaaacagacucucugacaauggcuucuugcuauagggggccagaugaacccauccagggagaccugaccccaguccugugauguaguguuacuccacaguacuccaugcugccucuguccguuccuucgccauccucuccagaggaucagaugcaagguagucaggaacgauguccagucacuuccgaugccacacagcugguucuacuuaagucacauuguucaacaauguccaguggaugcuaguagccagcccgcccccacccccuccacacuuaccaagcuagaaucuuguuccagucuucgccuuagccugcaauaggcugucuucccugacuucgcugcccugucccuguagaaaccucucuaagucuuuuuuuuuuuaagauuuauuuauuuauuauuauaugugaguacacuguagcugucuucagaugcaccagaagagggcgucagaucucauuacgggugguugugagcuaccaugcagacaugaguccaaugcccagcuugauuuccaaaacuucuggucaggagggagugggggaggagaaaagguggcucuauacuuagaaaggacuggguaguggacauuuggguugcugggaauugaacucaggaccuuuggaagagcagucagugcucuuaaccacugagccaucucucuagcccucucuaagucuuucugugguuuucucuucugaguguugucaccuuggaagccaugggcaccccucagcugccacucccuugcguacacugcuuuggcaaggcuccuuggcagaccuccugugggucuguaaaaugaagcgucugccuagccacaucugugcauccucuuacucgccaaacacacacgucugugaggcuccccacuagcacuguguucaaaccuccaugugaagcuuuuauagacacuagcaaaacaagaacacacacacacacacacccucuguuuugcuuauuuuacuauuguguguguguaugcaugguauauguguggacacacuuuccacagcauucacgugaagaacagcuggaguuggugcucuuauuccaccuuuaugugggucccagccaucaaauucagggcuucaggcuugacagccagugagugucuuuaccugcugaguuagcucgauggcccuguuuuuguuuuuguuuugguuuuuugguuuuguuuuguuuuuugauaaaauuauguuuguuuuauguguuuugucugcauguaugucugugcaccacugugugccugguuccuucagaaaauagaagugggggcuagauacccugaaguuagagucacgggcagggugaaccacuugaaaugggugcugggagcugaacuuaaguccucccaaagaacagcaagugcucuucaaugcugagccaucuuuuuuuuuuuguuuuuguuuuuuuguuuuuuuuuuguuuuucgagacaggguuucucuguauagcccuggcuauccuggaacucacuuuguagaccaggcuggccuugaacucagaaaucugccugccucugccuccugagugcugagauuaaaggugugugcuaccacgcccggcugugaagauuuauuuauuuauuuugugcauaugcuuacaccaccauugcucucuucaggcacaccagaagagggcaccacaccccauuacagaugguugugagccaccaugugguugcugagaauuaaauucaggaucucuggaaaagcaguccguacccuuaaccacugagccaucucuccagccccgcugagccaucuuuuuagccccuugguuuuuguuguuuuauuuuugugugugcaugugugcgugcaugcuguauaacagaucagaggcugagguuagucaggugucuuccucugucacucuccaugccuguacacacaacauaugcacauacacacauacagucucaugagacaagguuuuacucugaagggcacauuguccuagaccucacuacacagcccaggcugacuucacaugugccgcggguuuccugacucaggcccccaggugcuaggaucccaggugugggccacugcaucucucaguucugagguccaccugccuccugugcucuugucuggccaauccccagcacuaugccgucugucugucugucugccacaaugcagacaggaugggaagccagagcccuuggguagacucugucuacaguuacuuugaauuaaguauucauuuccucccuucgguacugugcugauccuccgguuaauuaaaauguuggagaagauggagcuuucgggacccuugaauuuaauuggagagauuaacccauaaaagcaugguucuuucauucaauuuuuggaauucucucuccuucuuaaaauuaagauaaaagagcauccaggugugguagcacaagccuguaauucaaucacuugggaaucagggauuugaggcaugaguauuucaaguucaaggccaaccuaggcuacuuauauaaugagacucucucuuaaaaagaaaaagaucaccgaauaguagaucagaaguuuuggaaaucaagcugggcauccuacucgugucuuuaacaccaacacuuaggaggcuuagaaaggacugggugguggaccuuugaggcugcgcuauggagucucaaaaggacaaaaguuuuggaacuaagcaacugaacucuagagcucugccaggcagcacacaugcaggcaggcucacaugaacugacuuagucaugcugugagaacuauucucacccaagggaguccugcagucaggauccuugcugucugcaggaacucagugcucccugcccaagcccaguauggcuggagcugagagcuuacgggaaaauuagcuggaaugucgggucaaaguaugaagguugguuuugcugcugugugcagcaaggaagagacuaaagggucucugagaagugagugacaaacucgguguuccagcgcuacaucccuggggucuuagaagauaagagaacaguuucuagcucuucaguccuccacuuguggauugugugacccuuggggggucgaguaaccuuuucccagaagucaccuaagaccauuggaaagcacagauauuuauuuacauuacaagauucauaacacuagcaaaauuacagucaugaaguagcaaugaaaauaauucuaugauugggggcucaccacaacgaaaggaucuguauuaaaaggucacagccuuaggacgguugaagaccacugcucuagcaggaagaggaaguugcuuucagucucugcugagaaagucacuuuuuaaauuauuuguucuuguuuuucuuuccuuuuucucucucucucuuuuuucuuuuuuucuuuuuuuuuuuuuuuuuuuuuuuuuuuuuuuuuuuuugguuuuuugagacaggguuucucuguguagcccuggcuguccuggaacccacuuuguagaccaggcuggccuugaacucagaaauccgccugccucugccucccgagugcugggauuagaggcgugcacuaccacucccggcuaccucuccuuuucuuauuccauuuauuuauuuguuuguuuguuuacuuauuuauuugaaaucaagcuggguagccugggcuggccuuaaauucacagcgauccuucugccucagccucccaaguguugagauuacggacauaugaugccacacccacccuaaacuggcuacuuugggccuucacccuccuuuucuuucucaggccuggguccuugugcucucuccuuccuuugcaauguccaggcucaaccuuuccaggaguuaauauuuagacagcacaggggcaccccugguguuacccuuccccaacaggucggugcaagggguggggccugggcacuggagugagacauggacagagacgccugcugccugggccacaguccucucaggaacuguggcaccagugaccuuuauggagaacgaagcccagaaguagcccagaagucugggccuggaaccuucuuucuuccagaggggagagugaccauccucugcugggauugcuaaugugaacucgcaagacccgagagcuuccaaagguauaccuguccugucugagggaggccuccuugccgguugguugaggguauggacgaagcucaccuagggucagagucaaccggcacccaggguuaguguugccagcucccgggggagaagauuuguaugacagggaggaaagaggggcagaaaaggaaacucagauuaucuggacuuccaaaggaaguugggccuuggaggacugggcuggagggaacccuguucuccacagauagggcaggacugcaggacagagaugaucagagaauggggcuaucaagagaagggucuccuggcccagcuaaccuccaccaucccucaccaugcacucauccccaccuccacaccacauuccuccuagcaacggaugaccuugacaacaugcggacgauagggggagcucuaacucccugggccucuuggcuccugggccaacugggcucuagaacuauuccugccugccggagaugucuggcugauggggguugggggcauugccaagcacugugugacugagguguggaggaguggauuugggccuagagagacuagaagaggcucucuuggacucagacuuuugucuagguagggggagguuggggacuugaaagagguacccagguagagguagaagcccauggccacauguccagcccagccagugaccuucuggaaugugguuuuuugacaccagggcugugaauccugugucccuuucaccuuuccccaccuaccggaugggcugccuggaauaaggcaguccucuugccauccagccuguugucuggcccugaauuacgguucccuccagagcacuccuguagccuauccuggcuuaggagggagugggaggcgggcacaccuugguaugguacaguuaggggcauuauaggcucugcaggcccccucccuucccugaggaagaagcaauaggaguugcguuuucuccucccccucccaucgcugcugagcugggccugggcugccaggagguugucuuggcaacgggaggcggagaggagaugcgcugagggauggagguguaugucaccgcagaggcugcuguguuccugccccacgccccgggcccuugaagguacugagaacccuccuucaugcuccccuccuccuggcccuuucccuggacucucucuuccccugccucauaggcugauuucuuccgucaggcagggacgccccuccuggaucuuugacuccuacccagggcucuuaacccaccucauucuacacuccugucuacagcucuccuuucugacaucaucucguucccagcauaccucuggagacccuuauacuggaaaacaugucuccuggaguggggucuggaagggacugcuaaucaagggaugaggaaacuaggcaggagcagagucaggaaucugaagggccugccgagugucagaucccuggguccuuggucuuccagagggauggggaaugcuuaggaguaggccucccuccccaccacucuuucagacccagacuggggcgggcaggcuggccggcaagggugggguugaagggacagugagaggcuaggcugaggacagggcuagcuauggagaaggacugguagcuccuccuccaaggcuguguccccuuccuacacauuaaagguauaccccacgcagaucuccuugggacuggaugucccuccccuagcccaggugggguuuuguuuguuugguuuuguuucuguuugucugccccuuccacagggcccacaguggcugcaucccagcagcuaagccuggauucccgguccuccuucccccuuucacggccacucagcuaccugccuucugucauuucuccuucugcccaagccaccuucagguuacagucgucccuguccucugcuacuccagauacaccccucccuuccugucuccuccaguccucuuuucuuugaagacggucggucggucggucggucggucggaugcugaggccauagucuuaccugucuccuucaagccccucccccugagauuuuuuuuuccauucagaaaccccagagcccccucuccagauccuagcuuugccccaauagcugcugcuaucaucagcugaccggcugugggcagugguuaccagggcaacggcaaggcugccuagguaggcaagucugcagccgacauggagguggggaagaggccaguuagugcuaauagggguuagagggcuaggcuuucuagaugcaccccaaagccaacauuggaggccuggaaugguugaaguuuugccacagagagaaggcaugucucuuuggaauauggaugccaucugauagaaagcuuccuuuugcaaaaacagcuuuccugggaaaaaucgguccuucauucucucccuggccccuacuacgauccccaggggaucaaguuuacagaaaauccaaucugaaucugauguauuuaugaccugguuccuuccauccuucuaucuguccuccucagagaggguuaauguuuggauggccaauucgggugccccugcuguucccugucccagagguggggggaucccccacagagccucucaucugcuucuggaagaugguggagcauuaugaaugggguuugaauugcagguucuuggagagccgggugggcauagcuccccucaguuaucaguaacagccgcuaacuugaacucugcuggagaggcucugaguguggauauugcagagccgggauaugggaaagggggaaaacgcagcgcagccgauucugcuucgucaugaugccagcgaaugagccccuuguuugaaauggaucagcugcagcagcagcagcugagaugaacuggaccagcaacacgcccaaacgcacacacucacacacccuggggcccgccacuaucaguuguugguggggaggggcccggggcccgcccgcccagagaccgcuccucguccugcccgcccaccagacaccagacucggacuccccagcuccgggaacccaagccgguggcuugcagagcagcaggggacuggugaagcggguggggguucaggagggagaucagaccgcugagcugagaccagcuccccuccuucgccagcucccaccccacccacccacccuaagccggcuuucuuccuguuauuugugcuucguaaagcgcggcuggguuccuggagaagcugccucuuaccuagauuccugagaaaacgcggccacccagucgaccagggccuagccuuuugcuuccuggggcuucagagagccugggccccacugucugggaggagguaggugacagggucuuuugccucucuuucuuuacguagguauuuugggcuguaccucuggaucuggccaugguuuugggugauaucagagaugcuaggacagggucagcuuuggaaaauggucagugggagaauaggccuagguggccagacaaggugcucagcuggguuugacccgaucaaacucccuuuuuauuugggaggaaggaucuaggcuguugccgugcaaagaguccauaugggccccagcauucccuuucauggacacccccccccccaagcuucuguggccagaauuucaaggggugggagcauggggcacagucuguggagggagcuguuagcuuuuugcugaaugaugcaagacaucuuuggcagccucccucccgccaggccaggugcccucuggaguggcagggguccauugagggggccaaagccgcugguuuccagcccacucuggagccccuccuagcugagguuagccugguuaggguagggauucgucgaagaaugaggcuguguagcagggugugacugcagagcuuagccuggcucucugccugcgagcagcuaguguacugagagagacugggugcugaauaaaccuggagagccccggggguccuaagggauuccuuucucggcaccagacacgccauacuccuuugcugggcaggcacaccugugcgucuccucccagaagacugguugccaggcuguaggucuaagacaagcaaggcaacggugcagugggaguggagggauguggggaugggucaggugagggcacugggaguauugggguucacgugcucagaacagggauggguucagcaggccaugccagggagcugugagcacagaugacgggugccaaggggaggaucagugggugggugcaaguagguguccuuagcaccaugugucauugugugggggucuggcagggagagugggcgagugcucuggcaaggagggcggcagagucccugugugcacccaugugcaguucugucagcagccauguguugggcagagcucuucugucuucugcauguaugcuccugggagucuugucuccauacagcuaguuggucuuucugaggcuaggagagcaucugucuacccacuggugggcaaugucugcagaauucuuucagagcucacguguggggagaguggaauggggaccucuccugaauucuagaaucuggauuuagggugggaguuuccucuccuccccagaucugccgauccagcuauauauaccucaggacucagaucuauaaggaacguguuuggacaaagcaagccugagcaguggagggaccuagcuagaaaagagaaacuuaccucuucugaggaaagagcacagaaauggccacuaacucggucaagaggggaaccuaagaaaacucuaaugagcucaggcauguuugcaggggagggaggcaggagggggggucaaagggaaaggagcacucuugucacugagaguggguaggcagguccuggaacagacggacuccguuaucuacuccugaagcugccugaucuuguucaaugggacaggugucauucagaguugguaugaggaaugcauaguccaaagcaauaggaaaaggaucagaaagcauuugcaugagcgagagagagagagagagagagaaagagagagagagagagaaaacaagagaagagaaaguaacagggccuugguggccugagaaaaggccagggauaaacuugacuuaaguaaggcuuuugaugagccacuggccuaagcaggcccaaacccugcugucccgugucucaccccacccuacaauacacacauucacuguagugcgcgcccaguucccgcccuauugacuacaccacccuucucccacccuaggaugcuguuuugggaacgggugaccuagcuggagccugucuuuauuucuggcauugcguuguuguugccacagcaacugugcaaguggggcugggagggggagagggagagggagaaaagaagaagaagggaaaaggaaggcaggaagaaagacagagacacugaaggaaacagaggcagagaaugggccucccaccugccugaccuagcccacauggcaggccuguuaacucaugaacuaacucuccagcauggcuugacgaugcucaguugucccagggccagauccuacacucucacccaauccugacucccagcuccugcuguacgggucaggugagagguagagagacccaaguucauauuaaaauggaaucuuuggggaugcauuggaaagauaggaaauuccuuuggcuuaaauucagcccgguuggaauuucauccagcuugccuucuuuuggguggcccuggguaagcucaccucuuaguucuuuuuuguucucaucuguaagggaacaaaaugccaauguguuaaguagaaaguagcgguggcuucggauggaaacaagggcuggacuagacccccaccugagaugguggaucucugugccugcugaacuuucuacauuucauuucuccaaguccagggcuuuuaaucuggauccaucccugccugggauggguaggugccaaccuggagaucccugugggcaagucuuaucacccauauccuggggagcugcaaagcucugguugccguggaaaugagagggugggugguuugagguggggccuggcugguggcucagauaaggcuggggcggccagcugaaggugggugcggcugagauggaaggaugggaagccugcuggcuauugaccugagccugggagguugaagggggucuuccgacaccuggacuggcuuccucuauggugccguacccccaccccuccccuucuuuccccuucccuuccugcugcagccugaccuuuuaguccguauccacagaaguuacagaacuuggggaguguucugaaugaaguaagcggggccaugacggaggauggagagggaucaggcccggaggaggaaugugagaaauuagcuugggugaggggacuucacgugggugcgguaggcagaugccugugcagugugacuaaacggaagcugaaaaaucacccucccuccccacacaccuccuucccacccacucccaucuuuccuuucucgucuuccacuccaaaaaaaugguuuccccugcuggccuucugacagccucaaauguccccagcaagaaccuuauucauagcccgggguuauaguuuaguuaccuagugccuggugugcaugacgccccugggcugauccccacgaccaagugaagccaggcuagguagcgccaaagguucgggcuuuccagaggugaaguugaaggucauccuagguugggauuaaguaguuggagaccagccugggcuacagugaaaacucuuaucuaaaacaaaccaacaaagcacccacugcuaaaaccuuucauucaaaugcaaaugucccuaaggcucugccuuuuagcacuuucccaaaaggcgcugauuugugugcucugguaccacacagggaugcaggacccagauggagccuggggagccccacuagugcugugggggcgccucaggcagggcccagcuguggagggccuggcaaggggaagggacagaggagcacaauaacucaaccugaagugguacuguggucagugagcuuaagugugcccuugacccaguacuuacugaagucucauuucaccacgcuacaugcaacccaugcuacaacugagggaacaguucacaggacugagacggcguggugagggugaaaggcaggaccgugaaauccggaguccacagucaaucaugauagucuguaaauaucaacuauuauauaacucuguccacugguguuugcaaucggguuccugaguggcggcuguguguaggcaugcuggugcuuguucauauguaaccauggcuuucaugucuggccacaaccccggggacccuuugcuccgugaagcgccccacgccugguguucugggugaggugcuagaacauuauuccuccugucggucuuugcucuccagaaugcccauuacagcuccccugcgcucuaggccgccuuccugguaaaacggagaggcccucugaccagcugccucccugugcccuguucuguuacaacccaacuuccgguccuuccccuucucagugagaagcaaguguuuucuccagagccuguccuccgcuggcccucccgcccgccccggugcugacaauccuuuguucccugucagccacccugcugcagccucaaacccaggacuuugcagaagcuccauuccucccguggacguggccuucuucccucacuucucugggagccuccucacuuccucuggccucuggcuuugcuggucuucccuucccuucagcguuuauuccauacuucaugugauguacugaccccuccccaccccaaaguggguccugggauggcauucgacuuucuuucccugcuagcaauuucacauuuagaccccuaccucuaggucuguggggcaugaccuccuuuuggggucagacgacccuuucacaggggucaccuaaaacuaucugcauaucagauauuuauauuacaauucauaacaguagcaaaauugcaguuaugaaguagcaaugaaaauaacuuuaggauuuaggguuacagcgugaggaacuguauuaaagaaagggucuauuuaggaagcacuagggagguugagaaccacugcuuuaaggccuccaacaaaaaaacuucuccauuccuccagagacacccuuuccugacuuucugcagcccgcugccuuaucuggggugugugccucuccacuuuguguagaacuuaucuaugagcgaguucuuccuggagggccggaaucaguccuuucguucaccgaucuguucuccaugaggcuugggggcacaaagcuugguacuguguuccguggggaagagaugcuccaacguggaugggugggaaagccagaagcauaucuacuacauggugggagauggguggauggggggacaaguguucgcuucuagggcuaagccauggguauagaccuugggacaauggcuauuagcagaguaaaauucagggccuagugagagagcacugacagcccuucaguguguaccacagcgcauguugcucaucagacaccuaguuuaagcauuucacaucagcagugagaaggcuggagaagccugauacucuagaaggagaauccuguuaucacaaacuccacauuccuccuggcagucugauggagaugccuuggugcuagaauucuuguuuuuuguuuuuguuuuuguuuuuuuugguuuuucgagacaggguuucucuguauagcccuggcuguccuggaacucacuugguagaccaggcuggccucgaacucagaaaucugccugccucugccuccugagugcugggauuaaaggcaugggccaccacaaccggcuagaauucuuguuuuguuuuguuuuguuuuguuuuguuuuguuuuguuuuguuucaagacaggguuucucuguguaggccuggcuguccuggaacucacuuuguagaccaggcuggucucgaacucagaaaucugccugccucugccucuguguccugaguucuaggauuaaaggcguacaccuccacagauuucaccucugguucuagaacucuaaaaagacucacauggcacauuacugggcagacacucugcaccaugccaugccaaaggcauuuauuucacuugaguuaguugaccuuggacuggaccuuagucucccuaagccuggguuuccgcagcugugaaauuggucuagccugcagaacucuuguaagaacgcauuagaauaguuguaguuguugaccuguauccagcauacaguagcuagcacagcuauuugagagcggaagcaggaaagaaucacaagcuaaaaggccugccuggaucauagaguauuccaaagccagcccgaguaacuaacucggacccugucucaaaauaaaaauaaauaauaaauaaauaaaucaaaacaaaaaauagaagacagagucuguggcucaggagaagagcacacuaaauucaagcuccgggcauuucaugagugcacacacacagucucuaguucagaagguaaaugugucuaucggugauagcuggggugucacaguugcccgcugggaagucaguggccaguucguuucagggagcaaggcauuccauggcugaagaaccgcauccagcauuaaguaucaccuucuccacaaaguuugcuuuucagcuaaggguuagcacuagcaggaggcacuaggacaggauggcggcaaaggcuuccauguggaucuaggagaaugagaggucugagggaggcccagggguggacggaagggaguagauguaggccgagguuuagaagugggauaaggacggcuuuuggugagacacgggcagcggaaugguagagguaacauacagaugaaaaagauuggcagagccgggcauggucaugcagcacgccucuuuuuuuuuuuuuuuuuaagauuuauuuauuuauuauauguaaguacacuguagcugucuucagacacuccagaagagggagucagaucuuguuacagaugguugugagccaccaugugguugcugggauuugaacuccggaccuucggaagagcagucgggugcucuuacccacugagccaucucaccagcccuuauuuuuuuuuuuuuuuuuuuuuuuuuuuuuuuuuuuuuuugcagcacgccucuuaucccagccuaugggagccuggccugagguagaaggacugagaauuugagguuggccagggcagugcagugcaacccugugaggagaagagagguggggagacuuaagaggacaugguuuugccccccagaaagagagaaacaaagcaggggcuucauucuuucaugacuggcuacagaaaaagcccccucaauucauuaaucccuggggagauagaaauacuauuaauagcuuacccucuacaugaaauagagcauguuuuauucaccguguaugcacuaacuuagcuacuucuuuggggcuggagagacagcucaguaguuaagagcauugucugcucuuucagaggacccagguuugguucuuaacauucacauggccacucaucuguaacuccaguuccaggggauccgaugcccucuucuggacuccaugaacagcaggcaugcaugugacacacagacauaacagucugacaacacacucauacacauaaagauaaguaaauaaauacuauuauugacuugucugagcagccuaugacaagguuucaaaaaugcuuuagacaagguuucaaaauucaaagcugauuggaacucucuauguaacccaugcuagccuggaauucaaagcaauccuccugcgucagccucccaagugcuaggaugugcagaguguaaaugacuuacccaccacaucggaguaauagucacugcuuaaggccaggcaggcaucccggcuugagaggucuugcuugaaaccaccacaccauccuccuuucccuucuguacacagcucuccucagucuguggcugaggacugggagaagggaaaggaggagagcugagggcguggccaagaaggagaggacauggacuguagccaucaccuaguacauagacuggccuauccuagggacagacagugugaaaggugaccaagcagcccucauagagcagugugacagccccugagaaugcucugggcacuuugugguggcagagguauuuuacagugucuacauagcauacugccugccuguagggaacagaaaaggcaagugcgcucgcuagcuucgggggggaccaccagcagcucuuggucaugcccauagcuucaccaccccaaccgauccccguggguuuucuuccucgggccucuggcucccugugcuuccagucuuagcuaaugacucaauguccccguguuaaccuucuggggaaaauaaagauuuggcugagcaaacucuggggagugaaaccaguggcuggagugggaggggccagcaccacuugggagagggcccgggccagagcagggccagggcaggggugacaagcuugaggauauagccgucuguccacccugggaugccagcugaccccugccgucauuuccucugaagccagagaacaauggcugaaaaaacaagugcagccgacucacgcagccaccgccuggccacaugcacgcacaacucccuggggcugaacucagcgccgcggaaccugacagccuaacgcccuuacuggggcucacuguccuuccagccacccgcggucagcagcccagagaggcccaagggaugaggacaccacagagcgcugugacgcccucgcugcaggagccgggccgagccugacgucuguccucuccaagugcgcaccggcccccgagggagcggccggccaguggcugccgcauggaacgucugcagaaggugagcggcuugcaccccgggccaggguggggaccgcugcucucccagguccgugcuagagucgccggcgccaccugguggccaccuccacguagcacgccggguuuccccaccccaccccaccccauccugaggccuagggcaagacccacucccacacccucgcacccacgcgcaugcccacuccgccaccuucucgcucucuccagcaaccucuuaccuccccggggagcgucagcuccuccagagacuccagugugcccggcucucccuccagcaucguggugaguacuuauguuggccaccugcaccucagcugggaggagggaggggcggauccccuucacuaccccuccccgcccccccuccugucucccccuccggcauggagggagguccugugaacucuugcagguggaaagacccagagaucccagcggaggcugucuugggaagggcuggucuaguugcagagagccucagaggcacagagcuuuuuuuuuuuuuuuuuuuuuuuuuuaaggggccuaagucccuauagucccagcguuugggaaguaaggaaguucaaggccagaugcagcuauagagaggguuugaggcaagccuuaacuagaugaaaugcugucucagaaauuaaaauaagcacuuauuuuagguccuuagaaggaacagaauagagcugcuaauaagagaauugaugaauaacauguuuuucugauaacuaaguccagccagugaguccaguguccuagugaugcuauggggaacucuuccauuuggaccauuucccuucaggccaagauggacaaccagguguugggcuacaaggaucuggcugccauccccaaggacaaggccauccuggacauugagcgaccugaccucaugaucuaugagccccacuuuaccuauucccuccuggaacauguagagcugcccagaagccgggaggugagaagggaucacgugugcaggcgugaggggagcugagcggggaucuuccuggcaguccuccuuggaggcaggcacaggcuaugcgcaggagugagcacuguucagcccccagcuggacaguggugacauggggagagguccuauagggaaaggcugggagaacaaaauacacagaaacagcuccagaaauucuaggcaagggagaggggaaacauuuuagccucaguuugcccucugucacauagaagagcugguucuucuuaugaaccucagaaagcaguauauggggcaaugcuuggucaggugcuuugucaccugucuucaaggaaggggucauggucauggcgaugcuuaccuuugaucccuguaugcagaggcaaaggcaagcagaucuccaggguuuggaagccagccuggucuguguagugggcaaagggcuacagagugaaacuuugucucagaaagaaagaaagaaaguggucuguguagugggcaaaaggcuacauagugaaaccuugucugagagagagagagagagagagagagagagagagagagagagagagagagagagacuauuaaaguaagguguggccagguggcuccgcaggugaaagcacuuggaugcauguaagccggcugacuuaagugggaucccagaaccaaugguagaaggaaagaacugagcccuggaagcuguccccugcccuccacacaugugcuguggcaugugcgugcccacacucacgcaaaguaaauaucaaaacaauacaauuugaauuuuaggaaacaaaagaggucauauuggagugaacagcugucacccuggaaaacuugaguaccgaguggcccaggagaucugacucuuccagagcugcucuguggcuuuggucccuccauuccuuaccaggcucugccaccagggucauacuuaguacagggcacgaggcacacuguucccauauccaagcuucacaugaaaagacagagagaauacugggcagaagaaggaugaaggccaggccagagauuggcagggacuccagagggaagcagguugguuaggacaguaggggaagcugcguagaugggggugaaauggucccucugagggucuaggguuuaaaccuaccugugacucugaucauucucuccguucacagugcucacugucacccaaauccacaucccccccaccgucuccagaggucaguuggcuuucguccugcuuuguuugggcccucagcccccucccccaacaugccuagccccagcccagcaaaguccaggggaugauagagucagcaaauccuggcugguuggucccuggccaacucaucugucugccagacccagggacucucuuuaacccuuuuucucuggguaggcacccugagcgggcagauggaguccuggaaugugcuuccucugcccgugacauugcccugggguugggaaguggggacgcugguguaggaggaugggaaagguagccugagguaaagccaugcacaugggagugggaagggguaugggguguaggcuacaggcugcauacuucugcauaggugugggcggagagccggacucuuggaaucaucucucaggcuucaaccccaaggaccacagggacccccaggaccagccugccccacuuccaccacccugguagguuuuauuaucagccuagcuacguucuuuccuugggacuucaauucuccuucaggacccccagaccccuuacucucuggucccuacucuuuggguuuagaucuagcuggacccuacgguacuaggaugccaggcagaacuagcggugauaguggucuugcuaucucuucucaccuacccagaaaagugcaggaagucccugccuucacaagguguggucugagcuuauggcccuguucauuuuaccuccauuuugugcccagagccaccaccccugucaucguguccccuuucucagcugaucuuguucugucucucagagacuacccgcccggauuccaacaucuacaagaagccacccaucuacaaacagagaggugaggguuccccugacuuccuccgugcuucuccuggcacaucgcggugggguggugcugagagccgggaagggauggaagaaaagcuucuccaggccuguaaggcccggggcucucucccguggaucagcugaguucuccgugggugugaaggagaggugacagagcuggagcugaggguggcugcgugguuagcaggggugguagguguguggacugacccuggaucugucugcagaauccgugggaggcagcccucagagcaagcaccucaucgaggaccucaucaucgaauccuccaaguuuccugcagcgcagcccccugaccccaaccagccagccaagauagagacugacuacuggccaugucccccgucgcuggccguuguggguaggaaaacccggggaaaggagaggaggccaaggguccccguucacuucucuuucuuggcccggugaacccagucccagcccaccucaagccuguuuguuucuucucagucuuuuguacuuuccccuauugacaguucauuucuuaccucuccccuguacuucuuuguguuacugugcacagccuggucaccauuucuucuccucuugcucauuaucauuaccaccaccaccaucaucaucauuugguuuuuugagucaggguuucccuguguaacagcccuggcuauccuagaacucacuuuguacaccaggcuagccuaaacucagagguccaucugccucugccuccagagugcugggguuaaaggcauggcccaccacgccuggcccucauuauuauuucuuuuuuaagauuuauuuauuuauuauauguaagcacacuguaacugucuucagauauuccagaagagggcaucagaucucauuauggaugguugugagccaccaugugguugcugggauuugaacucaggaccuucagaagagcagucgguguucuuaaucgcugagccaucucgccagcccucauuauuauuuuuuuaaagauuuguuuuauuuauuuuauguaugugaguacacugguguacucuucagacacaccagaagagggcaucggauccuauuacagaugguugugagccaccaugugguugcugggaacugaacccaggaccucuggaagagcagucagugcucuuaaccacugagccaucucuccagcccucauuauuauuuuuuaagguuuuauuugauuugaacuauauguacauguguguaugugugugggaggguaugugcauggaagugcagugccuaggaggcccaaggcaaaguuacagggggcugugaaggcaccccgugcggguugcaaauggaacucagguccucuggaagaacagugcauggccuuaaccacuuagccaucucucuagcuccugucacuuaauggacaucucucaaguucuugcuauagccagacccugugauaggagauuuggaaaagagaaguaaaugagagaagggucuuacucuccagggaauuuaaauauguguuucuuauccaguuuaugaauuuucuggggacuaagcauucaaauauauggggccuauagggggaugauucuuauucaaacuaccacagacacuaucuccaaaucaacaacaauaacaaaaauguagguuuucuagaaaugaaacuagacucaagguguaaagaaagaaagaaagaaagaaagaaagaaagaaaggaaggaagaaagaaagaaaggcagacagacagacuuuguuccagcccuguuccacaagcuggagaagcccauggcugaguggccacauuguuucuggggccucuaucuccuagagacagaauggaggaaacggaaggcaucucgaaagggggcagaggaagaggaggaagaggaagacgaugacucugaagaggagauuaaggccaucagggaacggcagaaagaggagcucaguaagguagcaucuugccccuccccacccccgccacccucaugccaucuaggugauaaauauucuguccccagagccagucuaaaaggcuagugccauagaaacaucugcauuugaccuggugggaggugccucuucuuuaccaggaguccugugcuuuaggcugcuuuuggaacagugguccuggacauuaagauccagagcacaggaaagagaggggugcaccagcacccgguuucagcaggcuggccuaggggaggagagagaauaaggagucuugggaaggccauugguugugcucuugacauggugaccuagaauagagaagccacaguggaaggcuaccacugaacaucuucagcaaacaauuugcuugagugcccaguaagaucaacgggcuccagguguggaccagccaccugggaaagccaucgcuaacccuccugcuuugaaucccaaguuugcacuuuucagagaugggaaucuggugucuucggcugggcaccauucuccucuacccccaaacagguuacuuccaacuugggaaagaugaucuugaaagaagagauggaaaagucauugcccauccggaggaaaacacgcucucugccugaccggacacccuuccauaccugugagugcuguggagugugcuccgggucaucuggccaggggugggugugggguggacggauguguguguggcuauugaaccauuauacuuaaaggcucagucugggggugaggcccacagguguacuccuuuagggcaaaaauaugcccugauagccagaacagguagagauuccugguacaagcagcgugagagccuugacuucauuuaauggacacuuacugagggacaugcuaagcacuggggucauugugagugaaagauacagccauuuccuccagccaaggggaaaguaauguguaaauccgugugacuuuugagcaguguggcaggcaauggggacagaguaucaacgagugcuuugaaaggccagugaggaggccugguaggcuccccuaaguauuuucuuuaaccauuuauuuauuuauuuauuuauuuauuuauuuauuuauuuaaugugcauugguguuuugcuuacuuacaugugucagugagugugucagauccccuggagcuacagacaguugugagcuaccacaggugcugggaauugaacccagguccucuggaauaacagccagugauuuuaaucacugagccaccucucuagccuccccuaagucuuagaagaggcaaauaaauggugcagaagguccuuccagaugucaaggacagcgugggagcaaaggccgggagcuugagcuaguguggcagcacagagagcaugggcaccgaguagcaugcggugggugaagggggccuugaguucugggccucugagcaaccccaacuagucuggacuucccuagagccugguagcuggagaugggagggacagagcuaagcaccccaagggagaggcaugagaacucuuaagaccugaccuugggagccaugacgggucacuguuuuugcauuccauuagucaaggcaccaaagcuggcaagguggcacaaguuuaaucccaaaacuaggagucuagccugggcuggggaggaaaaaauaaaagacccuaucuuaaucaccguucuguugcugugaggaggcaccaugaacaaagcaacuaaucaaagaaagcauuuaauuggagcuggguuacauuuucugaggcuuacucuauuaucaucauggcagggaacauggugacacucaugacacuggagcaguggccgagagcuacauccugauccaaaggcagagaaaagcgaacaccuaggccuagcaugggcuuuugaaaccucaaaagcucaccuccauugacacacuuccucuaacaaggccaugccuccuaauucuucuaauccuuuucaacagagccacucucuggggacuaagcauucaaauauauggggccuauagggcgaugauucuuauucaaacuaccacagacacuaucuccaaaucaacaacaauaacaaaaauguagguuuucuagaaaugaaacuagacucaagguggaauagguucugucccagauucaaggaauuacaagguuucauugcaaaaaggaagcaagguauauggagagaguuacaggucaucucuggaaacaaucuuccaagcuggcuuguagauguacauauuagucagccuucugucgcuguaugaaauauguggcuagaccuguggagcaggccuguaaucugagcugcucagcagacugaagcaagagaauuaaacauuuaaggcaucugggcauaguggugcaugccuuuaaucccaguacuuuguaggcagagacagguggaucucucugaguuuaagacgggccuguccuacauagagagccccaggacagccagggcuacaaggagagacccugucuugaagacauaaggaaggaaggaaggaaggaaggaaggaaggaaggaaggaaggaagagaaaaaaguuuaaggccuaccaaggcucaaauugaguaugaauguagccuagacaacuuaauagacucuguuucacacuaaaaaccuuuuggagcagggcuggagagauaacucagcaguuaagagcacuggcuucuuuucuagagaacccagguucaauucccagcccccacauggcaucucacauaggguuugcccuuaacccugagacaauuccucuuccuucuccucuuccuccuccuguauaacuucaguuccuaaagauccgacacccucacacagacauacaugcaggcagaacacuaacccacauauaaaaaaggaaauaaaccauuuaaacaaacaaacuaacaaaaacuaucagagccugguuugguggugcccaccuuuaauccuggugcuuagaagcagacauaggcagaucuuugugaguucgaagccaccgugaccuagauggggaguuccaagucaucuagaguggcauagugagaccuguuaaacauuauuuguuuuauuuauggcuguuuugucugcauguaugucugugcacuggaugcaugcacagagauuuccccuaggacugcaugguugugagcugcagugugggugcagggaaccgaacugggggucauccagaagagcagccacugagccaucucucuaguuccaaguuucuaccuuuuaaaaagguguguguggccgggcgugguggcgcaugccuuuaaucccagcacuugggaggcagaggcaggcggaucucugaguuugaggccaaucuggucuacaaagugaguuccaggacagccagggcuauaccugucucagaaaaacaaaaaacaaagcaaagcaaagcaaagcaaaacaaaacaaaacaaggugugugugugggggggggggggguuggaggguggggaguagacagcggcuaagagcacccacugcucuuccagagguccugaguucaauucccagcaaccaccacaugguggcucacaaccaucuguaauuggauugaguacccucuucugguguaccugaagacagcaacagcauacuuacauacauaugagaaauaaaucuuuuuuuuaaaaaaguguguguguguguguguguguaugauguauguguguuggggguagauaucagagaacaacuuuguagagucauuucaauuguuuucuacuucuauguggguucaaggagucaaauuuacauugucaggguugcaaggcauuugccuuucuuuaccccuugagccaucucuccagcccuauuacuauaccuuuuuaacuucucacaauuuuugaagcuuugcaauaugcugaaaccauauccuaagaauagcacauccuuugggguucagagaagaggggauggaugugagaaaugcucagaucaaauccacuaaagugaauccuaggacccaugagaagggugaauaagggagagaggugucagggcuuuaucuguguagagcaaaugguugggaacugacauuggcaaaccagaagcuggagggucugcagcuaauauguguaggaaaugggaaaagauuacucauggagaaaggaaagggaaauugggugaccaggccugcagaacgugagugccuuagcuagcaugcucagccaugacccauguguucaagggcuacauugugagccugucuuuaagagaaggaaaaucuagacugaggagccuggggaggaaauggagccgugugcucgggaugcggccaugggagaccuucuccacggggacuaccgcaaggucuuuccuuuguggugaugcuaauucauagcugagggaguaagagaggagggaugggcucaucuguggcuagugucugguaaggagggugcuaagggacugcagugcuaggcaacuggcuccagggcagaacucuuuggaagaguguagaagacuggaacagagaggcguaguaggacuggaauuuauuugcuuugguuuuuguuguuguuguuucggcuucaguuggguugguuuguuuguuuuugguagggguuguugcuuguuuguuugcuucuuugguugguugguugguugguugguuggagguaugccucuauaucucugccuauaaaguacugagaugaaaggcauguaccauuaugccagaugccuuaaauguucaaucuuagguaacugaugcuagccucaaacuccuguuuugcugaggguggccuugaacucucuguccuccugccuuugccucucaagugcugugauuauagacauuugcugccacauccggaacugaaggagcgguaaagugaccauggcuaggaugcaugaagagcaccaggacucagguuuggggugggugagacgauuugcaaagggcauuuuaaagaauauaaagucuguaguugaggccuggagaacaagaguauuacaaaaccgucccaauggguagauacagucucaguguuccagauucuucuauucagcuaaagaaaugagcuucugugacuucccuuuuggcuuuguaagguuuaauagucaagugccuuccuuacuuuggcacaagaccauggauauguaugucaugugguugugcagguuccugacagaucucaucaggcucaacagcucagagucaugaacaggcauuaccuuggaaucgucacuuucaaacacaaaccuucuguccuaguugaaguuuccauugcggugauaaaaugccacgaucaaaagcaacuuggcaaggaaaggguuuauuuugucguacagcuuguaguccaucauucagggaaggcagggcaggaaccuggagucaggaacuggugaagaggccacggaggacugcuccuccuggcuugccugguuuguguuuuuauacuauccaugaccaccugcauagugguagcaccacccacagugggcugggcccucccacaucaaucaucaguugagaaccuguccccauagguuacccacaggccagucuguugaggacauuuuccgaauugaggcuccccuuucccaggugaauguagguagugucaaguugacauaaaaacagccagcauacauccugaaagugauuugggguggaaaauguuuauauguaccugauggcauuguaauucuguccauaaaaauaaaaaugcuccuaauuauuacuaguacauagcauacuucagcaaugagcgcugacugugagaaucagugacuuucuuuugcccuccccucgcccaaacucagguucuugucugacagcacacgaccccgagccaauccccagcccugagagcugcucauucccuacucaggcuuaucauuccuuauccaaaaugcuuaggauuugaaggguuucagacuuaaagaggguuuuguuucauuuccuggauuuuagaguauuugaaaaaacuuuaccaaauuggagacgaccucccccaauccaaaacugcaaaaucugaaaccaacauuuccaaauccaaaacugagaacccuaccaacaagacugaagaaguuuggaauucaggggagaguggauuucagauuuugaacuuucaguuuagagaugcuaaacuuaauugagaauaaacaccagguuccccaaaccuauuuuguucucaggcacugaacuuccgguagacuuuagaggccugaugcuuaugguguugaacuguaagcuggacauuuaacaaaugccuguugaagcaacugcaaugggaugccagccauuucuacuaguuacagacaaaggagcuuugaggcuggcccacucuaagaaugguagcuucuauuuugucucuguguggugguaaauaccuuuaaucccagcauucaggaggcuaaggcaggcaggucuuugugaguuugaggccaaccugaucuacaaagugaguuccaggacagcuagggcuacauagagaaacccugucucaagaaaccacaaagggaauguuaguuucuagacgccauggcacaucccuguacuugcagcacuuaggggggcugaggcaggcagaucuugagaccccuggauuuaaaacaaaaaacaaaacaacaaaaaaaccuuguugcaaacuaaucucugaaauuauaacuaguaguguuaaaaauuuagugauuuacaaaaggcacaaguugcaaaugaucuucaguuacgccaauaggaaguguguauguauauguguguguguguaguguagacaaacaacuauucagguauguuauaaguggaggccaggagaggacauugggcauccugcacuguugcucucugccuuacuagacguggaagcugaacuggcagugaucccccugucucgaccccacacagugcugugguuacagguguacacagccaugcucugcuuuuuauguguguccuagaauccaaacucaggucuucauacuuguagagcaagcccucuuaccuacugaggcagcuacauagccucaaaugggaacuauccugacugcauucacugugcuaagaugacagugucagaacugugcugucaaaauggcuagaaguugaccgcuguuaauaccauugucauaccuucgagauuucacuuagagcugucauguguuuguagaucucaaacuuacuucaugguggcugaagugaaaugagccucaacguugccugggguucacacuaggcuuuuggcucacuucuaguuggagaggagagggaagauacacguucagcaaaagccacagcgucacugugaaaguccguagaagccuugcuagguucuggacagggaaagccguggaggcagcucucuuaggaaggacugucaggaccaagggacuaaaccugggcccucucuugcucucuuucagccuugcauucgggaacaucuaaauccucuucgcuuccuuccuauggcaggaccacccugagccggguaaggccuuaggaccgagcagggcugccugguguguguccaccaugcuucuggguggccaagcgcuuggagauucuggggcgggggggaagcccucagaguaaaggagacuguugaaggcuuccucugaugucuguguaucauuuuccuagcuacaguccacagaauucagcccaucgggaagugaggcugggagcccaggugagcaauggggucacacgucguugggacgcgguccuccacagacuuuauagagagccgauguccagugugggcagugguuuaagaucagguguaggugcaauuucugaagcugucucuaaaccguggcucuugucuccuuaggccugcaggugagugcccccuggaggggagcaggagaagcucgggaaaccagagccaggcauggggacuggugggggaggggggcacgggccgacgaguugcuuggcgaagacugaagacgccuaggguaagguugagaaggucccccugacccacucuggcucacugcggcuuuggucuccccagaacggagagggccagagggggaggauggaucgggggaacucccugcccugugugcuggagcagaaggugagggcaggggaccugaccaccacaguggggugggcuucaggggggugguggagcccaccaagcugaaugcgcucagggugcuccuggagaugacgggguggggggugggggcagcagggaagccgaaggagaugaauggcgagauggcaugaaccccaguggccucugcagcgggaccaggggagucacgaggguuaggaggacccaggacuaggcaccuaagagggcuuucucugccccuccagaucuaucccuaugagaugcugguggugaccaauaaggggagaacuaagcugccuccggguguggaccgcaugaggcuugagguaugaaagaaagaugcguggcaugggggaggggccaccccguggggcugccuuugacuuugaggcuguaggggcuaccuccuuaagucacuccguuacccauguccccacagaggcauuugucagcagaggacuucucuagggucuucgccaugucucccgaggaguuuggcaagcuggcccuguggaagcggaacgaacuuaagaagaaagcuucccucuucugacaucccugccggcucggcucgauucggcucgcccuguccgugacaguaccuuccuucugcugcuucgaggcccugaagcuggggcugugagacccuucccuacaguguccucuuccucugcuggcugggagcagcgggaggcagggcagaaacguugggcuccauuccucacggagagagccaagaagugcacagucccagagucacgaggcguggacuuccuuccccacgaugggccagggggccuuaccauuucccugggcucuacugccuagacaaacccagcccggacuccagcacacaauguuugcacccguucccugucugucaccccacaugagaguccccagaagacagugaggagaaacgaagggggcuuagcggggaggucggucugcuguccuguacagggggaggcggcagcucugggacccugugccuguccacccaaaggcuccagccagcugcacuccuggcaguuuccugcacuugggccugaugcuucucuaacuggcagaagcaggcucuaccuggaccuccagcugggaggucauccucccucuagcuuguauguccuguacuuugcaaccccuaagcuucaaaccucuugcucaagacccaagacuuauucaaagcuguggcuaagagcagagacgcuguucacacaacgccucaccaccaccagccuccaggcaaaaccagauaggaugcaccguucuagcaccuguccagggaccaccgagcccaggccucagccucccuaagaugggauggagagucccagcucccaggucccuccauugccaugcaucuccuacugugcucucuacagaauguaauuuauuggggcacccucugcugcuucccugacucccugcccuaccuaauugcacuuccaguccugucuguccacauauguacguguauauaauuauacauauauauauaucuauuuugcccaggucuggguuucguuuuuacccagacccuggcacucccuguccacugugugugugaucaugcugggagggguaacugcuuggaauuaaaagguugcacugggucccuaaaucuauuguuucuauccaugccugugcauaucagacaagcacuguaccacaaccaguugucuuaccucuuuuuuuuuucuuuuuuucuuuuucaagacaggguuucucuguauagcccuggcgguccuggaacucacucuguagaccaggcuggccuagaacucagaaauccuccugccucugccucccaagugcugggauuaaagcauguaccacuacugcugggcuagucuuaccucuuuaguugcccaggcuagaccugaccucucacucuguagcccaggaaguuuuggccuucuugguucaguaucaaguagcuggacgcauaggcuuaggccagcagccugaacuaucuauucauuuauucuguuuuguuguuuuguuugaaauaaggugucccauagcaaaggcuggucuugaaccccugauccagcauuugccuuuccgagugcugggaucacaggcauauaucgcauauuuguggaucuuauuugucucacauagcucacacuggccucaaacuuacuuguaucugagguugaacuucccauccgccuugccucugccucacaagugcuggaauacacugacagccaugguuuauuccgugcuggggauggaacccagggucucuugcuugcuaggugugugcucuaccaacugagccacauugauaacccacguuuguuucuuuauaagccacuagcccugagacauagggacaggugacaucagguuucaugugagccagagugggcuuagagacaauaccauagucccguuccucucuaggacgcaggagcaagggcuggccuagagagacugcuacuugccaccuuuccaggggcucuaugagacagaaagcuaucuuuuguagcuagagagagcuugacagagccucagaagaugaccucaaacacaccggccucccuaggacccaaggugccucugcaucagggaagcccagcagaaaacguuaccaggagguuaccaccuggcugccaagcacugagcagaggaagcaggaacggagaccugguaacugagggacaaauggugccuuggugccuugauggccucugacugccuuggugaagccuucugccugcaaccacuauggagcugcgugcccaagguggggcugagugugcaguuugauuggaagaucaaaaagaagacgggaugggcuugcacaggggaagaggaccagcuggccccaaagcaaauagaugagaaccauucaaaacaaugauuuucuuaccauuggaauggaguuuacagcugaagacugccuugaaucgccucccucugcuucuaccuccugcguguugagaugacagguggacaccauuacgccugcuucauuuggggcuagggagccaacccaggcuuugugugugcuaaguagacacucugccugaaagaccuacauucucagcucccgaaugaacaaugauuuuaaguaaagucggcuuauguuuacagcauuauccuugaaacagaccugcgagagcaagguuuguuugacccaacaaacgagagagcguuuuaccugaaacccaaggcuucauaaaaccaauaugugugguguguguguguguuggggggcugagggcaguguccuaucucauuuuggggggagggcauucaggagaucaaagccagggucuugggccugcuaggcaagcacucuacugcagagccagcuacaucuccagcugcccagcacuggagagauauagccauuuuuccaggggaagcaggacuggguuccgcauauguuaucagacaacauggacuaugugauuauaaagcggacccuguuuacuuagaacucacagccgggcgcuguagaaaguucacugguuaccaagggaagcaacauaugaucagauugacuggaaauguuugugguaggacaaauuuugacacuaaguccuaaaggauuuggagcuccugagaauuuagauuccuucaaagugaggcucuugacccccuaaaacaaagccuuagggagaguccuucaugcguccuucucaugacacaaagauguaaaaccugggcaacuuuauugguucccgaagcuuuuguuuugguuuuauuuacuaaacaccucaccauuuagagucaggagcugagggcuuagaaugcagcacagagcgcuugcuuagcaugcaugagcccugggcucucuuguuagcaguggacacaccaggcauaugccagaucccaacacuaaggaaaggaagauugggaguccaaggucaaccucagcuacacaguaaguuugagucuauccugguccauaugagacccugucuugaaaaaagaaaacaagaguugacuuuacagucaugaaaucaaugaacaacaaaaauaucugauaauuaaaaaaaaaacaaugugucaac

SEQ ID NO: 7570 - RNA, 2004 nt, Mus musculus
agagccgggcacacuggagucucuggaggagcugacgcuccccggggagguaagagguugcuggagagagcgagaagguggcggagugggcaugcgcgugggugcgagggugugggagugggucuugcccuaggccucaggaugggguggggugggguggggaaacccggcgugcuacguggagguggccaccagguggcgccggcgacucuagcacggaccugggagagcagcgguccccacccuggcccggggugcaagccgcucaccuucugcagacguuccaugcggcagccacuggccggccgcucccucgggggccggugcgcacuuggagaggacagacgucaggcucggcccggcuccugcagcgagggcgucacagcgcucugugguguccucaucccuugggccucucugggcugcugaccgcggguggcuggaaggacagugagccccaguaagggcguuaggcugucagguuccgcggcgcugaguucagccccagggaguugugcgugcauguggccaggcgguggcugcgugagucggcugcacuuguuuuuucagccauuguucucuggcuucagaggaaaugacggcaggggucagcuggcaucccaggguggacagacggcuauauccucaagcuugucaccccugcccuggcccugcucuggcccgggcccucucccaaguggugcuggccccucccacuccagccacugguuucacuccccagaguuugcucagccaaaucuuuauuuuccccagaagguuaacacggggacauugagucauuagcuaagacuggaagcacagggagccagaggcccgaggaagaaaacccacggggaucgguugggguggugaagcuaugggcaugaccaagagcugcugguggucccccccgaagcuagcgagcgcacuugccuuuucuguucccuacaggcaggcaguaugcuauguagacacuguaaaauaccucugccaccacaaagugcccagagcauucucaggggcugucacacugcucuaugagggcugcuuggucaccuuucacacugucugucccuaggauaggccagucuauguacuaggugauggcuacaguccauguccucuccuucuuggccacgcccucagcucuccuccuuucccuucucccaguccucagccacagacugaggagagcuguguacagaagggaaaggaggaugguguggugguuucaagcaagaccucucaagccgggaugccugccuggccuuaagcagugacuauuacuccgaugugguggguaagucauuuacacucugcacauccuagcacuugggaggcugacgcaggaggauugcuuugaauuccaggcuagcauggguuacauagagaguuccaaucagcuuugaauuuugaaaccuugucuaaagcauuuuugaaaccuugucauaggcugcucagacaagucaauaauaguauuuauuuacuuaucuuuauguguaugaguguguugucagacuguuaugucugugugucacaugcaugccugcuguucauggaguccagaagagggcaucggauccccuggaacuggaguuacagaugaguggccaugugaauguuaagaaccaaaccuggguccucugaaagagcagacaaugcucuuaacuacugagcugucucuccagccccaaagaaguagcuaaguuagugcauacacggugaauaaaacaugcucuauuucauguagaggguaagcuauuaauaguauuucuaucuccccagggauuaaugaauugagggggcuuuuucuguagccagucaugaaagaaugaagccccugcuuuguuucucucuuucuggggggcaaaaccauguccucuuaagucuccccaccucucuucuccucacaggguugcacugcacugcccuggccaaccucaaauucucaguccuucuaccucaggccaggcucccauaggcugggauaagaggcgugcugca

SEQ ID NO: 7571 - RNA, 6068 nt, Mus musculus
ucuuaaggagaugagguugccgcaucaaaccugagggcgggagcugcugacccugaggaaggggagggcaaggcgccucccucccugugcuugccgcuggccccgcacuucacggagaccggcagguuggugcgggucaggaauaaaucaagagagaucguaggggccagccuccugauagaggacgcucucgcagcuccaauccuuugcgcccggggaccucugcccgaagccaguagcccaagagagcgaguacgccaaucggaccagcuccggcuucgcagccccacuggcccggaagguggacaccucgcaccucagucucucaauuacgccuccccuucauuccccccucggcuagccuuccccuucccuccaucuccuuucauuccugaaaaccuguggcuccgagaaaccuuggcuucucugggacucuaccucaggggccuggccacauccgcuccugaguuuggggagcagaggggcaaucgccccaagaagucucuccagcgaugggagccgcccgccugcugccuaaccuuacccuguaagugugcugccugcgcccggaguucuuuuuugccauuuccagccccaggaauauuauaccuccaucccggggcaggugggacaagacaaaggugggggaugggggugcccuggggugcccacaccuugagcugccuugucuucccaaacaggugcuugcagcuauugauucucugcugucaaacacagguaggcaccccugccuagcccccaacccccaaccuuucccaccucaccucgaaggaggagaggcaggacuggccuccccuaaccaagcaacuguuaagguuuggaggaucaguucagaagguggguuggaaaacagacugaaccagaauggggaauagacugagguuugccucucaaaccuuucuaacaacacuccugggucucuacccuugccaucccucugugcuggguuucagagggccccaggcaguuagcagccaguggaggcaagcgcucagguaagguuuguccgugcagauaccugaaggguuuggguucgaaacccacauguaccguccaccgucuacucuuacccacauguuuggacuauagguggccagggucuccauaugguuggacuauccaaccaaguagacccguuaccucuaggguuccuaggucaagccuagagguuuguuuggaguggaauucagggcuuaccucuccaccccuccaccucccacccccaagucucagcccccagcuccaggcgaggcccugucccuuuuuugugauucuccauaagacugcagcuauuaaaaugcacugguccagaaccgcucuggggagagauggucuggcuuucccaggccagaggccuguuucucucccauccacuggggacuuuucuuuuuuuaagguaaaugccuuuucagugggaaggggcugccuuugaagcagugggggggugggagagagacaacaccccccuuuuccuuccccccuuuucucuagcccguuccaggccuuuugcuucacacaucuagggagaguaagaagaaagcccccagccuggcagggagggggcuggggguggguccaaccuguucuggaaaggaaauuagcacaauggcgcugcugcccugggcguuuauggccuggcugaggcuccauucaggacucagggaagguggcaaggcuguccuuucccccuugaagugccccuucaccccccugggagggggggcaacaggcugaaccacagccaugcuugaggggcugucugacaagcagcugucuaccgugguggaaggggagguccccccacagcgggaacaugaaaggaacaggcaaggaccugugggagagggacuugugggcugugggccgcugggggguggggggagggcgugggcuacuuuugugaaagacuugaagggggacaaggagaggagggggcuuuggggggcugcuaucugccccugaccuggaagagacugccaggagaaggcugcccgccaaguggggcggacauccugaaccugggccagaaggcuaaggcugagauagacaggaacccaccccagagggaggccugugagagcuaagcaguaggcuccucaccacaagugcuggugucaaguuucucuaggguaggaugcaaagauguucuuauucuccuagaggccuugcaacuccugaccuuuacaggcuggugcugggaagagacaguaacagaaaguuugaaggggucaaccccuuggccaugagguugcgaccacccccuauguugacguaacucacccuucugucuaggauauuggucccugauacaugcugagcugggucuagcucugucuugguccaagugacugguauucagccugagaucauuauaguugggauuaggcauuagcggcagagaagaguugucccuaccuaagucuugcaggcugaguugaagcuauaaccagcagcugacaacugucacccuagagggcaccuuggagauggggcagugauguuucuguccuacucagguaaggcuggguaaggcaaaccccaguaugaagauggagaugugguacuggacaggcuugaucuaugguggaaaugguuccuugaaccaccucaggaggcaggcuacuaaguaccuagaccacugccacaggcaagcaggugaccaugagagcagcuauugguaccaccuucuacugcuacuucuaccuccuauacuagggugcucucucucuuucucucucuccucuaggacauuuuugauaagaaccaaagaggccccacccccaccccacuuaacaaaccaucugcucugugccuggugugcugggaccaggaaccaggaccuuucacagcuaguggcagaguugggggagguguggucuagugguccugauuaauggagccaagaccccagagaaagaggaagggguucuggcuguaaguugcaugucccaugcaucuguccuauagaacauggggacaggacacacagccuugcagguuucuucuagcaaccuguuaugauugcagaugaauacugucucucgugguguuucccaaggcugacaaucacaaguacccucaaauuaacaacugguccaugcagcauccugggaagaccgugggcagaggcaguuuucagcuugcaccgcacacugcagggcacacagccagccccacuucacuuagguccucaccccucuccccacaugggccaaugguggugucacccaaagcaaauugacacuauuuuucccuugguaaccgcaaagggggagaaucacccgucuccuaauuuuaaccaguacgugagggaccagggcgcuaugaccgaccagcugagcaggcggcaaauccgugaauaccagcucuacagccggaccaguggcaagcacgugcaggucaccggacgucgcaucucugccaccgcagaggauggcaacaaguucgguaagaccuagcccuugcccccagaccacuuguagcuaccuagucuagucccuggauuuuuucccccaguuccugggucagggagcuugagguauuguggguagagaggaagccucuugaugcugccacccacccuuugaucugacuucgaagcgcagacaguuuggggagaagccuugcccaccccugagccacagacuaaggucucuuuucuuucgaugcucacagccaagcucaucguggagacagauacauucggcagcagaguccgcaucaagggggcagagagcgagaaguacaucuguaugaacaagaggggcaagcugauugggaaggugaggccuggacacaagcagcagacagaugugucuucccuacgggaguaagggcaggccaggccacagcaaugcauccuacgccugcugcugaccuaacucaccccguuaaagcugaggcuccagccugacaggacgaggucucauuuugacaaccaucccaucccccaaccuauuuaauuuuuuuuuuaauuugucuaaagauuucuuuuccucucauguguauaugaguguuuugucugcgugucugugcaccacacgugcgccuggugccuauggagguaagaagggaguugggaguugugacucuaaaacuggcguuccagaugguugugagccaccacaugggugcugggaagggaacccagguucucugcuagagcagucaguacucuuaacgacugaaccaucucuccaacucucuguugauuuuuaaauauuuauuucuaucuuauguguaccaguguuuucucugcaugccuaucuaaggaccaaaugcuuguagaagccagaagagggcgucugaucccuaagaacugcaguuacuuuuuuuuuuuuuuuuagccuccauguggguacugggaaucaaacucugguccucuggaaaagaggccagugaucuuaaccacugagccaucccuccagccccucaaucucuauuuaaaagaguccuuguagcuccuggccugcugaagggacaaggcauccacaugacaccuggugcugauagaaggaauauucccccagcagccaccaggaggaacucaccauccacaugguguuguacaugaugugcuuguguggcagucauagagagaacuaaaaggcgaugagggcuggaagcuggggcgucugugugcagcugaaguucucgaaagcucaguggcgaucauggacaaggcgcacaccgagcccugacuggugaagccuuacagcacugugcggacagagcaccgcacuuccucagaccuguccagucuugacuucuaguucugacugaugcucaccaaauaaccucucacugcucaccuguaagaaggcaaggcauguagggucaaggggaaggcuauuucugacgccucucuccugugcugucccugugacagcauagaauucucacgagccauaucccaccccucagcacugaauuauuguuauuacccgaucuugacccuacaugugagcaucugagggggcugagauucaggauucucucaaggcuuccuuaagaggccuuaugacugaaguucagcucugacgccaagcacagccuguauguacugcccauggcugccuuugcuaacuaaaggugcccauucccacuagacagggcuacaaagacuucuugcucccacauggguucuacaaaaauuaggccccaaagcugacaacccagccagggugaauggacaaauuccccuccucugcuccuuucuuccguagccgagcgggaagagcaaagacugcguguucaccgagaucguacuggagaacaacuacacggccuuccagaacgcccggcacgagggcugguucauggcuuucacucggcagggccggccacgccaggccucccggagccgccagaaccagcgagaggcccacuucaucaagcgccucuaccaaggccagcugccuuuucccaaccacgcugaaaggcagaagcaguucgaauuugugggcuccgcccccacucgcaggaccaagcgcacucggaggccccagucccaaacguagucagggaggccaguagugugccaggcuggguagaugccccucagcagccuucccucucuucucuaacucauccaaagaugggggcuggggaggaagguggggagccagucuccaaaaggaccccgagggcaugaaguuucugauccccacugggaagagacaguacuuguguaucccagggugggcaccauucuauggaacagguuugaggccagaggcagaccccggcagaagaaauagggucuccuugaccuaaaaugccugcuucccagcgucuaccugaaauaagcgggcugcucagcagauuccagagcuugcacaacugugcucaaaucuugcucccugaaccucucugaaucugaaccaaauagccaaacucuuggccagaccguagggacuuacgguuuuguuuucaaaaacagacagagacagaaagagaaacaaaagccagucagccacuguucuuauuucucgccccaggccugcguccccaccccaagccccagaauaaaaccauuuuccugcaac

SEQ ID NO: 7572 - RNA, 276 nt, Mus musculus
cccacaccccacaguugcagacucugacucccacacacccucaauaugcuccaccuagaccuauagcgucacaagucugcucuacagagcuuacauguaauauaugaccaacacagggguguugaugcgacucuuccaucuuguuuauagaaucugaaucauccaacaugaugguuauauuuccuaccucucccucucccaucccucuucuugaggaauucaggagucacacacagaacuucucauuuggugucucacaaucaagccagggucuca

SEQ ID NO: 7573 - RNA, 2251 nt, Mus musculus
aucugaaagcugagccacuucuggucccaggcauuuuggauaagguauagccaaccuuaauaguauacuuacagugagcagggugauaaguggauaagguagguagggagauuuuagagauggguuugggagugugauggagacacucuugagaugacucaagggguacaucuaugcauuggcguggagccacuuuuucaguuggguaagauccuggguugaucaggaauucuauuugggacacaguaauacuuugguguuucaggacggcucugguaccugaguggguuuguaaauuuuuuuggggggugguggugggucucauuagcaggguggugguauuuaaacugagggauaaugaguucuuccugggaagacucuggugggagaagaggaaccaaggauaugguuggaaauaugguucgaauauuuccauuggugaggcuuauggggauaugacugcauuuucaguugaagagcacacauguuacaauuuggacucugguucaaccccaccuggcucuugauauggucaucgaugccuuuaccucuccagcucuaggcccaagucauucaacuguggaagacauccaugucugagucacggcuuuaggagcagcguaggagucagucucuacuuuucagcucuucuagucuuccacaaggaggcauuuagugcuuuauugaagggguuugagggcuguuugggggcuccugugauggaauguucuccaaggacuccccugugcccaacaucgggggcuuugccuuacuguucaguagaguugagguagccuucaccucaugaguacugugagcccuauuguccuugagcuacaugcuggcuucauggccugucaguugcuuucacauagucaugauguaauaccugacagaaacaggagaaugauuucuuuggcucauggucuaccaaugugaggauggcacgacagacuaguucauggcaguagaaacauguggcacaggcugcuuaccucaugguaauccaagaagcagaguguggcaggaaccagggaauauaauauuacccucaauggccuaccccacgugacccagagccucccaaaauaacacuagcaauuggugaaaaagcuuuaaaaaaaacacaggccuguggaaguaguuucagauucaaaccaugauagaaucuuuuuaaggcccuucuugcaagacucagaggccuuucacaguagugcuacuauggaagguucugaauagcuuaggcugcuagugacgcccacccaccuacugagaaauugggacucuauaugaaucuauaugaguccccauucguauggcugcucauauagagacguuugaaauacccuccccuaucuugcuuggcucaggucuuccugagccagugaguacuucuuucuguucuugggggcuggacuuugggcaccaagauguguuucagaaaagaaucagggagcuguaucaugagugggucagacagcccugggucuugaucaugagccacaugaguaugcagacauuacuuuuuacacugauugaagagccucuguuuguaaguacaguggcuugguagcccauuuaggaaauggauuugaggauuuagauuucucucuggguauucaaaggugccaccaggcuuguuagggcuauagguggaaggcuagcccucacagcuggcagggucacuagagaagcccucuuggaaguaauuuacccuugaaggagaaguaguuuuguauucugaggugacccuucuguuucucgcagagggaauguaucauagaggucuagugcagaagaggcaaggggaccagcugaucccagcccaucuguacuuugcuagcaaguuugauuuucucuggaagacauugaggagucaugaaguaguuaagcaggaggacaacaugaccugaacugcuauuuuagaaagaugcuucuguggauaaaauaguuggaggcuggagacauagaguccaauaggaggccuuacuguagugggcuugugacacuggaaaggcagguuguugaacaaagagaaacuggucaaagggaugacaugggguccuuugagggccaguuucugaggacucacuggaggcagacaguaaaagggaauccaggaggcuaucaaggucucuaguaugacaguugacuagcuggucaagccuugagaauggaagaagagaaaaaggaguuugcuaagagauggcacagggcagggaggguguuuaggucucagagcuguuguuug

SEQ ID NO: 7574 - RNA, 422 nt, Mus musculus
uagccuuuguauuguucccuugaggagaaaugccuuggggguaaugaaagaagaauccaguaguagaaaaauuucaagagcauauagcaggauuggugaaugaagcaacaccagggacuucucagccauucuccagugcucacaagaaacuaggaagaagacaggaguauauuuguugccaacaugauggcaagaggaaauuuuguaaauucugauucaccugacccaugcugauauccuuggaugucauggcuucacuuucaaguacuucugaaguauuggacuaauguaccuguuguccaccugcaaccuaucugcuguucauuaugcaggugaagacacauucaaccaaccagcaagauaaaggaagccagggcuacaucagcuuuaauacaacagaguaacacggaauuucaaaccca

SEQ ID NO: 7575 - RNA, 647 nt, Mus musculus
gucacauccaguuugaucuggaguggaggggugccauggucuucacauauuucucauaugcuucuucacucaucauucaucuagcucugaagggucgcucagugucaucuugaucagccaaccaucuuuguaacaggauuuguugacgagcccugggucuucggcaauggcuucacugacuucaguuaccucuccugacaaaggugaggagagcucacuggcagccuucacacucuccaaagcaccaaacuccucuuguuuuuuuucucaauuuugucccaacuucaggcagacuacaguaaacaacaucuuccaaagcuuccugugcaaaauugcugauucccacuguuccaauaccuuccucuguuguuauccauucauguuucucugugaauuuacgcacugacagcaaagcagauccggugcgcagugagcagaggccagggcggugcgcaggcuguaggccacaacccgaaagcuccucgacccuugcagcgacaugaucagagguccggaguggguaacugugcuucgccuccgccaccaggccagcggggugggauauuuguuauugagaauuguuaaacugagugauuugugaauguaugcugcugaaauaaaaugaaauuaaauagaaaccuuuaaau

SEQ ID NO: 7576 - RNA, 1797 nt, Mus musculus
aggccgggaccuaccugccucaguccuaccuuauccaugagcacauggugaucaccgaccgcaucgagaacguggacaaccugggcuucuucaucuaccgacugugucacgacaaggagaccuacaaacugcagcgccgggaaacaauuagagguaaggagagucagagaauucccaugacgcuugggugacaauguaaagggacccugugucaugcuugguuaguuuuuccaagauuuagaaucauggaaaucccaaacccucucucuucagauagaaaccaucagucagcaggaaaugccauugcuuugggacgcacacccaccccucaguuugcauguagaagagucagguuugacuuuucauccucacuguggcugggccacaggagagaggaggucuuucagccucacgcuuggacucuuagggaaucugaguucucacaggucccgucaccuguggaucgugcugaggcuagucacagccaggugacuuaggaagaccuguaggugaggagucuggagcccugacaugaccucggcagcucugcugucacuaaaucuuguuuucccccugagcaguaagaauagcagcaugugcccacuauaaaugcaacgcagaagugugugugaccuuacacaucguccagugccauccgucggugacgccacagccuggcuugugugggauugugucacccagcagaagugcuucuuuucuggucuuugccaauacuuguagugacauuguucucaccucaggcugcugagucaucugaaaccuaccacuugauuucuuacauuuaagucacgaucuugccucauaauuuucuaaaaccaauuugauagaacgaaguuugucucucccggugugcaguucugcaagcacacacgggcaugugacuccaccguauguaacuagaauaccucccaaaccuuggagcucaugcaucugugucuuaggguuucuguggcugcaacaaaacaccauggccaaaaaaaagcaaguuggagaggaaaggguuuauucagcuuauacuuccacauugcuguucaucaccaaaggaggucaggacaggaacucaaacaaagcaggaaccuggaggcaggagcaggugcagggaccaugaaggagugcuguuuacuguccccauggcuugcucagccugcuuucuuauagaacccaggaccaccagcccagggauggcaccacccacaauaggcugggcccucccacaccaaucacuaauuaagaagaugcucuacaggugaaucuuaugaaggcauuuucugaauuaagguuccuuccuugcagaugacucuaguuuguguaucaaguugacuaggcagcacaucugucuguaagccguuuguaaagcacuguuaccaguugcuaggauauauggaaaggcccaguggagcacaaauuucaaauuaugggauggauauagaguaguggcaugcuucucuaugucuaaagaguaacugugaguauuuguuacuaaacaacuuaaaacaaaaccaaaaccagcccccuuuccuuucccaacagguauucagaagcgggaagccaguaacuguuucaccauucggcauuuugagaacaaauuugcuguggagacuuuaauuuguucuugagaagucaagaaaaaacguggggaggaauucaaugccacagcauacccugccccuuuguauuuugugcagugauuguuuuuuaaaaucuucuuuucauguaaguagcaaacagggcuucacugucucuucaucucaauaacucaauuaaaaaccauuaucu

SEQ ID NO: 7577 - RNA, 8830 nt, Mus musculus
gcucacacugcgcaugcgacggcugguggucagcggggcgauggcggcuucuucaaguggugagaaggaaaaggagcggaugggaggcguuucgggaauggccggccuuggcaguacgcgagagcggcuucugucugcgcuggaagaucuggaggucuugucgagguaaccgcggcccgggagccugcuccggccggcucggcugugggcgcugacuuggguaggcgggcuugggaggcuccguuggacguggggucuagggccuucgggggcuuugggccgcauuuccccgccaaggggacaucucagucacaugaccuggaaaccaaggcagucaaaacuuuaguagccgguaagaggggcagauccgagcccccucagucauugacacgcaacagacauuuaaaagcacgcuuccccccaguagucaaggggaggcuagaugccaacacgaaggagcccagggugacaggagagacaaauguguuaaaacgcuauggaccagauuucuaaggguugagccgcagccuccugcaguccaccgaugggauuccuauucuggugguagcagggcacacguccccaagaaaugggcugcuagucaaaucagauuuguuaggcgucugauagauagcccaucaucugaaaaagccuggaaacaucaggcagggcacagugggguuggcugguguguggccgagauagaguaaauuggaugucacacuccacaucgucgugauagucuuaaaucuaucaguugaagucuuaucaagggaaggcagccauggccaccgucuuacaagaaaacauaauuuacacaaauggcagcacuauuggccuacagaccuacauaguugagucaggagguuuucuuguaaaucacagcugagucuuuaucacgugcaguuagccagcgaaugcugaaguguuuguagucaccaugagaguccagcauguuaggaggaccauaaacccaacaaucgguuggggcagggagcaauuuaaacaguuucuuuuguguuucuacuguguuaugaaaagguuucacuagauaucugaggcuggucugaguccucccaaacacugaguuuacaggcaaguaucaccauaccgugauggguguuuuucuuuuagggaacucauagaaaugcuugcaauuucaagaaaucagaagcuauuacagcuggaagaggaaaaccagguaaacuuuuuguuguuguuuguuuguuuuuuauuaaaaaguuauuaaugccgggcagugguggcucgcaccuucaaucccaccacuugugggggaguggcagguggaucucugacuuccaggucuacagagggaguucuagggcagccagcacagauaaacccuuucuugaaaaaaaaauaagagagauaaguuaauguuugaaaguucauauuuauuuugugugagaguagggaugcuucuugaagucuuuuaaguugauacuuaaaaaaaaaaaaaaaaaagcauuauuuuauuuuuggguuuuucugagauugucucacugccuguucuguaauuccguagaccaggcuggucucaaacccacagcccuuggccugccucugccuccgaguucugggauuaauaaagguccgugucagugugcccggcacauugauacuuuucuuuauagcacuuauguaacacagugccuaugaaaguucccagccauacauaguggcucacaccuuaaaucccagcaccggagugucccagggagacacaucgcugugaguugacguucuuccuggucuggauacaaauuuuauuccuuacuuuugaguuaaucaacacaaccuuacaaaauggagacaaagauagaaugcugggaggaaguuguuauuauaaacaccuguauguugcugcuuuauccccgugaaacuugaauggaaaucaaagauccucucacucuuacacgcuauguauacuguucauccauucucuuuccuuuccuucccugugcuuucuuccuuucucuuuuuggaguguguguguguguguguguguguguggagggguaguguucaagacaagguuucucuuuguauguagccuuggauacucuaaaacauacucuggucaccacagggucauaagagugggugagcugcccugcuuccugauggcuacagcgcuuaggagaauugacgccgcaccucaccaggacggcacaguagagcugucccugggugggggagcauaggugacccagccccgagcuggcccagccauucaucuacugugagguuuccugggugugggggggaaugccccuuaccaccuacaguaguugagagagcuggcccugccccuugcugccugcagcacuuuggagagugggcccugccacuugucuguuaugagguggugugggugcaggggugaugcccucccccucuuccccugucaucugugguagucuggagagucggccccaaggcaugaauauaggagacuuagccuugcccacucccuagcuguagcacucaggagggugggucugcaccaccugagcuagagcugauggugaagguaugggugagccagcccuuagggugugagagcaggagagcuggcccagucccuugacugggcagcacaguggagcuggcucuggaggagugugugcaggcgagcuggcugcugccaaugguggcacuggguggccuauugggaguagugcugagagcucccugauggugcagauaacagggagcugccacccaggcccagauccaaguguauuuuuccagugucauaucucacaccugcacccuuugggaaccgccauccugccuccuuaucuuuaagauuucacuaucuuuauguuaacaguaaugauaauuauuaaaaccuaugaaaaauaguggauuuaaauuaagggguguguguuguacuccaccaccacuauccagcuccuugucuuuuuuuuuaagaugaguuuuuauguagccuaggcuugcccugaacucagugauucuccugcguuuaccucagugcugggguuacaggugucaccaugccuggccugcugagcucuuguguuauaacaugcauuaugucacgagucuugagaacagccuggccuguacuaacacuauuuaauaaaugcuguuauuagugaaucuuucucgcuagaggagaaaaaugggcucaugcaaggcagugauuuuuccuaugucguacuacuagcaaaugaagggcugcaaacugaaccccaggcuccuguuggguauuaaccuuuguggccuuuugccauaucuguauaccaucuauucaauuguacuguguuuuuaaccaccucauucuucagacuaccugcauucuaagcaguacugggugucauauagcuucuaauauaucagugcaauuacauuucaaaguuuuuaagucucuuacugccuguuaaacuugccgccugaaagcauuagauuuuagaggagguuuuuuuguuugauuguuuguuuuuuaguuccauuguauguuaaggauaaauuuaaaaauuuuauccuuggaaggugaacaaaucugaaauuuggcaugguacuacugcugaaagauuuguucuuuauggaagaggagcagaaugaauggcacuucuugguauuaagacuguuucccaaaauaaccacaaauggcaugcugauuaagaauauuucaagguguuaaaauguauaaaccuagccaauucaauuauagauuaucuccuggugguagccuugauaauccuguugucugauggaaucaacuguuacucuacaggucuuggaguugcuaauucaccgagauggggacuuccaagaacuaaugaaauuagcacuuaaucagggaaaaguucaccacgaaaugcaggcuuuagagaaagaaguagagaagagagacagugauauucagcagcugcagaaacagcugaaagaggccgagcagauccuggugaguugauggaugguccugagagagggagcugcuucauucucuucugaggggucuguuaucuuaguuugugugugugcucgagcgcaggguguggggggggggggagcugccauuuuuaagguuguuuuuauuuuacuuuaugugcaucagaguuuugcuugaauguacgcauguauaucauaucauaugugugccuggugccuauagaggccagaagaggacaucagauccccuggaacuggaguuacagacaguuuugugagccacauguaguugcuggguccucuggaagaucagucugugcucuuaaccagugaacuaccuuccuagccccccaccccuuuuaguuggcuagauaggacuuuaugccaauugcaaacucaaacuugguggcuauccuccugccucauccuacccaugguucagugaccacccucccauuuauuuucagauagccuauauuauuuuugugcuauauauuuuauuuaaaugcuuuauagaaauuggaagggaauuguacuuuugaccuaauuaagguuugauauaaguaaucaaacugucuaguuugugaaauauuuugggucaauaaacauguacuaguuucacagaauauuuaaaauuucauuaaucuaucugcucuuccaucuuaaguugguaaguuaucaaucaaggcucuguauuagguguuccuuuguuuucuauuauuuaaaacauuucuguuuguaaaauaaacgguuuuaugugcauguguuuugcccauaagaaggaaccaucacaggugaauacuuugggguuuuuguuuggauuuuuaaguaaaugcuuuaaaaaauuuuuuuuuuccuagugaaagaaauauuuacuuaccagaaaauacagaaaguagaaaaaggaaaauuugccuuuguuuuacaguagcacagugcacauccaguguuguuguuguugucucucuaggcagggcugguguguuguaguuccaagaggacuuucugcuuguagcccucaucuucucuccucccguccuaauccccacggaacccuucaccccggcauucccucccugcacggccauggcuuucuaacagcuauuuaucaacaggaggcugaguugugaauacauuucucucauuaacuauaagugauauuuaaugugauauaaaugagauuaaguggugcuucagaaagacgacugauaaauuucagggauuucuaagucuuguuauuguuucuguaggugaguaaccuuguguaucuaaaaacugugcaugauauagugaagaauaauuuguauuuuaaauuuguucaaauuaggcaacagcuguuuaccaggcaaaggaaaaacucaagucaauagagaaagcaagaaaagguugguaccaugggaaggcugccuggcugaaauauaagcccaugucuuaggaugcugauaagggcuggggagaagaugcaguggguaaaaaguuuguucaugugugaucccuagaaccgcauaagcuguguacgugcccacacucacaugcuuucacacacacaugcacacauucucauaucaaugcacaugaaaauaaaauauuuaguugauaaaacuaaaaacuacuccagucgggcuguugggaggaugcucaguaguuacucaguguagcgugugauguguucuugcauccugaagaggguacacguagcucacaacccuccguuaguuuauaaccaaugagagaagcggauggggcuuuaucucagguguauagugaggacacugguuuacagaaguguugagaaagaaggagaagcaaaauugaaguuggaucuugaaugcuaggaggaaacaauguugggaaccacacagcuaaacugagaaggaaacacuagagucagagaccaucagcuaguacacugugccugccugccugccugccugccugccuccugcccacuuaaaagccuuacauggucuaguuggucuuuauaccaagagugaaauuacagcuguuucacuuuaauacuuugugcauuugguuuacauuuagccauuucuccaucucugauuuguucucugcuugccaguauggagucuauuuucugauuguuacauucaggaaaacagcucauauucucugagagacgggugggcuucuguagcagaagcaagucucuaggagaggaggcugaguccauugcucaggggugguuagaacuccuuagugcuuuuugaaacaggucuaaaauuuauagaauggaaagcuaugacugucuggcgcacaaucugcuagagccucuuccuugggagucacacagaggcugcagacuguagggucagcagcuuggaugcugcuggaaugaaaagcgcuccccuugguuuacugucccucacuguggcauucagaagacucugcacuugauggcggcuaguaaucgagaugacugagcauuaucacgcuggccuuaaauuuacguuagccgacuuugcuggguggguaucuugguuccaagguucagaaauguauuuauaacaguuuuuguguaugugcagguguuugggagauggacagcuuagaugauccuauuuccugauaguuugaaauuaaauaugguguguguauguaugcucuucuaaacuuguguuuaaugaucugaacuguucuauuuucucaacucaggugcuaucuccucugaagaaaucauuaaauaugcgcacaggauuagugcaagcaaugcugucugugcuccacugacuuggguuccagguaacagagcuucuuacaucagaugaaugcagguuugaaaggacugagguaucuaaauaagaucauuuaacguagaauguacucaucuagaguaacaucugcuaacaaaggcauuuucuucaguguuggaaggaaugucagguguuacccucuucuacccuucuacccuuacuguguagcccuggcuguccggggacucauuuuguagaccaggcuggccugggaagagaagucagaguucugccucacucugccuuaaagguacgugccaccgugcccagcuuaaggauuuccacuguagcuucaggcaguguguggcaguauauacugcaaaggcagguacugaagaggccgaggcaggacugcaggcuugaggcucacaaagcacuugcgucuuuuagugugaacuaagggcagcucauucuucaagaacauauaaaugcuuuuugaaagccugaguuaaaagcugucuuuacuguuuuaggagacccucggaggccauacccaaccgauuuagagaugagaaguggauuguugggucagaugaacaauccuuccaccaguggugugaauggucaccucccgggagaugcccuugcagcagguagacugccagguaaugccaacuggauggguguuuuuaagcagacagaggugcccgugaggcacugucugguaguggacaucaagaucuguuacacagguucccugccaguuugucauccaaagacccugcagugaugcacaggacacugaccuaagccccuaugucccucaugugcaucuauuuccuggcacccuccccaggccuggccuuccccugucgugaccacucugaagagcauuuuugcaguugagaggcaugcccccaaauagaauaagcacauuuuguaggugcuguguuuuaauguggaagaaccuuccuaaggagaggacauaguggggacugugcuuucugaagcccauuguagccaugggccacacuguguuaaaguguggauuugggaaucugcuuauuuguguuuagcauugcgaaucccuaaccuuguuagauccuugguacuacaagguagguggguggguagauagaauuaagguacuugcauagagggaggggauuugaguaggcugaucacaaguaggacuaaucccaugugccucuuuucuccagauguccuugcuccgcaguacccauggcagucaaaugacaugucugugaacaugcugccaccaaaucacagcagugacuuucuguuggagccuccugggcacaacaaagaaaaugaagaugauguugagguuaugucaacagacucuucgagcagcaguagcgacucugacugagaaagguguggcaugcacagacuccagugcggcagaguucugucaagggggaaagaaaagcacagaccuaaggagcccaugaaaaucagcggguuuucuuccuagagcccgagccccugguuuucuaucuguuacacaauguuugaggauuagucagaauuacuguaguguuugguuguacauagcagcccuggcaugagacugaagaggaacucacacaacucauggagcauacuuagaaagagcacugagccagacgugguggcucacaccuauagucccagcaccugggaggcugagggauugcugugagugucgggccgccuugagcuacagaaugagcugagccaccaggguaacagagauaagaacaggcaucggagcgcugugugauacuucagaagugcucacuugaacaacucaauauauauaugugguaaauacuguaauuuguguaaauaaacuugguuuuguuuguauuuaauuuuuuucaauuuuuuaaaaaauauuuuuaaaauuuagguacaccuucaguguaggaaggaaacauuuaaauccaguugaauuugagcugggcagugguggcacaugccuuuaauccagcacucaggaggcagagguagguaggcagaucugaguuuggggccaacuuugucuacaaagcaaguucuaggaguacagagaaacccugucuggggaaaaaaaauccagauguauuuuauaauaaaauaagauucugguauauaugauacaguauauacaauaaaaugacuaucuuaacuca

SEQ ID NO: 7578 - RNA, 8830 nt, Mus musculus
ugaguuaagauagucauuuuauuguauauacuguaucauauauaccagaaucuuauuuuauuauaaaauacaucuggauuuuuuuuccccagacaggguuucucuguacuccuagaacuugcuuuguagacaaaguuggccccaaacucagaucugccuaccuaccucugccuccugagugcuggauuaaaggcaugugccaccacugcccagcucaaauucaacuggauuuaaauguuuccuuccuacacugaagguguaccuaaauuuuaaaaauauuuuuuaaaaaauugaaaaaaauuaaauacaaacaaaaccaaguuuauuuacacaaauuacaguauuuaccacauauauauauugaguuguucaagugagcacuucugaaguaucacacagcgcuccgaugccuguucuuaucucuguuacccugguggcucagcucauucuguagcucaaggcggcccgacacucacagcaaucccucagccucccaggugcugggacuauaggugugagccaccacgucuggcucagugcucuuucuaaguaugcuccaugaguugugugaguuccucuucagucucaugccagggcugcuauguacaaccaaacacuacaguaauucugacuaauccucaaacauuguguaacagauagaaaaccaggggcucgggcucuaggaagaaaacccgcugauuuucaugggcuccuuaggucugugcuuuucuuucccccuugacagaacucugccgcacuggagucugugcaugccacaccuuucucagucagagucgcuacugcugcucgaagagucuguugacauaaccucaacaucaucuucauuuucuuuguugugcccaggaggcuccaacagaaagucacugcugugauuugguggcagcauguucacagacaugucauuugacugccauggguacugcggagcaaggacaucuggagaaaagaggcacaugggauuaguccuacuugugaucagccuacucaaauccccucccucuaugcaaguaccuuaauucuaucuacccacccaccuaccuuguaguaccaaggaucuaacaagguuagggauucgcaaugcuaaacacaaauaagcagauucccaaauccacacuuuaacacaguguggcccauggcuacaaugggcuucagaaagcacaguccccacuauguccucuccuuaggaagguucuuccacauuaaaacacagcaccuacaaaaugugcuuauucuauuugggggcaugccucucaacugcaaaaaugcucuucagaguggucacgacaggggaaggccaggccuggggagggugccaggaaauagaugcacaugagggacauaggggcuuaggucaguguccugugcaucacugcagggucuuuggaugacaaacuggcagggaaccuguguaacagaucuugauguccacuaccagacagugccucacgggcaccucugucugcuuaaaaacacccauccaguuggcauuaccuggcagucuaccugcugcaagggcaucucccgggaggugaccauucacaccacugguggaaggauuguucaucugacccaacaauccacuucucaucucuaaaucgguuggguauggccuccgagggucuccuaaaacaguaaagacagcuuuuaacucaggcuuucaaaaagcauuuauauguucuugaagaaugagcugcccuuaguucacacuaaaagacgcaagugcuuugugagccucaagccugcaguccugccucggccucuucaguaccugccuuugcaguauauacugccacacacugccugaagcuacaguggaaauccuuaagcugggcacgguggcacguaccuuuaaggcagagugaggcagaacucugacuucucuucccaggccagccuggucuacaaaaugaguccccggacagccagggcuacacaguaaggguagaaggguagaagaggguaacaccugacauuccuuccaacacugaagaaaaugccuuuguuagcagauguuacucuagaugaguacauucuacguuaaaugaucuuauuuagauaccucaguccuuucaaaccugcauucaucugauguaagaagcucuguuaccuggaacccaagucaguggagcacagacagcauugcuugcacuaauccugugcgcauauuuaaugauuucuucagaggagauagcaccugaguugagaaaauagaacaguucagaucauuaaacacaaguuuagaagagcauacauacacacaccauauuuaauuucaaacuaucaggaaauaggaucaucuaagcuguccaucucccaaacaccugcacauacacaaaaacuguuauaaauacauuucugaaccuuggaaccaagauacccacccagcaaagucggcuaacguaaauuuaaggccagcgugauaaugcucagucaucucgauuacuagccgccaucaagugcagagucuucugaaugccacagugagggacaguaaaccaaggggagcgcuuuucauuccagcagcauccaagcugcugacccuacagucugcagccucugugugacucccaaggaagaggcucuagcagauugugcgccagacagucauagcuuuccauucuauaaauuuuagaccuguuucaaaaagcacuaaggaguucuaaccaccccugagcaauggacucagccuccucuccuagagacuugcuucugcuacagaagcccacccgucucucagagaauaugagcuguuuuccugaauguaacaaucagaaaauagacuccauacuggcaagcagagaacaaaucagagauggagaaauggcuaaauguaaaccaaaugcacaaaguauuaaagugaaacagcuguaauuucacucuugguauaaagaccaacuagaccauguaaggcuuuuaagugggcaggaggcaggcaggcaggcaggcaggcaggcacaguguacuagcugauggucucugacucuaguguuuccuucucaguuuagcugugugguucccaacauuguuuccuccuagcauucaagauccaacuucaauuuugcuucuccuucuuucucaacacuucuguaaaccaguguccucacuauacaccugagauaaagccccauccgcuucucucauugguuauaaacuaacggaggguugugagcuacguguacccucuucaggaugcaagaacacaucacacgcuacacugaguaacuacugagcauccucccaacagcccgacuggaguaguuuuuaguuuuaucaacuaaauauuuuauuuucaugugcauugauaugagaaugugugcaugugugugugaaagcaugugagugugggcacguacacagcuuaugcgguucuagggaucacacaugaacaaacuuuuuacccacugcaucuucuccccagcccuuaucagcauccuaagacaugggcuuauauuucagccaggcagccuucccaugguaccaaccuuuucuugcuuucucuauugacuugaguuuuuccuuugccugguaaacagcuguugccuaauuugaacaaauuuaaaauacaaauuauucuucacuauaucaugcacaguuuuuagauacacaagguuacucaccuacagaaacaauaacaagacuuagaaaucccugaaauuuaucagucgucuuucugaagcaccacuuaaucucauuuauaucacauuaaauaucacuuauaguuaaugagagaaauguauucacaacucagccuccuguugauaaauagcuguuagaaagccauggccgugcagggagggaaugccggggugaaggguuccguggggauuaggacgggaggagagaagaugagggcuacaagcagaaaguccucuuggaacuacaacacaccagcccugccuagagagacaacaacaacaacacuggaugugcacugugcuacuguaaaacaaaggcaaauuuuccuuuuucuacuuucuguauuuucugguaaguaaauauuucuuucacuaggaaaaaaaaaauuuuuuaaagcauuuacuuaaaaauccaaacaaaaaccccaaaguauucaccugugaugguuccuucuuaugggcaaaacacaugcacauaaaaccguuuauuuuacaaacagaaauguuuuaaauaauagaaaacaaaggaacaccuaauacagagccuugauugauaacuuaccaacuuaagauggaagagcagauagauuaaugaaauuuuaaauauucugugaaacuaguacauguuuauugacccaaaauauuucacaaacuagacaguuugauuacuuauaucaaaccuuaauuaggucaaaaguacaauucccuuccaauuucuauaaagcauuuaaauaaaauauauagcacaaaaauaauauaggcuaucugaaaauaaaugggaggguggucacugaaccauggguaggaugaggcaggaggauagccaccaaguuugaguuugcaauuggcauaaaguccuaucuagccaacuaaaagggguggggggcuaggaagguaguucacugguuaagagcacagacugaucuuccagaggacccagcaacuacauguggcucacaaaacugucuguaacuccaguuccaggggaucugauguccucuucuggccucuauaggcaccaggcacacauaugauaugauauacaugcguacauucaagcaaaacucugaugcacauaaaguaaaauaaaaacaaccuuaaaaauggcagcuccccccccccccacacccugcgcucgagcacacacacaaacuaagauaacagaccccucagaagagaaugaagcagcucccucucucaggaccauccaucaacucaccaggaucugcucggccucuuucagcuguuucugcagcugcugaauaucacugucucucuucucuacuucuuucucuaaagccugcauuucguggugaacuuuucccugauuaagugcuaauuucauuaguucuuggaaguccccaucucggugaauuagcaacuccaagaccuguagaguaacaguugauuccaucagacaacaggauuaucaaggcuaccaccaggagauaaucuauaauugaauuggcuagguuuauacauuuuaacaccuugaaauauucuuaaucagcaugccauuugugguuauuuugggaaacagucuuaauaccaagaagugccauucauucugcuccucuuccauaaagaacaaaucuuucagcaguaguaccaugccaaauuucagauuuguucaccuuccaaggauaaaauuuuuaaauuuauccuuaacauacaauggaacuaaaaaacaaacaaucaaacaaaaaaaccuccucuaaaaucuaaugcuuucaggcggcaaguuuaacaggcaguaagagacuuaaaaacuuugaaauguaauugcacugauauauuagaagcuauaugacacccaguacugcuuagaaugcagguagucugaagaaugaggugguuaaaaacacaguacaauugaauagaugguauacagauauggcaaaaggccacaaagguuaauacccaacaggagccugggguucaguuugcagcccuucauuugcuaguaguacgacauaggaaaaaucacugccuugcaugagcccauuuuucuccucuagcgagaaagauucacuaauaacagcauuuauuaaauaguguuaguacaggccaggcuguucucaagacucgugacauaaugcauguuauaacacaagagcucagcaggccaggcauggugacaccuguaaccccagcacugagguaaacgcaggagaaucacugaguucagggcaagccuaggcuacauaaaaacucaucuuaaaaaaaaagacaaggagcuggauaguggugguggaguacaacacacaccccuuaauuuaaauccacuauuuuucauagguuuuaauaauuaucauuacuguuaacauaaagauagugaaaucuuaaagauaaggaggcaggauggcgguucccaaagggugcaggugugagauaugacacuggaaaaauacacuuggaucugggccuggguggcagcucccuguuaucugcaccaucagggagcucucagcacuacucccaauaggccacccagugccaccauuggcagcagccagcucgccugcacacacuccuccagagccagcuccacugugcugcccagucaagggacugggccagcucuccugcucucacacccuaagggcuggcucacccauaccuucaccaucagcucuagcucagguggugcagacccacccuccugagugcuacagcuagggagugggcaaggcuaagucuccuauauucaugccuuggggccgacucuccagacuaccacagaugacaggggaagagggggagggcaucaccccugcacccacaccaccucauaacagacaaguggcagggcccacucuccaaagugcugcaggcagcaaggggcagggccagcucucucaacuacuguaggugguaaggggcauucccccccacacccaggaaaccucacaguagaugaauggcugggccagcucggggcugggucaccuaugcucccccacccagggacagcucuacugugccguccuggugaggugcggcgucaauucuccuaagcgcuguagccaucaggaagcagggcagcucacccacucuuaugacccuguggugaccagaguauguuuuagaguauccaaggcuacauacaaagagaaaccuugucuugaacacuaccccuccacacacacacacacacacacacacacuccaaaaagagaaaggaagaaagcacagggaaggaaaggaaagagaauggaugaacaguauacauagcguguaagagugagaggaucuuugauuuccauucaaguuucacggggauaaagcagcaacauacagguguuuauaauaacaacuuccucccagcauucuaucuuugucuccauuuuguaagguuguguugauuaacucaaaaguaaggaauaaaauuuguauccagaccaggaagaacgucaacucacagcgaugugucucccugggacacuccggugcugggauuuaaggugugagccacuauguauggcugggaacuuucauaggcacuguguuacauaagugcuauaaagaaaaguaucaaugugccgggcacacugacacggaccuuuauuaaucccagaacucggaggcagaggcaggccaagggcuguggguuugagaccagccuggucuacggaauuacagaacaggcagugagacaaucucagaaaaacccaaaaauaaaauaaugcuuuuuuuuuuuuuuuuuuaaguaucaacuuaaaagacuucaagaagcaucccuacucucacacaaaauaaauaugaacuuucaaacauuaacuuaucucucuuauuuuuuuuucaagaaaggguuuaucugugcuggcugcccuagaacucccucuguagaccuggaagucagagauccaccugccacucccccacaaguggugggauugaaggugcgagccaccacugcccggcauuaauaacuuuuuaauaaaaaacaaacaaacaacaacaaaaaguuuaccugguuuuccucuuccagcuguaauagcuucugauuucuugaaauugcaagcauuucuaugaguucccuaaaagaaaaacacccaucacgguauggugauacuugccuguaaacucaguguuugggaggacucagaccagccucagauaucuagugaaaccuuuucauaacacaguagaaacacaaaagaaacuguuuaaauugcucccugccccaaccgauuguuggguuuaugguccuccuaacaugcuggacucucauggugacuacaaacacuucagcauucgcuggcuaacugcacgugauaaagacucagcugugauuuacaagaaaaccuccugacucaacuauguaggucuguaggccaauagugcugccauuuguguaaauuauguuuucuuguaagacgguggccauggcugccuucccuugauaagacuucaacugauagauuuaagacuaucacgacgauguggagugugacauccaauuuacucuaucucggccacacaccagccaaccccacugugcccugccugauguuuccaggcuuuuucagaugaugggcuaucuaucagacgccuaacaaaucugauuugacuagcagcccauuucuuggggacgugugcccugcuaccaccagaauaggaaucccaucgguggacugcaggaggcugcggcucaacccuuagaaaucugguccauagcguuuuaacacauuugucucuccugucacccugggcuccuucguguuggcaucuagccuccccuugacuacuggggggaagcgugcuuuuaaaugucuguugcgugucaaugacugagggggcucggaucugccccucuuaccggcuacuaaaguuuugacugccuugguuuccaggucaugugacugagauguccccuuggcggggaaaugcggcccaaagcccccgaaggcccuagaccccacguccaacggagccucccaagcccgccuacccaagucagcgcccacagccgagccggccggagcaggcucccgggccgcgguuaccucgacaagaccuccagaucuuccagcgcagacagaagccgcucucgcguacugccaaggccggccauucccgaaacgccucccauccgcuccuuuuccuucucaccacuugaagaagccgccaucgccccgcugaccaccagccgucgcaugcgcagugugagc

SEQ ID NO: 7579 - RNA, 2112 nt, Mus musculus
gcaaaagagaccaagaugcagauggaggaagaaaacaucccuugagaauaaguccuugacauuugcugauaaaguuugguucacuuugcagugcuuggaauugauuaagacucaacaauuuaaugcuaacaaccuaacuuuuaaaauggugaagauauaugaucacuggaacaucccacuaaagaagauauguaaggagaaagagagggggaagucaagaagcagagugugugucaugggggcuaugagaugaggguagggugugagguagggugggggagucugcccuuccaggguaauaucgcaauugagaacuuuggacacuuacucauuuguuuguauaagucccacuccccuuaauauaaguagcaacauuugcccauuuucagauacuuacugagagaccugagaucugucuuaaaaugugaagugauagcagagcuguuaaacacgaccaguucuagggcuuucauucaacaauuaagccucaaguagagaaguaaugacacacagagagaugacuugacuucugucucacugagucacaaaggcccuaacucaggucuccaugaccuuaugagggauucuuucugcuucagggucauucuauucauuuucuuaauuuuucccucgucugcuccaauuucugccccguuucuuuauuuccuucaucuggaguguggauaugaaaugucacugauguauagggagaugcuuagcacauacauacuaugaagaaaucucccaugaaucacuaugcaagucaaagagguagaacacaccaaagacugcucauggcagagcugaucauguuaucugacaccuugaacuggaucauuagaagacagggcggguuguggcacacugcacuagguagauggaccaggcuauagccacuaaacuggcauaagagggaagaaaacuuuuagggaacacuacagaggugccuugcaaagcacaaagcacagcuaagccauugucaguugcuaugccaugaaaaugauuagagguuaggcagaagugugcaucaucgauuuguaucuuguuggcauauuuauuccaagaaaaacagcuuuacucucuagaacagaaaauucuaugggauugaugcuauaguacauuguuucucuuugcauacaacaucacaguaauugucacaaacaacauauccagagaagauuuauguuaugauuuuugaacacauugaguuguaacuguuaguuacauuuaaacaugcucugaccugcaguuucugucacaaauaaccugcaauaacuugaagggcauacaugguucgaauguuuccuuucuccauguaucaaugacauguuugcugaauuuuguaaaaagucauuccuccaaggaugugucccuauagcucuggacuggcuggcaguguugugaagaugaaacacaggaacuacagagagaugcaguuaccuggguuaccuggagcaaaauaaaaagaggauuuguuuuuaagagauggagaaguggguuggggaggaggaggaggaggaggaggaggaggaggaggaggagcaggaagaggagaaagagaggaagcugucaccguguacuacugucugugaucaccagcccugcuuuucaguuaccacacaaaggagucccugucccuguuuaccuauaaacacucacuugcucaucuuagcagcucuacaaaaguucucagacauuuucuguagguuuauuaugccugagguuccuuuagccuaggauuuuuauguuuuaguuuguuuuaaucaaguuuuaccuuuuguguggccauuucuagucaaugugaucuaauuuagccuguuuuauugcuguuuauaauguaaaugcuacaaaaaccugcauauauuuaaauuuauuaauuuccugacuuuuuuuuuuuacauaggcacaccauaugaaagcauccaaaccaagacaauguacaaacccaucuuccccaaggucguacuuguuuguauuuccaguuucaagcuccuccaugcuccaucuaucuuccuuccuccagcacucuagaugauuguugaucuguuugaugcuguuauuuauaaguaccauuuucuagaauuuaauguaaauaaaauggaugauaugcuc

SEQ ID NO: 7580 - RNA, 18471 nt, Mus musculus
cgggacauauggugugggcggagccagaggcagugcucggggcggaagccccaaccuucuucccuggcgaguuagaagcugccccucaccgagguaagauggaaugggucgugagucccaagcauucucuacuaccugguuuucgggcggcugugcgcggacgccuagaccugcgguggugauagcagcggggaauggugacgaucucugcacccuucccgccgcgguaaggcaggccucgucccgcagggccugcuaaucgcuuuaacuucggggagcuggaaacaaugugugaccuggggcgccaggcucgcugggaugcucggguugguggagugcccgccgggacggcauuucgccgagcauucccgcgcggagcccggggaacgcuuucccuccgggaucccagccugggcugcaggcgacgccacuagggcccugaggugucuugggcagcgcgcucgaggccgugcccagugguaaaaauucagguguaggcggccguccauaggugauuugugguugagucgucagaaagauggcacuuauguuauuuaaaauuaauaaaauucaccauuuuuuauguaggccauauuaggccuaauggucagcaaucuauaggcauucuuugaaaaguuaaaggaaugaaaccccaggcuucuauaacaguauuguuuguagugggacauacuaguaagaaaguagacuaagguuuuaauuagcucuuagcuauauauaauugcuaugaugauacugagauuuuguuuuauuuuguuuuugagacauuguaguucugacuguccuggaacucacuuuguauaccaggcuguucucgaacgccugguucuccagggauuuagggcgcgugcaacgaaacuuuuaaaguucaacuuuugagacauuucagauauaagauaggcuguacaggcaaggaucuaaguuuaauuuuaaauguguuggguuuugcuauagcgaugcgaaauaaaugcauagcaguuuggcacuaaugcuuaaaauuugaauaugaaaagacagauuuagauuuuucagcccagaagauguguuugaaauuuagggacuaugaguuagggggaaaauaugugacaagaacugggaaaggggcguggggugggggaguugggaacuaagaaugaaauagagggggggggaggcaggacaggcuuugaguaaagaaaugguggucaggacugugaauuuaugccuuccccaaagcagcagaauaugcuuauucauugugaagcagcaaaaguguguugccauugucaaaggucugugacuaagcccugacuaagucuggaggcaacuguaucuuaacaaacaacauagguccugagaaacuuaagaaaguucauucuugggugagcauaccagaaucagcuuaugcaaccuagaugguacuuuggagugugaacauguacaagguauagaauaugguaggcaguuuuaacacgauggcaacuacuggugugucuacacacaaaggagacagaguaaauuauggcauaaaagauuuucaacaaauagaaugccaguaaaagaaugcuuuuuguaacuagagcuuacagguccaaagcaagucaguaagucaauuuugcuaugaguuagggaauguaagugaccuggacgaagcuacacuaaaccuauuuuaaaauaucuuauucauacuuuaacuuuuuuuuuauuuuauaaacuguaguuuuuagagccauuuaacauuuauuauuacagugaugcaaacuuuuuuuuaaauuuuaucagcuuuuuucugguuuuaguuuucacaaacuuucuauagaaacgaagacacaaucccacaaucuucaggguugauucacaggaccacaucccaugacugucuucugcauccacauuucaucccauggaagugcuuuaggguacauauauggagcuauccuccccggcagacgcaguuccuucuccauaacgccuucuguagugagcaccugcaggaggcuccacacacacacacacacacacacacacacacacacacacccgcagacaguagcuuacuuauuucugucaucuugaguuugauuuauaagugacuggugcacaugagcauuccuuuccauugauaaaaaauccaugugauauuuggucucaaguuuuuaaaguauuuaaggagcucguugagcuuugcaaauggcucugugaagucugucacuugguguugucuucccucugcagcuacguguguccuggcugacaggaacuuuuagcucuacuauacucuuacaggaucacugucauagauguaggauguccuugacuaaacccucccugugcugacugucuguauuaacauagaccagacuugucauauucauaugacaauuauccaugugacagagaagcaguauuugcaauaacauaugaaacauuaaaaguuaauauuuuguguguuacaaaucaagcuaucuaugaacggaggguacuuuaucaauguguaacuacccuaauccuauggaauuggcucaucuggcuuauuuuuuuuuuuuuuuuucgaaagagaaaaggaaacagaaaguuccaugauccucuaggcggccagaccacaaagcagcuaagaucucugaugguagcccuaccaaagcucaaaucacaauucuccacuguacaacuaaguauccagauuaagagacaggacugagauuacucuuaauugugcaaaaacauuuuccaaaauucacuuuucaaacuagcguuacacuucuaagaguagccuacaauagaauccagccagcacccagugagugacaucacugauaagaccaccaacgugguaaggcgucuuccuggugucuguuacuuuaguuuauauuuuguauuauauagaaagugcuucaaggagugggaaggaaaucuuuccaugccagguuuacaucagaaucaguucaauuuuucuuuauuacauaauagguauuuaugauaaaaaaugaauuuccagcuuuuuccauauauuauuucuauugcaagauaauauauuuauauguguucaaauuuaucuucauagagaaucaacagagugacuucagagaaaaggaauuaacuaccaggcuucaaaaguuucugacgacaagcuauuccuuaguucacagcuaacaggcucauguuugcuuguugauuuguuugaaaggagaaauguuggucaaacaaaaaucucuugucacuuucuugcaaaaacucauaaaugugcauagaaaaaugccucuggugcuguaaguguucuguaauuuucuaaauuaaucaguagacuaggaucuguuaaucaguagacuaggaucuguuuugaaggucgugaggcaguccacaacaguaacagcagcaaaccucacgguaccgaccuuuuccagaaucaggcaagugccugugcugugugugcgagugugaaaacugucguguuuagauaacugaucugagaacaguucuguuucaaguguuucagaggccuuuaauaggucgggcauguguuggcaugugccuuuaaucucagcacuuuaaucccaguuucaaggcagccuagucuauaaagugaguaagagaacaucuagggcuacgcagagaaacccuauccugaugugggggagcuuuaaauuaaugggauuccucuucgucccaggaggagaauggcgcucaaacagauuuccagcaacaggugcuuuggcgggcuccagaaaguuuucgaacauagcagguaagcauaagauaccuaucauucagcuuuuaucaucugcuuuguuguaguuuuauauaaaaccuucacuuaugaaccugcuuucucuccccgaagcgcacugucuaucugacagcgccaccaaacuuaccuguuucuggauugggcgcugugagauaggagaaggagagcccagagaaugucuugguuuugguuugauagucuucuaaaaguuucuggaaaaccaucuguguuguuauugaaaauucagacaacagcuuccugugaaucuucuaauauaguaaagaagccuagacuuaaauuaaauuggcagcauacacagacauauuugccuccaccagcuccugaaaucugaucuuacguccuuagguaaaugcauuaaauacauauacauacacaaaugcauugaauauacacacacaaacaaaugcauucaaaacacacacacacauauacacacacaccccucaucaugugcauaugaaccaagaggagauacaguagcagaggacaggagcugaggacaauauuuuagauacagauaucuaaccacagauuuagauaucuaacuuauuagcaaagccuagaaaacuaaauucuaaaccgaaaagcgacauauuuauauaaauuccuaagauacacugacaacacuggaaagacaaacauggagccgaggagcaagaugaguaguuaaaaguuuauuuugaaaaaucagauugucucaacauucuggauggucagauugcugcuuucuccaugucuguuguguugcugugaagagacaccaagaccaaggcaacucuuagaugagaaagcauuuaauugggagcuugcuuagacuuugggaaguucaguucauuaucaucaugguggggagcacggcgguggcagccauggugcuggaggaguagcugagagcuauauccugaugcguagacacgggcuuuugaaaccccaaagcucaacccccuugcgaaacauuuucuugaccagaccacacuagacaccacgccuuuuaauccuugcaaauagugccacccccuugugacuaagauuccaaaucugugagucaguggggaccacaccccagggccaugugguagaagggaagaaagugacucccacaagcuaccugaauccuacacauauacuauggugugguguguacacagugcacacuaacacaauggaucaauaaauaaauggaugaggggguaauucuagaacucuuaaauguggucagauuagaaagauuauuaagcacccuuguagaagcacuagccaggugugauggcacaugccuuuaaucccagcacucgggaggcagaggcaggcagauuucuaaguucgaggccagccuggucuauagagugaguuccuggacagccagggcuauacagagaaacccuguuucgaaaaacaaacaaaacaaaacaaccaagaaaaagcacuaacagugcugugaaguaucagaucaucgggaacaaagaacauuucuaaacauuuagaggggaaaucgauuaaaguuuuguguuguuguuguuuguuugcuugcuuuuugaaaauaagguuaguuugugagccacaccagcaucacugcgguggugccuucauuucuaaaggaugacccuaucuaugccuagccacacguccuguggagagaaugaaagcauuuuucauuuauuucccaugugccuuuucuggaagcagcugggcagagggaggggcucgacugagagcugaagucaagggacccagagacagaagugucuaguugcaggcaaaguagcucugauaaaacauuagugacgacagaggaagggugcagagcacuuuaguacccagaagggaaacagaacugaacagacauguuuuuggggauccgugugucauaucucauagaaacagagguguuuuguuuuuuuuuuuuuaagauuuauuuauguauuuuauguaugugaguacaccauugcucucuucagacacaccagaagagggcaucggaucccauuacugaugguugugagccaccaugugguugcugggauuuaaacucaggacuucuggaagagcacucagugcuauugcugagccaucucuccagccccaaaauaaagacauuuuaauagaaguguuacauugagaauuacauuuaacauuuguauuuaugcagcuucaaagcuaggcucaggcugggaauagcucaguccaguaaacuggccucauuaucuuuuugaggagcuaaguacauaucuuaaauguugguacuucuuugaauguuuaaucacauuuuaaaaaauucuuuacuguauauucuuccuuguuauaaaaugcuaaauuauuaguuuugguccugauuaaugaagggcacuaauauuuucugugauauuacaguguugagcugaaauguaaaaugagauuugcugucuaccuaccaccccaggccgagaguggaaaguguccagcgcuuuacuggcugucugguaaguauuucacuuuugaauuucacaaaggaguucugccuuaccuuuuuauugugaccuacuuauauacuuuuugggucauuuauuggaaccuucggauggggcuagagagacagcucagugguuaagagcauguacggcccuaguagacgaaucaaguuuggcuucugggauccaugucaggcagcuuacaacuuacugcaacugcagauccagggaucuaacaccaucugcuagcuucugaggguacagcuaccuguacgcacacgugcacacguauguacgcauaauuaaaaaguaauaaaguaaauauuguuuuuaaaauuuaaaaggcugucauacucuauuuuguaacuuauugagaauaacuucagaccuagagaauuacauuuuuauuuccuuuucaauuagaccaaguaacuuagcugaaaauguaaaguuuagcacucacugauaaagauuuggaaaucuuacacauaauuuggaccugccuaagcauuucuggaguuugcaaagaccucagcagucaaagagaaguaugagauggaacugaaacgcaaagauucguucgugcauuagaaacuacagacaaguaacuuccuagaugugucugaauacugaacuccagcgcacuucccagcagcaguccaaagaacacagcgcuucuuaaccacgguuaauauuuccagucagacuauagaacagaugguugagagccaggaugcacaagaguaguucugaguuccuguguuuacuucucuuccauaaaaugugagcacaucugcaucagaagcaaacguaagcagagaguuacggcaacugucacagaugccauuuuccuuccauaaaauuauugcuuauguugacaaauccuaccuaggcaucuaucaaggagaguccccuaaugccagugugaaaaagaaaauaaaguuuguuuuaacaacaaaaugagcauuucuaucuuaguuucuuucuuucacugugauaaaacaggaugacuagaggcgacucauagaaggaagaguuucucugggcuuccggagagacugagaguccguaaugccaggggagcaugggaggaggcagcauggcacggcaggcagcagaagcaggaaucugugaggucacacucucaacugaaagcgugaagccaagaaaucaaacaggaagagagcagguuuauacgcugaaagcuucgccccagugauauaauucuucuagugcguagcucuuaaaccuccccagauguggagacucugcaaacaccauggcaagcauaguguaguuccaggggaagcaagaaggaaauucaguucaacccugcagccagagucugacuucgaguaguuuauuugagacauauuuaaccacagcacaguguggugaaaaaacuuccuggugauaaguaccucaauccugugugaacaacaaagcuuaagacacgacugcauugaaacucuuuguaaaauaugugugacaucuuccauaaagauggggucuauagauugacuacaucugacaucuuccauaaauauaguuuggauaaucugacggagaaaaacaaucuuaugauaaaggucugagggaagaugugguauggucucagccacacagauagugacaaggucaccaggguauuaaccaaaucugcucuuagccuucuggguggaaaacagguuaacaucuggaugcauugaagagacaacccuguguguuuaauguuccugguuccccagugguuaucugugagcagagagaccuccgugccucucguacccaaacagugccaucaccuggggacuaaguauucaaaugguauccucagucaaaccaccacaaauuuagauuuucuuaaaaguguguuagacauaccagcagcaguaguaauaaaauuagauauuugauuagaaaacaugcuaauuguacagcuaaggauaccguagaaaucauauaauucauagaagacaggcccagagaagcuaaguacugucuaaggucaccugaguuagucacauuaguuaguccagaccuaugcuuuugccgccucucauuuauagugagcuaguuaagucuuacccuucuuuuagagacccagaucagaauugaaaucuaacagugcauaccaucugggcuuugugaguauaaauacaguuccugauuguuuacaucaaaugacaggauaaucgcguuagugaggugcugagaauagaccuuggaaaugaaguccugauuucucagauccucacuauguacaaaguaccauucaagggacauuacauguugucguauaugaccugcuuaugaggaagaggcagucaguucugucucuagucuucagaggaacaaauggaggucaguaaggaucuugucugaaggcaauucuguaggugccgagagcauucagcugucgacuuuaauguuacugguugugaguagucuuaaccucuagucuguugugggcuaauaacuaaguguuuuggguucaccucaagcgucguugcuaguucguuuuugcccacucucaugucauuguuaaguaccuaaugaugcugagcuagcuggucuucugaauaauaaacuauuaaagcuuguagaauacucacaguguagcuuaacauagcauccuuuuucaucuucagguuuaacuugcacagaacaaaauuucauaucaaagucuggcuaucagcaagcugccucagagcacggccuuguggucauugccccugauaccagcccucguaaguauccuugaucaaaaugcuuuauaaaccacuaaaccuucaaaucuaaguuuuauaaguaggauaauacccauuauacaguuccucucaaguuucugcucuugugaucuuuuggucauaugagcagcaucaggacucugaaaucccauccugggagcagaguggggagagaggaugaaaucacugcagcgaacacuaggagacauuaucaccucaggauggugaucuuuacccucaaggucaugugcuggagagaguuaaggaagugcuagcagucugggagccuugcagggagagcaucaccacacagucacagaaagugaagagcacacaagccacuuguaacagagucagauggggggaaguucaagcuaggagagcucaccuugaccccugcagucucugggucgaaggucacucccucuucccuuguuggccagcacaaguggcacguaccauucaagguuaaaggacacagaaaguggaaucccauuauguaucucaaaaaguagaagaaaauggaguguuucgggagcguuccauuguguguagacgcacauaugcagcuggcagcauguguaguggggguuauuuuacgacguagccuaggcugauaggcugacuaacaaguacccugucucagccucccaagugcugacauuauagguaggugccacugaacccaacuaaaacuagcauacuaaacauggggacuuacuguagaggaggugaaagucuaaucucuuccuugcuagguggcugcaauaucaaaggagaagaugacagcugggacuucggcacuggugcuggguuuuaugugaaugccacugaagauccuuggaaagcuaacuacagaauguacucuuacgucaccgaggagguaaucucgcuuaucucguaauuauuagcugaugaccaacugggaauuuaguuucacauacaaaagccuuccaaaccugagaauuuuaauauaggaguggcacuggaaaaacaauuuuaauuuggagaaaaucccaagauuucccaauauuauagcuccugcaguuuaaguuaauaguaaguauagguucgaguuuuuuuuguaguuauauucagaucugugauaauucccagguuaucucucaacaucgcacacagaacaggccuucauguccuagagcugguucagucaggugucugagguagcaagaaggaccugacuagaaagggcaaauggcaaaacaugacuucuuuuauuaauauuuauauucaguauaugcauuuccuggaguuagucauauauauaucauaaaaacucagaaacaacuaaaauauaaucagauauaguuuguggugaguuguuuguugcuuuggugauuggugucaaacucagggucucaugcauacuaagcaagaaguuuaccauuaaggcacaggccagcacccagucacccauaauuuuuacacccuagacagcaauuauguuuugguggggcuuuuacauuuauugacauuuauuuacauuuguguuuuuauaucuccuuuacucucucaccagcucugaacauguuuuaauugaaaaguuuauacuaauuccuguuauuuuauuguucguuguuguuuauucacggauacgccaugguuuauucuuuacuguggccucauaaauguauauauuucucuuuaguacauaguauugcuucauguauccucuguaauguuggcgauuacaaacaggagcuguauuuauacuuacagagcucagauggugcgcacuguuagaucucaaaaaaaaaaaaaaucugcacacguuuuucagugacauaaugagaaaccauugucuaccugagguuuuucuuuuagucuucaccuguacaauuuugcuuuugaaguacugauugugccgcuauuacacaguacuuuggaaaagucugaccuaucuccucugagcucuuuuaucauguuauuaaauucuuucuagcuuccacaacucauaaaugccaauuucccaguggacccacagaggaugucuauuuuuggucacuccaugggaggccacggagcucugauuugugcuuugaaaaauccuggaaaauacagaguaagaaacacuaacuucguugauaaaacacuucuggggauaguagggaauuucaaagacuaaacuuuugaaguagccuuagaauugggaauuaaacaugucuaugggugggguuucaugagguuggcagaagguguucaacuuguccacaugacagauacuguaugauuaaagccugagaauuccaucagaaugguucuugcuggccugauagaaguacaagaacauauaacuuauguuuucauugcucuuucagacuauacuuuugaacauaguuuuuccuuuugucuguuagucuuaauuagauggcuagaguuauuauguaacacuaucuguaguucaucuaugugauuuuuuuucaugacaaaugucuuuguaauggugaauuugauugguuauaauggagaacacucauauuuuaagaauuuuauguucuuagugcucugaaugagagaugcuugguugaaaaauaucucuuagcauccccaucccccaacacacuuucuuuaaggcuuuguagauuuuuuuucuucuuuuaaugagccaagauugaaaaccuacaacugaaacacuaaauucagcaacugaaaugaagugugcuuaaaaggggaugcguguuuucaaacccaggcuguugagcaucuuagaucaguuucaucuguuuccuuuucuuugcaaggacagcagucauuucaggcaugcugcugagugcaugugcugagaugcacaaauguugcucagagcaguuccauaacacaguacuagaacauaaguguuuagcuuuucaguuuucuuacagugagucagugaauuuauggucuaaaguggaaaagugagcuuaguuuguuuuuugguuuuuuuuuuuuuuuuuugucuuuuaaauauaggaauagcauuguguauuauauacagugagaauucuaaagcuaagagaugccuuauuggcccauugagaaccagcguccaaacagaaagcuguguuggaaaugccagcauggugaggcagaccuugcuucugugguaaugauugagagaaaugccucauuuaaggagcgguucacuaaggaaggcaccaguguauagaucaucacagcuuaaagaggagaaauucugaacacagacuuuuguuuaaggcguacuugcauucaacaauucggucugugaaguuuugaaguagguuauacaacgcuguaguaugaagaagccacaguugcagguuuuuuauguugucagauggcacaaguugcaaaccaccauauuugcuuuagcaaaauauaacuuacuuuuaaauuuccuuuugucucugaagucugugucagcauuugcuccaauuugcaacccugugcuguguucuuggggcaaaaaagcuuuuaguggauauuugggaccagaugaaaguaaauggaagguaggugauugacugcuguuucuguucucuuaaguucacacacacacacacacacacacacacacacacacuguaauuguauauguugacuauuguauaguuacuccucuguguucauggggucuacaucuguagacugaacuaaaaggaacuucaguuuuaguuaaguuugucauuaauguguucagaccuuuucccaucgucuuuguucucugcuaccucacauuaauaccaacaggaaccaggguaaucagugguggauuuaaaguacucaugaggacaugugugggcuauaggcaagcaucgcuguuuuauauguuauguaagcauuacacgugucgagaucauugggaggguucuagaaccaauccucagacacacagggacaacuguuuaauagucaccuugguuuguagugguuccggaucauggaaguuuccagaaacuacauucucugcuggugauugcuuuuacauuucuaaguuaccauuacuucuaaauuaauuuuuaaaaauuaaauuggauaucugaaugacucagacuaaaaguucaaaaaagccgggcgugguggugcacgccuuuaaucccagcauuugggaggcagaggcaggcagauuucugaguucgaggccagccuggucuacaaagugaguuccaggacagccagggcuauacagagaaacccugucucaaaaaaaaguucaaaaaaauaauuucuaauuuaauuuugguucuaguacagucuaucuuggaaaaugucucccuggacacuuuuaaguuuucaauguuucuucauuuuacaggcauacgaugcgaccugucucgugaaggccuauucggguucccagauugacauccuaaucgaucaaggaaaagaugacgaguuucuuucaaaugggcaguuacucccugauaacuucauagcugccugcacagagaagaaaaucccuguuguguuuagacuacaagaggcaaguacuaugaaaccuuagcuugaucuaaauagcaacacuuuaaaggcaagauguguacaagucucuuaccuuuaugguagauacguuaaaacauaggguaauacuggcaguaagaguuucuaaugcccuuaagaugucagaagugaaguuuguaagaccuaagccaauuggacuuaaauagggaagcuuuugacagugagaaguaggagcaguuuugcccaucaucaggcugcacggggcgggaaguucaaggccugagagcauggggcuuuggcuuccucaucauuggcugucuuuccuuccagauccgccacugcuacccuacagcacggcgccacgcuccccuguuagguucaugugcacaccauggccucaaagacugaacacugucuggucucccaggcuuuucuugcuucucuuugccagugugcugccuguagucccagugccguaagaggcaaucgcgguuggcuugcagaccuucuugacuguccacaauucaccuucuuauccugcucuuguuuuagaaauuuuacuuuuuuuuuuuuaagacuauccguaagguucagaguauauuauaaacagaguguccauuucaaggugaaaaaugaacacugaaaaccauguaagaucaugauguauaaaaacuuccuuguuuaagcuucaagguaaugaaugugucagagaugucuacgaaaagucuaauuguugugaggcugaccuggacagugugcugugugguccucggcgguucacacuguguguucauagcauuggcucaucugcagucuucauaccugguucuaccacugccgucaugcucuguaguagagccaggacuguuaaccaagaucacaaccacaacuuuugucaugucauguuucuagcuuugucuaggcaaugugcugcagggaugaguaagagcucgcccaggggaaacugggcauaacauguucccuuuccagcuuacacaggguuaguaacuccuuguuuaccagaguagucugaucaugugcaauacauaaaaauggauaucucuguguguguguguguguguguguguguguguaugccucuccuagauauauagauauauguuugcacacaaauauuuauccccauauauuagguguguguauguauguguauuccauccuuaaguaauagcauuuuuuaaguuuacuucaauauuucccaucacaauuguauuuaguucaauaaccaaccugagaaaccccaauuccuguuuggcccuaaguuuggcacuguguuuaacugcaucacccguggcuguaagcuguaaucauaguucguucagaugaucuuaacugcacuggcaugcugaaugcuuugugggcuuccccugaggcugggccaggagauucugauguuucuguagacaaaucucugccccagcaaagucugaaaauguauggaguuuguuaaacaacagccuagaguuagaacauggaugaaugacguuguuagugaggaaaaaacaaucuguuaauuucuaaaacgccugucugaaccccaagcaaugaagaaaugaguuuggcucucuugggaggagccaaggcagaauaguaaauucuucuacgagcauaggagcuuauuaaaauuaccaaucacagucuggaaucgaggcacaauguguugguucauuuuucucucagcaaaggccgggagaguaauugugcagugugaagcagacuucauuuggugugcuguaaguggaucagcggaguggacacugcagagugguggcugcagagaggccacucacagauggcuggucagcuucuugaccucagccccucggguccgagagcuggucuguugguuagguuuuuugguuugauucucuugaugggauucuugcuauuuuuuuaaucacugauuuaaucauugauuauaagcauuacuaucuucuuaugaaauaggaguuuugaaaaaaaaacagguuuuauauaaaaagacaaaaaugacugcagccuugucacgauucacccaccuucacuguauaucugucaugucggacauucucagcuuguguuugugcuuugucaguugucaaaaaagacugcucggcaggagaggauuaguucaugggaagacuuacuuauuucauagcgguuuaaucuggggcucuggggcaucuacauuggauuuuuagaaagcgcuauacacuagaacugacaguguagagacugacucuguaagguagggcgucagccgaucuguuuuuaguuacugaaguuacaaaaugaagaggaacgaccauggcccaguacugagggaacauccaagaucucucugucucuguguguaaggccauuaccuggcacccagacucugacuguuaguaagcaagugaaggucuuucaccugucuucuucgcuaacucaaggcucagccugagcuuuugcaguuggauccaggagccaugcagggaagcacgguauagaggagcacugcuuccuuccugagagcucagggaggacugagagugugugugcccucccgcugccagcccuuccuacugagcgcuuucccauuuaacgcuugcaggagaggggaauaugggugacugcacaagcugcuuagcaaaccaaacuugacuaauuaguucaagaguguaguagaaagagcucguuuaauaaggcugauaacuagaacccgagcccuguccuggauagcacacuuggcuccaguaucuaccuucagcggcacagcagcagcucaguguguccucuugccuuguaaaguccuucuuagaguuuuaaaacucuauggcaggcagcagccguaacuaaccagugagagguggaaaccaaguaauuccaggguguggucuugaccaugaagacccuccugucugaugcuuguccacacuugaagacgaguuacuauuaggacguuacugggagucgucuacacuggaagugacuuccuguuaaaucuaggguggauugcaucuccauccccuccaacagugguuuuguugcugggauggucugucucucucugucuccgucucugucugucugucucucucucucucucucucucucucucucucucucucucucucucucucucucucucucaggggucagggacauugcauguguguuugugcauguaaagaccaacagugaacaucaggugucacuccucagauacugucacuauuuaaaaaaaaagauaaaaucucucacugcccugggauaguagcaauagccagacaaacuacuaugacuggccagccagccccagggauucaccuccucacacuagaauuacaguacagccauuacacaccaggcuuuuauucacccccuugugguucuagggaucgaaugcagguccuugugauugccaagcaagcacuuuaccagccgagccaucuccccaggccagagauugaauuccuaacuuugaugugcaugauggccaugacugacuucuuuaacaguguuaaagacuuuaaggccuuucuccauguuguuuuauguacuuccuuuguauuuuaauaguugcuauuauuuuuaugucaaguguacugccucuaagaauuaacauugucuagcccauguuucuacccugauucugcuucuucaguguggccacaugucuccuuggcacauuuaauuacuguauuacugccucuccuugcacauuaaugacagcauuuagaagcucggauaugcagaaugcuugauuucccuucauaguuuugcugcauuuaaauuaaaugcaaagaugacuacucugauuuugauuaaaccauacuuuaacacuugaacuguauauacauuuuauauacauuuuaaaugacaggagagguccagagaaucauaagagagauguuuaauacuggaguuucugaaugguggauccaugucucauuuugucuccuaggguuaugaucauagcuacuacuucauugcaacuuucaucgcugaccacaucagacaccaugcuaaguaccugaaugcaugaaaagccucagccaagagaaucucaucaggaggccggaagggaaucaacaggagugcugacuuccucgcagaagaucaugcuccugcagcugaaucgcuuuucugaauaaauauaucaaacuuucugguuuaaauuguuauuuuaccaccauucacguaggaguuuaaugcuugguagguuuucugagucauuuggaauucccuguuaaguagccucaagccauagacugugacugcagcucucuuggugguguauguucaagaacuuaaagggaauuuagcacaaguuuuucaucccaucagacguuaggccacuagcucuucuuacugcguaccuuucucuccugucugucgaggaucugauuucuagaaggcaaugauggccagucauuaagaggauagggaaacgggcacaggagagucaggcacacugucuguggcagacuuccucagugcuaguccaguuuuuucuuccuugaugagcugaacgcauuuguaaauuuuguuuggggguuuguugagucucucaagauuauauaguaagacccaaucugaaaauaauguaaggagauaaacuguauacuacuaucaacaacuacuuuaucuuaguuacauggagaaguuuuucuuagugagcucacagagaaaagucacuggucucuguaaauacccacacugcuccccgaaaagaucaauagauaaugcuuuuugaaacgugcuaagaagccaguucuucuguuaacacaaagguuguguccuauuuugccuuccuuguguuuuaggguaaaacaccaugacuaaaagcaacauaaggaggaaaagguuuauuugucagucacugagggaagucggggcugguaauagacaaguggguacuccuuacugguuuacucuccaugccuugcuuagccugcuuucuuagaguaaccgggaccacauucccaggggcaguacugccacagugggcuagauccucucauaucaaucaagaaaagauuugccuaacaggacaaucuaauaaaggcuaaauucuguagcuaua

SEQ ID NO: 7581 - RNA, 193463 nt, Mus musculus
cagacacaggcgcgccaccgcugccgucgcugccgccgccgcagcccuuggcucccccggcuggaaaccuuggcgaucgaacugcugccuccaccucugcgccgcuugccgccccucccgcagucccgcggcuuucgagggagcgcugcggggacucgggaccgccggggaaaccugugaccccgcgcaggagcggcggggcgggggaccgggagaagauggcgacgccgggaagcgaaccccaagcuuucgcgcccgcucucucgguaaccgcccugcacccgcaucuccaccagcaccaccaacaccaccaacaccaccagcaccacggaggcaccggcggcaccggcuucaaccugcccuugaaccgugguuuggagcgcgcgcuggaggaggcggccaacucugggggcuugaaccugagcgccaggaagcugaaggaguuucccaggacuacggccccgggacaugaccucucggacacgguucgggcaggugagacaaggccggggcuggccacgcgugugcgagccgggcugucgcuccuucccgccgggcccgaauguguuacuagauuggcucggcaggagcggguucugcaacgagcacggugguuguagcgggcacggugguccuccuggccccggcgaccugcgaccguggugcaggagcgcagggaugcgccuaggagcuguuccuggcgcgcgggaagugggggcaucucgggcgaccgcgagcaaguccagaacacgaaccaagucguggaccucuacauggaagcauucugcguccugguggguggggaaggccagacaaagguggccggccgucggcuagcccuguccucuccgcguagugucggggccccggccuccgcgccgcgcgaccguggcuugcugcagccagagaggcggugccaaccuugguucugcgccugugcgagcagaggcuggugucuggcucuccgcccacacauuuugguucccuccaccggggcuccccgguucucacuaaccccggucuuugcgggggcccuggaggggaagcguggcauaguaaaugaaaaguaauuaaagugagccuguuugccagugugagcccggcaaguuguaacccgcgccacagagcagccugcuucuucaaguugugucauguguugacauauuuuggagaugucugcuuucccuuuaguagucggaguugugggaguggacccauaaacaggaaggagggugguggaagaggguuggggccuugggaauccgugcagaucugacuuaaguuuccgaccauauccuguucuguucuuugcgggacgauuuguaccccagcgagcgccuagcguuucccagggcagugggugccccacuuuugugccauugccuagaccucacgacugucguugucucuuccgacuugcaucaggucucuuaggcuucugaauggcuuggcuuucagaugggguccuucagcuacuuauaaaggaagacuagggggcggggcaggggagccagcuguggcuuucggaggcuagguuucugguuaauuccauaaacauuuaaucaggagaccaauugaaaauuuagauggaguucugaguccauuggaggcuagaagcacuccucuggagucauuaaacggugauauuuggguuuaaggauugucaggaauggguaagcagaggggaaauuccagaacucaguuuucaacagcuggagaggcucuugauaggaccucauaguuacagcuucucaaguagaaguuauucuaagagucgccugaaucauuaaccuuaaaaagucaccccauguuuuccuucccaucugccauaguuagaauggcuguguacugcagaauggagaaucagaaugccccaugcuaacguguucgcgcuauucaguagcaggcuuagaguuauuccaacacuucaguauuacucaugauuccucccaagguuggguagaguuggcaugugugcugugcuggcaugucuuugagaauaccauugcuuuaaaaguaguggagggagguguucaucuuucaguuaccgccucugugaguugacacuguguggaaaggguccuuccuuccuguucucucugugugcgguggggugugcagguguccaggcauuaggaguguuacauauauuuuaaugcuccuaaaauccuuaaguagucaaaaguaagaggcuucaugcuaauucuccacccuaaaacaguuacuauuuuggagcagcagcggcaaaagaaugucagcuacguuugugggcacuuaaggcaauaccauaaagaaaacaaaagcaaaaacaaaaacaguagcugaagagucuguuguuuuauguaaaaguuucaacauucacauguguuaaggauugcuugccuugaccugagucacacaugugagugaguauuccucucuucuccagaaaugcuuagguuggacacggggacuuugccugugagcccaguaguuggaggccagucuggacuuaguaguaaauuccaggccagccuccguuacagguuaaggcggcccugacucauucuucaugccuauacacccccacaucccccaaagaguguauuaaauugagcauuauucuuuacuugugaaagcaacaaagcaaaauaaagacauuccgugggggguguugacauuuccuacacauaagggaguugagggagauguugaaccuuugguaauaauaaaucccauacagauaguggcuucuccugggcucaaacaucuaaggauggacuaugacgauccucaagacccuuucauaaguuuacuuggguaguggggagccuuuucucucuguuaaguuauguguuucauugugucuuguaaaauuuagccuuuccagcagcuauuucuacagacagcaccacauacuugggccacacagcccaacugaacagagauguaaaguaagagaugagaggcccugaacugcucaguaguacaagaaaccaaaaccaaaacaaagaccuucuuaauuucacuuuuaggcuguuauuucccugaaauucaaucaaaacagcaugcuuugugccaagacaggcaguccuguaguaaguaagcuuacugggaaguagcuggggacaguggcagaggcguuacuauccuagacuggauuagaacugaugugggcaugguacuuacuuggcuaacugugaagucugugucaggagcacaguuggaacaucaucuccccguagagagaagccagguuacaugcuuaaagucauaccccugcugagacacagaccagugaucugaguccucaaggcuucucucuaguguuuguguccugaccgaagccuguugggcagagggcaaccguggagagaguagaauuugggaggcuucuugaagguucauuccauagaccuucaucccuucaccuguucugugaggucccacucugguuugaggaagggaugggagauaaacaaagcaaaagaaaacaaaacaaaauaaaacaguuuaucuugcaagaugaguaagagggguuuuuuggauacaugcaauaccuuuguuuuccaaacacaggcacugauucucauggacuugagguugcucauaacaagaguacgugaugaccaucauaaguguagacagaaacacaacacugggucugaugagaagaaauagacaaaggcaugucagugaagcacccccguccccgcuagcguugauuuaucacauagcaccaguucagauggaggaguucaaaguggguguuuauaugacuggauucaaaaggaaagaaaucugagaguggccuccugugugaggcucuagaaaauaaauaauaauaaaaaaauccauguacaggacuuuggaaauuaauaguuuagccaggccuguuggcaagggccuguaccugaggguuacaggaaggcuaggagauuagggauauccguuuguacauuagaccgugccugaaaaaaaaaaaaaaaaaaaggucgguguugugaccaaaaggucgguguugugaccgagugguggagucugucauucugagugucuuaccaagacuaaauggggaauggagagcuugucuaaccauguggcauaacuacucacugagacuggacccgauagaacuggccugugaucccagccucuugggacugagagaaguggaucacaguuucaaggccuucuugaacuacaaagugagcucagagccaguccagcaucuuaguaagagcuugucucaaaacugaaagugaaaagaggguuuggagagauugcucagugguuaagagcacugacugcucuucugaagguccugaguucaaaucccagcaaccacauaguggcucacaaccaucuguaauaagaucugucacccucuucuggugucugaagacagcuacaguguacuuacauacaauaauaaauaaaucuaaaaaaaagaaaauuaaaaaaaaaaaagaaaagagaaaagaugguuuggguuaaucacaaggugguggagaacugggagccuguaugagacuugguggaaagguucagggcuugaacaugcgaggcaagugcucuaccguugugccaucccuacccccggcaugccccaggaagugaagcugcaaaguguaagacaugaaaagccaaguguaaaggguucaggaagccaccggaggagccccacgggacaaucgauguccagacagcaccggcacugugugcagccuucagaggccuccugcaguggagggagggugccugacagggcuugcaggguuggauguggguagacaugaccacgaagcauuuucuggugggaaagaugaauccaggauggggagggagaaccugucauuaaaagaagagagaggauauuuaggucuggcuucuggucacauccucucaccccaccuaauagcaggugacagggugacagggugacagagccccuuuucaccccacuccugcuuuacuggggugacagagcccagagcuuuuaugagggcucuggaauuugucagugggugggacugucaucuugccugccuuaacucuaccucuuuucagugucugugaagauucaagaucugggggcaagcuucucugcagcaggcugacuuccucuacccaacucccuccaccgccuccccaauagcugcagaguccuuggauaugagcauauaugagcccuuggaauccauacagaacuugguaaugaaaccugguuuugauaacaugcucugugccauaauuuuggccaugaagauuuuuucacuguuagagcgagacauuugaauccaccaccccuucccuaagacaggguuucuucgguguagcccuggcuucccuggaacucauccuguagaccaggcugggcuugaacucagaccugccugccucccuucugaguucuggggucaaacgcauacgcuaccaggccuugucacauguguuuucuuaaaccuuguguucuuucuuucacaauguuggucaguggugacgccuuuaaucccagcacuuggggggcagaggcucugccucugugaguucaaggccagccuugucuauagugagaguuccaggaaagccagggcuacacagagaaaaauccuaucuuaauaaaauaaaauagacaacaacaacaacaacaacaacaaaaaaacaacaaaaacuuguauaacuauaccuagucuaaagaauugauuuguugguuauugauauuuuuugucacuuaaaaauuauuuuuaauguuuuuuuaaagagaauuuugcacauagauauaauguauuuagauuguggucaccucauuacuuucuccuuuguucugccucucugccugaaccuuuucuucccagggaccuuccccuucuauucuaugacuucuugugugugaccccugaauuuaguuagggucgaccaguuggugcuguagccacuguuaaguuacccaugcucuguuaaauacaccucuguguucacauagucacccuagcguguuuguucaccgugcguagugggguuauucauccauucaggcccugcuagcuauacccuuccccuuccuauucauauucucuucugcuguugauugauuucuuccuugucagggcacagaggacuuuuaaaacuauuaaaaacuuuaaagcacugugauucaguacacggggguggggguuggggagugaccugaaucacauccagcuguguuccucccugugcuguggugugacccaaaggugcccuaccaacuugcaugucagacugcucuauugaaaagccagucgcguacacaugcuuccaaaacaguaacauagaaggacagaccaggaagccaguuccucaucaaaguauaucccaaagcuguugauccuugucuuugaacuggaucuguugguuggagauuuugugaguccugguaacacuguauuugauuuuugcuaguucuuguuaggccaaaauuugccucccauccaaccauuggacaguuuuuauuucagguguugacuaagacuuuuccugaguugcugaagcaaggcgcggugcuaucaggauuuaaaggcuggacagacgccucucagaguacaugucuucuccuugcugaggcuucucugccauuguacucaucuucaucauggcuuuauugaaccucacuuuauuaaacccaaauuuccucccuuugaaguguguguuuguaucccggugcccuguuuuccagaucuaucgagaguguuauauaaaauccuugaauaggcugagcaguguuuacuuccgguuccucucuuuguugucaccuucccauccccucuaaugugauucucucaagauucuguguaguaaaugguagaggugguuaugaguguauagugguuugaauaggaauggcucccacagauucacguguugaagcugggccguagggaguggcacaguuaagagguguggccuuacugaaggagguguggcuuuguuaaaggaagugugucacuguggaggcggggcuuugaggucucaauauauuccucaagcucugcccuguauggaaacacaacccccuucugcugccuauggaucaagauguagaacucucagcucuuuuuccaacaccaagucugccuggaugcugccaugcuuccugccaugaugaucauggacugaaccucugaaccuuaagccagccucaauuacauguuugccuuauaagaguuggcuugggggcuggagagauggcucagugguuuagggcauugacugcucuuccagaaguccugaguuuaauucccagcaaccacaugguagcucacaccaucuguaaugggaucugaugcccucuucugauaugucugaagacaguuacaguguauucacauaaauaaaauaaaucuuuaaaaaaagaagaaaaaaaaagaguuggcuuggucaugaugucucuucacagcaacgaaacccuaagacagaguccaucagccaagauacaacacuugagcuguuuacacuuuagacuuagcccuuuggagaaauguauuuaguuuuagagagauauuagccuugguuagguaguucacgaacccucccugaucaugucaguuguugggauuacaguggguugguguuaaaugcagcgguggagucauaaaguuauaauagauuauaaaaguuuaauagccaacuggucuuacacaccuguuaucgguggaucaggcccagccuggguucuagaauaaggcccugucugcagaauacaaaaacaacaaaaauuuaagucuguaaguuguacaaccuaacuauauuuccauagcuugaguuuuuuucuuuagcgagauagcacggcucaugggaagccuagcuucuguccauugcuacuguuguguugcaugaaagcugcuugugugugugugugugugugugugugcacgcgugugcgcccgagugugugcaagugccagugagcugcggaaucugccucucugugacucucaccccuaccugauuguuccaggcuuuuaaguaggaauuggggauuaaacuuggguccucaugcaugacagccgcuuuauugacugggccaucuccuuaguagcaaaguuucuuuuugugacagaacauugcuaugcuaaaguuuuuuuuuuuuuuuaaauaauuauuauaaacaaugagaauugcuuaacaaaacaaagacaaacaaaaacacuaaagaaaaaggagaauuccaacuuaaacuuauuuuaggaaagcuccgucuaucagaagcauacuuguucuuccucuuacuuugcgaguccaggggccugcuuccuccguaccccguaggaagaaacaaugcauuuggaaaccacagagcaacagaacagaaagugagcuugccugcacggacagaaggaagucgacaguugugaggacuggauugcuucugcguguuccaggaucugaggagaaagggaaaugugcucuaauuuuuaaaauauuuuuacgcauacuagcuuuuugccugaauauaagcacauguaccgugugugugugccucuugcccauggaagucagaaaaaaggggggugggugcccuagaacuguaguuagagauggcugugagguguuacauggauucugagaagugaauccggguccucuguaagagcaaguguucuuaacuacugaacugggaagugugguuuucuguuuguuuguuuguuuuugugugcccccuccuccuaccccucagcugagggcugaacccagggccuugcgcuugcuaggcaagugcucuaccacugaccuaaaauccccaacccccuugggauaugugguuuugauuagaauucuguguauucaguuugccucagcuguagccuccucugcuggcucaauaaggaagguauaaaucugggggcacacaaggaaaaaaccaaucagaacaacacuguugauuuucauaguagaaauguucccccccccaucccucuccagaccgaccuuccuuccuuucuuccuuccuuccuuccuuccuuccuuccuuccuuccuuccuuccuuccuuccuuccuuccuuccuuccuuccccuuaagacaugguuuccuuauguggcuugggccagccacaaacucucucuauagccuugaacuugauaugugguccauacaggccuucacuugggauccccccugcuucucuuuccccagguugggauuuuuuucucuuaauuagaaaugaguuguuuuguaucaguaugcuuuuggcauaggcaagugggcuugauagacgugagagcacacacugcacuuagguaguuucaaggagguaaugagucuggggaucagguaauggguccugggaucgcccuugaggcuggcuuuccucccagguuucccuuguucccucugcugcaugagcccuaaagagagcaugagaugaacagggcagggcaugagccuguuggagaauuguucccagcgugcucuacugugcccaccuucuauucuccggcuucccauauggccacgcucuugacagcagaccccaugggcacuguacauuuguugggucauguacuccacugauacucuuccauauuuuugguguuuaugugguaugguguguccuacagugucagcauuccugaccugguacagaacuuuagcguaguccugacuuaaugcccuugaucucugcagaccacagugacaguucaaaauugcgccaucaauagacugccuaccuugccucuuuagacuguuuucguuuugcuuuuccacgucuucggucacauggucccacucuucacugcucuauggaauucugcacgcccaguucauauuccguguagccacuggccugucggaagcaagccaccucccugucaaccucuucuuuugcaucggagcauugacucauaugucgcuccaaggcgcauuaguuagugccauuuccucaugcauuuuguauuucuuuauuuuuuuuuccccuuuguguauaaguagccuucccucacagugacuccacuuccaugguuuuuguuaaccuguggccaccuguuguccaaaaauauuaaauggaaaauuccagaaauaaauaagucguaagucaaucacuuaguagucuuuuuuuugguaaucuggcgaacuggugcaguguaacauuaguguacagguaucccuuauguaguagugugagucucugucagcauaccuuuaucacccaucucucuuuguccuauuuguccuauuguaugggcauugugucaucuuauaucggcacuaagaggaugaauauacuacaguaggauaucauguagauaugugugugugugugugugugugugugugugugcgagagcaguaaagacagacauugccugaagagacugucuuguaaaggggguauguuggggguggcaccucagguuguccucuggccacgacaugugcaagcaggcauaugugcacauauaccccgcaaaagaccacauuuauuacaguauuuuuaucauuaauuuuuuguaauuauuccuauuuuuaaugacgucuauuugugagugucuguguauggguaagugcacugugagagcaagcaccuaaggaggccagaggugacauuguuacaagagauugggagccugagguggggucugggaacucaacucagauuuucugcaacaguagcaaguucucuuaacugucaagccaucucucuaaccccuaguaguuacuguuucuuaugucccacugugcuucauugggaaauuacgccuuagcauaggcaugcauagacaggaagaagccuucuguagacagaguugaguauuagcugugcuuucaaugaccuaccaggggccuaggauuguuuccaucuuagaaaaaaggggaagugcugugcucuccucaaguuuaaguuucuuccuccuugacuggcucaugagaguggcuagacagggacuuuccugauugugugugugcaugugugugugcauaugugugugugugugugugugugugugugugugugagagagagagagagagagagagagagagagagagagagguguauguacaugcauauguguuuguguaugccuuacagaucucucaaaccagaauaguucgauagauucccuugcuuaucugccuucucuuucuugccuugagacucugaacuuucacuuguuaucuugaaucuauggugagguugucccaaacuugugccuuguuagucagucugcugucuuuuccccagccagcuuuauaugacaucuguaagucaagugacuuacaaggaauucuggaggagguggacaaaaaaauuccaucaaagcaaauaguggauaaaauagcugguaaaaaugaacucugguguggugacacaugccuuucagcucagcaugcaggaggcugcaguaggauuuuugagccuagccugggcuauguugcauguuucaggcuaguucaagcuuuauauaaugagaccugucagcuaacaagaagucaaacagcaaaugcuuguccagcuuuggggaaaagggaaccauuauucauacaguauuggugggaauguauauuagcauguccauuauggaaaucauuguccucaaaaaccaaggaggcuggagggauggcucagggguuacgagcacuuacugcucaugcagaggaccuggguucgguucccagcacacccauggugguucacuaccaucuguaauuucaguuccaggguauccaacucccuuucugaccucuguaggcuuuugcacgcaugugguacacauauguacaugcaggcguagccacauacacauggacucuauaaagauaauauuaaaguaaucccuuaaaaaaacccaugaaauggaacuagcauggauuuagggaguucacaucccuguacagcagagacaccugcaugccuguguuuacugccgugcuauuugugauagccaagguaugaaucagcucagauguccaucaguaagaugugacagauauacaugaguauggugucauacucagcugccaggcaggaaaauggauggaacuggagaucgugguaagcaaaauaaaugaggcucaaaagauaauuuggcuuguuuuccccucauauccagaaucuagacuuuuuaaaagaggacuugaaaauagagggggcauguuugagaagggggagggggccauagugaggguugggaaccagcagggggcuaguaggggcuugaauaaguaaaagcacaugcauaaaugugcacacacaugauaauguuuggugcucauuuuuuuuuuguuaaaguucauuaaaaucuuuuuuuuuaauuuaaaaauuuguuaagauuuaaaauuuuuaugugugugaguguuuuguucccauguguguucccaugugugucugugcacuauaugagggccugguuagaagggcaucagauucagacucaccgggauuggaacccacgugcuugugaguugccgcguggguacugggagucaaacucuggccucugugaaaacaaagugcucuuaacugccggggcauuucuucauccccaaaacuuaauuauaaagaacuugcaaaugaagaacaucucacccucacugaauuuggagccuguggucaggcuccagcaagcuucagugaucugccuccgcagugcuagcaauacagcaacaagcugggcuucucugcucuuacuugggugcucuggacuagaacccagguccuuaugcuugcaugauagguaguuuacuaaaugcaaugaacacccccucccagcccucaucaacauuucugggguacauauauauauguauguauguauuuauguguauguauguauguauguguauguauguguauauauauauauauauacauauauauauauguauauauauggagaaguggauuuuuaauauuuuaaauuuuaaauauuuuaauauuuuauauuuauauauaaaaauagagauguaguuuuaucuccuucauagacugguaaagauuauagaaguaaugugugugaaagaacuuuacacauuuaaguauucucauuaacaaaugcugauuaaagacuuucagcccuuagcuaguggcacucucaucaggauagcucagugguuaaaacugaugauucucuucagcuucuaaggcuugaguccaaucucaaacuaaaaacuuaaaaaucucgucuccuuggccacaugaaucccgaccaucucuuucuuuaccugggcaauggagcuaauagaguuguccagcacggcggggggccggauccugcuucaauacuguucugugguuaaugcuugccagguguggugcuuugagcaugggcggggcuuagucagccuggccacaccuucuguugucuucugaaaaagagggaauguagaaaccuagaaacuguucuuccuauuucuuugucauucagguggaggacaaugagucccagaggaaucuguucuuuggccuuggucauguaacaagaaugucgggugccugagccaagggagagccuuucaugguccuguguuaaagagccgucgauguagagucaggaggccacaguagacccgagaggaggcuucugucccucuguaaaggucuuagcucaugcucuacugauuguggcaggccccaccacgaucagaaaaugcccugaaaccuuuaaugacaucugguccaaagcuggagcaaaugacauaagaccaacaguaguuagggauuaagcguguuaguucaggauuuuacugccugugguuugggggacuugcgcaggcuccuugugaacgggauuccaagcacuuaacagccucguugggcagcccugcuucacaaacuaggcuucaaaguuccuuuuguagcaaccuugguaauuugggauucgcucuuccagguuuccugugaaagcaaugauuuaguucccuuaccaacccaggaaggcccauuaaaugcuagcagaugccagccuucauguucauaguuaauucuuucuucuucuuuucuuguguauguggaugcaugggugucugugugugcgugccuuugugcaggacagaugucaaccuugaguugagcuuccucaggaccgguucaccauuuucuuuuacaggcauggucuuuuucuguucugacggucaccaauuaggcuagauugguugccaguaaaccccaacuuuccuccugucuccaucuucuccaacacugggauuacagacuggcaccuggcuuuuuaugugguucugaggauugaacucugguccccauccuugggugacauuuaucuuacugacucauuauuucucuugagacacacagcugcauuuugaagggauacucugaguucugugacauggucaucaaccugugaagcaggauuuuuuuuuuuuuuuuuuuugccucuggaaggucauucuucuagcuaugcccagcuaugcccagagaccuuagagggucucugucuccaccccauucuaggcuccuugaucagugggccuaagcuggauuucucuccacaguggugugggcuucuaaaacugccacaagucagggccuugaguugucucugacacucaggcugccaggcagaaguccuggauuuauauauuuccucauucauucauucauucauucauucauucauucauucauaaugcaggucuuaccaguacagugucuuuaaacucacuguacucucgguguuaggauugcaagcgugugcuacuaugcuuauuuccuuucuuucucauauuuguuaucuaacaaauuacaaauuuuagagcuggagggaaguuauucagugucuuuaauggugauauuuguaaauuugcuaaaaacaaaaaugcuggccggguauauuggcacacauuuuuuaaucccagcacucaggaggcagaggcaggcagaucucugaguacaaggccagccuaguuuacaaggagaguuccaggacagccaagcuacacagaaaaauccugucuugaaaaacaaacaaaaaaccaaaaccaaaccaaaccaauccaaaucaaaccaaccaaccaaccaaaaaacagaaaacaaaagaagaaaaccaaaaaucccuuuccugcuuggauccucuguagagucaccagggugcacacuagauagagcucagcagauuugccauaggguaggugacuagagcucagcagaugugccauagggugccccauggaguacaaauggcucuguucaucauucagggcuuggaaagugccagccugucauaggcacagugccggagaacucaagcugucaggacuucauccagcugcgaagggcacagcacgucauuuccugcgccucaguuuccuuacuguaaaaggagcacugugauccucuggguucuugugaagagucaaugauagucggcguguguccugucgaucaacagucggcacagaauuugcuguuaugaggcaccugcggagaagauacucagucuucuaagacacgggaagauuugcuuccuagaaaauauugugacauuaaccaaguaaucuuaauacacgcaacgguuggguugugugagcuggcgguguguggaggcgcuguuucuguucuccugacagacuugggaagguggaaguagguggcgacauuccacauccagucuuucuugaguuauacugcugguucugggacagucagaaccauguuuuaugggcuuuuguguuuuguuuuccaacugguccucagcucgacaguggccuuugguugauuugacaaagguauccugagggaaugagcccuggguucugugcaucuuggggcugcauuccugauccauaugguauauggaggagcaggcugcugcggucagcucuuuagucuggggaauugaaguugggacaaggauaguagagucugggaguacuuggcugaccucaaaccugucacuucuguuuugccuuugcugccauuauaucccccuccaagaugucucacaucccucccucacccaagauuuuguuaaggaaagccaagggggcacuuuguguuaagcaagaucacaugugguuccuggauacuuagcauggucccuacuugguucccaggucgcccaacaucuuuguuucugagaagggaacucaaaugauccaaguacgcucugaacaagaaaaugugguaacgacuuggagcucagcucuugaagaagcuacggagcauccuucgcuuuggggucacuggaggaguggaugagagggagggaggcauugcuuaggagacccggaccuagggcacugugacagaugagccuuuggguagcagagaugcuggaguccaucccagacuaugauucuugcaugacuuccuguaccgauccgaagcagugugcagagugaccauguacaagcugagaagaauccagccagagccucccccuugugugccuccaacuccuuuuguaagaaaugaauucuaaaggaaguaaaaauucuaaaggaaguuaaaaaaaaaaagauguauucaaaacuuccaacuguaaugacuugaaacagacauuuuguaaagggggaaagaagaaaaauguaggcauauguuguuuauuugcuuggacgucaauguuuccuacuagaguauauaaucuaacuuuuuugauccuuucauuggcaucugacuagacuuuaaucucucuaaugagaaaugaacaagugucauuuugguuggagaccaagaaguugaggacccagaacauuacaagagacaaguaccuauuuuaugaagcaagccugccugccugccuuccuuuccuuccuuccuuuccuuuucuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuucccuucccuucccuucccuucccuuuccuuuccuuccuuccuuccuuccuuccuuccuuccuuccuuccuaucuuguuuuuuugagacagagauccaccugccucuguuaggauuaaaggcaugccccaccaucgccugccugaaagcugccauuuuuagguaacaagaauuauugauuugaucuauuaaaaugugugucuuacuuagcacauuugcuugguuacauuuaaaaccuuuuuaaguguggagccaggccugguaaaguagacuuuaagucucagccguuaaggagguugagacacggggauugcuaauucaugacuagccuuugccauagauuuaguucaaaaccaaccuggucuaguuaggaagacccugucucaaaauagaaaguaauaaaaagggcugaagauguaacucagugguauuuccuaguauaugugauucagaccacaguacuacccuaaagacaaaagaaaaccuuguaagugugccagaggguagagugaucucggugguagagugcuaacaugcaagggcucugggguucaaguccuagcacugcaaaaccccuggcauucuguugguuugcaauuugaacguaauuuaaagggaggcaucuuucucuuuuugcauaguucccucagaggaguggaugguaaucucagcaugcaguuuaaaguagauguguguguguguguguguguguguguguguguguguguguguguguguguguguguauguguguguguguguuuguguuuaggaagccuugauauauccaaauuaauuacaguuuuagcugugguucagauaaugcuuucugguaacuguggccaacuuucuccgguauuguuaccaggagcccauuagagacggucagucccacccaggugacagccaauugaaagucuuuauuccagcagcugggauuacacucagguacucagaccuagaguauagcccugagcauuuagaucaaggggcuuuuaaagacaaaaccuaccuucuguuaucucauucagcagcugcaggggcuucuuagaagcaugaaguuuaacagaagcuaagauaaacuguuagcuggaggagguccugcacaagcaagcaguuuaacagaagcuaagguaaguuagcugggccaucuuaaccucagguccuagaauggaguuggguaauuugccacgggauucuccaucagaaagaucagauucuaguuaaagcugaaauggcuucagcaagaauacaagauggaggaacccccacacugccuugcccuguugcuguauuaugccacacauuuaugagagggaauguguugaaauaugaucuguuuuaugaaacuugguuggcagcugagaagacugacugacugcuuucuugaguugguauguuaacgaagauaggauagcuucccucacacagugggaguucugaaugcuuguccgagcccuuccagccugucccugaggaguccauugaagucagguagcccuggucuuuccaaaguggcuuuauagguucuggguucuguguauuuucuguggugacucugggucucagaccacuucccuccguggguagacuguguguguguguguguguguguguguguguguacacguauguaugcauaugugccccuucaaguguguuuguguaucacaucuguguggaagccagaggacaccaucaggcauuacucagucucuggucauccuauuacaggguuggccugaagcuugcugguuagacgccucuggcuggccagugagcccuagcauccacccaucuucaccuccccagagcuaggauuaugaacacacgucagcacgugugccauuuuuauauggguccuggggauugaagucaggacaagcauuuuacagucugagccaucuccucagcccuguuuauaauccuuuaccacuaccuaauagaccgacuugggcaagcucuggcaccucugcaugaaagacuuccacuuuugcucagucuuucacuuucugagagaacgucugaccacaucaucugagggaccucggggugggggugggguuggggugcucaugaguucagauugccuggaugguuggcaauauccuucuugcuccagccuaguuacugcuaaaacccuccuuaauauaucuccuaauuuuuguaguuauucaugcacaugggacaugguagaggagagacuccaucuuuuaagguuuuucauucauuuauuuacaugucuauguguggguaugccuacaccaccauggugcugguggagaggucagaggacaaccugcagaagucaguucugucuuucugccuuguggcucugggauaaaugguugaggggauggguaucaaacucaacaaguguccuuaacuguuaugucaucuuguguacaugauaaucuucuaagcauaguuugaaauggaugaaaggaugcgacuuucccauauaugcuagcugaaugaaaauugaggcuauagcugcuccuagguguggcugaagagagguuuauuguggauaugaaggagagaauagccugaggcaucugagguggaguggugagaggggaagagagaggaagcaggagccaagagggaggccaggagcaagccaggugaccaagacaccagaagaccgguagccagaguggcugagguuguagggauccuaggaagggaagcccagucucugagcuggagaguucgggguuggggcagggucagaggugcuggggggagcuacagguaccaacugagcucuggugucuuugagaucuaauagcagccaguuuuguaaaaucagguccuaaaguggacaagugcaucccggucaucuuugccagcugccaggacugcuguccuuugaagggacuaacaauacuuggcagucuuucuuuuuaacuuccauaaaauaagguguuuggcauuugucacuaauuuugacuagcaagaucuagcacuaauuuaaaaaucaugagauguagucauguagauacgauuuaaauagugguagcaaggcagacauggggacguagagcuggguagguagguguagcaaguaguccuauuccacacuggccuugaacuugugaaccucuggccucagccugccacacaugcacccccauguucgcuaagagaaugcuuguauugauuggaacagcgaguacacaggugaauacauuggccagcacucccuacuuuaaauggguggauuuuacuacauggagauugugucuuccuaaaguugacuaaaccgcaccuaagcgugugcucucccacuuagaaagcggcucauucccauagguucgcagcccuccgccuacuggcgauucccaacugacaaagcuguuuuaaaauagaacagcuggaguuugccagcaaauagaaucagugccuaccuuugcaaggguggccguucuguuuucacuuucuuaaagugucucaucaacauugucuucaugaaauguuugaguucuguucauaaauggcccuuaaaagcaucugaugaacaaaaaaacugguguugaaccagaugugcugggaccacuggguugcuguuagcugaguucaagauggaagaacauggccccgccuauugugaaugccccaugcuauagaguagccacccccuccgacuauacaacagguaucuuuuauguuaucacagccagagcuuauaaaugcaaaguagcuugucaggaucacgcagaagaggggauagggacucagaguuuguaccccaguugucugaugcugaaacuugacccaucuuucucacacaguuauugugagccgcuuuuuccuagggacaguggaguguugguuggaucuaguggcccugggaccaugugaccuggcccuuuccaacuucccaaggcacagcugugaucuugcacacugccugucagacccccucccuggcucgcuccugccagcccacccaggcucagcugcuugacagccgggucucuaggggcucuggaaucugacgccgcccugcuuauccuacugaggucucccgugagaccuuccccaaaggcguugguggcuccagcugccuuucuucugaaugucuucauauauucccggcuuagggcuuccacuuuacauuugaccauaccuuuucuaucccuacuauauucauugggggaaaagagaacagaaacacaaaaccccaaggcuuuuuucaucccuguaaaucaccuuagcaccuuagcugcugcugcuuuugugguacccaacuuccagccucaagccccgccucuccgcuccucaccuccauuugugugcccuagugggcaguuagggugacucggcuguuccuaacguguucuguguccuggaucuuggaucuucuuaacacaauuaaucauuaucauugucacaaugaugauaaugguuuauuugagucagauagcaugcucuccccuucauguccuuuuucccauuuaguucccugaacaaucuuaugaggcagguacauccacuccacaguucuucgagauucagagaguaagacccagcgucccaucgcuaccaaguggagaagcagauucaaauucaguuugacugcucugcuggcucuuugcagcuuccugaggggaggggagaggagagacuuucugaggcgagggauggaggugcuaggccuggcaucucacauuauccuugcuguggugcuggaagguucccaggucuccaaaugcuguguuuaaauaauuaucucaaggucgcggagcugaugagaagaggcaucugagucaagccagagcucgugauccaugagaugccuuaccagugugggagaaacaccagagaaugaaauacgguuucucccacacugguaaggcauccaaagggaccaaaggaugaaauaugugcucagggccuggcacagggccagguacuguuuccaguuaguucuacuuuggguauugggagcaugagccuggauggcauguucucguagggaguaguacaauccacagucuguucaauuucuaaaagaacacucagaaacaaauauguaugacagguaaaugaaugcccauagccgccacaggcucucuucugucugucugucugucugucuccuucugagucagucucucucucucucucucucucucucucucagaaacaaagaugugugacagguaagugaacacccauagcaaccccagguucucugucugcuugccugucugucuaucacucacucauucagaaacaaagauaugugagagcuaaguggauguccauagcagccauaggcucucuucugucugucugucugucugucuaucugagagagagagagcaugacuuuauaugugcacacaugcauguucaggugcgugugcauaugggaugaaguugugugucuacauugauuauucuucacuuugucuugauacaguggucucucacuggaccuggggcucacagguugaccagacuggcucgcuagugaguuccuggcaucugccugccuuuagcucuaggcuuaugagugugugugacaugucuagcuuuacagaauguaugcuggugauuggaacucagguccucaaacgcuuguguggcaggcaccuuaccaacugagccaucuccccaucuuacacaucuuuagaggacaucaccuuauucuuuucuauaguggagaaguaccaaaaccuaagcggggaggugccuuccuccucugaugugcagcuugauguuguuagucuucuccagguggcugaccucacaccuuauccccuuucuugcccuucacggugaggaaguaaaugauaauggcaugcuacuuuuucauugguggagucuugcuucuaaggcuacccuagagcuccuguuagaguaauuugcuauauuaaagcccugaggaggccuggagagguggcuaggugguuaagaacacuggaugcucuucuagagacccacacuguggcucacaaccacauguaacuccaguuccagaagaucuggugcccucuucuggcuucuuugggcaccagacaugacauggugcacaggcauaugugcagacaaacccacgugcauauaaaguaaauacaaaaaucaaaaaguucuaacuuaccaaaaaagaaacuuucauugauacaauguuauaauauaugggaauccgggugauuaauuacgugacuaugugacugccugcucauguugguggugacacuggguagugcuuagcauaggugcaccagcagguucaagggacugcucugccccaggugauuccuggacuuuggguuggacuuucaguuuuuuuguuuucaguugcuggagaggaguuagcugugcacacuggaguuccacacagugaacugcuuucaugguugcuuucuagaacugugaaugacaugaaaacccccugggugaggagacacuaaguguucaguucucuaugucuuugauuggcucgugugcuuuucuuuuuguggcuguucuuagaauuuaaagcuaucuuggcugugagagugauuugcuuggugaccaagaucaaggucagauucucauuggaugagugauuuggggcaauucauacaccuuugcaaaccucugauccuccccacccccacugcuuguagcugcacuuugauguucaaacccuuguucaaacacaagggcuauuuuuagaggaagggucuccuugcuguuccuaaccaccucuuacuggggaccugcaucugucucugucacuagucuggggacauagcuccaggcuguuacagcugucccucuguucccuuggccugccagcccugggugaggccacucccaucccaggcacugccuggggcucccuguccugacuuuccagcuagcucacugcauuuugaagggaggacuuuugcgaucucugauccacagugccugaaacacagaugcagaaccucugaagcugcugccgugcucccaagcagauacacuuaucauuguauuugaacuacacugagacuuacugcaauucuuccauaaggucugugacugggacuuggcccacaaccucucacauggcugggugucuuacuuagcccuugguaaaaggugaaauggaugagugaaagaaagagauggcaccacucaaaaagcagauucugucuguguuaucugaacaccucugacuaaccuggaacucacucuguagaccagguuggccuugaacucacagagauccgucugcugccaccucccaagugaugggaauaaaauggaaauaaaagugugugccaccauuuccucagaguuacucuuaacagaugggguguaguuuggaaacgacacuuagaaccuuauguuauaagcacuuccuucuggguauaagaagaugccauccuauacugacuuauggcaacuauauuaguguccgcaggucugugguaaugggaguggagcugcuuacaaucuuagggagggucugaagaccuucaugagggagucccagcuguuaccucucauaaccuaagugaucuuggcagaugccuuuacccgcugagccauuucauugcguuaguagccuacagcauggcuuagaaccacagcauggcuuagaaccacaucgaugugucuaaauagagaguucuugcugcauccucguggucuggguaaagaccugggccugagagaacuuacuuugugagguguaagcucaggaaugauuccccggguacacgcuccucuacagaguacauccguaaaucuaaaagcucuuggagagugcaugcgugaggaaggaggagauacagugguuggagguggucuccauucugacuucucaagcccuucaaguaggcacuucaaagcuuugccuagaguguguguuuugugacuucuuguggugacuauguuuuggcaacccuucauuagcaccggccaaugccuugaaugaaaacuguuggugaucaccugcaagugaaaauuuagcuuucuucaagugggucucacuggggaaacaaauuacucuuaaggcuaggcagcaugcccagcagcagaugaucuacagaaaacagacccaaucaguaucacuggagccucuuugucuuauaacguuguugauguuguaucaggguuuacaucaucaucauuacauauuuauuuuauuuauagcccuccaccuuuuuuauuuuaaaaaagaaacucuccugguucuuuggguauauauuauggcuuucaguuaagccuuuuugugggaugccugagugugugaaucaauggggacaaguggaucucugggucuauaucugguuauuugggcucuuuuucuuccauuuguuuguuuuguccuauucugacguguuaguuauuuguccuaucauauuuuauuauuaucccccuguuuauuuucugagagacagaaggguuuacucuggaugggaggggaggagcagaggaacugagaggagagggaggagggaaaccuuagucagcauauauugugugaaggggaaaaucucuuuucaauaaaagaagaagaaaaaaagaagaaaaucguggugaaccaucugugugugcuuauaggacagaugcacauggaacggacacagcaaggaugagguauaaagaacaucaaccagaaaagaccccccaccccccaccccccaggaucucugugcaugucugauugccaaucagaggaaacaaagaccguuugcaucuggagucaccagcccccaccugucauaguuuccucugaaucucagugagagccuccagcugcuguuaacaugccaucucucuguuucugcagugagcuagaggagccgugcuuacacaagauggcacccaagccauccgucccaacaccguggcccuguggucucagccagcugguacagaaguggcaguugcuggguuggacccgugacccguucggucacgugguaggagcuagaggugcagggcguggcaugagugccaggaaggacaggaagcauccucaggggagcuccccguacuccgccccccccccccgccccuccucccaugggggagagaggcaauucuuaguuccaucuaaugcuuuuaaccagcaaggccagacuucagccucuagcucugcagagaaagcucugaccugaaaaguucuaucccguugaggaaugucggggugcuucucucuggagggaccguagguagugggaguguaauggagggugcgcugugagcagagagaggcuuggcguuuucaagaguccauaugugguucuuggaauaaacacaaaauacaccgaagggcuguuuuucuagaaaccaugguccgguugacucugccaagcagcaggcuguuaauguucucccacagugucugauuacagcaccuguuugggggacaugcagaccacagcguagcucugccagcaauuaucugucuauuuuuauagcucaccagggcaguauuggucacuaaaaaagugggccaucugagaacugcacgagcaagauaucaguucacugaggcugaggcaggaggauugagaguucaaggucagcgucgguuacaaagggaggucugucuaccuaucucucucuuucugucucucucucucucucacacacacacacacacacacacacacacacuguauguuuuugucuacacacccacacacagcaggacugguaauguuucuguuuauacacccauaccuacacaugguggauugauauauguuuuuguuuacacauacacacaguggauugauacacuacauauuuuggucuauauaugcaugaugaacuuaugacuguauauuuuugccuauauauacacuguggacuggacuuauuacuuauuauuauguuuuagucucuugagcucuuucuuggcuuuuuauuuuauuuuauuuuuuucccuacagagucucaccauguagcugggcuaaucucaaacucucucggaucuuccugugacacccuccccaaaccccuaaugcuggcuuuucaggcugugcagccaaaaccaagagaguucuucccccuuagcacuguacccguucacuugguauugaggaauaaugauuuuucccuucgaaaauccucauuuggcugacuuuagugggguauagggucaguaguuccuuuccuguggcuuauggcugcagaucugcugaugugaaugauaaagcgauaacaccauauuccuauccacucauuuccgguuucuuucccgaguuccuuuguugccacuuugcucacacauuuuagauuuuugucuucccacacucuugugagaggcugccaaccuguguccccacccaggugcaacgcagauguccacgucguugucugcugaaaggauccuguuucagaaaugaguguugcguucuucauugggaaguuugcagagucaaagcugacggaagcccagggucagaaucucagcuccauggggugagcuugguagaauuucagaguucccugggaggacuuggcacccgcccuugggaaugacaggaguagaaccugucucauagagauguggacgucuguaucacaugagucguagggcacuuggcaugaaugccacuuuggguuccagcucauggcccuuuguggcuauucuuccucucccagacucacuccuguugcuuccagguuggggagaaaaaguuguguucaacucauuuuuauuacugagcaacccccccucacccccaccccccuccaauaagcuuuguaauacuauuuucaguggacgaguucuuaaaacuaauucugucacuugccucgucugcguugugggggccagguaggcagugaagcuuguguugcugauguugugaagaugugggcucuuucccauggugaugaagagcugccuagcucuugucugagugugacggucccucuaagucucuuugugccuuauguguaggggugugagugugcacacacgugcauguguuagugcauguucuuacaggcagauguguauaggugccagaggucagcacuggauaucucuugucacucacugucugccuugauuuuugaggcagggucucucacugguccuggagcauacuguacaggcuagauuagcuagccccuccccuccugcugggauuacaaaugcuaugcaaagcauuuuaauugcaugaucuggggguugaacuccggguuuguguuuguaaggugcgcuguuuauuggagcugucucaacuucccuugaucuuucuaaauguuucuuaaugaacuuugguuucuuaagguuuugcccauuuguaauuguauagacuuaauucuucuuuauugcuuguuuuggggguaagggagugugagacagguuucucuauguauguagcucuggaugcccuggaacucacuacacagaccaagcugcccaugaacuugugguaguuucuucuguuucuacuuccuuggguugggguuacagaugcgagccaccacaucaaguugacccuuagcuuucacaugccagacuagucaaaauccacaaggacugaugaacacuguuuuauaaaaugcugcuugugaaaaaaacaaacaaacaaaaaaaggaccuucuggagcuggaccgugugcacagcauggauggcaucugugcugugguugggaaggaucacggcagugcaguuugguguguuugcuauagaaguuccucucucagagugcucccgugggaaccgagcaagcagagagcugggcauuuucacguguuucacuacugaaaaguaaagaggggaacuccuagugacauggagacauaauuccaggcggauuucugaguucgaggucaaccuggucuacagagugaguuccaggacagccagggcuauacagaaacccugucuugaaaaaccaaaacaaacaaacaaacaaacaaaccaacgagacguaauuccuuaagggaagcacagcuucucagaugguugggaacuuuuucagcuuagcacaggggcaggcaucugugugucaccacucgggugcuuagaguuucugugaccugucuuagaacgcuuggaaccuaccugugaggagaggagcagcugacacucaugcugcugucacacgugaagaugccaugggucuuuccauggcugggacagaaaugagcaugacgcaaaauccuggccuugaauaugccucaccuacugguguguuguuaaucugagucauugcuacuuugggcugcagcucuaucucccguucacuuuuaaucauuuuuuugguccugucccuauagaugucugcuuuuagacccacccugcuguguaaagucccagcucuaagccuugugggccaguguugugugggaggauacuggggcaggggugggggguggagaggaaucagcacuucagaauuuacuuucacuuuuuaucuugaguucuacugccuuaaaagccucacauuuuuucuucaugggcuuuggauguggacaagggaucuauuucuagucagucuauuucuaaugcuaucauagaugauauuacauaaauguagguagaaagagagugaggaggaaaggauagcaagcagaggacauguggccauuggcuacagccaagugacaguucugaugaccacugucaccaggugguuuggggagugcuaggguucugugaccugucucagaacauuuggaaccuaccugugaggaguggagcagccgacccucacucugcggucauggucacacgugagaaugccacagguccccggaacguuguauuuguuccugggaaagugucacauaacaggccauaacugccagucacuuguaauugucagccauugacauaauugaauagcucauuuaguggaucuguagagcucacuucuucauugaggaccacgacugagcuguaacuggcuguguugggcuuggguugggguucugggaugaugggcugcauuuuguuggcaugggcagcuuuucuggaucuuuccaagcagagaagaauauuaggcauuuuggacagagauggcgguuucauccaggauuuuaugagaaagccuuagcuuuuguagcaaagucagugauucccaccaggucucaguuucguuaugaaaagggaacuggccauuaaauggcuacugccucagacucagagauacugugauuugcugaagcucaaauagcaccugacagaugcgaagaggcucaguaagucuaggccuccuuuuaucucuccaagauucuugguuuguaaugaccacauuccagggauacugcuuguucaaggaaaugucuccuguccccauuacucugauuucagagacuagagaguuguggcccccagugucaccucuguucccgacccuguguuuuuuucugacccuggcccugggguuuuucagaacccuagaaagaggugccagaccucuaacucuuccuguggucccaggcaggcugcacuccaaauacaugcauaacacugaugcugauggaaaggaugccaggugaaccuugaggcuggagcuucggugaugaugagccaaggcaguuuagacagcauuuccggauguuucugaaagguuugacguaagccacaggcauuuuuagaaguaucagaggagagguaaugaagaugcuaaggcauacauacauggugacuugccugagcggaugauggguuuaaacuggcagaugaaucucucaggacacucgugacaaguaugauuacuuagggauuagaaggaaaaaaaauauccaaaguaguuuguucucguguuaugguacaguuuuagagauuaaacaccauuuguuuucuggugaaaaguugaaaaaugugucugucuuauuguuaaaacggggguguuauggacuagcaaugagaaucuuaggauuguaaaugaguucuuuacucuagcuagcucauguaaaagacacagagaccugguauuuuauuaacaagcuguaagccuagauugggaaggcucugagcuauuuuaacuuacaucucaaccguaugccccuugcuacuuguuugagucucuccugggcugacuucuucaucuucucucuucuucuuucccuuccugguguuaagucccucccuauucucucuucugcccagccauuggcuaaauuagagaauaaauggggagcaauguuuacacaaacuugaaacaggagauacuuggaguaagcauuacaguguguccagauugcaacuagaugggugggcgggcagagaaaucagcguuugaauaauacaaggauagucuuuaaacaguucacaaaaacauuaugcccacauagaacagguucaggugaauuuaagugaagauaugaccgcucuuagguaugguugaagagguuuauuguagauagagggagaacauagccaggggcaucuggaagagugcagacugaacauggcaaacagaauggacugggcugugggagucagggagugagggaggaagacagagagcaagagaagaggaagauaggaagauaagaagacaggaagaggagaggaagacagagaggaagagaagagaaagacagaggagaagagauggagagagcacauggaaaccaagcaaaccaagagagugcagccaaaaugguuggggcagucaagcugggggguagugggaggggugaggagagcuggucaggggguggggugagguugggggugugguuguggggagggcacagguacugagugagacugacccagggaccugacuucagggagccauagccuacuggcccuuguacacggcgugugagccccaucucuuuguucucuccucccggcugcucacauuaauuacucuuaggguuuccauuucauuuugcuaugccagggucauuacgggauggcgggacuguggccacuagcauuauggcgaccuuuaaauaggauuuaaugugagaaaaucggaggaaugugcagauccgaggccccauuucuccccaugagccugauaguuguaaaugcaguuauuugaucucuucugagugacuuauuuuguagucauuuguauuuacagcacgcugcuugcccaagugugaaaaccagagccauagaguuucgguauuaucugaagucauaaaauaccuuuuauguacacaguaaaucugggagagauuauaguagaaaaccccuacagaccaagcacacugaaagugguggcaauuuucagagauaaauaaguuacuuauaauucugauuaaagucucugccaguuacauguuaaguaacccucaacucugcucuuuuccuuguuucuuuuccugguagaugugccugcucuaggaugguuagagccuuagccaguuuccucuacccuggcucuugacccauaaaccccaccaguuagauucacaauuacuauuguccuaugugugcugugucugcguguuugguauauuugguuguggauauguacauacauagaugcaugcauacaaaugcauguaugcgucuauauguguguauauaugucuauguguauuauauauaugcaugcauguauaugcuuguaugcauauaugcauacacacacacacacacacacacacaauuugagguaacuggggugaucagauuccuuccccuugcuauucuguguuuuuccuuccugcagguuguagcaagacuagacucaguaaacagaggcauucucuuacagaaaaagcagugacauuucaaaacacaaacacuggcagcggcuuccccggcuuccucgugugagccacacucagcccacacucccaccccgcaguugucuccaagaugucgcuggcagaugcuuguguuuuccuugagcuacaguccauucaugcucagugcugugaugugcgugcugacucugggaucucucuggcuucauucuggagacgagaacgguuuucauguucccaccaggcugacauuuuuaagagcucagccaauucgagauguuggauuuuacuuuuucuugucucucuacucuggauggaauggaagucaggcaggccagaaggcuggauggcauuguuccgccagucucccagacaggugaggcagagggauuaaggaguaauuggugcucucuuugcagaaugauuuuuguucaaaccugagcuuccucugaggacugggaaaagugaacugaacuggugguauucaguuuauugagcagugguucuguacacaucuguuuggucucuccugauuuuaaaagacuagcuguugaccuggcugggccugucccuaaaucguugucuguuucuccuuuggcuguccugaccaugaguauaugucacuaagaguguuucccauaauggggcaacccuucccaggucucuugucuuacccagcagccuuggaguuguugacagcaagaauagucuuauuucauuuuaagaaaucuuuaaaaugguccuuauuguuauuguguauguauacuugcuugugugcacaggugcucucaugugugugaucauguguguguacacaugcuuaggagugugggaggucagcccuggauauuguuuaucagucucugucuguguuuucuuuuuuugagacagggucucucacugguuggaaagaacuguuuaggcaagguuggccaguuaggacucagagaucugcaucucugugugcuccccccuccccuacccagagugcugugauuacaaauucauguaucggggauugaacucgggcccuaaugcuuguguggcaagcccuugagccucugagcucucacccuacuucaagucuauuauuuuucccauaacuucuugaagcccaaggcaacuccacgccacugcaaguaaguuaauuuauucccauuuagcacuuucuuccuaaauugggugaggaggaagaugauucagggcccccagcgaaucuccccugcacugugaauagaugucuugucgaaugccgggcagauccaguuguggacugcgucaguuuagcugcuuccccuugacugccgcuuguccccucccagggacaaggagaugauaguucucuuguguguuuguauuuccucuucucaggagcugaggugugccuucucugguccccaccucccacugccuuggcauuucuuaucuuuugggguucuuuuguuucacuugcccagagcugggaauugcaguuaaaccaagucucccccugcuuggcacuccugucccguggccuuggaacucccagcaaggauacuucucuguuugccccacagcgaaacuucagcuuugcuauaaauggcaaaguuacugaauugccuuggcuccacgccaaaugcuggaaauaauuugagaguauaaaaacauagcuuucauaugaaaauauuuauuuuaggagccuucgguaggcuugugugugugugugcgcgcgcgugcuagucauuuucauuaugaauuaguuccuuucucugacuguguggauaaaccuuccugaacaucugauuuacugagauggcgacgauucuugucccacacugucaccccucccaucagggaaggcauaaaugacgcaaucgaauuugaauuaaaaaaaaaaucugcucugagaugccuuugguacacaggaaaggcugcugggaacacguacuuuuuguuguuaagauuuguuuuuuuaaugcagggcgugguggcccacaccuuuaaucccagcucuccagaggcuauggcaaguugauaaaggaucucugugagucugaggcuagccuggucuacccagugaguucuacacucagagaaauccugucucaaaaacaagcaagcaaacaaacaauaacaucaaaacagcacccuccccccccaaaaaaaaaaccacaaaccaaaaaguuuguuuuuacugauauacauucguguaugucugaaugcaugaaagugcuacauauauuuggguaccacugaggccagaggaggguauuggaugcccuggaacuagaauuauaggcuguagugugccaccccaaaugggugcugugaaccaaacucagguccucugcaggagcagcagacacacuuaacgacugaccaugggcccauuuucuagccuuccuuguuuuuguuuuuugcucugagccagggcucaugcagcucagacuggccuagaacuugguguguagcagggucuggccuagaccuucuacccuuuugccuucacuucccaagugcucagaucacaaguguguaccccaacauccgacauucacggugugcucagcgagguccaggcuagcaacuucacccccuucccacuggcaacuaaauggauggauaaggacagagauugguucuggauggagggaaauggcacagcgaagcaagccaucacuucauaagcucacuagaaaauaaccaaagauaaaaauugugauuucagagaacuugccgucuacuaaacuguccuugaguccuugcaucugaacgaggccugaggaggcuuaaaccaggcugcccccuguccuuggggucagggugacacuugugcuuugaguuaauaaagcaggguagguguuggagcuuggucauaguuguucuaaagguuuuacauuucagucaacccaguagauuaguagcuugggaaacauccccaguuuggggcuuuuggggccugagggggcucagugguucuuugcagguguucugccacuuugucauggaacugggaguaaaaccuuccccaguuugcaaggcuucucagaauccuguggcuuaggaaucaagacauagaauccaguuuucaaauucuuaggagaggcacagugucuuacucaccgagcaggaccggaugcagcucaagccuuuauuuugaauaugacugugccacccaauagccugcaaguauucuuugcaauaugcaauggaauagauuuuaaaucauaucuguucauagugaaggguacccaagaauauaucuauuuauuccuuuuuuuauucccuuguguaagcuugacugaccuggaacucacucuguagaccaggcaggccuugaacuuagacaucugccugccucugucucccaagugcugggguaaaagacgugcaccaccacugacuggcuauuuauucauuuucucacgaacagaauugcacuuuuguuccuagguuacaaucugugcugugugugaaagaggcccacugagguaggucacugggucauccauugcacguguccugcuucuggaguccucaucuucagccgucuuaggcaagggcaggagaaaaggagaauggaugacacuucuugcuauguaugacacuaaguccuuuguagggaugugggguucucuccccgacucucauuacagagugucagguucaccuugaccuauauagcuuggugacugcaggucugucuggccuccuccauggcuucacugguaaaucaugcuguacccagcuggcauauugcaaaccauacuuggcauggccaguuuuaucaccccagacuuuuuccuuccccaguguaaccaccuucccaagcucuggucugagucuugccucuggugauucucugaugcucuaugggccaaaauccaaacuaguuuguuguagaauccaguccaggugacaugacucuccguccgcucuugucugggccuggcuuuugacaugacuuugguggaggagacgcaggcuggauagagaguacauuguuugcuuagcauaugauuucucugccucuugcaugccugugucccuccugucacucugggccaagguccccccucacuacaaccuuucccaauccucucaagcauuuuccaucucuaagccuugcguuucuacuuuuuccugaaccuuaaggaaguccaggcauuugaaaaauacucacgagugucuugauauuuucacuucuuuaauacaagaaguuucacuaauguguaaccaagccucauuugagguauuuuugguuuuauauaucugcguguguuuugcuuguauauaugucuaugugcaugccuggugucugcagggccagaugaaucuggaguuauagaugguugugagcugccaugugggugcugggaauugaacccagguccucuagaagaacagggagugcucuuaaccacugagccaugucucuagccccagccaagcauguuuugacaagacuuaaaacaaacaaccaaaaaauguuuuguauaguauuuauuucgucuucccaacacaugaguggccuagauaaauuuagcuaagcacgacaugucauucuucaggccguguuuuaaauaucucagggcuuaggacauggccaggaguaaaaagcuguuuauuaaaaagccuucauggcgagucaugggauuugaugcuuuuuuuuccccuuucucagugcugggaugaagcagagagccuggaguguacuugggaagggcuccagcuccgagccacaccccagccugagucacuggauuuuagagcugggguaaccaaggugaauucaguuacuguaguaagauauggcccucagauaagggagaggccacacugugccccaguuguucugggacugguucagguggucacugcucugucgucagccacuguacuuuuguaauuaaugccucggucuagcugcugccugcugccugcugccucugcugggucgggugaggagcaagguggaggaguaucaguuccagggagacucccaacuucugucaacuuccugcccucgaaauccugagcucacccugcucugauuucauuauuaugguuuugauuaugucccccccccccccaccaucccaaaucagaaaguggaaaaacacuggauuguuuuaugugacuugucuuuuuguguugauuacaucucauguccuuuauaaagcuaacuuuaaacugcuaagauauaaagcaaaggugucauuaccgaugaaggaaacuugggacgaacugugcauggagaagcggcccuuguagcguuugccuugugacagaaacggguuuuuuuuuuuuuuuuuuuuuuugguuuuuugagacaggguuucucuguauagcucuggcugaccuggaacucacuuuauagaccuggcuggccucgaacucagaaauccgccugccucugccucccgagugcugggauuaaaggugugugccaccacgcccggccagaaacaguuuuaaaugcuccagguauuugguugacccacuuaggggucaugaggugaugcccguuauuauccucauugaagcacagaaggguuaaugacgugcccgaugucacacagcccauaagaggcagagcugggauuuaaguacaagcagucugauucuagaaaacagaugaagauagucacugugucuuuucauuucuuaccuauuucuuaccugcgugugugcaugugcaguguguggagaucagaggcuaguuagucccuaggaguugucuacugcuuguuuuuguguguguguguuuccugucaggauuccucacuugcccagggccuguccauuaggcgggcuggucaggucauggagucucaggaguccauugccuuugucaccccaauacauacugaaccaccaaaccuggcuucucacaggggugcugaaaccccuaccucccuacuccugcugcgaguaaccguguuucugacgugcauccucaguaacaggguaccccgucacacugaguacaugcucagucaugggguaccuugcuuggcagcucuaccccauggccugauucuccuaccguccccacacugcuguaccaagucgggcaggagaguggugaaaaccauuauguucaagugaggauuuuucacucuggaccggagaugcaccucagcuagccucacggugcuugcccagguuuaucacugacaucuguucccuguguguauccagcuggggccgaagccacgucugcucuucuagcuuccuccugccuauaaaggguaaucuuaggcuugguuugucuuugauggugacugcagaggaagauggguucuagcuacgacuuagugugaaccugccugucaugauccuguauuucuggagccuuugcaccugacaggaauaggcccaaggaaucuuacaggucaggcaaagccccaggcucaaaauccuaccaagccuggaaaaaaauucuuuguuggugacugguucagagugaaaucagccccuugcaaucuaguuuuuucuuugacuagccagcguaggcaugagauguugaacuugggaaauccauuaagaaugauagaucuagcugggugugguggcuuacccuuguaaugccagcauuugggaggccgaggcaggacaauuacugugagucugaggcucuaucucagaaaaccaaaugagaaaagacugguaaauauaguuuagggauaaacaugugaauuauagcaucagcuaaggcuuaaaagcuuuucauugugauaucaaaaagccuuucacagggaccucccccccccccccccccccacacacacacaugcuuugagaguugaaagcagaaguuuucacaggcagugccuccuauuuuagcuucacagaaaggagaaggagcuugguacagugggggaggaaggcgacaggaucaggguaggauguggcuccgugguggggcaggugccuggccuguguguuugagaccagagccaacccccagucuacaaaaaaaucaaagucaaaaguuucuuccgggcuggugagauggcucaguggcuaagagcacccgacugcucuuccgaagguccagaguucaaaucccagcaaccacaugguggcucauaaccaucugaaacaagaucugacgcccucuucuggagugucugaagacagcuacuguguacuuacauauaauaauaaauaaaucuuuaaaaaaaaaaaaaaaaaaaguuucuuccaugguccaaguguggaggccugaacuccuuauacagcauggaagagaaucacuuuaaugagcugcaaggcccugguccccuggccccgagcauucuggaucguaagcaggugucucauucugauuguaaauccauguguauuugucuuuuccagggaauuaaaaaaaaaaagucauuuguuauuuugcaaggauggcgugauggugacaguaugccugccaucugcuucggcugcuaugauguaagacacuucgauauuaacccgaaauagcaaauuggagcagaccaggcacuuuaaaaucuugaguuuuaucugaagugugaauauggaacggauacagaaaucuuggaacagagacuccuuuguugcgaugugggagaauauccaugaauuuuaauggaagaugugaauagacaaaggagaugauuuuugaagaagcuggaggcuuccuucuggaggcggaggagacccuccuggguagagguggccuguguuuggaucaaagucaggccggccuuagacaccggaagucgcagcugcuagggcccgagucucuggcccuuuguucagaccuucuccugaugaauuuuggagagaaggggggaguucccaucauuccuaaguaucuggcucuggacgcuguguggauaaaacucagggaagcugaucacaugaucauaggucgcugcugauagguuugaauagauuuuauauuuauugcuauacuuggaaggucuaagagaguccagucagucaguaacauuaggguuaggauugguccuguucaugcaaaguugugcuucugugaguguguguacauguuaaaauuuguuaccccaaagcaauauuuaaggugcuuucuuggguguuggugguccauggaugugucugauacccaaacaugcuaguaguucaggaugcuugugccaggugaggcuggacaaggcuacacuuuucuugauguuuccucaaacuguuaguguuucuguggcagucuacuuaaccccaggcuguuuuggauuuucauguuucuguuggugauuucuauuuagaauguucucaguuguagggcugguauguguuuaguguuccuaaggaugggcugugaugugucuuaggaagaaauaucuguauguuagaaagccacuguugccugugacuaaugcuuauaagguagccauauacuaaaagguuucuuuuaaaaacuagaaacauaaauaacaaaguuacguguugaucguuugagcaaaguauguugggaaccuguaggaaccugccucugaacaucuggcaggauuaaaggcagguaaaugcuaauggggugaucaaagccaucuuguaccuuaggacaaucaccuugaucagugaggggcccuuugagaaacccuuugcuccuuucuaguccuccaaagugugugagaggccuguuggguucugaagggucuugaacccguguuuacuguuggugugcaucuuugcaaguguggguauguggaccagaaccacacaccagcaguagaacucaggugaaaagaaauccgugcgcagcgcauucuucccucagaagucccgcuguuccuucauuugauaccagugggcucuguggauccauguagaaccguguagaucccaguagcuuuucacuggcuuccugagcuggugcccuggcagcauacagucgguguuaaaaacaggcuccaugggaaccuacuguauguggcaagaguggcuuuuacgucuauagaaggcuuugcauuucaauguauauuauucuguagguucaacaaaaaguauuuaauuuuuaaaaagcucauguguguauguaugugugugugguguuaucuacuuuucuguauuuuguauaacuuuuauuuugucacuuacaagaaaaaaggauugaaggaagugauagaacaaaacaggcucuguuuagggaaguguuuuuuugaggucauuuggcuagacagugaaugaaagaggcagaauuuccgguaugggcuuuugguaggggaacugaaguccgccacaaggccuggguucaguguuuacagagucauuguaaagugacucugacuuacagaauaauggguaauauucaacaauacaugaaacuuuagaaaaucucuguguguguguguguguguguccacaucugucuguccguguucaccugccuguuuuaucaucauucuguccugcugucuguggugucugucugugguguuuaggccugguguguuuauguauuuaauugugguaagauacacauaauauuuagucuuucaauuagguucacaguucagcacuguuuagugcauucaauaaugauaaaugauggggcuucuagaauucuuacugucuggcaacccugaaacucugucuguguccaguaaacaguaccccugucucucuuuaucccagucucuugaaauugcugucuugcuuugccuuguuaugcauuugaugacuccaaauaagucacauaagccacacacauggcauuuaugguucugcuuuuuggugacuggcuuauuuaauuuggcacagugugagaaagccgggcaucauggcacgcacuuguuagagcuguaggacuugguguucagccagccuagccuaaccaaggaggcccuggucccagguagagaaccuaucucaaaccaaaguggaggggacccuguacacacacacacacacacacacacacacacacacacacacacacacacacacacagaggauguagguggggaauccuguucuguuuucccacacuaagaccaugccugugcgaugaugauucuuguucuuuagaaauaagaguuuguuuccuugucugccugggcuuuuggucauaguagcauaagcaguguuauuucuaagcaucuuuauguuugguaacuguauucucaaccugccucuuccucuuucucuuuuuuccucccuaugaacaucugggcuugagauguuucguguuuuauaaugguuuucucagauaguugcccggcuuccagcuggaaggagcagccaagcugaggucaagacugaaccacacggucgguccuuugaaaggaugccuuuuuaaaucauguuugcucaccuuuucguaggccauggucauuacugugcuugcccaggguuccguucgugacugacccagcagggagcuuucuacacuucccaagcaagaagugcauucuuaaaccuuagcauuuguuucaagugagcaaugaaugcauacaguuauuucuaauuuauacagaaugccuacuccugguucugguccaugucuugcuuauuucaucuccuccugcaucagagagacagaggcucuagcuuacgcugcucuugaacuccuugguagcccaggaugaccucagacuucagauugcuccauuucuaccuccuguagcguuuugagauuacaggcgugugccaccacaccuggcucuuauacacuacuggagaucaagcccagaacaccuugcaugcacugccagccuagccauguuccugggucucaucaugugcuguagucacagagccagggaguggggaggagggagaggagggaggagggaagaggaaguaggagguaggauggacaggccuuccuucccauguggucuucagugcaugggaugucagacagaaacccgaccugccucaagacaucgcccccccccccccaacugguaguuggugcccaucuacugagaccaaguuuuucagugauuuuuuuuuccuucauaauuuuuuucuaacuucuuuuugugaagcucuuauuuauuuuuaaauacauuuucaauugaauagaucuuaaguauauuuucaaauuaagauauaaugacaccacuuccuuccuuccuucccuuuccccaacucuguuccauuuucuuucgcugggaaacagccuguuugaucagccuaagaagaauucauacuugguauuuuguguuugugucccggaucuucugucuugccacacugucauccaauucuagcuguggauccagcucugcuuuaauggcgacuguccuugauggagacucaaaaggucagacucacucucuaaacaugagaagcuaggcggaugucuuugguucaaguugaacagagccaugauuuggggcaugaggaaagucuuuggagagaaucuagcuuccuuguauaacugagugaguuugcugcagugcgugcuuucaucauguugggaucacuauguugacugugugauguggaguugagcccgaugucugcugaagguggagggcagcgucugcaucagucuguagaccgaccacccagccucuccuugcaguucaucauguuuacugcuuuggaugggaggccugacuucuuguacacugauccuuccuaugagaugaaauagcaagaaggcuuuugcuuuugcuuuuucucuuaaagggaauccgugaguacugaauggugauagacuauacaauauguucagugcaauggcuggcacccagaaaauguccacuacuauuaacccuuagucaaagggcacugaugauuuuggacuaagacggggguguugaguuccgguuucucucuuccaucaacacuuaucugaaggugagucuccaagaguucagucagggucauuuauuaauagcuaccacaacacacguuucuagcagucaaccagucagucauugcuugcuggauaaagggcuguuucauuauaauagugucugccuucuguggcuccaucuuguagcuguguuuugucucuagggcucucugauccuggagggagaaagcucuucccaggguugcagaggccuggaacagagauauggccugucuccagagcacuguugcuggcgggcugaguggggagcaugggugugucuggucaccaggaacaacaaagccacacuguggaucugagguccugggaagccauccaguuuccuccuccugacccugacucaagucuucccugaaguccucugucagcuccagcccuguucucgucuaucagccacccgaacccuccuuauauaacccagcugggucuccaggucaggcagugagcaagugagcgagguggcacauggauguucugugcuuaauagaagaaaacaaaacaaaacaccaccgccaacaacaaaaacccugggguggggggaggggcaccuggucagugaugcagguggaaagcugaggaccugcaugggauggcaacaauguuuccaccuuucugauuggacacucaauacuuuagagugcuaagaagaaagguucuguccuaggcacuucuuuaagauuuuguguuucagguaaugaugguaaacuucaguaacacuuuaaaaaaauuauuaguuuaauuuuuuuuauucuucucucauauauuccauccugauugcaguuucaucuccuuccccucccuuuccagccucccugagacaucaacuaaacaugauaugacaaacuucaguaagaccaggcacauaucaucacaaaauuauuaguuuaugauuugaaugacuguacuggccgguuuugugugucaacuugacauagcuggaguuaucacagagaaaggagcuucaguuggggaaaugccuccaugagauccaacuguaaggcauuuucucaauuagugaucaagggggaaaggccccuugugggugggaccaucucugggcugguagucuugguucuauaagagacuaggcugagcaagccaggggaagcaagucaguuagggacaucccuccauggccucugcaucagcuccugcuuccugaccugcuugaguuccaguccugacuuucuuggugaugaacagcaguauggaaguguaagcugaauaaacccuuucuuccgcaacuuguuucuuggucaugauguuugugcaggaguagaaacccugacuaagaccauacuaagaccugacuauugaccacaauuggccuguugauuccuccccacccagcaggcaacuuuuuuguuaguuuguuuuuguuucucuuuguaucuuauuucuuuuuauauuauuaacugcuauggaauauggaaagaugaaaggggcagaaugugagaugcagaaaauaaaagaccauauaaugaguuaaauuuuaaaaccuuuaaaagcauuuauuuguguguguguguguguguuuacacauauguacaaccauggucugcuuauacaggucagaggacaacuugaaggaguuguuucuucucuccuuuucccaugugcgucucagggacugaauucaggaccuaaggucugacaccaaaagccuuuauccaccuugcuggcuaguuuuaugucaacuugaccuaagcuagaguuaucugaaggaagggaaccucuguuaagaaaaugcuucaucagaucugacuguaagacauuuucuuagugauugauggguuaggccauugaggguggggccuucccugggcuggggauccuggauucuguaagaaagguagcugagcaagccaugaugagcaagccagugagcaacaucccuccauggccucugcaucaucuccugcauccagguuccugcccugcuaaguuccuguccugacuucaaggaugaugccuagugauauggaauuguacgccaaauaaacucuucccccccccccaacucuuuuggucauagugucuuauagcuguagaaacccuaaguaagagacccacugcaccauuuugacagucuaagaguguuuuuuuuuuuuuucuguguaagauuucaucucuauguuuaaaaaaaaaaaaaaaaaaaaagaggauucuugagcauccuucuuaccacagucaggguuguguccagauuaaaugacuagaaguugaaaauaccguauuuuuguugaaacuguggaaauacugcaugucuaaaacacauugauaaaucucacuauccugccuaaggccuccuuuccuugucuucuucuuuuuuucuauuugccuguuugugugucagcgcggaggaggaagaguuggauggguggggaagaucugggaggcauugggggaggggaacugugaucagaauauauuguacgagaaacauauuuucaguuaaaagaaugcacuaugcacuuggaacauggauauuagcauuuaauugggcaaaaucauucggcaugaaggccauuuuagaauaguguuggcuuucauggaguuuauugagugcucugcuaaugucaaacauagaaugagucccaggcuauaccuucccaccaaugaggggauuaucugggacugcguuuaucugcaguucaaagcaaccacagaagccuguuuuaucuggccuccuuaacugggugaaggcacugagggagggacagcccgggagggagccagaagaaagggcuuagagucgguggcuuuuuugccucccagccucauuguccuggguguucagccuucucucuggugucacucaggauacagugauggcagugacuugaggcacggggucagcucaguuguggaggaacacagugggccugucuccuggaaacaguuauucccaggccauggugcaaugcuuaguugucugcccuuucucccuauugcuacugagugagcugcaaugguggcuggagagacgcaggguuuguccuucucugcucuugaccccaaggcugauucuuucuucucucuugucauugucugacaagugagacacaccagugacgacauaaugugacaaggaucugugaggugcuuuuuauuagcuguaguuaaaaaaaaaaugucuuuuuuaucucauuucaacaccagcugcggacuuuucaucucucauucuaaggaaccagacaacuacugaccacacgaugaaaucagcaacacacuuagcccuugagcucugaugcgauccagagguucgucugaggauauucuuagccauauucaguaucaguugaggaauuaguggcgcucucguuggagaggcagugcaggaaccucucugagacaaggaugcugaagucaucuuuccagcccuuucuacauuguagcuauucugagcuccuguuuucuccuaggaaaguuggauugacguggacucgcacaugucugggauuaucugaguccuuucuaaacagaccgacacuuggaagggaacaccuuugcuugcugacugcuuuccugggcuggguuccaaagcuuccugacuccugaacaauaacguguucuuuccaugcuacuuuauauauuuauuuuucagaacccguggcccuuuuauccccuuagauccaccucgaaaacaugcuuguguccugucggagcagagguucaaacuguggagaauuuucuguuuugacauuccacagugacagugggcuucggaggaggacaagggaacccuuuaugcaccccccccauuccuucuuccuccauuccugcuccaucuuccuccucuccccuccucucuuccagucuuucuuuucuuuuuuucacaaacaaucguaacauguucuuggugcucaugugccuuucugcauuuuuguuaggcauucuugaccaccaucagccaucccuauguggggaagguugaguauuucuucaagacauacauuccuuaagggaagguuugagccauucugaccuuuuaagauuuuucucugacuuuuuuuuuuuuuuuuauuugcugucugaaaaugugcuguuucuacuuuuaaggagaaacaagacuacaguugugauaauggcuguguagcuggaguacguuggagguaagcuguuggugguuauagggacggaaggaggcuugcgauucucagguucaggcucucccuuagaggaaauagaagcugcuucgccaccagacaggagagugggaaagcugaggugcagaccuugcuuugccugguuccagagacuucucucccagcgguugagaaacuauugaguggaacugcacuuuuccgacagcugaaaggaaaaugccauuguagcugcuuuugggucacagugucuucuuugaaugggcaugaagcccagcucccugucacagaccucagccgcugaaggacucuaccuucugaaagccugacuaugugaaacaugauucagcuuucucuguuucaucacaacagacgcuguuuugugaguguugacuauuauugucuaguccuauuguccuuugcagcuggggaccuauggcucuuuuggccugguuauggcaaaccucuugcagggaacccgcucuuccuuguugugacuuaagcaccuuuugcugcucuaggacugaugcucaugacccuguccucuucccugucauacccacaggauuacaguugcccgagauguugacuguaucacagaaagcccacugcuagugaaagcagauugucucuaaagaagggacaugguggcaugcagaaucucacagggaagcuauaaaaaugggagaagggguagccugggcucaggagagaaggggaagccugggcuuaggucuuccuuaugguuuccauagacuaacaagcccggacagggaacagugcagggcucguucguugggauguuaguggcuucuaggcuccagacacuguauaguugccuaugguuuggccuuggugacuuggggcaggggacauauguguugaauaugugagaggaggguauggagacucuggauugcuggcccgauggaaagcacuuugaccaucagguugucccugucauuaacggaaggcuaagaagcauggaacagcugccguguuucaguuucucaaaguuagccaggcaugguagauggugucugcugcaugcucuguagaugucuggaggagggcauuuauuauuuuaugagcagugagcucuaucuuauuuugagcucuucuuaugauuuuggacuuaugguaaagacuagauauuuucauaacuagaaacaaggcuccuuuguuugaaacccuguagauucuuagugacggcuuucuugacuuggggugaauccuucucucucucucucucucucucucucucucucucucucucucucucauucuuccuugguaguuggaaaccuuucccaguuuaaauaaagcccaaacaccaucugugugauauccuuguauaagucgucauuuauauauuuacauauuuauuaucuuacauuuuauguuauuauuuggagagguucucacucuggcugcuccggagcuuacuauauaaaccaggcuagucuugaacucagggaucuguuugccugccucugcccucugccuuccaagugcuggaggguaaagguguccaccaugcucggcuucaagucgccauuuccugccaccuccuguaagcuuaagucugguguccuucuguauguccaggguggcaaucacauugcuggauuuucucccuuguguauuuuuuuucccuacuuuuggcauaauucuuuguuuucuugccugugguccagcgucuagcaucauccaagcaugugcucagcgggugugucuggaggugacuuugucaagugucaucugugggacuagcauuucguuacuguucaccugcugauggaaggcgagacucuauaggugaggcuaucuguugaaggaacggaagccucgugaggcauucuauccaacaggcccuucuaagcuuuugugggaccaguggaguaguccaguucuuagagguagguacacugaggcagggguuaggauaacugggcuggagaguaaauaccgacucagaagcacuucaaccuaaucuugccuauagaugaggugaaauuauauuucuauuugaauacaaaucucacacacagcacugaaacaguucagugguaugagcaguugaacaaggaccaaaaaaagaaaaaaagaauguucaggcuaugauccuauuauugagaauuuuagguuauggcuauguaggaaaaccuagcuugggcuacauagggagauuugacacacacacacacacacacacacacacacacacacacacacaccucugugccaaagagaaaugguggagagagguguacgcaucccucuccuguguggauacccucaaaccugaaaagaugcuucccagaaauuucugcccagauccauucucagugccuuccacaugcauauuuaaauuaguaggcuuguuaaauacuuuuauugguaccauuguaaagcgcaauauaaaaaucucaggcccuuagccaccuuaggaaaacaacugucauuuauugucuccuaaccaagugagcagcuuccucgggagccagggguggggugggaagguggggaaucagagagucacaggugacuuaacguggagaacuucccagagacagggagagcaucaccuggugggucugugcgucuguaaggaagucaagggugauuucuguuuuguuguggaacggaucucggggaggacaggaugccucagggugucuccguagagcauaaaggucccaagucacuguuaaaagcagacgguugggaaccgcugggugcacugggacccagggaugugugccauccaggaaggugggggacuuguaaagagaaagaaguugggguccagaggacuuuuuuuccccucugagucuaaguccagggacuccuugcacagacuguugcuggagagcagaagagucgugucccaagguuucuuccccaaggugugguacaagccgagaugggagagggcgugcaugcuaucccucggagauguugcggacucauagagaugugcaugcccuguuucugcggcugaucacaggucccacaacaguguaugucauucggaguguaugucauucggaguaacuuaaugugcauuucuacucaguguugaaaaaaagagcuaauacagaacuggaaugauuuuuuuuuuaaagaacaagauauauauauauauguauaguugccuaugguuuggccuuggugacuuggggcaggggacauauguguugaauaugugagaggaggguauggagacucuggauugcuggcccgauggaaagcacuuuggccaucagguugucccugucauuaacggaaggcuaagaagcauggaacagcugccguguuucaguuucucaaaguuagccaggcaugguagauggugucugcugcaugcucuguagaugucuggaggagggcauuuauuauuuuaugagcagugagcucuaucuuauuuugagcucuucuuaugauuuuggacuuaugguaaagacuagauauuuucauaacuagaaacaaggcuccuuuguuugaaacccuguagauucuuagugacggcuuucuugacuuggggugaauccuucucucucucucucucucucucucucucucucucucucucucucucucauucuuccuugguaguuggaaaccuuucccaguuuaaauaaagcccaaacaccaucugugugauauccuuguauaagucgucauuuauauauuuacauauuuauuaucuuacauuuuauguuauuauuuggagagguucucacucuggcugcuccggagcuuacuauauaaaccaggcuagucuugaacucagggaucuguuugccugccucugcccucugccuuccaagugcuggaggguaaagguguccaccaugcucggcuucaagucgccauuuccugccaccuccuguaagcuuaagucugguguccuucuguauguccaggguggcaaucacauugcuggauuuucucccuuguguauuuuuuuucccuacuuuuggcauaauucuuuguuuucuugccugugguccagcgucuagcaucauccaagcaugugcucagcgggugugucuggaggugacuuugucaagugucaucugugggacuagcauuucguuacuguucaccugcugauggaaggcgagacucuauaggugaggcuaucuguugaaggaacggaagccucgugaggcauucuauccaacaggcccuucuaagcuuuugugggaccaguggaguaguccaguucuuagagguagguacacugaggcagggguuaggauaacugggcuggagaguaaauaccgacucagaagcacuucaaccuaaucuugccuauagaugaggugaaauuauauuucuauuugaauacaaaucucacacacagcacugaaacaguucagugguaugagcaguugaacaaggaccaaaaaaagaaaaaaagaauguucaggcuaugauccuauuauugagaauuuuagguuauggcuauguaggaaaaccuagcuugggcuacauagggagauuugacacacacacacacacacacacacacacacacacacacacacacacaccucugugccaaagagaaaugguggagagagguguacgcaucccucuccuguguggauacccucaaaccugaaaagaugcuucccagaaauuucugcccagauccauucucagugccuuccacaugcauauuuaaauuaguaggcuuguuaaauacuuuuauugguaccauuguaaagcgcaauauaaaaaucucaggcccuuagccaccuuaggaaaacaacugucauuuauugucuccuaaccaagugagcagcuuccucgggagccagggguggggugggaagguggggaaucagagagucacaggugacuuaacguggagaacuucccagagacagggagagcaucaccuggugggucugugcgucuguaaggaagucaagggugauuucuguuuuguuguggaacggaucucggggaggacaggaugccucagggugucuccguagagcauaaaggucccaagucacuguuaaaagcagacgguugggaaccgcugggugcacugggacccagggaugugugccauccaggaaggugggggacuuguaaagagaaagaaguugggguccagaggacuuuuuuuccccucugagucuaaguccagggacuccuugcacagacuguugcuggagagcagaagagucgugucccaagguuucuuccccaaggugugguacaagccgagaugggagagggcgugcaugcuaucccucggagauguugcggacucauagagaugugcaugcccuguuucugcggcugaucacaggucccacaacaguguaugucauucggaguaacuuaaugugcauuucuacucaguguugaaaaaaagagcuaauacagaacuggaaugauuuuuuuuuuuaaagaacaagauuaacaaaaagaacaguuucuuagcuugucauuccaguaacaaguguuugacuaucuacagagacgaguaccguuuucucccuuuucuagcguaaccaaggagacggagugaaguugcagaugucugccauuaauaucaagggacacuccucagcuugcugcuaagaggguuaauaacgggaacuuuguagugaauuaauuuuuuuuuauagaguugcaguagauuuaaagaaauaccagguguccaugcaguugacaaugagcucuguauaucuauaucucuauaucucuauaucuaucuauaccuaucuauauauacacauuugccagguucucuccuuccucccaaguuuucaagaugaccuagucaaacaccuuuaaaacugauauuaaaauauuacuuuauguuuauguauugugugugugugugcgcacaugccaugccaugcuguguauguguguguguguacaugccaugcugugugugugugcacaugccaugcucuguguguguguacaugcuaugcugugugugugugcacaagccaugcuguguguguauguguaugcacaugccaugcuguguguguguaugcacaugccaugcuguguguguguaugcacaugccaugcuguguguguggaagugacaggauaauuuauggauccaguuuucuccucuuccuaugugggucucggggauuggcaucagcuugccagcccuugugcacugagccaucaugccacagcucccuccccccaccacuccugucccuccccccuagcauuaacacugugaggugguuuuucuucacaggcauuucuacauaucacuggguuauuugagucuauguacuuuucauauugagcuggcuucauaaauaugcucguugggauuuuuuuuuuuuaauuuugaguuccauguauugaaaguaugaaacagucaagucacuaagucacuuuacaaauucacagugucacccagugaccacuuuuuguaucuuuucuuuuuucccccucucuuugggggaaagagaaccuaaaaccuagggcauuagcagauuucgggcauauaauaugauauuauuaauuaugguccucaugugaaauagucaauuguuauuuaucuaggauaacugcaucuuugugcccucuaaucugcaucucucucucucucucucucucucucucucucucucucucucucuguccacuuuucacacuugugccuuagaaggugugauaaugugaugguuggccuccagugaauucuggguaacuuguucucucuuuuccauguguaugcguggugugugugggugaguguaugcauguaccuuguguguguaugcauaugcaugugcauuuugugaggacauaauaugcauaugcguuuuguguguagguguguguguguuagaggcuuggacccaucuugggaaucuuccuccaucacucugacuacuuuuucaguuuauucucugaggcagauuuucucaguuaaagccagaacucacuuaucaguaagucuugcuagcuagcaugcuccagggauccuguguuucugauaucugaggcugcaauuacaggcagguuguauuaacggcucagcauuuccagggguucuguggggaucuaaacucuggucuucuugcuucuugggcaaaugcuuugaugcccaagccacccucccacucccccacccccacccccacccccagccccuuaguuguagggaaauagaauugcuaaggaaagaccaaaucaaagaugauacaugaauaaaucauaaaacuaaagucauaaacaucuggcagacaaaucuucaccauacaaagaaaagaaauguggucuucauaaagggugaaauagcucgggcggcuucuagaagaaugcacccaguuuaggaaaagcuuuagaaagagaauucuaagaagguuuaaucuugagugguaggugcuguuuccaaaucccauuuagaacuuuaucuugaaucauauuuucugauugauaguuuuuguucuucauuugaaaacaagugcuuuuucuuagaaaacaaacucccagguuccuuguaugugauaaugcuggcuccuugccucgggcugucaacucagauggaggauagugugacauuagagaugagguugauggugcaagaaggacucagcucuauuguauaucacagggagacaucaaaugcuguauucugggaaggauugacagugacucagaacccggguggaacccagggccuuauguccuaggcaaguguaccagugaguuacauugcuguauccuccauccuccuuccagauuuuauuuugaagauguuguuuuucaggacuauuccuacuuucuugacccgagauauugaucuacuuaacucauuggcuagcaguaagucgagguuauuacuaaucacacuugacuucucauucuuaaaaaacguggcuuccuggauaagauguggccaucacaauucucgcuuuuuacgaacccuccauugaggcuggagaugaagcacagccaucaugggcuugccuagcgugagcaaagcccugagugugaucccagggccacaagaaacuguauagugcugcgugccugugaccucagcacucaggagcagggcaggcagaauagaacaggcauucucaaccaucuucaacuccauuggaguccaaggccagucugggauccaugaaacccugucuuagaaaugaaugaaugaaugaaugaaugaaugaaugaaugaauucagcuuugaacucuccucuguuccuucaucaagaccucuuugguguuaacuguucccaaggacagaggagauuuaaacuuuuaagugaguuuaacauuuuuaaauugauaauagcaauuuuacacugggggcacacagauaauuaaauacagguauaugacauggaaugaccaaaucagggcagcugcuauuuccaucucuagacacagcuuaagcguggacaucucaguguugcuuuuguucucaaguuuggguauccaucgauuuuucucccugucucugccacacagaguugcguucagcuauggucuuccgauuggcuauguuuucauaagugaaggcucauugauaauggcuuggugggaaaauucuggaagcuuucugcuuuagguguugggaaagacacccugucagaaucagcacagaccuuugucccuccuucuguucucaggcagguggcucuugaagcuguugacgcuaucauuugucacuuguguauagggcuccuguauguuuugcuccuggagcaauuaaacauugcuuuuuugcaaauguaaacauggcuuaggauugcaaugcauuuggcagaugagcuauguauugggaaaaggaaaauaucuuggagagggcguggauuuuacagaucaagagauuagcgucauucaggcagucggaaccugacaagacccuguggcgugugucaguccaucuucuuagaugagcugacaugacauaggacaggccgcuagaauaaaacuugaaaguaggcagcaggaagcagaaagggaggccuguacgcaggcuuuacauuucuagugccagaaaaccaaaaguugcuaucaaaauaaauauaaaacagccacuggcagacaguuggcccuucccgagucucugagcuggugucacccuugccuuuggcaguuaggcagugaucuguagaaagucuagcuuggugaggugcaggguccuagugucaguggaggcugaagucucuucgugaauuuguaaaagggaaagccaguggguuugucuucacucacuauuucuuagcagacaacucuuauguugaaaaccauagauggaccaucaugcauuuguaagaugcuuuggaaucuagcacauaucuucucaugaaggugacugagcugaagcuuuucucccucugucugucugugcuaaugucugucugucugucugucucucucucucucucucucugcauguuaaaugcaugcauuggugcaugugcaccuguguguggaggccagggauugaccuugguuguuauuccuaaggagcuaaguagacuuguuuuuugaaacagggucuuccauugggaucuggggcuugcuaggcugguggccaguaaacccggggacccgccuguuccccagccccagcccugggauucuaaguauaugccacuaagccuggguuuuacauggaugcuggggaucaaacuuagguccucauacuuaaccagacuccucagcccccaaagcaccuuuuauguguguauuuauauguguauuuauuuaggugaagucuaugccuaagagcucagaaaaggccuucccaugugccaggcaacagcccugggugguauugggcucucagucuacagaagugccucgaguuguuuauaguucaugcuugagauaggggaugguagcaccuuagccugucaggcaggcgaaggagcaagugguaauuuggauauaguuuggccaaugagcugcagaacuugguucccaccccaagcccaucccugacuagugauaugaugucauuucaugcauaugaagugccuuucuccuaagucucuugccuuaucugugguagcaguagggguagugggggggaggggggucucuucuaauguccaaccuuaccauugguccugugggcugcuccuucuacccacaccuagggagacagagcaaggcuguugcaggcugagguucagccuugaguucuuguauagaauuagucauuccucaccuuucuccaugaaagagaaagaucaguguucucucucuugcugugguaauuaagcauucguagacacauucacucagauuuuccuuagaagauaaagacccaaccaaccaaccagccaaccccuacucucucucuccuuucuuuuucuuuucuucucaaagggucugaggagcuccuuucugugauagguccggaacuuuguuccucaugcuagaaucucauguccucauuuugcuuugguucaguuucauuuacucaacaaauauuucugaggaucugcugaacaccugaugacacuagcugcuuagacacaaaguucuauaagacagaggcccagucuccaagaugcugugaugccuucaguguguuccauaaaccaugaauguuuugcacaugcauauaaaauuagaggggaagcccgguguugaguggguaguuuuucugcuuugucuguacugaacuuugcugagauguuuuucacucaccaguggcuagagaaaaauaaguagagaauucuaugcauuuacacgaguccugcauccuuggagaggaggaggaggaugucagguguuacccugaggaaccuucucugaggaacaagcugagaaaugucuacuucagugguuuucaaccuguggcaacccccauagggguuacagaucagauaucccguuuaucagauauuuauauugugauuccaaacaguagcaaaauuacagcuacgaaguagcaacagaauaauuuuuugguuggggucaccacaacaugaggaauuaccauuaaagggccacagcauuugguagguugggaacaacuggucuaccuauguguagcagcucaggguugaguuucauucauagcuacuuagacuguugcugcuucuccaucugccucuggacugugaguccaguguggguuugucuugugaaaagaaaggggauuucccuuggguuaaaaaaaaaaaaaguaaauauuagaaaauggugcuuuacuuuuaggagucuuacuaccuugguaucuaaaauuccuauuuaaaguuuuucuuuuuuucuuuaguuuaagaaggugggcuugaaaccaccacaugaauuuucaggaaaacucuuaaggcguagauauuucagcagaacaggcuggaagugagagcccagguuuguaagacaggccaagggagaugguaagggauuguacauggagagacacuucaugcccacaggagucauugucagggucuuuguacgacaucacccacugagcucaguguuggaggcagaaggaagaaagcgaaccuuugcuggauaucgugauguuuaccaccauccuuucuuccugugaugggucaaugguugccgcauagguuucacguguuuggacauugaacugaaauagauccccaagugaggagacuccuucaguucugcauccacguguuuucugccagagauacuuuccagaguguauaauugcauuuuauguuucaucucuuuuaauacuggguuaagucuguaguuaagggagagagcacguucaauuuccuuuuggaucaguaccagcuuaaauuaugaauggaggcuauguaacuguagugucugcucuugguccuugaagcguuuugacucagugaugccuuuccagguccagaggugaccagcagguaucagugcauaggacuucuuggggccuucuucagcuacucagcccuuuguccagacagccaggcuuaggaacacuaaaggcauauuguccucuaauuuuuuucuaacuuuuauuagguauuuauccccuauacccuucccccugcuccccucuaauuuuuauauugacggugauaugcuaugucuauuauccagugguguuuauaguuaugauacuuccugagaaaaauaauuuaaaaauagacuaaaaugaaauaaauauaauucuuagagaauucuguaguuuucuagaaacaguuaugcgguucaacgaauaucaagguuuuaagauuuaacuuuauuuaugugugcauguguaugucucaguauuugccuauacuacauguauguaggugcccacaaggccagaagaccaugucagaucccugaagcuauagacagcugugaccucucugaugucggugcuaggagcuggacucaggucuucuggaagaacagcaagcugucuuaaccacugaaccauccuuccagccauuaauuagcguuucaaucauagcagaagccagguuagguaguuuaucagaacagggugcuauauccagagaaccaucuuguaagccagcaugucuuucugaagcacuauggagcuccauagcugaaguccacagggccuugcuguuuauucccuuugcauuguuaacuguggagaacuuugcuuugggguuggauguuuuccugcuuaguauuuaacccgaguuuuaauuaugacaguaccagacauugucagauuagcacuuucccuuuuuuuucugccuaagacauggaguuggucauuaacuaaagagaauuaauuagcuguguuguauggcgggcugaaacauuuccuggauugauuguaaggguucuugacucccaugggcuguguaauucaguuugccgaguucucuuuguugcuggugguguggguguuccuggcccugcgagcagaggcuggcagccuuaggugccugcucagcucuucccgcugccauacagaugccucagcucccagucuggggucuucugugagggcugugaugagcacagauguuugguauccacaaguuuuucucucucuauuucauucguguucacaagguucuuugaguacugaugaauguacaucaaaugggauacuucugucggcaaaaugcuaccugcccauucuugagaagagggcugcaggcuggcuccacagugcauuuucuacaucugugcaugucucauucccugaggagcuuggaggggugggaccagugguguuucaccgaaggaaugccaggcauacugcucaaauaacuagucaggaccuagaucugcuauaccauacuuggaacagaaaauccagaguggccuuuggucuggggcagcagcaaacugugagagguauuuaacaggugcgccacagacuugcaucugcuuccuaacaggugacucugcugguguuagagaggagccagguggagguaagguguaaugggggaguggagcuguaccugauucuuggcuguugcccuaacuagaucucucagaaaaaaaagaauuaagucagacucuuauuguauuugaauaaauuugauauuuuaacacccucgauauuauaaaguuuuauaaagccagcaugucaagaaaauguaaagccaccaguuaccuugugguuuuguggucaguauuuguggacacugccuugcgauaaaguggaacaguccucaggugggugagcuugcccugaacagcuuccacugucgauccugaaggcuucuuucugucuucucuaguuuguguucucaagugcucaagggguuuauuugaugaauagguuuauuauugccugugcugcagacauaagacucuaaacccuaucaaaccgcauucuucuucucucugugauagggugcuugcauaagcugguguauaaagcaguccuaaggagcugaguuaaauggaacaugcuacguugcugaaggagcccagggauaaaaugugcgagaugcgcaacuuucauagagcagcuggaaugguagcguaguugguaaaaugcuugccauacuuacccgauguuaguucaagagagugcugggauuauuagaauguuacacauacuuacccaugauuuauauaacgcgcgcgcacgcacacgcacacucacacacacacacacacacacacacacucuacaccuuucaaaaacagcaaccauguuaagcguuuagcaggcuuaacucgugccuucucuguugaugggauuccuguguugaugggauuccuucggccagccauccgccugguugagaccguuaagcaacacugaagaccuaccuagggcacagagcuaaccugccacaucuugacugcugaguggauuugcuucccuucagccuggguggguaugauuugcaucuuugcuaacagacaagugucugcaugaggcucacuggcagaggcucauuaaaaagcagugugaauccugaccuugccucuggcaacagguacgggcuuguggaacccuuguaaguggauuggauuccaguaucuguugagcuucuucacuguacuacugacaugaaaguguggcucuagaauauucaggacaaacgacacucgcauaacccccaaaggaacuguucaggggucaaaggaccugaaagaugaaaaauuucaguauauguguuguuguuguuguuuuguuuuuuguuguuguuguuuuuuuuuuuuauucuaucguaucuguugaaaucauuucauacuaagaauaagcuaaggauauaaauuaguuucuaauuugaacaacuugcccuccccuaggguuuucuagcagggugcagggacacagggccugccuauugagaagguuuuacacucgcuguuucuuuaggaaguuuguccucgguaauuucccugaacuggcuuuguugugcaggagcugcucagugaaagcugaagccuuuugggaaaacaguauuugcaaggggccaggcugcccgguauaauagccgaucccucuggcgcguggcccagaguaagccgagguugaagcuuuuagugugguuuaaagaugcuggccugucauuggccuccacuguaauugggcgagugguuucggacugggccagcguucugcuucuccugggagcagcugcuaggaggcuacagagucccugugagcuagggacucaucaucugguauguuuaaugcaaucugguuuuaucuugggagcaguuucugauuaauggugguaauugccagggaccggcccagguuuuuuugugcaagauaagauauagugcucgggugauuagcaugugaaggcuggguaggggcucucagaagugccgugguacugcaggagacagguauggaaggagagugagggagacaagacaagcuguaaggauggggagauccacaaaugugauuggcuuaagagccuuuuaaaaucaguucaugggcuggagagaaggucuugaguucaaaucccagcagccacaugguggcucacaaccaucugucaugagaucugacacccucuucuggugugucuaaagauagcuacaguguacuuacauauaauaauaaaauuaguuuauaaaugcuuacuacauuuauuuauuguagugcguuuguguguguucaccaugcauauggaggaucaauuucagaaguccgucuuucucuaccaugugagaccugggaauugaacuuagguucucaggcuuggcagcaagcaccuuuaccuacugagcuaucucacaggcccuaauuuaagagucuuaaaccaccuauaaagugugagcuucccagcaccagugaaacaaaguaugguuaguuagauuuuugaaaaacaccuacucauccucaucagguuugguguguguguguguguguguggguguguguguguguguguguggguguguguuugcuugcuuuucauugaagucaaccuuuuccuugagggauguguuuaagcaugucaccuuuuaucacugacuauggauggaugggucaugcuuuccaaggcugcugccccacccacuucucuuaacucaccgugaguuaugcagcucugccucuguuccucacuuucaacaauuuugccugccaggcuaaguugcugaaagacagacagaacagaacacgcugccgugcagucaccuuccuucauuuugucgccuggagugugacguggauggcgugggcuggaggcuggagggaugaaagcguuuccugcagcaugaagggaacuggcugggauccgauucacuuagcuuuacagugagaguuuuuugcuagugcccuguucucuuccauuuauuuccuagcgaauacguacgccuccaccuucgguggaaugcuaguaguuugaguuggauuuuaaugaaagccauagaggcuugaagucuugcagaaaaaacaaaaaucagugaagugggggugguguguguguguguguaugugugugugggauggggauggggggguagggcguuccauucuagggagguccugggacaggugggaggcuggacagcugugggggcgggaacuuagauucagcuguuugcccuggcgacacaaucuguuuuaaaucaagaugaagaagaaagcauuaacaucaugauggaucacuuggcuaaccccaagaauguuaauuaugugucagagauacauuuuuaacccuugauacaguggcauuuagcaggauuuugugguggguggauucaucuuguuacucaaguucuuccucuuccuuuuuuuuuaaaaacuaaacauuggccugucaccugucauucuuagcccugaguuaggcucacagagagcccaggccaucuucucaggcuguuugcugcagugagcucuguucuagccccgugucuaaccaaauccaucuaccuacccauguaacggugcagcuuugucuaauugcauucccagccucucucccauccaagugcuugugaucuccuguuagcaccuugacauccagcccagauguucuguuugcccccugguucccuucaucccagcuaugggcauuaaacuucaaacuugccuaacaucuguguaucucuguguuucauccaguuauggccaugaaauugcucacccucaaauaguagcuuaaaacaacacuggagacggaauguuuguagucuccucaaaugcucuguugaaacccuaaccucuaauggguguugcugagaggugaggcuggugggagauaaucaggccauuagagggaagcccucaugaaucaguuacaagaccuuuuccaccaugugaucugaaaugccuuaucagcugucuucuuaauuaauugugagcucuggcuucuggaaccaugagaaauaaauagguguuguccaaguaaccuaugauacguucaugaugggccagagcuaugacaauauuaaucacuuaucuuguucuuuauucugugccaugaguggccccagccaggaguucuggcuuagagcauuucugaguugcuguuagaagguagcuggagcugaguugaccccaaagguuucuuagcucauaagucuaaaacugaguguggaggaauguagcagccugggcuagaacugcugggcucccugcaaacuuugugucuucugcaccuggccucuccuugugggaagucuuuguugcauugggccaaggcucugaagugaguuuuccaggagaaacuggaagagcccauuucaccuuggaugucccacaguuaaauuucuugccuccuguucguucauucagauaguaggacugcguacaguugaggagugggaauagagagauccuuaguuguugccucuugguggaaggaaugugaaagacuguggaaaaccuggugguuugaauauuuuuuuuuuuaaauuggacaaaacacacauggcacaauuuauugucucagucuucuuggguacaguucagugaugcuaaguacauucaaauuacuuuguaaccaccacccucaccagacuuggagcacuucucaucauggaaacaguaacucugugcccauggaaugcuucuccaucccuucuccccacuggcuacucaauggucuguaaguguugacuauucauuugccaugaauuugacucugaauaccucacaugcaagugcaacauaguauuuggcuuucuuuggcuuauuucagugagcacgauacgcccagauucauguuagagcuuguguaauaucuccuuugcuuuuaaaagagcguauaugcacugugauucuccagccucuauuugugaacacacaguuugccuuuggccguuuaaacaaugcugcccugaugugggcacauuggaaagcguguuugaaaucacaguuaccguuaacauugcggcuucucaaguguuuuuccucacugaacuggaaauuucugaggguaaggacggugacuuuucauguggaaauccccaggucccagcacaagcacagaaaguaguugcugagugaguaacaagcacauggauggaguaauguuaguuaaaccuaccggggaggauucacucuuacgugugacaggauguugccgaugggauuggggaguucccaaaagcaguuauauugaacaccgcucuguuguaagauguuuacuggauagcaccggggacauggcauuugucaaacacaacaugaacuuauaagaugauauuuucaugccuccaguguuuuaaaaaucauccacuguguuuacacauguggcuuuuauacacaguaauguucuauguaguucaagggauaaugaugcagaaccauuugcuuuuuauauugguuagccugcucuuaacuaaaauggaagcccgugagucuugauaaucucauaugauggggaaaaugucuaacaccagauuugguuuucauuaguucgcuuuuagccccucacaugugcaaagcugggugguggcagccuauucuaacagcgucuaaugcugaagucagcccucugccguugaccauggacauggggggagugauaauaaaacuuggguugaggcuaccuugccuugccauuuuuaaaaaaggaggagauagaguuauagagcaaaugaauaaucaagcuuacuuucuuuuucuugcaugaaccacccucuguguguguguuuauguaaucuuaaaagcaaaaauuccuaaauggcuaugauuuccugacuuauugccuuuauaaaugagauaaacacuaaguagccuuuucuuuuaacugauucuuuucuugauugauuuaaccucacaauaauguuugaguguucucaaaugcuucuugcauagaccuuuagauuugguaguugggauuccaucauuuguaaauguccuguguggaaagagaagacaggauaguaaucucauagaccaaaaggagaagagucaagauucggaauaacccagauggccauuggagagugugcgaguccgugcagcguuugauggcgauguuugggggcuugcucgucucuauggagcugacauaaguuaagucaucuaaccucuugggagccaaggugaugccaaagagugcuuuuguuugugaucuuugcucaucgugaaguuuagguagcauaaaagcuuuuuguuuaucagaaggaaaauugaggcucagaaaauuagcaugcacuccgaagccccacacucgggagaggccuucagggacucugucauguuuuauuacgucacaucucacuaaucuuccugugauuuuuuuuuucuuuuaccaucuuuccauucucauccccccccccccccccccccccguucagccagcgugugcauggauacacacgcugagaucggaaaggacacucggucugagcuccuccuccacugagccuaccagugcuggccgcuccugcuggacugucagccacugaagcaauggcgugcucccaagggcuaaauaaaguucucuuucuagguuuuccuuuccuuggcaggauuugagcccgugggauaucuuugagucgucugccauuauuuuuuuuuuauaauccauacuauuaauuuuuuuucucuuuauuacuugucucuauuccagccucaggcucacagugacaugacuuuggguggugcgggguuggggucaaccacuuuaaccauguugcugugcagcuacagagccaguuaaacaguagaagcagagugacaacagcuggcuucauagaauuucuccuguacaguauggaaagcauagcuugauuuauugguuggccuuuauuuuuugagacagggucuuaugcaacccaggcugaccuagaaaucaguuuguagucaaggcugccuuugauccuccugccuuuacuucccaaggguuggguauuguagguguauaccacuaugucuuuaauauacuaaaauaugagggacuacuugaugaaaggaaagaggcuacaagaaaaaauaggaaggggauggugggauguuuuccaggugaaagugauugccaugcaaauaauauaauaauaauaauaauaauaauaauaaauaaaaaaguuagaaagaacggcuauaagcugguguuagcuacaaaauguguagggcaguaagugccuaaggcacgggcugcacaggcucagcugugacccuguagacuuuggagucacguggagggucuguucagcuuccuaguacccaucacuaccagaaagagucuaauguuuggucaugagugcaugacugugccaugguggcuucagcacucugcugcccccagccccuuaugaccacuccaacucaccauggaaaugcccuggagcaggacaugggacacaggacacagcguugcuacagcugaaguuuauaaagcauccccuggacuagccaucuugaaagugucacaaaucaucuuucuuuuuuuuuuuuuuaauuuuuguucugaauuugacagugccugggaaaucucucugaacucuaggcacccagcccugugggcaugcaucuugugccccgugugcugagcaaaaauuaaaagaaccacauuuauaaugcugcuaaccaacggcaugguuaaggccucuaauuggcuggccgaaguuggcaaugcuccacucacuggagccccuuguaauuaaacuuugguucuguuuuuaggacuauccucagcagaguaggaccuagcauucgagcucaguggagucucagccuuggugaagggcaggcuguacuggaacucauggacuaaggaaaugauccugugccugugaguccaagaagaacauugaccaaucaguuauauagcaagaggagagcuaaggcuccuuuacagcagggccaucuggauccgaggugcaucuuucuuauuuuauaagaccugcgagguaagaagucaaagugcuuacuugcuccugaagcucagaguuugguaaaagugcuaccacgaggccaguucugauuucccuuuuaguuucauguucauugagccacuggccugggaaccggcauggcuuaugcgaugggaaugagacuccauauugacgcuuugcauucugggagaggugcguuugacuuucucccugcugugaaaugcaguuagguugauccuaggacaaagcauggauccuaggcagcaaagcauggauugacacagcaacggcagaguggaaagcauuugucaucucuuuguggugagcucagacuucauagagcucugguuuucccacccugugcuucuuuugcaguucuacccuugucccccucauaccuuguacccccacucccuaguucugccugaagggagaauguccuccccagaucugggacucacauuugucugaaggccacagggagaauccacgauuggccccuccuuccuccuuccucccuccucccuccucccuccucccuccucccuccucccucugaacucuauuuagacuuacaggaaaagauuuguggcuuuuugcaagcuuucaacucugagguauuuuggaaaacuguaauuuuguuuguucccugcuguaugcuguggcuucuucagauacgagugugauuauuuucugcauccuuuccauagcaaacauuucucccuugacuccaggcuccaaaaguaggcucuggaaugcauccgucccacagacccugcuccuuggcaguggcugucuccacagucaacaagcuggcugcucugcuugggcugccucuccaggugccucuuggucuugcucgggcacuuggccuccacaugcucggcagucagacgugcccaguguguggcagauucccuggaagccaugaauuacugcugaguuauuaugaaacuuaauuugaugauaaugagguaguucuggguaauagcacuuuggguggauuuuacccauaaaucaguaauuugugggagaccauuagcgaguggcagggauucucaugguggacuguuggauuacuggguuuggauccuagaguuuucacacacccccugcaccccuaggaauuuuauaguuucuaaacugcuaaaauuuuagucugcuuggaauuuauuuugguauaagaaaccgauuuuggaucuagcuauucuuuucaagcauuuaaaaaaaauguguguuagaauauacaugacauuaaauauagcacuuuaagcauuuguggcuauguguaguguauaugugauggauaugugcauaugugagcacauguguguguagaaguuagggguuggcacuguuuuccucagcccuuuauuuuauuuuguuuuauuuuauuuuauuuuauuuugagauaggauggcucacugaaccuggaguucacugcuuacugagacuagcuggagaccugccuauuucugcauccccugcucugggauuucaggcaucuaccauggugccagcuuccccuugaguauuggcuauuccauuuggaguccucaugcugacuauacagcgcuuuacaggcugagcuaucuuuccaucccccacuuuacacauuuuuauuuauguguagaguucgauggcguucaguacauuuauaacuuuuugaccuuuaagcugugcccuagaagccaaguuauuuuaacauuccaugucccacuuuccuuuuuguaaguaaggggaaacacccuacuaaguuuuucuuaguggagguugaccuugaacucaccaucuucccgucuuugcugugugaguacugggauugcaggagugugccaaugagccuggcaagguugucuguaaaugagauugagaauuaggaaagcuuuuuuguucaucaggcugugcggugagugcucagcaauggugggggcuaaaaaggcucacagggacagccagggcugcucagaggaacccuaucuuaaaaaaaaaaaucaaccaaucaaucaaaaacaaaugaacaagcaaacaaacaagcaaggcucgcagggacagucagggcuacucagauguucacauggaagccaaggcuacucagaaaaacccugucuuaaaaaauccaaccaaccaaccaagaaacugaccaacgaaccaagaaaccaaccaaccaaccaaccaaucaaccaacggaccaaacaagguggcuuacacuacaagcaggcuacuuaagaugcauuugagucuugugucucaagcaugcccuguauaacacuaacacgcacacgcacacacacucacacacacacacacacacacacacacacacacacacacacacacacacggaauaauuacuuuccauuccuuugcugugaagacagaauucucauugcaaagcucagauaauuuugcaucauuuuugugugacuugagcauaguguuaauacugugauuuggauuucaggagagaagguuuuuuuaaaaacagauuuagaugauacaggauucauaauaaaaagauaaagucucuuaauauccauauauaaaacaaugcaguggacuggaaagggggaggccuucugaauauauuuugcucuuuucagagucuuaaaggaaauuucuuuucuuaagauguuguaauaguuauuuguuacuuagaaggaacucaagaugaagaaaugguaugugcucaaagugagaaaaaagguaaaccaugggcgaacaguaagcauucgcuuauauuuaaaucuuuuggaaaauuuaugugugaaccuaauacgucaguuaauuauagcacuuugaauuauagccccgagaagccaagccucgugucaggggggaaaucacgugaguucguuuguacuuuauagugagcagccuucuuguucuuugcuucagcaagagacacccaaauucauuugcaaagaggcgauaggaauuguucgaaucaacucuugcuagcuuuaaaauucauguucuuauaauacuguauucagucaccaccacaaacaugccuuucuuagccacacugucuuagcuaaaugugaacuuugaaaaugggaaaaucaggcacuuuuuuagacaguuuacucuuuguuucauaguuuggggcuuuuaaaaaaaaaaaaaaaacaaaaaaaaaaaaaaacaaaacguugccaaggggaaaaucucauggaaggagccuagcuuuuacguuggccugguguuuuggucgacgauccugguguuuuguuguuuugcggaauugguaguaaccuuaaguuuaauugaacaaacucuuacuucuaaagcauagaucauacuucuuuucuaaaaguaagugaagaaugucuaauuaaauuucaucacucagauacaugugcugggucagggacucaggguauugggguaacaguguugucauuauugcauuaagggauaccugugcagagcaugcugagguagggaucacacugggccugggggcagaagguaugcauuucacaaucuugcacuuucucuugcuuugaacaguugugacagagaaaggugucggccucaugguguagaggcugcugguaggcuccuuccuugucacauguucuuggggcaccaugacacuccuuauccuuauacugaugucuuccuagcccacauugugccaauacacuuccuguggauggaccuuaagucccaagucaaguggaaaaaacaggcccucuacuuggcuacccaaugaugcucuuaagucaguuuaguagaaacaagugucauggugacaccucucccaccgucacccccuaauuuaaaaaaaaaauuucuccuguauuucuuuuagcaagugguacaccugugggcaccguccugcgcaggcuggaagccugagauacacugcagauuagacugauggcuaagcucuguuaacgcugcugcuucaccgauggcucucuugucugucguuucauccguuuccacauugcuccuuccccugauucuccucaaggauguauauagauguuccccugugcaucccugaugaauaucuuaggucucggggggggggggggggguaguaaugcuuucucagagagcuacccguccuuccauucugcacccuggcugugccugugauccaagaaggaguacuccgcuugcccuggcaggcucccagguacuuguccagagacucauccacacacagguccauguuucuuggaaaccuuccucaaccuuugucaaccaagcaggauuuuuaccauguuuagaaaugucccucuaacucucuguacuuucucuuuuguuugacugucugccuucuccaucagucugaguguuacuauagguuauaaauuaagucucacucauguccguauauacuaacauggcauaugugucucauaaaugacaucucaguaaaugacugugugauugugggaauguugcagugguuuuugcuggagugggaaggcacuuacagguuuccccucaguacucaugaccuacuacugaguagcaaccuuccaugaucuccagagggaggguuuuuuuuuuuccccuacuuuuaucuccccaucccccaucaugguuggggguuagacccagggcuuucuuuacacaugcucaguaaaggcaagugucauaugacuguguugcacucccagaucccaggaugagcuugcuggugagcaaaaguccugagguugaauguguccgaccgaaagacugcagugaauuaauuguauaacaguuuguucagggggcugggccaucagcacgguuucauguuuaauccguaaacucaugugauaacccauguugcauuguacugcugugaucucugcccaaacacucucuguugacugcuucuuacuucacuacuccccuucuaguuuugggagcuucucuaucuccuacacucccagcuaacugggucggcggaccucagaaggaacaucucucuguccucaccagucacaagcucgguuauccacaucugugucuguauccacuagcuagccucucaugcugaaggaggaccaucaguggaccuggggagggcacaccaccagcuaccugcuuuagaacuuaggccugucagcucuucagcucuguuccuucucuucuaaaguguguuucccuucccuaaggcuauuccugucagcaugcaaacaugcugacgcauuuccucccuauccaaagccccuuuugcuccauuuuauuuugguuuaccuaaacccacugugacuucucuucuaaaaguuuuugguugugguagaauagcuauaggcugcacuuucaaguuuacuguagagucgggcauggugaccuaaucaggaggcagagguagguagaucucugaguuugaggccagccuggucuacaaagugaggucugggacagccagaacuacauagacaguucucuaagaaacaaauaaauuuuuaguguaaauguuugcaagguccaggaguaugaagugcaucgcauuguuguguaggcaguguccaggacucugcaucuugcaaaacagaaacuucuucaguuaaacacuugucccauuagacgaggcuucccuucucccacagaccguuucuucgucuucugcacugcccugccccugugugacucagggccuagugcuccacucucuucucaugcuuccaccaaguuccuuggugguuucucuagagagagaucuuaacugugccacuuagguccccacagcccuccaaauguugucucccaaguucucaccuugcaugcuucucugcuucauaucuuuaccuguguauguaguggacgucuaaacaacucuccaaugaccuugaccugcuccaggugccugcccagguugacuccugaggguggucacucccugcuuuccugcagaacucacagcuggcuacucuuuuuuucucagagcuaugucagcaaaucuugccagcuaggcuuucaguugcucacuuuucuuguuguuaauguugcuaugacaacauuugacaagaagcaacuuaaggaaggaaggaagggcuuauuuuggcuuacaguuagaagggacuccgucccaccaugacagggaaggcgugguguaaggagcaggaggcagcuggucaugugcaucugccuuuaggaagguagaaucaggcuauaaaaccucaacaucugucuucaaugacccacucccuccagcaaagguccacccgcuguaagucucacagccuucccaaacagugacaccagccuggggucggcguguucaaacacaugaggcuaugggaggcauuucacagucaaagcacaacagaaggcacgagcugagccugaccacuguguguuacgucuguccguuccucuguccgucuagcacuucaguuuaacugcacucuuuccuuguccugguuucugcaggcugaauacacuucuaaugagaguccuuuaaaaaacgaguuagauccugguuaaacacuccaagggauagugggugcuggauauuugcagcuguuggaauccccaggucacuggacaccucgugagugccauguucuuauugucuuacauggguucucucagccagaacccacacggucuuccccagugacccuucaaucugccacccuguccccacgcuagggcacucacugacccuucacuggaggaaagcaucuggcuccuagguguccugggacacgucugcuaaucuuuguagcucuugaucgugugagcuccucccuggucacuggguuugaaaaucccagcccucccugugcuuguggggcuucuggcucucuguccuugguucuaccugcgggguugguuugucuggccucccuagaaugucaguucuggaaggcugggguguggaugacgucagcugugcuugccuucuguguagaacuauuucuggcaugugguaagcacacugucaauauuuaucaaguaacucuucaguuuuuacaaaccagacaaggcuauuuuauugccuaucucccuccuucuuaaacuucacuugaaauuuuaaagucuuauuucauccaaaugguuaccaagaugauuuuugaauuucaccaaacaguguauauaugaaaaugcccuaaugaaauucauuauuuuguaugcuaucuaaaaaaauuccuaagaugauuuguuuucuaagaacauauauaugaaauuuuaauuuuaauuuuuauggugcugagccuuucccccuccccccaagauaggguuucuuuguguagccuuggauguuguggaacuuucuguagaccaaucuggccuugaacuuagagauccaucugccuuugccuccugagugcugggauuaaaggugugugcccccacugccuggcuaaugcugaacauuuuuauacuaugucauuaaugauacauuuuuuuacuuuuauguacacaggaaauugcuauagauuuucaaauagucuuacauaaaauuuuucuuuucugaaggauauuacacuuaaguauguuauaguaguuuuaaaucuuuucuaucugcaugggaguaccacugguaauaucuuugagggguuugguggcaauaauuuuuccccccuucgucuuuuuaaggagcagauugaaaugggcgcaguggucacuucuugacguuuugcuuguuagagauucuucuuacugaugggauugaucccaugugggaucaauucugaggcuccugugauuuccacuucaagaugcuguugcuagcgucacuguuucucguguuugacaugagccauuacuugaguuucuugagucgcuaguuaaccugaaauucucuccacaucaaaggaaaagguucaugucccugucuuggaaccauuuaaaguggugcugacaccuucuguuccaaauucauugaucucuuaagagggggaauaauuuuaucuuugauggggaaaggccugauguaugugcucuccucccuggcaccguucacauugcuccccccccccaucccccacagaacugcuggagccuccucacacuccuccuugcguucagagaauccggucuccucgccucuccucacccacugagcagcugccccaaguuaugcugcaccuaccaggcaaucccaggcuccucugcaucuggagaaagcucacuccuacagcaaccugugccccugugugccccugugugcaccuguucgcaccccacugagcuguguacaccuuuccacgcugagauuguccucuugggagccaugaccucccagggucagcuguagccaguugagcucgggcuguugcuaucuguucccuuugaaucauuucacuccccagaaguaucugcugcgagccagucuggcacauggcuagcagcaugaggagccagccgagggauagguagacugagcaauggauggcgggacagaaaacuguugugcgauuuaguggacagagaagccaucaaaaugauuuuuaagauuuuuuuuccccccacucauuauagagaagcauaauuaguuuggccagccaccacagcauguaccugugaucccagcacuuugaaagcuaaggcaggaaauccauaaguucaaagccagcuuagacuaaauaauaagacguugucucaaacacccucuccucaaauaaaacacauauacccauauguauauauauauauauauauauauauauauauauauauaugcauaguuaauuuuaaaaaguauaauuaguuugcugguaucucauaugaaauaugcuugccaguuuaaucuuaagcuacuuguaacucagaccuuauuucuuacuaucuaauggaauaagacagggcaacguguuugucucuauccucccuagagcccuuugcucccugugggcaccacucugagggcuuacucugaaugucccuguccaacccuuucaagaauucuggagcagcuccuauucuugucuucauguuacagguaaagaaacagaggcauaggcagaucuguccuuuccaagucuucugagccaagugguagggacagggcuugaaguuacuuacacuggguggcccaagaaccugcucuccaaccguguuugacauugcauucauucagcaacauucacagagcucuagcugugugucucagggccucacugccguagaacuuaugaaguuaaauacgcaaacaccauacacaacuaaauagcuaucugugugcuaagggaaaaaagaaacuaugggacagaaaaugguugugauagauaaagcuuugagagcuuaucagugagagaccuacuucuugguggaucucagagauaugugccugagagcuggacucucuccaggcuuuuaggaauuugcuugcuauuucugccuguuugcuccucgaagucucuggugguaaaaucuucagagucaggacucaacauugccuggagccuuguucccuuauucuaaugccccuccuguggugaguguugaaucauggggcuggacucuuauguguguggagagugauaggaaguagauuucccagcuagaaggcuuuguggggcagcgaggaaguucagauggagagauagaggagaccuggccuaacuaauuggagaaggguggugacccuaggccaccccaccacccaacauguccucaggagaagccacaauaucaaaguggaaagagcuuuccagagcauuuggagguacaaggucuuaggugcaagugagccagggcuuugcacuucccugugacgggcacacaucucacccaguugacaggaccucauggcugguacugacacaguaguuccuaacuaucuugucucagucacuguucauccaaaaaucacagucagcugugauccaaaaauaacauaagccuucccccucaauagagagaccaaagccacacagcuuuuaucacaguuuguuauggaagcuguucuacuucucucucucucucucucucucucucucucucucucucucucucucucucucucucucucucucucucucucucucucucucucucuuucucucucucucucucucuccccuuauugguauucucuugcuuugccuaguuuguaaauuccacuuuaucaugggcacacauauagaauaaaaggauaggugggcucaguacuaucugggcucuuuagguaucuccugggagucugaggcugcaacccucuuggguuaggaaggggaugcuggcuucugaaguuaauuacaugguaguauguuuauggucuugcuugguuuuccugaaccggcucaugauagugauuuccaagagugggacuuuucuucugaccaccaggauaugguccacaagguccccagcuguccuggcccaucagagcuuguacauggaggaugcuaguggcugcagauuucggauguuauugcuggcacacaagggauucaacccguuccucgugaacuaccacuuuccguuuuuuauacaaaaacagcgucccuccgcucaaucuugcugacugcacacuggguuccacauacuguuuuccuucucuacccugcuuauuuuuacucuuuuggccacuuuauuuuagggauuugcaaugcuugcuuuggcagcgugauccucauuguuuuauuucuggcugcuuggcuuucgugugaauacuucaauuaaguagcggaugugggcagaccgugucuuaggggugccgguuugcugccccgaguguguuuguguugguguguacuugacucuucacugcagagcaagaccccagggugggauuccagcaagggcaguugcccgccugggcuggguggagaacaaaggcacccaggagacgucccuucauuuggaaaauguguuaaagaccugaucagaggucacguagcuuucacaaggcuguggagugucuacugaccaggcucaaaaaugggccaguuaauguuuuuucuuuuuacaagauuuacucagauggacagucaaucuuuccgagagcucggcuucugaggcugagccgagaaagggcucucaggaagcuuugguggcuguucacacagcugggaauuaguucugcuuuuuacuagucugaaccuuacugggaauuacagaggcaucugccuuggcucguuauuguuaaggagggaaagaagagggggcugugaagaugggucacucagaaguacuugcugugcaagugugaguucaaucccagcaccuacuuuaaaaauaagguguguagggggugggcagagacaagaggcucccuggggcuuccuggccagcuccaaauaagcccagaauagagaccaggggaggaggggagucuuuccaaaaaauaaguagguggacagcaagggaggaagacaccugguguggagcgcacaugucaacaaaggaaggagaaaaucuaguuuuccauguccguggcucuuucaaaauauguacaacuucauuccugguuagauuuuuguugcccgguuuguauuggaaacuugcugagaagacaaugggaguaaggcucagauccagcgagggcugacuccaacuugggcaguauuuucagccccaccuuuggauccugcuaugggacucucuguguguccaaaccaacauccucuccagauuagcccugucucugggcacacacuuucccaaaguuauauuuuaaguacuuacuaugccuaagagauacauaaaacaaaaauaccucuaaccuguaagccacuugcccuaagacagauacacccugaaaugcugagggcuauuuauauaagaaguguuugccccccaaagcagcuugacccaaccucaccagaugucccugaucacauguaggugggagguacagaggcaggacauaugucaggauauaugcuugccccugauuggauguggugggaaauaccuggcuuuauggguuugcuuuuauaagccuuuguaaaaugugacucguggccauuuucugggaaccccggaauagaccuggccagaguccaucauccuggccaguauuuaauuaaugcuuguuucaaaauuggcucaaaauuguaguaguggcuuuguucuccauggugggaccgggcaggggugcucauugcccuucccccaucccuguagacugucggggcaucauauggauaccacaagaauccccauggcuccagucgugauccccaggcuucugaagugacucuaacaugccaacaggcugagagguucuagggagguuuuuacuuagggaaacagcccuaaauggagucacugauauccgcucuguauuuauagaagcccaagaacuguaaauaaccaaaaaacaaacacaaaucaccccuccaaguucacggucccuugcaaagccuguuuaucucugcauggcucaggucuuccugagucuuucaccaaaguguaccguuugcuuuuagauuuugucauuggagauuaacaagugaauugcccucuuagccuuugcuucaugucuagagagcauuugcuuuuccuguuuuuuucuggaguggagaacauuuauuguucagacuuugggggugucugcuugggcucugaugccuucuguuaggagccuagguuagggguuugcuuucuguccugugccuuugauuauagcuaaguccuaaauuuacuuucucucccuuccucucuucucuacccccccccccaccucuccccuccccuccccuuucucuggacugccuccuucccuuccccucuccucuucuccccucuccuuucucuuucucugaccucucccuuuccucucccuucccuucugcucccuccauucuuuagcccucucucugacccuccucuucuuucuguuuuuuuuuuuuuugagggggggggugcacagaaaguaggcgcuguagcccacagcuggccucugagugcugggacaggaucauccaagccugguucucagguuuucuuccugccuuccugcccucuucccucucuuccuugguuuagugcuugguuuucagguaacaugaaacacugggacuggacuuuauucuguaaccugauacccugagugcaaacagcucagugcaggcuuauugcccuuucuaggcaucuuuucauuugcucuagaacauacauggagcucagaggagaaggcggcggccuauccacauuuuuguacucuucuuucugucuuccacuaacaagguugggaauuaaacaaugcuaagaggcauagagaaaacgcagccauacauuugaaaaccuaccaagcccagugcuucucuguuacugcuagagacaugacucagcuucccuauggccuugcucagagaccauguuggcuacauuuugguuguacuuuggacgaaucaaacuagaagauugauuuguugcccuggucuuguuggcaucauuccaugaagaaggauggucuccuagggggagcuguggaauuaccacugugguuugggcaagccacccaagccuguucuuacccauaaguugaaggcacuuauaguuugcaugagcaucugccaagugcuagacagauuucaccagcuguaucugaccuuacagccaggacucagccugauuuagaacuuauguguguauauauauauauauauauauauauauauugaucuuauuuauuuuugaauuaugucuaugucuguguguggguaugaacaaugcuuguccuuuggagcaggaguuacauuagauugucagccccaauauggguucugugaaccaaauucaggaccucuggaagagcaguacaggcuccuaacauugagcccucuuuccaguccccgauuucggucauauuagaagcguaguuuggaauaucccccaugguuuauugugaucgugccucaguuuucuuuuaaauggcuaagcuccuugaauguguguggcuuuuuauuucuguagagagcauauacuugggaaauguuggacggauguguaaauaauucaucaugaaguuaauuaaccccaacagacuguuuguuuuguuuuaauuuccacacugcugaccgaggcagcuguuuuuguguaggcguuggcagagucuaggcuguguguagauuucugacccucuaauguagaaacugacacaaaucuagaaauucaggagcuuauggcacggggcggggggaguugucaguagcuugguggauaugaaggucgacuuauuugggugcagugaagaccugcucauggcggauacccauggucaacagcuuacaguguuucucagccugugggucacaaccccuuuggggguugaacagcucuucacaagagucaccuaagaccauggauaaacaaagauauuuacauuaugauuuauaacaguagcaaaguuauaguuaugcaauagcaauuaaaauaaucuaugguugggggucaccacaacauaagggacuauguuaaagggucacagccuuagaagcuugagaaacuacuggcuuagaauuuucuuuguuuuauauauauauauauauauaaacuccuuaaaggaucauugaaaagguauauaaagaauaauaaauuaaaaacaucauguuuaagauagcucaguugguagcacguuugcuuaguguucacaaggcccaggguuugaggucugagggucauugagcucugcacaaaccucuaaaccagauauaccaaucccugccuugaaccuggcagggggaucagaagcucaagaccaccuacuacuguguagagaguuuaaggucaacuugggcuacaugaaacucugucucaaaccaaacacagccauaauaguuucagauggguacgauaaggcaggcccugugguugaaagguuaacaguggcagcugaggcaagaggguugugaguucuaagccacccuaaaccugcauaggaagauccugucuccaaaaggaaaaacaacaacaaaaccccgaaaccaagcaagcaaacaaacaaacaaacaaaaagagccgaauagcaagauauuagacccaauuuaaaaugagcaagaauuaaggcuuuucccuucagcgguuaggacuaacgccaucuuuggagaagcuuuguggaugaauccucucagaaguaguaaugggaggaagccgcugaccguucgcuccuccacacugggagaccauggaggagauaggaggcgaggacagcaaacagccugcacuguaaacacuguagucgggagacuacacggccagguuuucucucugugaacuucaugggauuuucugagcugaacucgcccggaaacagcguguuuucuggguagauuuccugcuuuguggcacaggaaaaucugcgugucuucugcagagaauuguucuuucugugauggcccuaagauuucaggaaaggaaauuugcuucacaccccucuucccuacauuugcugcucaggaauugacagucgcuucagucuuugacuaaagcacaaauccauugugucgugagagggagaauguggaugucccgggagaugcuuuuauacauacagaguuggauauucuacuaguguauguaugauauaucauguauauucacauauauuguuuaucuggauacccacucacacacacacacacacacacacacacacacacacacacacacaccuguaugugcaugcauguguguguguguguguguguguguguguguguguguguguguguauuugaaugcauucaagucuuugcaggcacagaggggucuacagugagaagccagucccguccaucugaccagagagccauugucuagaaagugcagcguucaccaguuucuuaacucuccagaaauaguuacaacuaaguaacuguguugaacacccucuacaacucacaaaugcugcaugcuguucuauacauggccauuuaccagcaugggcagcuuaucuuagagauggugcccugucagccacagagaguccuuguguucaugcuaaugagugauguuucaguauuccaguauucauagggaaugcaauuguuguuacagccauguuuaugguuuaauuuaauauuagcauuauuuaugauauuuauuaauggagugugaauauuuaaucagcccuccacugacauuuaaauuacuuucuaacuuguaugauuucagacucugcugaaaaguauaucacgcguauuuguggcugugaauauacuacccauauuuguggcuguaaaaagauugagucaaaguguacauucauguacauaugucaggaaucuagucuguuuugguauauguacacguauaauacguacugaaaauaacuauagucagacaaauuauguauugucucacauaguugaccuuuguauaggaaguaccuaaaaucucuuagcacaucuccaguguauauaauauucuuuuaaaagggagaauauuagaaagcagccuagugaacuugaggggaagucaagggaacaaaugaccaagauggucauggaccaaagccacacacacagugaaagaaaguguauaacaaagguggaauuccaaaccgagaagaaagcaugagguccgcaagucaucugaggaaccaggcauccucgcauacagaagccgcccauccauguagagagacucucuuguaagcgucaccugucuguaagcgaugcugauggccaaugagcugaggcagaaguuaggagguggggcacgggcaggaagagagaggauucugggaaauagugaguggagacucgacagggauugcugagaggaugugaaccagcagguagcugaacucaggagagaaggaagaggagauucgccccagacuuggagacaugaagcugaggagaggggccuaaccauguggaggacagaauaguuugaauggacuaaaugaguuaggagcuagucaggaaugacguugugguaaaucuccaacccaaauaugccccggcaaugaaaacacaacucaauuaauaugaauacaugcugugcgccuagauuggguagaucugccacuacacuaccaucuuccacauauaagaggccccuuagaacuugugguuucuccaggccaggugcuucugcuccacuuuccuucuuucuccuccuccauugccccccggccccuucucucccaaaaccuucagcuccaccuuccccucuuucuccacccaaucaucgacucuagccuuuauaaauuaaggugggaagcagguuuacaggaagucaccugagugcggacucauuccuuguucgcagccccucacaggagaacagaauuaacaucaaauacaauuagccccagggcugucugcaacaggaugagccaaagauuguguccaaggcauuuauuaauaaauaauuagucucagagucggcauucucuagaagggcugggaaggaaaaagggauuuauuuuuuacacauccaccuuacaccguccauuccuguagcaccuuuauccgugcauuauuauuggugugugugugugugugugugugugugugugcgcgugugugugugcaugugcgugugugugugugugugcauguguaugugugugugugcaugugugugugugugugugugugcauguguaugugugugugugcaugugugcgugcauaugugugugugugugugugcauguguauguguguaugugcaugugugugugugugugugcuuaugugugugugugugugugugugugcauguguaugugugugugugcaugugugugugugugugugcauguguaugugugugugugcauauguguguguaugugugugugugugugugugugugugugugcaugugggagcagguuaugcgcagcucacagcaugcaugugaaagcgggaagacaacuuuguggaguugguucuuaccuucuaccccaacguggguuugagagauggauucuagguuguugggccuucacuaagggucacuuuugcuugcugagccaucuuucugagccuucuucuucuuuaaaaaaaaauuguauguaugcaagugugugugcccuuaugcugugacucaaguuugguagucagaagagagcuugcaggaguccacucucuccuuccacuacgugagucucauagaaugaacucagcuaucagguguuguuuacuaagccaucauggugcucccaauagucuuuuguuaaagaauuauuuuuauuuuaugccuauuguuuuugucugcuuaugugucugugaacuaagugugagccuggugccuuugaugucagaagagggugccagaucccuuggaacuggaguuauagaugguugggaucuccauguggaugcugggaacugaacccagguccucugcaagagcaaaaagucucuuaaccacugagcuaucucuccagccccucuuuuauuuuuuuuaaacaaauuuauuuuacuuuuauuuuuagcauuuauuauuuagaaggcgagugccauggcaugcguguggaugacauuuacugucaucgguucucugcaucaacuaugugcauuccaggcauugaacucaggcugucagccuugaugggcagugccuuuacccgcuggcccaucugacuagcccugcuaguccuaauauggacuggagccccaagcuguaaaacccuucccagauuuacucauuuuaaauagcugcaaccuccuguuguuugaucucugccucaguuucuccuuacccucaguucuauuaugauggauucugcuaaaaugucaccaguuaacagccuuuugcugaccagucuucaucauaguagugucucuaucagacuguuugauucuugcuagugugaaagguaaacaaugcuauucauguaauuacaauuuauguuacuuuaauugaaacaauguugcauugcuuuaugcacaggagcccuuggcaugcucuucuguguguucuaucucuccauauuuuuggugguggggcugcagacugaacccaggacuucacaugucacgggacuuuccccaagccacaucaccagcccuagucuuacuaagaguagcaucuccuuaucuuuguauaggaagagucuguugguuugugaauggaauggcugcugucccucauucccucucauggguuuucugaugggggaguuauuuaccuguuuugucuuaaguauugugcucauggaccaaauuuaucuucuuccuucaagcugucugggaagucuuaaguucaugagcauaaaguucccaguuuauccuccagguaacugucuggccuucacucuucacaguuguggcauguguuuccuuccuguauuuggcaucaugucuauuuuuccuaucacaucauuuuguuuguaugugugugugugggggggguccuguguguucgaaucacuccacaggccucugugcacuuggcuguggagucuauuuuuacugguaguuguucagcagacacuuuggcucuuaacagacacaguuguuuugucuuggucuuguauaucauaaguuuucuggugaauaaaacauuuuuuaaaauguggauuuuauauuuguugaagauaaaaagacauauuucaucuccauuagaaguggacucuaguuggaaagucagugcauauaaugaaugagugauaguuaugguauuuguauaugugaaaagaguuacauucuugccuaagauaauuuucaaaauaggugaaaaguuccuuguauguauguagccagauuuauaaaucagagacccaaagucucaccagcaucuuuguuucccuuaugcgugugcuucugaaucugcccaagaaauagaaaccacaauagaggcacaaagacagcgaugcugauaaaguuuagaucauagcauuaaagcagggacaaggcgucgaggaugcuggugaugugcccacagcaucagggauacuggugaugugcccacagcaucagggauacuggugaugugcagauagcaucaaggaugcuggugaugugcccacagcaucagggaugcuggugaugugcccacagcaucagggaugcuggugauaugcagacagcaucaaggaugcuggugaugugcccacagcaucagggauacuggugaugugcccacagcaucagggaugcuggugauaugcagacagcaucaaggaugcuggugaugugcccacagcaucagggaugcuggugaugugcagacagcauggaggauccuggugauguacugacagaguguucuuuccuuuuuuucccauagaucuaucuaaaaacagacugguggaagugccaauggagcugugccaauuuguaucacuggaaauucuuaaccuguaucacaacuguaucagagucauuccugaggccauuguuaauuugcagauguugacccaccuaaacuugagguagguuucacguggaaacuuugcgaucgccuucauucagugaccaacacagaaccauccugcguuccugucuaccuuccuuucgauucuugaucacacuggcaaguaaaccauagagcucauuaagaaugaccuuuguccuagauuuacagggucuuuaguguuacucuuuguugcucaggugcugggcuuccccggaugucagcagggcaggguccugaaagggaacgacuuauguagcaucacugugcccuguuugauggcguguguaaggaugcuagugugcuaucuucaagaauucaugcagcuuuugaaggaagaggggaggugaaacugaaaaagaaugauaguuaagguguuucaagaggaagggggaaaacccauucuuuguaaguucagucucuuuaaaaaagugacacaauccuuugaucccagcacuugggaggcagaggcagguggaucucugagguugagaccagccuggucuacagagugaguucaggacagccagggugagaguuggggguagggggucagggauugagugcccuagguaauuuuaauucaauugaauuaagccaggguuugcugagcaugccucccucagucuacauuggcuucccucagucuacauuguauagcaucguguaacacuuuaaugcugcagacuagcucuaggguuucaaggacacuaauuguuuuaaaccuuggguuuagacuuugcagcuagcuggcugcucuggucaggcccugccucuuucaggagaggggauacaguuguucugcucccuguaccugaauggaaacaacuucccagguuccagcccaaguccuuccucgagcugccagcauuuugguguguaagggguagagccuagucagagaagaggcuugugccgcauaacaaacacacucaauuuuaaagcucaaaauucccagcaagccagacacaguggcucuuuauaacagauaaugacaccagcgggcuucuuguucuucugguuuccauuuuguuuuaguuggcuccugaaaaauuagaggccuucugcuuuguuuguagccgaaacagcaaagagggcugccaucaugagucuaggaauguacauuuuccccucaagguuaaaaacauuccgaggugcaguugucauuagcuuuaauuuauuauuauuauuauuauuauuuaaaaaaaauaaaauguaagguacuguuaggguagucugcagguucaccuagcuaauuuucaguuccacagguuucugguuagucugucuagcuucaccuacagcagaagccugcuccccaggacuugucugggagccgacacagcagugucuguaguuucugguucccugacuucucaagagauuuauucaugaacuacaauuguugccaaagccaaugcagcccuugugcuuacuuacccacuucuguucuguuauagcauuuuuauccuaauaguuagcuuacgauaguaaguaaauuaguguaacauagcuucauguuaaguccaugugcaccagaacuuuggggcauaguugacuauaaaaucuuaaaaauguuggugaucuaaucuuaauuguuuuuuuuuuuuuuuaauauuaauguugaguguguucugaggaguucuagguugcgcucauuugagagugaauuauugcugcccucagaugaguagaaaggauagaaucaagccugggccucggaauucuugacuggaaagggacuggagaaaugccucugcaguuaggaucacuggcugcuuuuccagaggaccaagguucaauuccugucacucacguagggucuguaacuccaguucccggaguccagugcccucuucugguaccaagacugcaaggaguauacagaaaugcaugcaaacaaauuacccauacacauaaaauagucuaaaaacaguuaaaaacuuaaaaaaagagagagagagagacuaagaaccuauuggcgaugaacacagacuaaugcagugggcguucuguggugaauuucugcaugagggauggggaaacugcuaaauguacuuuguggcuugcuuaauuucaccauggugucucaucucccaguuuuauuuguaauuuuaaauuuuugucuguuuuuccuuuccuacauuuccuaccgugaauauuagcagggccgagaccguucagguucuugcacugagccugugaucuuugaaggagcacgcuauaaggaaugaaagauaagaaagagccugucucuuacugcuuuaugugaggaaguaucaaacauauacggcagccucugagcuuuuuaaaaggcuacgcacugcugcuacuacugcuauugcugcuuccucuuccucuuccacuuccucuuccucccccuccucuucuauuucauuauaucuuaaauuucuuuugugugcggcaaguacugugcacuguggugugugugugugugugugugugugugugugugcgcgcaggucagagggcaacuuaacagcagucacuucuuucauuuaucuuuguggguccuggggauugaacucagguccccagacuuaguugcaagugccuuuagcccaugagccauuuugagaacccaacauacuaaacuuccuggguuuucugugaucaaccauucugaccaaggguaacucggguuuguuuggcuuacagcuagcuuacuguccaucauggaggggcgucuggucuguagcucuaggcaagagcugaugcagaggccauggaagggugcugcuuacaggcuugcuuccucugccuugcucagucugcuuucuuacacaacccaggaccaccugcccaggggcaguaccacccacagugggcugggcccucccccauuaggccaguuucagggugacauuuuugaugcccguauaugaauauguaaauaugaaaugaugaugagggagguuuugaguguuacguuguuauucaguuagaguccuuaauugcugcuugaguaaccgauuucggagcuguacuugcuaguacuaccugucuuugagcuuccguuauuucuaggcuugggaaugguuuugguaggaugaauaucacacugcucuugccugagauuucuuuguuuguuuuuguuuguuuuugaaacaguaggugacuagcaaauuuguuuacuuacaaauauguauaaccuugucuagacaaugcuguugaguuacaucacaacacuugagucuucugugugacagacagcuuccugacucagacuggcccugacuccagcuggcugcaagcuaguaaccggaggggcuuaggaggucauaucugggcgacaaccuuaacaaauacgggggucuuugaauuuaaauauccauucuuuggcuguauguguggaacagcuugggagucugauuucugcuuucaacguguguucuagggauugaaguuaggagcccagguuggcggacagaacccuagagccauuugcugcccugaguccucuccuuuuauaagcaacuaaaacauuuucuuuucuguggugcuuggugcuuggugcuugguucucauucauucauauucucucucucucucucccucccucucucccucgcccuccccccuccccccuccuucucucccucuccuuuucccucaccccccccccuaucgucuauuaauuaggaagacucuuuagauaaagugguacagauaaaccgccuucccagaucuuguuccuguacuuaacaucaagcacuccucuguuucguuuuaaguguuguuucauucauuuucuuuuguuucugugacaguggggaucaaacugagcacuguccucagaacgcuugugcucugucacagagccucagggacagcccuguucuugcuauauuuaaaauuucuccuuuucuuaauaaauuauaagcaggacuugcuaauuuuguacauucuaaaauagaaaaagaucccauauaaagauacuuugaguuuauggcaaacguucaaaguugguuccauccccugagaaacauuguauauuauggccguguaggcggccauaaauauuugacaacagucauggucaugacaguggugguggugaugaugaugaugguggugguggugguacugguggaggagcagggacauguugcagcugccuagccagguucuuggcugguagaaucucuuggugcaaucugcaauuuucaaauagcugcuuugugccaaagacccucucgucucucaagaggcaggacuaauucacacgugaaaacaucuuuaccaugaacugcaguuagaaacaugaaaguguuucccgaauuucucacacgauggaaauguaacauuugugguaaacauugauguguugcuguuuauguagcccguguuugaaucgucgaggcuuuucaucuuugcuuuuugguguucacaaccaaagguuauguuaguuuaguguaugugcccccugugucuuccuguuugaaaaugucuuuguccaagaaacguggccaagaacaauaaaacugauucagcaagccugcugcucuauagcaacaggcacuuagagcugacaccacacaggcaagccugaaaaucuauuuuaaacggcuggaaaggugucagaguaccagaagaagcucaaacagcccagaagagcacaggaccuggcagcaguugguguugugaaucuuagaacgcagacuuuggcauagcaggcucauuucagagaagggaggugugaaagacucaacuucuuuauagcauuuaaucagacugcuuccaggaugaagggcguggguuuccgauucucagaggaaacgcgaccagcugggccuggauugcuccucagaaacccgugcucccucagcuuagcuggaauugguuuggagcuauugccaguguagagguuugucugguccacaagauguuauuacacuggaaaaggaauguauuuuggcugccaucucugcugcccgguaucccuuuuggcugcuaaacaaugugcaaaaagagccaacuuccugauagucacagaacccguauccccacauuccucugaggcuccuucucugaaagaaucuuuaauccccuggacacucacucucuuacugagggacccugggccagggcagcuuuagaaagcacaguuguuucauuuuuguuguuguuguugugaaacaaaaauuaauguccaucauucucuugccuugugccauugugugugucauuucuaaagaagccaaugugucucuucucucuagaaaauuggaaaguugauacuguuucucugagcuugaaguuuuguuucacuuacuacaaauccacaucuccuuuuuaugaagcucuaaucaaaaggaaagugagagcaucuuugugcacacauguaugugugcuuguguaucuguguguguauuuuugugugugcuugcguaucuguguguguauguaugugcguguguggacauguacacauguaugugcguauaugaugguuauguuguaucuuacgaaaucucagauacauagaaacaccaaaacacagugaaccagauuggcguucaauaauauuaaucuuaaaaaaaauuugaaaacacuuuccauggaacaguagacgugaaagaggccacugggacaugcaggcuacauagcacagcugucuacauauguccuaagccuuucuaggguucccaggcauuugcucauaugguugaacauauaggcagcggacccuaaacuuuuggguguguuuauuaaauuguguguaaagugcguguaacuguaugucucuuuguuuugugcuggcaggcuaccaaacacaaguaaauuaauaaugggauauuucuuaucaaaugccauuccuuuuagcauagcccguccuuggcaaggcuuccgcggaggguuuuuccacggugcacaccugaucccagauguucuagcucacuguuugcauugggagaaagcaagcugcaacacaaaggcgacauuaugcucccagcagaagcaaggcugaguucgcuggcuuuguuuccugcucuguuucugaucuucacagggaugugaagaucuuugugccccgaguagcucucuggaagugaggggugcuuauuugcuauucacugcagacauuucucuucacguauggcaauucucaauguuuuuuucugaggucccacaugagcaagcucaaaauugcgaucauuuuucuaacuagaccuguaaaagcccugugaaacauugccacuacaucaauaaucaacuaauuacauuuccuguaaaacuccugcaguuaauacgcuaucuuauaaauagugauaugaaugagaggagggauuggagaaaaagaacauacaugcauguacacauaaauguauauaugugcauaucauauauguguuuacauauauuauauauguauauaaugauguauuuuauaaaaaaaagcagaggaagccagggauauguuugauaagagugagguuuggugagauggauggcgguaccugugcagguccaugcugaggcaucccuucccggugagguaccagccacacacacaaugaggguggguagggcauggggaggggaguagagacagagaaaggcagugggggagagagagagagagagagagagagagagagagagagagagagagagagagaaagagagagagagugcuccacccccccaccacccccagcccaagaacaugcaugggaugugggugguuagaggcaggccaugaacacauggagagagagacuggaggggauggggagagaagcaauagagagugaagaggguaagagaggguaagaagugaggaaggggcauacagccccuuuuauagugagucaaguguaccuggcuauugccagguaacugugggggcagagccuagaagaaaugcuacccuauaauauauauauauauauauauauauauauauauauauauauauauauauauauauauauauauugggucuguggaauaaucauuguccucaucuccagcagcaccuuguagucaugacaacccccagugagccccugggcagccuuuguaguaggugugaggcagaagagggauuuuucccaagucacugagugacagaaacgggugguacugagcacuugaacgccaucucugcuacauuccaugcacuguagaacuauuuugcuagggagauuuucagggacagcccaaguauaaaaacaagaagccuuuguauuugaagguagcaugguccuuccuuguauucuucagacuguaaauuccugcauucuuuuaguuauguuuuuuuuuuuuuaaguuuguuuuugagccaggacugucuuggaacuugagaccaggcuugcuucacacuucaaacucacagagcuauguccaccucucuucuagaauaugcuccaagugacuuaaggguaccccaaagggcuucacccaccuucucaaaacccauaacuucuucuguucuaagaucaccacccaggugccccgagccuuuaacacaugaccuuugggggucacauaugaccuucgaggguuaguuguccagaccguacuauauacuguacuuuuaaaucacgcuuaaauuguuucuacuucucaggaucauucugaccagugagcuuuaacuucuauagaguugcuuuacgguaccuuuuaaaaauguaauuugaauuugauucauuauuucaagcuauguuuccuguuuguagauucuuuagauuguucaagauuuuccuuauagccuguguaauuaguuccaugaguaauucaugcggggguggggggggguggggagaauacauauacauguaaaaaaaaaaaguugucagcuccagauuuaaaaguuacucauuucuccuccucugcaacaccuuuuuuguuuguagcugguguuuuauugagacuuucguugcugggauuaaauaacugagcaagacauccugaggauggaaagcuuuguuucagcccaggguucacaugggauccagcucaagggcaggucccaaggccugacacuauuacuaaggcuauggaacgcucacaaaugggaccuagcaugaccguacuccgaaagacccaacaagcagcugaaagagucagaugcagauauuugcacccaaccaauggacagaagcugcugaccccuguuguugaauuagggaaaggcugaaagaagcugaggagaagggugauccuguaggaggaccagcagucucaauuaaucuggacccccaagaucucucaaacacuggaccacuaaagagacagcaugcaccagcugauaugaggcccccaacacacauacaguagaggacugcugggucuguguucauucagaaaugaugcaccuaacccucaaaagacuggaggccccagggaguuuagaggucagguuggguggauggugggaacauccauguggagacagagguguggggaggagguaugggauauggaacagucucagagaguggaugggagaugggggaggggaauaaaauaugguguguaagaaaauacauuaaugaagaagaagaagaagaagaagaagaagaagaagaagaagaagaagaagaagaagaagaagaagaagaagaagaaagcagcucauguggacccuuguccugugggagugggagagcaggguugcucuccuucuagccgccuggaagcagcuggagaggaugccugugcuaaugggcuucuuccuccugccuuguuuccucuuggguccuuagccuaugggcuggcgucgccuacauucuuggcacuaguucagaauucuaucaugauguggaugaguugcacagcagugagcucauugaacagggcuauagauggagaaaauauuucccagagguuacagauucuuucacgucuagaucaaguauuguaaggagugugagggucccguuggcugcagguggcgaagcagaaccacagaaugaccugugugcuuugagaguucacuugcuuuuaguuaguaaguugaaugagagcccuacagggaguucaggcaacuacuuaggagcacucuccacuuguagaugaugucuuccaugaggccacuguguccuuuagccagaauguacccuggaaaauagcuuaacuucccuguggugaccauugaguguuugguuacagugaucuuagauagaauccauagcacuagccaggaauccuuuaucguugucuaaaggaaguuucucuucuuuauuccuuggaagucaccaaacuuuuauacuuagcucuccagaaaucccauaggaaggcucuauagcuuauauacugcagaaaaauacuaucacagguaguauauaauugguuguaguucagagugauguugccugguccugacagggaggaagcagaacuguuuauauaccuuuuuguggggcaaugggcuaugcacagauagcuugguuuccagucgagacuagaucuugaaccccgggaaccgguagugguaauucacuuacaugggacagaaggaguucucucaugaaaccaggcugucugcgcguagcccauugccccacaccuuucauaauuucaggagcuuugcauagcuucaugagcagaaaaauuugcauagcuucaggagcugugggaaauagugagauuuuguuugguaaugaugccagcaauguuucccuuccuugaucacccuuuccuggggcuuuucugcuucuuccucuuucuucucagcucugaagucugaauauucucucuuccugcacuuauuuaaaguuggaguuucccaaagcuuuggucccuacagcuaccucuaagaccuccugucucacaagucucaacuuuauucuccaucuguuuggcucccuugaacaucacuccuuccuuccuuccuugccuaccaucccgguucucuuggaugucucauuuauaccucaaaauccagcaugagccaaacuuaaguguagagguuugaaugaggauggcccuguagacuccuauguuuaaauacuugguccccaguuucugaggcuguuugggaaggcuuaggggguauggccuuacuggaugaggugcgucacguguguguguguguguguguguguguguguguguguguguguguuagggguggaguuuggguuugaugguggaggcaggcuuugagguuucauuagccacaggcaauucccagcuagcucucuuuguuuccugcuugugguucagccugcuacuuccgcucugacgucauggaccaguguaccuccggaaccguaagccagaggagguuuucucuguguugccuugguugugguguuuuaccacagcuauggaaaaguaacuaagacuaaggucauuucuuauguaccuuggcuucuuucucgcuuucuuugauguuuuuauucuucucugucacaacggcuggugaucucagaauuauccugaccccuuuccuucauccucuuuugcagggaccaaucauuaacuauuacuagugcagcguuuuauugcuuccggccggaaagucugugccuuucucucgccaucuucuggguugcuugugcuguuccuaaaucucagagugaaugcauggagggaugacccaugagcuuugauaaaccuguuacuaagaaagcagguggguauuaagaauuugcuggccacucugccuagcuuauuugucgaguuagaggccaaugaaggaaccugucacaaaaaccaggguggaugacauacacaugcgagcacacauacacaccacacacacacacacacacacacacacacacacacacacacacacacacgcacacccucccugcaaacacauacaacaguauaacccccaaaccuauguugcugguuuugaaaguguuugauaaauuaacauucucacguauaguacuuuuucuuggaagauucuuccuugauuuuaagcauguauuuucauuuuaaaugaagcacauuucaagcuggaguuuuuacagugacugccacgcucuuugaauuuaacgagcuuggucguaaggagagaagugaucugaggccgaggcauuaucuaaucaaacugugguuauuuuuuagcagugguugcuacccaguugggcuguaaacauauggaauauuuuaagcagugaguuauuuauacucaagaggagacugaugggcuguuauugugggaaaccaguacaguugcaguccccaaauaugguacaggcaggcacagcugaaaggcugugcagcagcuacugcagaaucgugcugaaugcugaggccugccuuugaagauuuagucugggggccugaauuugguugaguucuccuuucaaacugaaucccugaccugcugcaaacaugcguuuuauaugugugggcaugaaauuaauuggcauaguuuccaagaacccaguucaagucauaauugaaauaaucaugugcguuucuaguuuuaaggcauuuuaagauugcagaugacaggaguggcaaggcuguaguuaucacaguugcucucaaagugagguuuaaacuugggcucccagauugggugugugcauugaacuugaacucaauccuuucucugggcugagguuagugaagaauaguagaacacgugagacccuggguucaaaacuuucagauugaaguauuuauguaagauauuucuuuuguucuacaaugaggcauaaguauaguguuuauuugauuuuagauuuauagcauaaaauuaaagugcauccauacuaucacgagguaacucaaaggcagcuuuuguaguuaauugucacacauuccugugggaaggaagggccugggguuaggagugcuaugcuggcugggggggggggggggggggagggggggggaggugggggaggggggaaguacucagucauuaagggaaggcagggugagaagcuuugcaggaagcaggaagcaggaagcaggaagcaggaaaaugaauggguccucuauggauauuguucacugcccuguguguaugaaaacuagcaagugcuauaugcaaaacagaagacagcaaugaugcuuucagggaaggcgagcagaucucacagcaggugagguaaucccucagccaaggaaacguccuggcuaaagcaauggcugcuuccugcagaucaggugcccagcacagacagucauccuccagcagucaguccagguguuuaugcccucucucugcuaggagcugccaaggcuaagucugguguggccacacugaaaccagucuagugacuccagcccugagguguuuucuuaucaguucuguggagauuaaauaauuucacaucacuguuucuauaacugucugaagaccuagaaguauaucccaggguucuuguuuugcuagagaaugaacggguggaugacugcagggaaaaacucauugacugucuggacuaaagacaggacuuggcugggggcagagcccaguuuggcaggucuuugauucuauuuauuuuuagcuuguauguuuucacugauugaaacauagaaucuuauuuuaaucuuuuuuuuccuguuagagcguaggaaagucuuauuuacuaaacggaguaauuauuauacucuuuaauaguauaaaaugucuuagguaaaauucuccuaauuguccuacagguuuuuaaugugccuguuugacuuggggcaucuggaugauuuccauacuuaauaaguaguuaugucuuuuaggucuccaguggugucuccccugcccuugcuagucagugcuuaaaaucaguuggaauuuuaagcaauuaaggacaaugaguugaaguagcugagcacuuaucugcucuauuguuaacucuccuuauaaaccauauuaguaguaagauauggauggcuuugcuuucauuuaguguuuggccaagcacuuuugcaucuagaagcuccuacuagguagaucuuuuaaaauaucuucuauguuuguuuguuuguuuauuuaugugugugcacaugugugagucauuuagcauauguggagauuugaagaccacuuucugcagucuguuucuucucuucugcuauugguccugaagauucaauucagauuaucaguauuggugguaagcuccuucaacugcugagccaucuuaccagaccaugguagcucuuacuauguucauuuuuuagcuagcaaggccuuagagauuaaauggugugccucagccuauagaaaugaaggcuuuggcaaaggugggauucagucccucccucgugguuccggaauugguauucauucugcacaguaacacaaaggucauagcagauaaauuguugauaagcauuuccuaugaauuacuucugagucauuucuaagucaguuuauuaagggaagaacauguacacacacaguuauauuuuguauuauuccuugauagugaaaucagauaaagaauauuacaugucuaugguuuaaaaaauuuuuuucaagaaaaauaucucuaaaauaaaccaacaaaaaguaauuaauuuaggccuucaaaauggacacugauaaguucuucagucaagauacauauaaauaauacucucuuaaaaguaaacccaucagaaacaucuuggccugugaaucccuuaauuuaggaaggcaguguugagguuuggucuuuugcuguguauuguaaugcuaaauacuggcccccaaaguugcuuguccucaggaacaagauuuucuuguacagcaagggauguuauauagccuugcucauuaguuuaaaaccauugguugaguaaagaugucuacagccuauagcugggcagaagagaggugggcggggcuucaguucucuggaugaggaaaagagggaacaguggauagaaggcaccaugguguaaagaacuagccaugaaggggcaaaguauccauaccuuggucuucuuucuucccgagcuucauguguuucacaaauuguaucuuauaucuuggguauucuaaguuucugggcuaacauccacuuaucagugaguacauaucaugugaguuccuuugugauugaguuaccucacucaggaugaugcccuccagguccauccauuugccuacgaauuucauaaauucauucuuuuuaauagcuaguaguacuccauuguguaaauguaccacauuuucuguauccauuccucuguugaggggcaucuggguucuuuccagcuuuuggcuauuauaaauaaggcugcuaugaacauaguggagcauguguccuucuuaccgguuggaacaucuucuggauauaugcccaggagagguauugcuggauccuccgguaguacuaugucuaauuuucugaggaaccgccagacugauuuccagagugguuguacaagcuugcaaucccaccaacaauggaggaguguuccucuuucuccacauccucgacagcauuugcugucaaccugaauuuuugaucuuagccauucugaguggugugagguggaaucucaagguuguuuugauuugcauuucccugaugauuaaggaugcugaacauuuuuucaggugcuucucagccauucgguauuccucaggugagaauucuuuguuuagcucugaggcccauuuuuuaauggggauauuugauauucuggaguccaccuucuugaguucuuuguauauuggauauuaguccccuaucugauuuaggauagguaaagauccuuucccaaucuguugguggccuuuuugucuuauugacggugucuuuugccuuacagaagcuuugcaauuuuaugaggucccauuuguggauucuugaucuuacagcacaagccauugauguucuauucaggaauuuuuccccugugcccauaucuuugaggcuuuuccccacuuucuccucuauaaguuucagugucucugguuuuauguggaguuccuuaauccacuuagauuugaccuuaguacaaggagguaggaauggaucaauucgcauucuucugcaugauaaccgccaguugugccagcaccauuuguugaaaaugcugucuuucuuccacuggaugguuuuagcucccuugccaaagaucaaguggcuuugccccuucuuggaauugggagcaaagcacccauggaaggagcuacagagacagaguuuggagcugagacgaaaggauggaccauguagagaaugccauacccggggauccaucccauaaucagccucuaaacgcugacaccauuucauacacuagcaagauuuucugaaaggacccagauauagcugucucuugugaggcuaugccggggccuagcaaacacagaaguggaugcucacagucagcuuuuggaugggucacagggcccccaauggaggagcuggaggaaguaaccaaggagcuggggggaucugcaacccuauagguggaacaauaauaugaacuaaccaguacucccccagagcucgugucucuaggugcauauguaucagaagauggccuggucagccaucaauggaagaagaggcccauuagucguguagaccuucuaugccucaguacaggggaaugccagggccaagaggugggagugggugggugggggagugggugugggagggugugggggacuuuugguauagcauuggaaauguaaaugaaauaaauaccuaauuaaaaaaaaagacaggcuagaguacagauacaugucaacaacagcacauguuucaggacuuaagacuaauauacauuccguuagugagcacuaaaucuuuaucacccagagaaauauuuucacauaagaaaauuagguaugcggauuguaguguagauauccugcacuuuauguuuaauaucuacuuauaagugaguacauaccauacauguccuuuucggucuguguuaccucacucaggauauucucuaguuccauccaucugccuacaaaguucaugauguccuuguuuuuaauaggugaguaguauuccauuguguaaaugaacuacauuuucuuuauccguucucaguugauggacaucuggguuguuuccaguuucuggcuauuaugcauaaaacugcuaugaacaaaaaaaaaaaaaaaaaaaaaaaaagaacuagccaugagggcugcccagucagaguaggugugucucagcaggagcacagcaaguccuauccucgggguuagugauaggggaaguagauacugaaagccauagaggguugauaucuacccaugugacuaaggcuuguuauaaauauaaaaguuugugugucuuuuaucagagaacugaaugauccaaggugcaaggugggguagaaacccccaaauuaauauuaaguauuuaccacaacaagaaagggcaaggugcuagugugugagaauccauccuguguauuuggcaggaaacaaaaaaagccagagauguuuuugagcccuguuacuugguuuaugaugaggaguuacugaaaaagugacaucagaggaccagguaggagccaggccuucgucccucuccucucucccuguccuguuuacccaggcagggcagggacaguggcaggaggaggcacacaggcucuccugcagcgaggacagggaauccuggggcaccacauuugaaccugcgauucuuuaucagcucaagaagcccuuuucacugcaaaucaacuccuuuguaaucaaggaaaauuagcuuuuuagacaggugucauugguuagauuuaagauugaacuuuggccuuuaccuuaucagguacugugugaccuuauccguaaacauuguuuucauaaaggauccguuuuuuuuagccaguaggcuugaaggagagaagcggaggcuugggaccccuggacuugccugagagaaauaagugucagaugaauggcuucaggaagcuaagacugcugacauaggcaguggacauggagcuaaagggacacaguugccccuccccuuuaugaauguuccccuuggggaccuugggucuuuguuacccaugugugguuccuuugacucucaugaaaacugcaaauaauccaaaaauaccucgugacaaaguauaugagacagaugcugagggaacagauguggcuaagaggaaacaugccccugcucgugcaugcuaauuaacuagauuguuaacuccauggacuuggggugggcuaagcagcuuuugguuauaaaacucauucgacccaccagagaggccuuggaugguuuuauaagcuuagauuuuucuaaagugugugugugugugugugugugugugugugugugugugugugugugcgugccugccugccugccugccugccugccugucugucugucugucugugagaaugucuuuuuagguuaaagaaagugugguccugaaguuagaguuaaaggugcuugggagccccccagcauaggugcugggagucgaacucaguccucuggaaggacagcaggcacuuuaaacuacuuaaccaccucuccgggguccagaagcuuagacugcucaguuugaagccagcacuggcccucaaacaccuccagggagagugaaccagcacagcagagccuucucagaguuguuuuuggcugcugugauaaugacucagucagucuugucacuggccugguuaggugcuugcauugauuggguggcaagaccuggacagaaguauaggaaugguuucagcauggguuugagaguagaaauuucuggaaauauccaucccuaccaccccccaauccucuuuucagcaggaaguugagauaugccuuuguucuaagagaauuuccuuguuagcauucuuuuuggccaguuuucaccuugugaaaaagaucucuauaaacuacucugcuuugggagucaggucucagucuaucccuggcuuccuucucccuuggcuuccuaagugcugggucacaggugucuacccccgugcccggcuuacaugcuuauaaauauuucauaaucacaaauuaccuugugaauuauguacuugccaccuuugaauaacuaacugagcugucuuccuagagguggcuguagagcucuccucagagcuugagaaaagccagcagaauaccaaggggaccguuauccaaccaguuucuuaaacagguccuauaggugggagagcacuacgggaggacagagggacaggcugggcccacuccauccuccacugucccaagagacugggcagugucacagucuuugauuuuaaccuuggaagguagcuaccuugucccccagagccaggccccugggagguuccccacuuaacucucuccugggccuuuaugggaaagcuuucuguccaguuguagagagagcuuuccugcagaccugggccgugggagaaauugcugaugugcuguuucuugcacugauagagcuagcugggcgucaaguaccuggaguaggggugauauugaguucuugcucagcacagcaccugcuuuuucugagcccauagguuagcauugccuuucaguggaccagaucccagccccuuacuaugugcagggagguggggucucugguauagcguaugcaccacagugcaugaguaccacauaucagagaguuggccuagauagcaacacccaugagagaaacaucuacuccaguuuaccuuguuccaugacgcuucuuuucuuacuagagaaacacuuguaaggauuucggaaaauauagcaauguaugcaaaggaaaauaaaaaagccacuuauuggauacccccaaaggacuaccaaugauauauugauauguuagaaaugugucucucuuagugacuuuacagauguuuuuagaugugauuguacgugcacagagggugugacauugaaugcgugugugcacaaacacagggaaaguuuuuaauaguuccaaucccaugccguuggcuucaucuauacgauaauggggaaagaaagucagagaacuguacccuucugucucugugguaguaugacaaagggcucugugucggggaggaggcugaaaugaauggcugacaugaacauguggagagucaaucacguuucauaaauugacucucuuucucugucuuagaaaacuaaacguggacaaugggaaauuuggagacucgauguggucuagcucugcaugcagaguggaacaaagccuccaucagacuuggcuggcugcucugggaagcugaagcccucuggguuccgggcauccuuugguagaaggcuauguuucuuuuuuuucuuuuccucagcucauuugcagguacucagacagacuuuagguguagcagcucuuguaauaguguggagcugagugaaccccacuuauuugugcauugcuguaauuuuccucucucugcuaacaauggcucuccuuugagaaaccacaccuacgcucauggacauuucuccccuacaccccccccuccaaccccaacaccucucuuuuucuuccuuuucaugcuuaaaauuaauauuacaaaucuuggguucuggagagauggcucaguggucaaaagcacuuccugcucucccagaggacccaaguucaguuuucagaagccacaugguaguuuacaaccauuaauuuuuuuuuuaaaaaguuuuuauuuauuuguuauuuauaugaguacacuguagcugucuucagacacaccagaagagggcaucagaucucauuacagaugguugugagccaccaugugguugcugggaauugaacucagguccucuggaagaauaggcagagugcucuuaacugcuaagccaucucuccagccugguggugggcauuuaagagguagccuguagcacugggcuucuggggacuauuuauggcaugagcuuccauugcucuuguuuugagaaaaaaguuguccuuuugccuucucucuuccugucuuccuguccuuucuguccuucugucuucuguccuucuauucaaggagccccauggcaccauacugugcaaagcugccucuugcagagggccacuuuguguguuuauaaugcacacacaggaguuggugagaauugucagcugcagaaaguagaaugaucaaaccuggugacaucaucccuucccuuuuuuuuuuaaauuaaauuuaagauuuauuuauuacauauaaguacacuguagcugucuucagauacaccagaagagaguaucagaucucauuacagaugguugugagccaccauguugcugggauuugaacucauaccucuggaagaacagucagugcuccuaaccacugagccaucucuccagcccccgcaucuucccuuccuuuaacagugcucacguguuugauggaaacauuucagcccaucagugaugcugagauacucauggguagcugcaagguuggcuuaccagacucugcuucaggaccccagaguucaaucuuucuguccaauugcaccuuuuucucagaauugcacauuucuuuuaaaaauauuucauuguaaauuuuaaaaauucaagauauuuuuuuauauauaauauauuuaauuacagcuucccuuccccucaauugcucaccaccucuccauggaccuacguccauauccuuucuugcuuccccuccuucucucucuuuagaaaacaggcuucuaaaagauaauaagauaaaaacagacagacaaguagauguacagacacaaaaagaacugaagacaaagcauaagaacacacguagucacacacauccacacauauagaaaucccauaaaaacccuaaacuggaaaccauauauguaaacaaaugaccuguaagguuaaaagaaaaaugcccagacacacacacacacaaacacacacacacacacacacacacacacacacacacacacacacacacaccaaaacagaacaacaacaacaacaaaaaaaacccagacaaacaaaacaaaaaacccauucaaaacuauuauauuauauuaucuauugcugggcauagcuccugcccuuacaagugguucguguauccagugaggucccauuggagaaaacuaucuuuuccuuuguaagcaguuaucagcuggagauagguucuggguuagggauggagcuuggugugaacuucggcuuucaccacugggaccccaucuggcuuaacccugugcagaccucaugccuccugccacaucucuguguguucacaugcaugucagcccuguuauaucuggaaggccuuguuuucuugguguuuccaucuccuccaucuccuuucgcucuuagaaucuuuuuguuuccucuuccacagaguucccugagcccugacaggagggaucugauggucccuuucucucuacuuccccaucaacccauaacuaucuauucuauuucccccagucucuuacucugugucuaaccucuguagcuauauggauuguagcccugcuuaccggaaacuuauuagcuaacauccacauauaugcaaaugcauaccauaguuguucuuuugggccuggguucucucauucagaauaauuuuuacuagcucuauucauuuaccugugaauuucauuuuuaaaauagccaaguaauagucuguugugcgaagagaccacuuuuucauuaucuguccauccucugagggacaucuagguuguuuccaguuucuggcuauuauggacauagcagcaaugaacauggcucagcaagugucucugguaggaugaggcauccuuugguuauaugcccagagaggcauagcugguucuugugguaggucaguucccacugccacacugcuuucucuaggaacuauacaaguuuauacucccaacaacgauggauguguguaccccuagcucuguguccccaccagcaggcacugucauuuguuuuauccaccuuggccauucugaccaguauaaaugaaaccucaaguuagucgucaaauugcauuuucauacuuguuauccagucuugucuauccacuccuucauucuuuuuuauguguuuuuuuuaccccacccccuugcccacuuaaaauuuaaaauuugagugacuucuuagacagagaauuggcguuuuuauuuuugcaaaauguucacaguugagcauggugcugcgggacuguaauuguagcacuguggaugcagagagagaagauuguacuguuuaaagccauccuagccuauugagguuuccaggacagcuaggccuacauagagaucuccaguaacccaaaggaaaacgcacucgccaacaaaagagagcccacuuccaggcagcaucaugacguggccuuucuguuuacguguguuuuuguuguauugucuucacagucgaaaucagcugucugcccugcccgccugccuguguggucugccucucaaagucuuaaucgcaagcaacaacaagcucggaucacugccugaagagauaggucagcucaaacaguuaauggaguugguauguuacugauuucuaagaugcucuuguuuguuuaaccgacuauaagcguuagagguccucugaaagacuuuguuacagaaggaaaaaggagaagucugugaucauucccccaucccccucaccccccauugcucuaacaaaauaccugagacugggaauuuuauacaacagacauuuuuagaauacaguuuuggaggcugaaaguacgugugauccguuuggccacugcugcgggcuuuccuuccucacagcugauagcaucaugcugggagcaaaugugugagggaaagagcacauggcuagacaggaagccaaagagagggaggggccaguuuuacucuuauaugaugguccacucucauugguccuuagugccauccuguaagcaguaugauaacccugucuaagagcaugcccagugcuacaaucaucuucugcuaggcuccaucccugaaaggaucccuguggagguuugaagaugcuuggcccagggagugacgcuauuaggaggugcagcuuuguugggguggguguggucuuguuggaggaaguguguuacugugggugugggcuuuaaaacccuguccuagaaaucagucuccuguuugccucagaugaagauguagaacucucagcuccuccugcaccaugccugccuggaagcagccugguucugggauccuguaaggaguuaggcauguccaggacaaaacugucuccaguucuggacacaagcuguguguuucuuuuguagugagcugaucuuugcuggggucuccuguguuguugccagcuccuggccuacaccuuacagccacagaccgaucucccucgggccugcaaguuacagggugucagagugccagcguguuguagaaguuucacuguuugaugacagcuugagcuguaacacccucauccauagcacuguucaguagacauccaggacacacaaaaaaugugguuuaaauguaguauggcuauguuuaaacaguuaaaagaaacaaaagaaaguaaguccuugcuauaaauuauauuuaacucuagauaggucaaacuuaugaccuccaguauguauaugagagaaaacuauccagguggcacuguuuguauccuaauguuuguacuaagucuuuccuaccaaguccuguguguaucaugcaggggccacacaccacacauaggaccaaccacacucuagugcuuagugccaacagggcugagccaccacuuugaugugacagcugugcaacuuugguguauuuuguucuguagcucccugggucuuggcaagugugcuuuugguaaagaacauuugggggggggaugcagugggcugguucaguggguaaaaaaaaccaagucaucaagucaccaaaagucaccaagaccgaugacuugaguucagucccuuggacccacacaguagaaggagagaacugagucccacaguuguccucugaccuccacauguggucuguggugugcgcacacacuaaaaaaaaauuaaaaacaaacaaacaaacaaacaugcaugacauuuauuugugaagcaggcaaaauauacuaaugacguuacuuaaacauggagaagugauauggccagccuugauucaaggucaaagacuaaaaaaagauuauuuuccauccauccucauuuaucuuugauuuaguuuuauuuauuuauuuuuuugauuaaaauaguaguguuacuauagguaaccgugucaugucaaauuauuuuuaguuaucaauuggggagagaguucccuggagagccagauaucauuuuugagcagaaggcuuuuguuuuuguaguuacagauuacggauuuguuuuuuuuuuaaaaaguaaaguugggcacuccccggagcauucagaaaacucaccauuuaaggcucgagugcugaggaaaucacuccgcccacugggcucuaagcauuguuuguuggcuguuuuggaaaagcuguuucaaacacuuucacgucagaguguucugaagagaaucauacccacuuuuaaguguguaccaacaucacccagaguucacgaccacuuuagaaacaaaggccagacaccucauccaucagaaaggaagcaguuguuccuucuuaguuuuguaaggaagucaggcugcagaacauuguccuagccuugccaucacaacacaacuaccuuaucgucuuaagacaaacaguaucucaugucagccauagcccgcacaggcagcucccugcacagccaaugccccacauggccauugccccacaccuaugcucccaucucccugcacagcacacucauugucccacccagcuauuguccugcacagccaucugccuaccuggucaacacccuggacaaccaacaccuagccauucuucuuuccagccccuguguauuuuccaucugaugcaggcacuggugcagggcaacugauaggaucuuaacucuguaucugauccauuuagagucacuacugauaaaucagucuagaacuuucagacccccuugcccacucugaaucaucuccuaaccaucucucgagguuuaucuugcagcuuagauauuguguguguaagugcugcuucgugggaagaagagcgaaggcugacauguacugagcaucuguuucuaguaggcuguuaacuauuuuauuuaccggcaucguuccauaaagccuuaaaauaaccaggcaaggcagguagcacguugcuauguuauagucuggagccgguuccguaguuacuuaccuaaggggauggagcaacguggcugauuaaagucaaacaccaguacugagcucagcgguguggaaaauggugauuucuuucucuggaauuccuuauuacaguuugcugugacuuucuuauuaaacuugugacaagccacaacuugcagaugagccggagaccuucuccuugauggcccuggacaaauaggcaugucugaauguuuccuuacaguagaaccaggucagguugcgagcaucuguagccuucuguagacuaaaucucacuuaaacucaacuaaaaccuuuggaacuuguugaacuuguguguguauguguguuugcauguuuauaaauguauuuggaggccagagauaagucuugggugucuuccuuaauggguucuccauuugcauacgugucucucuguguguuuguguaugcacaaguguugguaugguagugcauuuauguguguacacguaacauaugugccuguucccgugcauggggaagccagagaaggauguucaggguucucugucacucucugccauauucccaggagacaugaucucucggagaaccuagacgcuguauuucggcaagacuggcaggacagcaggccccagcaguccucucuuagccuuccacucacagugcagaggacgauagacacacagcaccacacuuggcuuugagauucacucuggagaucugccucagguccucauacuccugcuauaaggacuccuacugagugaggccagacuccgggacuucuaccuuauuuuuugaggugggaucucucacugacugagcuauucuagcugaccagcaagccccaggaaucuucuaguucccgucccuccucccagggcugggauuacaggcagcugcuucuggcccagcuuuuuaacacaguugcuggagauacaaauucaaugccuuacaaggguuucacuggccgagccaucucuggaaaugugcuucuuuuucuguccgauccugcugacagaugaggugugucuggugagaggugcucuaucauggccacauguuacaguugacuagcagcugugaagacuggcaugcuaacagcucaguaaagucggguccuuuuacagaugagaccuuugccaaggacccaggaguuccacccuggugcugugcacuugaguggguugcuggccucgcuggcuuugcuugcuuucucucauguccucccuggcugagcauccccaucugccaugcagaagaacagagggccugacuuaggagccugccuucacagcagaaggcccaccaggcuggauccagucaugcugguagaaggucuaacccuaggcccuaaccagacacacaggguuuuuauuuaccuuucaaccacuguuuggcuguguggggcauuugagcuaagagccagaugacaagcuucugacgagaguccucccuaucaugauuuuauaccuagugucucugugguaggugugggagugugugccagcgcgucugcuguaaucauuuguccauuaguggucucugguaaugccuuugaccuuucugguuucuguggaaacccgggaguuacucagagccucucuguggcuuccauuucugccuuuagcagcaagaacagggaguggagccuguguuugugggauguggagaggucugaggccuagguucacaauggagaggcaagggcgugaggcggccauaugucacaucaaaggcugcugcucugaaggggucaggcuuauguuaauauacuuuuauuuuuuuuuuccuuuuuccaaguucugacuguagguauugaggguuguuugauuaccaagaaaugaaaauugacauuauugaguaccacuuaauaguuucauuuacuucuuggguagucaguggauuuuccugauauagaaauuagaaauuagaaauauuucauacucuauuuauuuauuaauuuauuuauauauguguacuguauuuauucauauauauauauaugugugugugugugugugugugugugugugugugugugcuuuauugagugagugagugagugcagguuaggaaacuuugaugagcccccuccuuugcgggagugaggccccuccucccaccuuguggcuuccuggagucagggguugagacuuuggucaggugcucacucugaugcucaucccuccuguuucugugagcacagagagaguaaggcacuugccucaaguuguauagggagacaugcaaaaggcaccucuacagaggggucugguuccacgcugguuggacacuguugauaauuugcuuuugcacccauuaccgaaagaccuaauuuucuuauagacauucuuuugcugguauuauaccacucaguccaccccugagugugauuuaagucauuguuaggaucuaaacaauaggguuugggugagugagcccauaaaaagcuuauauuugaguauuuaaauuguuauaauuagauucccuuuuucuuuuaggaagaauucagucaguaaauauuuguaacaguuucucaugauucuuguguuggauaguugugauguuauaauguugagugcacagugauucaauguagcuuaagugaguuauucucaaagacauagaagguugggacuaacagaaaauucagaaggaauuaauuugaauauucuaguaaguaaauugauguggaauuugcaaucugauacucgacacugauuguagacauguaagacauugauugcucuuugcuuuaaaauuuauuuuucuaauuaguaucuuuucagaauaaucuuuaaaaagcccuaugacuuauuuagacgaauuuuguacagaaauguucuagagaaugagaccauucuagaaacauugcuugugcauuuucaagauagaaaccuccccagacauggagauaauuauugcuuuuucacacuacuccuuccgcuaauuagacauaaguacccgugggguuucuuuuuaugaugaaacgcauaaccucuuuaagacuugguuagguucagaggcuccugggaaauaggauuugcccuguuuuuaccauauuaaauauacaaugcuguauagccugucucuccuuuauguaauagauuugcuugggaaaucuauuccuauuauguuaugcauauuauauugggagggcacauaacugacccucgucagauacucuucaaaauccgagcaggccuguguauuuguguuuguccauagguguccuguuucuuagauggagaacuugggugccuaucagacgcagcgcugucuuauguguaguaaguacaugcugagguuaccgcaugugcuuaaacacagccugcagggguugguugguugguuacggccaugguguuggggguuugugccaggaagaaucaucuaggcuauugggguccaaccuacgccuaaugaugcugccauuaacuggggacaacauaaacacacacagacacacacagacacacacagacacagacacacacacacacacacacacacacacacacacacagguuugaucuuaggagaggccauucugcaaguguguugccuaaacauauagauuaucuucccuuuucucauuuuuauuaaagaaaaaaaaucauauuaguuaugucuuucaaagccguggaagcgguugauuucauacuugcgaugagucuccacaagcaaugauaagcuuucccaugugguugcuuaggagacucacagaaacuuaauuuauacuuacaugacaagaguccucuccucagacagaaaaucaccccugcagauucuucccccaaaccgugucuccccuuuggcacugucaguccugugccgggccugaucuggagccuggaggaccguagcaugaucuccugugacacuggccucaggccggccuggcuuccaugcuugugagggccguugugaaccacaguggagugggccaggugcugauucauaacuuaguuaaggcauggaaagguccggcucucacuggauagacuugcuuuuagacuccauggacgaucagaauuagaucaccaccgaauucugauuuuauguucuuguauauuuugguuucugcauaaguacugguggugauuuguagcuguuuugugauuuuuguuuuagauauuagaguuguaugugcuuuuguuuuguuuuguuuuguucuguuuuuuuguuuggaucagguuaagggcagcagcuaaggugguacuccugaaaagucuaugacccuaaccuuucucagccuacuucccuccucagacgguugaagcuaggagaguguuauaugucagccacuccacgcacacccuuuuggauggacggcaguuuuucacgcuguuacugauggugauauugugccuuugugaaguaguguccauugcgguucaccugagggcuaaucuaggggauggggacagcugacugauggcugacugguguagccuggucuaacugagauccugguuguagggguggaaucgagcagaagaucgauugguuagugaugcauucaucuagucugaaggaaaguagagcagaacaaggccucgguaaccucugcagugaaagguugcuuugcagguuccuagagcuggaucguagccccgugcugauuuagucuccacacucauucaggcuuccccugcuugauaugccacuccacugggauagcuuagagccuggauuugucuucgguucugucauagcaaguggggcaugcauggaacuugacuaacaugucaaaccauucuggggccccagaagcaagguacaaggggccaucguaucguggggugucuacaucagaggauauuagacauuuuaucccugccuuauaccuggaacucugcugggggauggcgagaacguggguccucucaccuaggaacuuccagcuuuacaggcgaaggagaagggagcaagugaauuacauguacacccugcugcaaagggagaacaaaaacacccauucccaggugaugaucagaguaggagaggaucaugggagugguuuuaaagggggaaauuuuaagcuuggguugagccaugacagaugaguagcaggccaggaggacaaugccagaccuuacgucaucaagcaggggaggaagccugaaugaguuuggagacuucgaaacagcauuggccuauacugaaacuccacguggugacugcaugguuaggguguaggaggcaagagagaauaaucagggaguggcccuggaggaacugacgucuucucacagagucuggacuuugcugaaggcuuaugcuggugaacaacagaauaaaaucugcacuaggauagcucugucugucaaggauggacgugaggaggugggaguggcagagaagggauggacagacagacaggcaggcagguagaugacagagcccgccggagagcguucugugcagcagucccucugagaggagcacaccacagacugcaggagggucuaggugugugagagaaaagcagagcccugcugcuuaccagagcugaaggaaagauguggggagauaaugagugucuauaggguaagaauggucuauauuuuaugugguaggagcugguucuaaucuaggauuagugggggacugcaauuucaaagcgaagaugacagaauccucacacuucacagacuugcuuaacaaaugggugugcagccaucagcuguagcugucagccauaugauagcaaguccauuuggaauaaaugaugcauccaguuggugugcugguauuucucuguguaagagcuugguaugauggagugggggguggggcuguguaaccuucuuucugaaagguggcugguaauuccuuccuaaugucaacuggcaccugcuugccgccgggcuauaacgccgccuuuuccugagcugugagauaguaauguugccuuguaagauuguggugggaccugaguaagguccacgcaucugaaaaucagaagcaacagaaacugcuagccaaugccuuuaauaucuuuugugcccucaaaggacauugagaaacaaaccccuuuucuucacuguugagccccaauggauugggaccgggagaccaguauucuauggaguuguccaagcauuuaaguucuuugaggagcauucacauguaauucuugggggaagggcauugguuauucuugucugacucccccucucccugaaccccccacuuuugcugcaggaugugaguugcaacgagaucacggccuugccccagcagauaggccagcugaagucucugcgggaacucaauguccgaagaaauuaccuuaagguuuuaccaccagguaagaaaggagggcaaaguggagagagcgggagauagcaccugcuggguuuacuuuuaugagaggugauggguuaguguguguguguguaaauugacuguuauuaauaauuaauaguuaacgauuaacaauuaguaauuaguaguuaaugaucucaccggcagaugccagaacagugauggccaacuucuaguuugaauugaggcuagagcaacacaaccuuuaguggaacauacauuaguuuucuagggcugcuauuaaaaggaccacagcgaggguagcucagauggaugacaagaagguuucucuucaccauucuggguuguccauuccaaggccuuccuccguggcucucagauggucauuaauccuccccucccaacaacccccaccuaccacuauuuguguuucgaucuuuuuuuuuacuguuauaucagaggauuaaagucuauccuaaugaccuucguguuauuuaauugcccauuuaaagccucaucuccaaaucccauugaauucugauguacugggguuaggauuucuauaucugaguuuuggggugugggaccuagccaguccguauaacaugguggugugacgugauauucuagaccaugaagcuaacagucuggaggggacaagcuugguccugcagauccuggcuaucaggauuuggggaucugggaacacugguagagagcucacagugucuacacucugccucugugugugggugaugcuacagcggaguccucccugcacugaggccaaggucacuaguaccagugcugacccuaaagcuuugcauggacacuugcacagucagucauaguaucccccacacagcccugccgugggcucuugcaguaugucccuguuguccagagcacuaggguuuaagcauaaagacauuuacuucaaagcuggaagugcuugaggggucuggaggaauaguuugguguguaaaguccuugcuucauaagcauagacauauguuugaaucccugacauucauauaaaagccaagggcgaguguggcagaguguaccuauaacccuagcacugaggagguguggagauaaauaggucucuggagcaggccagccagccuggccaaaucaaugggcuacaaguuagugagaggcuggccuaguuaccuaucaacaugacauagcccagaaucacuugaaaaaggaguugucuuuaucagguugauuugugggcaugaaugugagagauugccuugauugcugauugcuguaggagaguccaucccacuguggguggcuccaucccuacgcaggaggguccuggucuguauaagaaaggcagagaaaggcagagagcagagcagcaagcagucuuccuccauaguuugugcuucaguucuuaccgucaccucucuuaacaguggacugugugaccugcaagauaagugcacacucuccucccugaguucuccucucaguugcuuuuugccaggguuguuguuguuguuguuguuguuuuuaaaucacaaaauagaagggagacuuagagcagagauccuguaucaaauauugaaacaaauuagaacaaaagagagagcaauagagaaagaggccugauggccaacugugccuuccacguguacauacauguacauacauguacauagauaaaaugugcgcacacauacacacgguucacuucuguaugauaaaacgcccuaauaaaaagcagcucaggggacagggauuauuuuuagcucauaguuccagucuuacaugugaggaagucaaggugggaggaacuugagggaacuggucacgcccacagccaaugcaucaugccuguuugcuuguguuucuccacucgcacagggacgaccucuauagugaauggugcugcccacagugggcggcgucuucccauauuaacucaccuaggaaagacaaucagagcuaaccaucaucccccccccccccacacacacacacaguagauggggagcagagugccagguacuucuuuuaaaacauacucuacuuuccagagauuauguugauuuccaaaauauacuuuaaaaauuuauauuaguucuuugagaauuucauauaacaugaguugaucauuuuacuccccuuucccuaauucugacuaaauccaacccugccccccugcccagccaccuuugugugcuauucaucauuuuugugguuguuuaacucaagcccaauuugugcuacccaaguauuuuuuggauggguggccuuccauuagaagcauggccaggucaccaggggcuauucuuuuagagaaaauuuuucucucaccccccccccccccguccccucuccuccucucucuccccuagcagcuaacaguugccaguaacucccuggcugggaguaggcuuucguggacaauuuccaccuucaugcugaggcuugccuuucauccaucccauguguacugucacaacugcugcagguucauacacugagccacucugcucuauccagacgccacuguuuccuuagaguucucuaccaucugggucuucugcuuuuucucacccucucuuccucagugauccccaagccaugggaugagaggguaggguauauauuuucccauuuagcgugagucucucauucucuuggccuuggcuguuugcaguucauccauugcuucucagaugaggguugagagauguacugaacuguggacauaacaaugaguuauuuggagucaguuuaauacaaugucaauuuuuaacagaaugguaguagauucuaccuuggggccuuuuagcuaacgagccaucucuaauggugcuagguauaguuuucaucuuguggggaugacuuaaauccauucagaaugugcuuuuuuuuuuuaccuguaugaugauugagccaccaucacaccagugggcaugccuugccaggccagucuguguuguagcucccaggguucagagcuggguaugacugaugaucacuggcuugcccuggaagcucacagagcacuuucaagcucugugaaugcuagccagugggcugacacuuccaggucgacggcaccagcucgauuucgcuauguuccaugacucacauauguggcaucuucagaagcagggucuuaacugucaaguucuggagagaaaccaagagcauuggcaauguuugagaacuggugggcccuuacuggccaacaauuccagaagaaguaacccauucuuggcauugggcuuuuguuuuguuuuguuauucucuggugucuaguauaggaacauuguugccccauuagaaguuagaagguaacuaacucccuuuuaacucuauguauaugccuagacacuuguaggaagauucugcaguuagcagauuuccauaugagucuuuugaaaggcaucucaguucaaaagcacacacuuggaagcaguuggcaccuaguucacuuggcauuuauuaguggcaguuugaaagcugccugguuuuugccauccuguuacugcuuguuccagacauggaaacagcuccuaaacccaugcagaagagcuuuguaaaaugcaccaugcggaugguagagggcucgguuauccuucccuguuucucaccuuacucacgcuggcuuacauucaaagaagaauuagaaaauaccucugugugggagucauugccuuauuugaaugagcucauaaaaggagguuuacuuuuuccauuugucacugcacagucucauuucuuuugagugcauaaaacuauuuucccuaauuauaauaaaaccaaauaauacuaaggauaacuacaaacaaaauuuuaauucacaguuuaucuguacagcacaaccuuucaggcauuaagaagccccgcugcauuugagugccugcgauaaccacuguggaaaugccauaaaugauugaacccauuuccaaagggaaaaccgauuacauucuuguguggucacaguguggcacaggggaggagggagcaccugcagggccuacuuuucuguuuuucucagugcuucucucucaccuuaaggacacucuuuucccuauaaagaucaguuauaacuuacucuccuuuuauaacuauguauccucagcuaugauauuuuaaaauauacccaaagguaaaacuuauguuuacccugaaugcgguuuuuauucaaaaaaaaaaaaaaaacaaauuaaaaaaaaaaaaacaacagaauaucaaguuuuuuuuuccugccucagaggagagagcucuaauugacaaguguugaugguauccggucaccaugagugacccucuuuauuuacuuacauuuguucucuugggggaaaucucuccucauauguuuucaauuugaggaggggaaaaaauaaaguuugcagcccaguuaccucagucaguuuuguguguuuuuacuacagcugauggaagccauacucuguuuuuuuaggacaggagggcaggggacuaaaguguuuauuucuugccucucuuugacuggaaaguggaauguggaguucuuucucggccuccuccuccuccuccuccucuucuucuuccuccuccuccuccucauuccccuucuuccugcuucugugcuguuuuuccucuucuuuuccucuuguuucucuuccuuuuccuuuccucuuuuccuguucuuccuccuccuguuugacuccugcuuccugcuucccugcuucuccuccugcccuucuuggcuugcuuuccucguuaccugcucugucccuugaccuuuugugggucagccuugcgagucugucauucccuccaaggcaucacuacugugagacuguagagucuuccccuacacuacacguuggaaccaaagggcagggaaguggcgaucaucaaaaguuuccuuuaccugcuugccugcaaauucucuacucccccgaggagccggucugcuagucauaauuuagagucuucauuuuaguugguaaagaguuucugggaauacuugcuauguaguagcuauuguuuaaaaagccccccuuuuuguagcaaaggaaucacacaagcccacaaaauacagggucucauccuauuuuaacauuguugagacagccaagcuuugaagucauccugcccugggaauccccauccuuuuuagcuggucuguaaacuguaacaugaaaauccuaaccauaccgauuagguuuuguuguuguuuguuuguuuguuugucuugucaaguugacacaagcuagaccaucugggaagagagccagagugagaaaauaugccuccacccgauuaacuuguaggcaagucugugggggcauuuucuugaugaauguuccauuguggggggcuccagccuacugugggugguuucaucccugggcagguaguccuaggugcuauaagaaagcaagcugagcaagccacagggaacaaggcaguaagcagcacucuuccauggucucucuaucaguuucugccccgacuuacccuuaugauggacucuaagcuguaagcugaaauaaaaccucuccucccggguugauuuuggucaugguguuuaucccagcaauagaaauaccuccuuuucuuucuguucacuuucauaacuuuccccuccacuauguacaauugcccccccauaauuccacccugugcccacaacccguaucaaaacaaccuuuaggaguaaggcgugagacucauggcugcccccguuggggacucgaacugcuccgucaaaguagaaauagggauuccuugacaucuguuuugaaauacaguuccugaggcugacaugggcuuuacuauaugagaccugggaguugaguguuguucuuccuucuagaauuuuggucucaaaauuacucuauucuguaagaccaaguaaucuacugagaggugaaagacggaaagccccuaucauucccagggccuugcguucugagaagacggagcacucaccccaagggaguggugcuggcugggcuaaaauaguacugcagaguugaucgaaagccucagccauguagauaaggaaaagggacuaacugcuagugcuucuuaaaggcucccguccucuccuucaaguccucucccuaucuaguuucuggcucucuuccacuuuaggccagaaguauuugaagccacuauauuuuggccuuuaacagcugccauacccaaaaugcagagcacuguucugaagugaccccacuguagucaccacccagccagcucagagaucugccagcgucacccuaggcccuggcgugccucagccuggcuucacucuaugggauuauauuugacuucgugccuagcagcugucagcguugguuggaaugcuugaaauuacugaguguuuauuaugccacugggugggaaccucaggcuaaaugggacauccucuccugugaguugagcugugggcagcuucgaaggcgaugggacgaagcccagccagaucggaauuauggguccuuuugaaaaauccuaaauuagauaacacugaguauguaucggaggguagcaauggggacccuuugacaaaaucgggagcauauuuacugaaacucauucugggccugugccagcucaugaacauugacuagauaaggguuuucuguauagcauagcaucccuaaucagccagugggucgggaaaaugggauauaguuagaacaugcuccgaguggcauggcuugugcaauucuuuugcuggaagaaaacacgcucuuuagauggugugagugguagguguuuccaguacaguuuguaugagugaguguccagggaaacggucccccauucagggagauucuuuauaugcgcgcaugccaugagucucauacggguaacauggcucacuguugaugcugcuagccugcguaucucuagauacacagagaguugacuauugaguugacuacacagccacuugauccugccauuuucugagacuuuuuuuuuaaugucccccccuuucucucuucuuucagagcuaguagaucuccccuugguaaaguuugacuuuuccugcaacaaggugcuggugauccccgucugcuucagggagaugaagcagcugcaggugcuccugcuugagaacaacccucugcaguccccuccggcgcaggugaggaucugccuagagcaacggccagggcugcacaguaguggcacgagugacucuccacagagccccugcucugauucucucugcauaccggaggcugcgcuaggcaugaugggaugcaguccgcaccccaccaccccccucaaaacacacagugagacuuucaguaaaucugacugauagguugccuguggcacugucacaucuguucucauaucccugucaucgugucugaaccauccaaggacggaguuucagguuugauaaaguaccaaccacucagcgacacaugugacgcuugucauaggcuguauagccuacaaagggggucacacaugccuuauuugaacauuagcugggaaaacggaauucaaacgucuuaaaauaugauuauugacuuuuuugagacacagaucaaacuaugagaacgcuacacaguacaaaugaaaauauuguacaguuucuuuucuucuuaaauaaccuaaugacuuauuaaaucuaugaugaucuuuuaaacucuuaguugcugucugugaacuugaagauaauugcguuuucuuccauauuuuagaguuggacuuauucccaaugcugucugauuuuuuuuuaaaaauaaauuuuacccucuuuucacuuacauauguuuuugucagaauuuaguaguuugaaaagguuagguauuucuugagcaggauuuucugcccaaaguggaauguggaggaaagaguccuaagaacucuuguguauuuagugaccauuguuagggaguuacuuaccaugacagucucaagauuaaacugcguggucggggaccuggaacuuacaucuuguuuugucacugagaaauaaauacgcauuacugauuucuccgcagauuugcacgaaaggaaaaguacacauauuuaaguauuugagcauacaagcaugccagauuaagacaagugacucucuuuaccuccccaccauagagaggccccauuuacaccaacacguggaagacaggugaguuaaugccuuccuuccugaaagaggcuguguagaaugcccuucgccacagcugcccagauaaccugacgucagcauccguacacuuuguucccguaauucacguuuaugacuuggcguuugagaaaauaauggcauacaaaaaaaaaaaaaaaaaugaugcuggggaaucucuaaucccuguaguguagccucuccucgucagaaaucagcgcuuccugaggacauguguggaugcuucuaaauaggaucuguacugacuuuaugcuuagcacggcuauagcaaacucuauuguaaaaacuauuguauuuuaaaaauugaucgcuucaagcuagguguagcaguaugcuccugugauccuggcacuuaggagacaggguuaagagggucacggauuugaggccagccuaagcuguguguguguguguguguguguguguguguuguaugucuaugugugugugugugugugugugugugugugugauaucgccauauauccaguugcuaucucaaacuugcuguucuugauugaauaccuguaucaaguugaaacauguuaagaguuauaaauuuucuguguaccugugugcucuuguaucuuaagguuaagaucugcaggcuucaguuuuuaaaauguagaauguauagguauuaaccgccccccccccccauuuccaguuucauguguaaguguuagaauccuuucaagcauccuugggacauuugugguguaagacaggccuuaugcauccagagacuagaguagccacagugacccacuuaaagaaacacacauuuuucuugagaauuuuacagggcagaggucuuuuccuugaccuugagauuugcuaaacaggauggcuuggaauuucaaacuauccuaauggcacuuucaaaauaacuauacacacauauacauauauauaaaauuuuauauuuauauugcaagguauacuuaaauacuggaaagguuuucaaauugacugaaaacaauguuuucaacccuaggacauaaaauaauuaaauaucuuacugcuucuauauaugugucaauaagauaaaauuaguaacuguuucaaagaaauaaguugucccucagaggaggaaacccugaguagagaauuuaugauguccuuggcaguuacaaguuuucauuauaggugugugaucuuaauacuucuuagaacuaggcugacagccuguugccauauaucaauaacuucaauaaugaugauguguuuuauauaaugaagucauaaucacauuauuaaucgauguacuuuggugucaauuuugugauuuuuuuccaauccuuuucuaaacaaacugaaugcugacgauguccgcugcaguaagaaggacuccgacucagggguuggaagugacaauggagauaagcgguuaucugccaccgagguaaaucugggggucgcagaguuaccuugcauucuucauccaucugucuguguccaccaaagucuuucuauaggaaaaagccacuggugcauuugaacgaugugaauugacaguucaaucaugugugaaagcagcuugggaccccugaggggugugugaaugcuagcugcugucgcucaguguuccuaagagccccugucuuuccccuaucccacuuccacauugucuagcauagucuucaauucuaaaugaauauuaugaaaggauaauguauuaguaugaagcacuuugaugaacauaccuguuuuuaaugguacuuuagggaagugcgguuagauacaucccuaagugcuaaggaaucaaaugcacauugcgugugaguagcuuauucacugaaaugucuguaacuagcuguuaaaacauuuaagcuaaucuguguguucagaagcgucacaacacauguguggugguccgaaggcagcggcaggagucgguucucuccuuccaccacgugggguccagggauugaacucaggcaugucaucaggcuuggccccaagcacguuuuccugcugagccaucucgcugguccuuaccuauaguuuuagaaacaauauuuguauuucugguacuucagcugccuuaugaucagaaaauuaaauuuguggguaaguucaguuucaucagucgggcaugacagaacuuccauuagugauagcuguaaggguaggagguggggaagggaaaggaaaggggacuguagaaacgauuauaauuuaguagaauaaaacacaucuuuccuuugucuuucuuauuaucauuuuuuggccucauguauggucuacuagaccccauaggggguccuugagguuguaaugacuaggccaguuacuucucauacacacacacacacacacacacacacacacacagagagagagagagagagagagagagagagagaucacauuuuuguuuuuguuuuguuuuguuuuuugagaaaggguagcccuggcuguccuggaacucacuuuguagaccaggcuggccucgaacucagaaaucugccugccucugccucccgagugcugggauuaaaggcaugugccacuaugccuggcugagagaucacauuuuuaucaggugugacuucaggaaaaaucauuuccaguucuccccuggucuugagcuuuaguaagcagauaggucuauuucccacaagaugugcuauaaugcuguauauuuaaaaauaaaauaaguuaaaguccguggcuggggagauggguuagucuuguacaaugcuugucacagaagcaugaggacccgaguucagcccagaacaccuguacaagccaggcccagaagagugagccugugaucaugcugugaggaagagagagacaagaggacacuugcagcugcuggccagccuucucgguugaagcagugggauccagguucagugaggggaccugucucaagaagcauguggagagccagcgggggagacgcccagccuugaccucuggcuuccacacgcuacacggacagggacaugugucacgugugcacacacacacauaaaacaaauuuaaguuccucaggauuuuguuuuuuuguuaaagaauuuauuuauuuauuuauuuauuuaacauuuugaagaagagucagugggaagcaaaaggcaucccguaucugugugaggcugcgacccacgugaaaccacacuaacaguuggcugugggucggcggcgggguuggaaugcugaacgcaucacuuucuuauguugcauucucuuuaacccccuggacuucaugaaagcuccuaaguccccucaaaugggcgauugucgcagaaacugcccacccugggauuauuuuccauuaaauuaaaacaagcucuccuuuaucucucuuggaagaguaauuaaguucauuaauaaaacaucacggaaggaauuucauuauccuucucuuacuuauaaguaggaugcuaauagcauucugaagagagcccaaggauuuauucucccccuuuaauuaaaugcauaucuuuggauuuuugcuagcuguaaggguaggagguggagggagggaaaaggggacuguagaaaagauuauaauuuaguagaguaaaacacaucuuuccuuugucuuucuuaccucacaugcuagccucauugucugagugcaucucugugguacuaauuauuuuuuaaaguggugagguuuugaauuauaccacaucguguguuaccuuuaaauuuuuuggucacauucacucccuguuuacccucacuguuggggucaguagucacgccuguccccuuucucugauggaugccacaucugauugacuuaacauugguccugaaaauacuaaacccaugguuuucucaagauacuuaaacaagaacuuguggggaucugugaauaguucuuuggugagugaaauucaugcuugcuuucugguguuucuaaguggucugugcguguguuuaagggcaaaaauugcuucaggaaccggccacacaccugagggcgcauguggagguccugcuuccuguggcuuaggaugcuugucacuugucccuaaauagcaacacuaaaauggagagagggagaagugaggaaaugugucuuaacuugugaggggauuguagauuucugaauauacgucauuggccaguguggggaaggagagacaucagacagaauuaacucccgguacuucauagaaccuuugucuuagaagucacacagaacacccuuuccuuauaccuaauaccuaauaacacuaucagcugccuggcgcugcuuccucaaugcaagucaaggcuggacacugacccuuaaugucuuaaacaaaauacguacucaguugccugccuccuuugugugacuaccuccauguaguuuuggucagucaacccuuugucagaccugacuguaccucuccuaguaagauuauaauuuagcgcuauaguuugucuccaaguguucccuuguuguguuggguauugcauggcccucuggugaccugaugguggcuguaagcucagaaaagggagaagucacagagacaugcaucuauguggaggugugugugcagcguaagcacuguaaaucuguacucacagccggcgcccauucacaaagcagagccacagcggcugcccucaaagucucaggugcaucccugccaucgcgugaauagucgcucucccuuucugacauggguaucgguugcuauuucugaguuuguaagcaauaugcuguuugucaggucagggugccgcuuuaugugcaucgagaagcccucuccccagaaugauaugauucccuguaucuuuguagcccucugaugaggacacgguuagccucaaugcgcccaugucaaacaucguggaagaagaccagaccaucaaggaggaugcgugccaucggcucaccccaacuaaaggucugagagcgacgugugcagagagagcuugcuuugcagguuuagcuagacuuaaagcaaacacacacagagagaggugcagaugaucaguuacucuuuaugucacacauccugugagccagcugucaugcccacagggaaugauuucauucccagucuagauggcucuucuggcuguagugcaggauggggaaaccaaggcucagacauuugacgugauuacccgugguuucacaagcgagcucugcuccuuaacagucaguaguagaguccagaauccucaggaauauuggagauucuucaaauucauuugugaaaagaaaauauugauaugauugauggauaagacguaggacagcucuagcagcugucguaaaaucuccgaaucucagggagaaggugauagaugcagauagcuggaagacugaugcuccauuacucaccguuagcauggacuccccaagccccacauccauguggguuaagcuagagggguggagcauggagagucuugggcuugugggguugugggguugugggcagaccuagaagugccuaugacuuagaagauggacuucaucccacggccauaaucuaacacacucgaggguaggaaacgcauuugagguaugagcuugggaaucuguugugacuguaaccacgucagcuggcugcuuccaucccuuguaaagaugguuagaucagauggccuccgagagcuuccuuguaacuuuuguccuuugacucuuugauagucguauuuuaaagcuauucagacacuuccauguuuucuuccaccucuuagauuuaggacacuuguauuucauuuuguuuguuuaaaacaaggucuuccuguguggcucagacuggcuuggaacugucucuccuccugccucagccuccccaguacuggguuuguaggagagcaucaccaucuccgacucuuagauuugggggaagcauuaagcagagagacugugauggaaaccaaaccccgaaauguaaaugaauucuugcgagaaaaauguagcuacugcugaauugauucauauaaacuuuauaacaauauggaguauugggggucguauuuaagacaagucuuccuuuuuuaaagcuuuaaauguuguuauguauucucgucucauguguuccaucccagagaggaguaacaaagcuguccccucgacaucuugcagugucacuuuuuaaaggaaacucucccugcuuucuccuguuuacucuucagucagcagagcccucugugcuguccccuuuucugccuucugccugcugggacagaugaguucugcuccagcaugcucuggcuucugcagggccuuuccugggcgauuucuaugguaggcaggaucugggguuuuuggcuagacuugucucauguuuccuuaagguuaauugguugcuuaagggcagaagcaauuuaaucccuauaaugcauaugcagauacauaucuaaauggcauaaugauuuccagguaacagugguccauacauuuuguugaacauagaauguguaauaauuagccacacacuucuaaaaacaccaaaaugcuuuuaugauuuucucaauucuucaaaagcaugagaggacauuccguuucuuucauggggagcuaaagcccugaagaggccuugacuuuuaauacucaguuugugggucuucuguuuacuuucuguuucuuccucuacucccauguuuaauucuccccuuuacauucugcagaggcaauaaaucauggguugcucaggggccucagcagcgggugacggggggcggggguggggcugguuguguguuuggggacccgugggugcuucaugccucugucuuugaagucacgcuuccuugcuuucucuguguuuuccugacaggagaauuucagccgaagccuuccauuuugggggacagcggcaucucaggacaagaaagagagcagcuugcuggccgugcagaugcucgacacucgggacuuaugaacuauauuaaggcaagguuuugcagcucaacacauuuuccucugcuugggaccuuagaauucagauccacagauuucagauuucagccaaacaugucuguccagccuacuguucacucucaaagccuccagcaucuccucucuaagcuugaggcuuuuuuuuuuuuuuuucucuuugccccugacauugagagcuggcuccaaccaugcucgucucuagacugucugauuauaaaugaguuuuguuuucugauccagguucagccucuucuuaagccuccgaaccuuacaaauugacagguuuccccaaaugaccaugaccacuugcagaaguuccuaaauuguuucauuuuccccauguuuuacgugagugccuagaugguuucuguaaaugcuuagccugagagcucaggcugugcauuuuuuuuuaauccaauauguuuaaaacuagagauguccuagauugcugggcuuuuuggauuuugaauguucauauaggcauuacagcacaaggcucccuaaucuaaaaaucugagaucccaaaugcuccaaaacuagaagcucaaaaguuuauacgacucgaaaaguuucaguuccgugggcugacaagauggcuccugcacggaugucagagggcaacuggugggaaucaguucucuccuuccccggggauugaacucggaucaucaggcuuggcagcaggcaccuugaacugcugagccauuguggcagccccucaccuguguuuucugaugauuuguuugaugccuucagccaugcuaaccagcauuccagggacucacaucccaggucacugggaguaaaacaagcugaauuugacuuguacugcuugaggcucuaauguacuguagccuucuucaugcccucgagacugaaauagugaacuugacaaucccaucaugaaccugacucaguuugugcaaaguuaauagucuaaaaugauuacagaaacacccagacaguaaaacauagaccacgucgucuuuacacuacucuagcuuuucaacuucagugcuucuucucuucaucuuguaucucgauuaacaucucuuuggcuggguucaucgugucucgcugcgauggucgcaggugcccacuccagcuccucagccaacacggccuccauacauacgugugugcuccuaagugcacauauucuauauucugccaccagcuauuuuucucagcacacagaugugcucacaucacucucaggucauucccauaaggcucucccacacuugacuccugucugucagcuuugugggacaggucagucauuagaacauggaaaaaugauucugucuucauuucaucaagaaucucucuuaaguugagaauaaaaacagaacacuugaaaucucagauucauaaagcacaguguccccuggauucagagucccgggauggcagcacccugggggguggcugauguggaggguggauccugagggcgacacucaaggagccaaccauguguuaggcuugacuucuguuuugugaccuaugagugcgccaggcuuccuagcacacuaacaguguuuuucuauaauccugccuuauguacuaaauuggcaucuagugcuuuuuuuuuuuaauuauuauggccuguuuuuuuuucuuucuaaucacucauaauaguuguaaauguaugaaaccauuaugcauguuacacuguccagugcaaagcuaaucuacucagaggaaauacaaaguuggauuucugagagccuugggucacauuucugucagccaauacaaagccuuguuucuugugcauuucuguuuagagaccccuggcucaguguccagucagccaugcuuuaaggguagagauagggucugggaaauguguuguaacagaauucugucaguguguacuugccugccuccgauggcugcagcaucaccagcgguguaaccuuagggugaccgcaugucauuggugcauuagcacugaaauguuagaauucacuaacacgguaaugcacacccgugaacagccuaccuaacacauuguuucuuuugggggcacuuuggaguugucucaggaaguugucaaggaagauuaaucagcaucucagcauuguauuucagccccacuuagaaccaugaaauaaguuuuugaaggcacaaaacuaugagaaguacgcuaaguggaccagccccagugcuugcucagugucuacuaugagaaucagagccagaggcggagugucccuuauccuaccucacccggguccugcuuguguuuguuaaucacuuuguguguuuaugugugugugugugugugugugugucuaugugagugugugcuuauacaugugugagugugcauauaugaguugauugugaguguguguguaugcauguuuaugcauguguauuuguguguauguguguaugugaguuacaugugaguuauguguuuauguaaguguauauaugugaguguguguguguguuuaugcauguauguguguauaugugaauguguguauguguguguguauuuaugcauguguguguguauuuaugcauguguguauuuaugcauguguguguguguguguguguguguguguguauuuaugcguguguguuacuuacaaguaccccaagcacugcuuugggcacugcagaugacugugccaauucucaaaugcuguguaauuugcaaauaaaaagcuuagcaagcugaugccaaccuguucuguguucuagagaacaacugcauguucuguugaguuuucauucugaagcuaaaaauuagaagacaacccccuugccuuugcuaguggaagccuagaagaccuggggcaggucgcuuuggacgugucaccuggaagucugauuucauggacuucaccgucacuugcagagugacacaguuuaucuugcuguacccugaaaguaccgucuaggcaguaaagguuggaguggcuuuugcaacacccuccucagggaagggucauccuaaggagacaccagaaccaauggagacaugcccgauagcccacaguccgauguucuuucccuaauagggacauguacccacuccagaguggcucucuguuagugugagcccagccaggacauuuuccuugucugaggagaaaguucaaggagauacauggaagacccacaguggacacagcccccaggaugcacucccagugcagugucucuggagagcuuuggugugggaggcucagugaagacaugaguguucucugacuuuguucacacgaaacuacuggauucagugcagggcauuuccuuuuguuaaauaccaguaaguugaauuaaauaaagaacucagguggauuuuauguugcuucugucuaauggaaguuguaauccuaagccagcuugguggaguuauuauuauuauuuuauguuuuaauuguggcaaaauacauaugaauuauaaaaccuuuugucuguaaaauuuuuugaggcaaggucuugguagauagcacaggcuguccuugaacucaugguccaucugccuuccuugaccuuccagaugcugaagcgcaaaugcacacuagccauacagcaccacaacccaacguuuuagccacauuucaguugcacucuguaguuuguguuaacuauguauuguuauucuguucuguuaccacuaaaaccuuuuucaucuuucugaacugagacuauuuaccacuuaaaucuucccaucgugccuccucucucugacaaguaaaccuucccccgugccuccucucucuggcaaucauagauuuguguuccuucucaauaaguuugacuacuauaaguaucucauauguguagaaucaugcagugugugugugugugugugguguguuauuucaugcucaaggauuucuguauguaguguaauaauguccuccuuguaaagaagauucaguuauauauccuuagcaugcaugucaguggccaacuggcuuguuuuuuccuuuuggcucuugugaauuacacugccaugaauagggacugggaccgguuuuaacucuucauugaaaagcccaugugcucuaucauaggaccaggcagaagacugugaagagcuauugcggauagaagaggaugcucacuggcacauggaggaacugugagugccagagcugggucaugggccaccauuccucuucagauacucuggcagucauguccugauagauuuugaucuacuuuucuuugggcaagccuagaaucuuccccagucaugaagauacgaaguugccaguuuuccuaugacucuucuuuacagucuugggucauauagucaaucuucauuugugcuacucacauagacuggguaacacauuacaguugaaguuuauuuggcuugcaauuauugguuuagaaguccaaaaucaagaggcugugucuagugagagcuucuugguccgucauaacacagcagaagcugucccaugggaagagaauaugagagguggagacagagcugagcuucuauacauaaggagcuaccuccuguaauaauaguguccauuauugccuuggggcuuccuagauucccugaucaagguucuaugccuaacacuguucucuuuggcauugaguuuucuacacauaaaguuuggaauguacauucauacugcaggacaacggaaaguucuacuucauuguccuugaguuuuacuugagucugucaauaaaaagugagaacaucuucuccuuuccuuccguuuuccuugaagaagccaauagccauaccuaauaucuagagagccagucccuucaaccgugguugccugguucaaaucuuugaaaagcauuucucuacguccuaguugccaaucuaauaacugucauagcuggcauauauuaaauucuguauuccuggcacuguuuuauuuccuaggcagcagcccaguuaaucuuuguagcaguccuagaagcucgguugucugccauauugcagaugaugaauuuggggccuagauuggugaugccuuucuguccaaggccagagaagguuugaccuugaggaaucuuguauaagugauuuuuuuuuuuuuuuuuuuuuuuuuuuugcucugcuguauaucaguauuuacuuggcaagaccuccaguggagcagaugagugucucgacagaaaaggaaccucuuucauggaguuggcuuggaaccuguagcauuggguagauguuugguucauagauuuuugcugucugugguguagaguguauguagguuuugauggccuuccacuauucuuugugggcauuaucuuuuccuuaaaaaggacuggucagacuguuaagaauguucucuaguaguaggaauucauuggccugcauuuguguagcaagaagaguagccaaaccgugaucaaauuucucuuccugggaagucccucuguaucacucuaucuuaccagcuccuuguuggauacacuucugagaggccaaggaggccugacucaguguagcaucagagaaucacgagggaggaaagugaggccagauaaagcuuugcaaaccccguuaucaguuucacaucucuucccaacccugacucuaaagucaggauuauccguggagcuuucuagagggcccgucuuuacuugagauuggauuugcuuagguguguugggggcuaguuccuuucauaagcuccacaguugauuuuccugcauugauaaagaaucaggccugagagcugcuguuccacacugagccccucacauggaacuagaguuggaagccuaggaauugauacagcuccacucuggggagccaggcuggucuuaugggaagacccaguguccuugucuguugccugacuggccauggagcaaguggaagccuggagaugaacugaguuuucccugcccagggacuucucccaccuccauagcacccaccuacaggauacuuaugugucuucauuacaguacugaguuugucaaaauccuuauuagaagauugacgggguuuugugaggcugcacuuaagaugucuugcuaaacguucugcacucacacuugguuuuauguuacagacuaaauucauccaaagaccgggagcuggauauagcgaugauugagcagcugagagaggcagagcugcuucaggaucccaacggguaugcacgucuguuccuggccuggcccuugugcguaaaugagggcuacuaacuuacugagcacauuaugucaguuauaucaccgucuaacacauuuagagcagaguuggucuguauguaaccacuaacaaagugaaguccuuuaguugccuauuccccaagauccaaaguaaaagaaucaaaguucuguagcaguugagaccaguuuccugguccuaaccucucgugacauucauauggaauggcugguuucauuuauggaaaacagaaauaugguagaagcacagaauaauuucuacugauuuauaaacauaggaggaaaacccuacuaaaaaaauggaaauuuaaaacuucuacuuauuucugguagugccagaugucacuucuauuuaugucugguagugucaauauguuuauaaaggcuuggguaguagguuucucuuuaaauuugaauuggacccuugucaggaacaugcauuguacaagaacuucccaacagacuuccaagugauacuugacuaucaugucaaccugucaaccgccauguugaaaucauuuuauguugggcacauuccuuuucacuauguugacuacuuccuauauuuguucuuuguucuuuacuuuuaaaguaauuaccauaaauuugacaaguuuaauuuuuuucugguaauauucuuguggaccaaggaauggcuaauuuuaaauauagcagucuaagucagacagacauggcaaucgaaccuuaaugccauuagugguguaguguuaauaccugagcaguuuggcuugcuggaucaugacuucaucagacauuaucauggucuuucacacauaaguuggaguucaguaaaaacaagcgcugguacuccauugggagagccacuugcauuuggaaacuuuuucucuuaaucccaaagacaagcugugcuugucaguuaaguguuucaccugcacggagcccguagagcgaaucagacguuuaauggguucacuccugucgguucucccuccucuuuagucuaagcgcagauaucauagagagaaguauuuugaaccuguuccccauggacucaggagaagccucagaauucccugauccuucacucaaguacguucaccuuuuauaauucaguacauuuucucuuuuuaaaaugaugugauuguguuucaaaaauccacuuugccucucuuuucugcccaccuuccuacaguggccaguugcagcuggagacgucuccagaccgugagguaaggacagagcucgguguugccuugggggaggaaaguaguugccuugggggaggaaaguaguggcauuuguucaugaccgaguuuguaaucuuuccugauucucuaauuuuguugacuauuguuccccccaccuucccucaaagaugagagguggcuuaauuuuuuuuuuuuuuuuuuuuuuuuuuuuuugguuagauucucuaaguuuguuugccaaaacagacucacuuugucaggcaguggucacugcagugcauaagaaagcaguucuggcuuggaaauggagggaggcccaguugaugcagacuaaauucgaguugagaaagaagucuggcuaaaugaagggccugaaggacgucaucaaaggaacugagaaugcuugggaagauuaaaagaauauauagggaguuggggguggugguguagauggccauucaggcguaaagacccgaguucagacccucggcacugcagccugggccugugguuucagugcuaccacgugcacauaggagcgccgcucaggguaacugguuagccagcuuagcugaauugaagagccccagguacaacuagagauucugacucaaaaaacaaugaguauauaguauacauagguccauacagaacacaaaagaauacuaugagaagcuggugggaauauuuggggagaagauaaggauaaguuagauacagucauguggagugaaauuuggggggguuaguagagaaaacauucucaacauaaaaguaggaaugauccuagagaaagcuuaucccagcuguggaaagauaaguuugggagaguaguuaggaaucacacaaucuguuaaaguuacuuuucuauugcagugacaugugaccaucacgacagggcucauggcaaaaggcaggcaggcuggcaugaugcuagaguaguagcugaaagcucacaucuuaauccauaaacaggacacacacacacauacacacacacagacacacacacacacacacacacacacacacacacacacacacacaugcaggggucagggggaaggugaguguagguuaccuggaauugacaugggcuuuugaaaccuccaagccugguucuguugaccugccuccuccaacaaggccacaccucuuauuccuggccaaauaguucugccaccuggggaccaagcauuuaaaucugugagccugugagggguguucugauucaaaccaucugauuuuacucacuggacucucuaggcuugugguccuauaauguaaaaugcauucaguccaccuucaagucuccauagucucaacaugguuucagaguuucucuugagacuugagacagucucuucauuguaaccccuuuaaaauaaaaaagcaaauuacauaguuccaacauacaaugguacagaguauacauugcuguucugaaagggaagaauggugucauaguugaagaaaguggacuggagcagggaagaauaaaacccucagcggggcaaacuccagauccuguaauuccuugucugaugugaaagaacuuagauggcucugccuuuucaacuuuguugugugugacacacuuguagcuugggcugguuccauuuccuguaugaagcguucucuggcagacaugucauggcucugcggcggcucuguccauugugcuggggucuccaacaugaucuaagcuucacuuuucauggccucauaaauacaguggccguuuaaggcuuccaugcaggaacuccucucccacaugcccgaccucaguagcucuccuuauccauggaggaagauuccacaaccccuuuaacccuacauccuucaugauucuaaagccaggacacauggcugaugcugccauaucuagcuguccucuuuggauggagccugacucccuccuugaauucguuuuacacuuugcuuucuugcuuuuuuuaggaccaggaaaucucugagacauuuuccagacuuugcagauuagcuggauagagucuugcacaccaauucacuuugcuccauuuggcuuugagcaucucuuuaucucuuucagcacaagccugggcuccaauguuaaauucccuggcacucuuucccuucucaaacugcacauguuguauuucuuuuuguccugcuugcuguuuuucacuguagaguuucauaagaguuacuacuaguaacuauacaacaggaugaauaugaagcuaucuucagauauucuuggccagugaaauuagcccuaaacuuuucaguuagccucaggcagcuucuuaggauaaaggcaaaaugcagccacagucuuugccaaaguaucaaaaaauggucuaaaguccaguugcugauauuguucuucucugaaaccaccaguacuuggcuuccauagucccauugcucuccucacuacugucuuccaagcuccugcuaggauaacccucuuaaggcaugcuuacagcauccagcugcuuuccucauucaaagucccaaaucuuccauguuccucugagaaacagcauggucuggauugucacagcaauagcccccuccccaguaccaauuucuggcuauuuuucuauugcugugaaaaaaaacaccaugaccaagccaaauuacaaaagaaaauguuuaauuugcugcucaugguuacagaagguuagaguccaugacuauuaugguggggaacauggcagcagacaggcagguguggugcuggagcaauaguugaaagcuuacaacucaguucacaagcaggagucagagaagcuaacuagugggaauggaguggacgcuugaaaucacaaagccugcuuuccagagacauaccucuuccaaugaggccacaccuccgaauccuucccaaaauguuccucuaaguuaggaugaaguauuugaguuuuugagucuaugggggucauucuacucaaacuaccacacugccuauuuacaguuuaauacaucccucccagggaguggccuuaaaauggccuauugagagacugaaauucccuacaaaccagcaucuguacuggaucugaccgcacaugcacuaugaaguaauuaagcagguuuacacucaacaugccugaguaaaugaaaugaggaaaauaaaaaacauaaaggggaaagcuagguuugcagagauugugauugcauuguuacagacaaggacugguaauuauguuacauggcugcccugacugaauugcuaacucuguccaacuuaauuaaccucucuaaacuucacuuuuauuuuugguaaauuucagucuaauaauagcuauuguauagcucaagugagaugauucaggagaaaccucucagcagugggcauguaaaugcuagcuguuauuuuucaacaaucuuacuguuaucggugugaccuuuagauagaaucacaguguggugggcacgucaacaaaccaggguugaacaucaggagacuuuuauuugcaggguucccuuuaaugguuuccauguccuuucuguuugagaauauuuguuucaauguguagacuagcuuuuuuuuuuuugcauguaugaauauuuugcucacauguguguuccacagacaugcauauacauguauguggucaggcuagggcaucccaucccuuccaucccuuggaguuauacuugaguuauagauagcuguuacuauguggguacugggaguugaacccaggucccccaaaagagcaagugucucuccacaaagacucaguuuuuuaaaaaguugcauauauagaaauauuuuuaacuuuaaaagaauauaaaaauaaauuucaggguccuauaaaaguuauaaaaauauuguaaucuuccacuuugcagcuacagguuaccuauccuuaguaugcaaaugauuucaagauguuacaaaacucagaaguguuuuuagcaauauuagaacaccacaaauauaaaccuuugcacuugcucucaugagacaggucacagguaaaacacaggugagcuugaaaacagagcauaaaauccccucacaccauguguauaagucauauuugaaaugaaaaccagcuguuuagauucagcuguuuccaagcuccuaucugcauuugcagauaauuugaucccaugucccaacacuuccaggcucuugccuuuuggacagggagauucagccugcauggauguuuacccaugcuagcuguguuauuuggucucuccguuuuccuccacaucuaccauuuuugaaauagcugacaguguagacaccacuucccuuacugcucugcauuucaguuacauuguguacaaauagggauccaucuucuguagauacauuucaggauuccgcuuccuuagugucugcugauaagcucuugucccagccguccauaggucuguugaucuaaaacaguucucugaauuuuccugucccuuugaugugggcaucaggcuagcaucaggcauuacauuugguuacagagucucucuggucucuuugccggcuccuuugcuuugcagcguuucugaggauagugaugcgaugacagugaaguuguagagaaugugggccuuuuuugguguguguguuuugaaauaguaucucauguagcccaggcugcucuagaacucuguguggcucaggagauaaccuggaacaccuaaccaucuuccuuauaccucccaaauucugggauuauaggcaugugccaccagagcccuugccaggccuuuucuuuuggagacagggucuaauguagcccaggcuggccucaaacuugcuguauagcagguggcuaucgugagcuucugucuauccggccucugccucuagaggguagggauuauaggugugcuuuaccacauccaguuuauguggugcuggagauagaacccaggacauugugugugcuggaucuaccgacugagcggauuuccagcaccuagcccuucccuugucuugggggauauucuuccuuuaguguuugucugauguuuccucuugauugagggucugcauucuuauuuuggauauugccuuggugcuguugcgugcucuucccgggcucucagauuuggaggcuugcuguguccuucuugcccccauugcuuguauuuaguugaaacacuccauuguuauaucaccccauuuuauuacuguauuaugguuauuucauuguucccgcaugaccagugagaagucuaugaagagauguuuuagcuccugaugacuauccugcugaaugacuucagggugaggaggacacaagauuaaaaaauccagggcacaguucaaacauugugucucuguuuacaagugcuuauuccuaacagaaaaagaagccuugcugggugccagguuuugugcuucauguuuuauaggccuuaucaacacaagcccuuuuugauuuauaauggguuucugguuccucucauguauugcuguuaaaaacauuaaugcaaaaaugcauuuaaucuaccuaccauagugagcacuguugcuuugccuagccuacccuaauggguucggagcguuuauaauagcuugcagcgagggaaaaucauuuaaaaugccugcuguauaguaguaaucuaaaguaauuuauugaauguuuugcuaaaagccuucaguaaguggcauggcagcauacaccuggaacagcaggaggcggaauuaggaggaucaggaguucagugggagcuuugguuacaagacaaguuugaggcaggucaggguugugugagacucuuuuuacaccagaguaaagcagaccuuuuccaagucaaaccuucaugaaaucaggacuuuguauuuccaucuccucaguaaguaugcucugggugucgcugugugucacugaggaagccuugaggaccacaaaggucguucucuuagcagcguauauuccugauggcuguuaggaaauauaggaguuaacgugaccuguucauggaugcaggacaugaugcucacgguugagacuggcugacucguuaccaugguaauggauaggccggcuauuccaucacacuagauugccuucuuuguauucaguuugucacacuccaaaccuuagcgacagcugauggcguggaaccucuccuuaaaagcuuugucuuagcggaaggcaagaagccaauacacuuaugaguucaugagcaacgcuuccaggaguguggaaggcguuuggaaaggcuagaagaggauggguauguaucuacauauagacugagccuaguucacaauucagucugcaucuaauuuucauugggaucccugcccaagccaggugcucaagcccgcccccuggaagcaguagcugcacucacuucaaccuccuauucugcccaggccgaggcaggggcagccuguguggcuggggaugguguaauucugccauugaggccggaggauuccaguuucagggugaaccuggacugccuagugagacccuguggagaaacagcacuuacuuguuuccaagauugccagagcacaaggaaggaaacgaagcuucuaggggucagagguucccgaacuccucuccguucagcugccggugcucucugucagguuacagugcuguaagcuugucucccuuugcuuuggugaguaaccaugcuugcguaaggcauucuugucuacccucucaagggagcuuuggacccaugacaggcuuucaaaaggaagggauggacagccagccugaugcaaaaaggaagucaugugaugaaggaaaaggaaauaaguuguggcuucucuaggucccuggucucacuuguuauuuggucacacaucgacacacccuuucuccagaccgacaguugguugccuacuugugcaggguguggcuuuuuuuuuguuguggaggacggaucgugagacccauaaaguagcaaaaugguugagugaacagaagauguugguacugguaacauuucuaguggguugccauccugaguuguuugcuguguucuuccggaaaggauagaguguauaacaaggcaugaggacagcuuaguuuguggaccugcaagggagcacggguagcccgggaagauugagcacaguguguuaccaccacugagaggggaggcagagguuguagagggucugccugcaugucaugugaccugccuuaaacauaguuuagaagacuggccacaugaaguuauguaccauagguguccacaaggugagaacgcaccucccuugcuuguaaauaguacugaggagaggaguuugugaggacaauggggagaguugguagaagucuaguuggcucuccuaagaaggcccuuuaauugaguagggacaugaaugacauuuuauucuacaugcauuucccuuggguucauuuuaaauagcacuccuccacacaaugggcaccuuagauuuacacuuuuaugguggcauauaugcagguguuuauuagcuauccccaaacuuuuuauuuuuauuuuguuuuauuuuuuguuuguuuuuugagacaggguuucucuguauaguccuggcuguucuggaacucacuuuguagaccaggcuggccuugaacucagaaauccaccugccucugccucccaagugcugggauuaaaggcggacgccaccacacccagcucuuuuuuuuuuuugcaaauuuuuuauuuauuagaguguauauguuaagucaugcuugguuccuuaacagcucucuuaaccagugacugccaaagcagacugauaauaaacaggucacgugaaugagguuuuucaagguugcucaggguucaagcguguguaccuacugaaaauuucuguauauuuuggaacuacuaguuuggaccauuucuaaaaacccauaauucaaauagagaaaggagccaggagacaguuugguuacuuggccagguaagaugcgcucauagcuacuggggaaagaucccuguuugggggcucucauguuaaucugugcuagucuuuagauuuuucucaauggauacaagcugcguaguuuuagaaaauagaaggaugaccuucuuagcuacuuaaccaugaauuaauucaacauuugcuaguuagugugugcuucugggccagggcuauggcagcaauaaaaaaaagauguaguccuugccuccucuuucuccaaaucuaauggaacguauacauuucucucucccuuaaggugcaaaaugaucuaauguuacagaguaauggaagccaguauucucccaaugagguaagcuuccugaggguuaauggcagcugagguauuccauggagaccaaacugaaccauuggucccagaguuggauagucugacuccgggauuaaagaguuaaugggacugucucuggggucucucgauaguugucacucacugucacaaaaucacuuggcucuauacaucacuaaagauuaauucugugagaaauggccuuugagaucuaggggugggaugucuuuauggaaaacggcagaugaucauucagaugacauuuccucaguugcuacccaagaugguucgaugcgcaguuucugcgugaugagcugcaugcucaguguuagccgugugucuccguguuacagaggcuccguuagacgugcucuuuggcgugccugcccgucugcagucagauguguccaaugagaggcagaucacggcuuugugucacugcaagaugauuuuguagugagcaaauaaagacuucaaugcaacaacaaaaagaauaccggaaaacauucuauugaccaccucuuagaguauuuacaaaaugucuuuuuuaaaaagccaagcugucauccaucacaaggcagccauagcaaaagcagagucauuuuauaacaaucacuaaccauacaaguccaucugcuucuucauuucccaauuguuuucucaccccacagauacgagagaacuccccuucagugucuccuacugcaaacaucacagcuccguuuggccugaagccucguucagguacguugaccucaguaacuaaaguaacuaaaaugauuucucuuuggccuuucaaacuuauucgugaguaauaugagcuuugccaguucuagucggcugggguccuggcaucagaauagcagcagcuuggugaggucgggugauaacguuaugcuauugugaggucugugcuuccaggacugggcagcucgcccucuucugaaucacagcaaagaaaaguggcaaagggcaauguaaguagggaaggaauacucccuuccagcuuuuaacccgugggaauaaaccggcuccgcuuuaccccaaagguuccuggugcccugaggagguacagggcagccugcaggcagaguccuccccaagacgaccccaguugcuuuccaggcaugguaagggcucugcauugacucacacaagagggugagcacuuuaaggcuuguaugagugguuaggagucggggaaacuucuuagaaaggaaaacaccuuacuuuuugaccuacuugguuguaguuuguguuaccauauugacaaaguuaauguuagcaaagugcaaaguuacuuuuaauuuuuuaaaaaagggccccagguagaaaaauacauuucuuuccacauuuccaguuuuggugcuaaaugccuucuuuugggaccuuguuuguuugugcuuuuuuguuccucucagacuuacuauauuuaccacgaaugcuuuuaaauaguucuuacaagggcccuggacacacacaagcacaccugguagaaaacacaggugaucuuggauuugaggcaaagcauuuugacaacaguaugagcguuacccauuucuggcuugaauaaacaucgcuaggggaaaaacagagaugauucguuuuauaggggagaugguuuguucuuggaagacauugauugaugggcacacguggccaaguguggagguguccuggccguuagaauagaauaagagaaaauaaacaguugggaaauggcuuuaguaugaucagaguuucuagaucuuuccugucuuguuuuuuucaguccuaggaauuaaacccaggcccuuacacgugucagggccgugcacuaccacugagcgguaucucuagcccuagagaauguuacagauaggaagggugaggaugagaucguagaaaacucaagugacuggcccccuaauguaaggaagugggcguauacagacaaaucugggguacaccucaauuaugcccauaauccgagcucuguucugggagaaauggaggucacugcuauuauaccccccugccucguggcuggcgacaguucucucgcaagccacuggacaguucugcagcauuucaaaaugucucauaacugaaaucaaaacgugagugagagucugcaaagauuaauagcccuuugaguguuagacuuuuacaauuaaguuguaaaauggauccacagacuuuuaaugcaucuauagagccuaaaccaagcuuaccaaguuagagauugccuugaaccugcaguguacaccauucagguucuguggagagaugaaaaagagaguauuuaguuacugucucaguucuguaaaagcauuaaaauacacaauuccucuauagucauuuuguuucuaaauaucagaugcauguauacauuuugaguguugucuaaugugacccaggaguucugggugaauugugcaauuaugucagcugacuaguuguuaaaagggguuggcaaaggguaucugugggccuuucugcuuuccgcugccugaaugaccaaguucuuuccuucugcugccaugacccaacagcacgcuaggcugcaggcucgcagaacuguuaagauuaaggcuauuaacugcaugcagagugugagccaguacuaacacucgguuuuuaucguucuuuuccuuccaugcgccaucucccauuccccuccugaacuguccauuugaauuuaaaccccacauaaugaaauccaccucauuuccauacgaaccucaugccacguguggaaugcugcggcccccuggguucccccugguccuugugcaacuguccaccuggcucucucgcucgucugcagacccagcccucauucucccuccuaucuccuucaacacacuuacacaggcacaaacaugggacaacucuagcuacaguguuccaucugaaggaaacagugacaaugguaggugcuuuguugucucuucuucgauguucauguaauaagccugugacuguacuccacaggccucuguguguaccuggagacaggauauauugaccugcauacuccauacucuggaaagccucugaggcaacgucuagacaagugcuugugaccucuugccuaacagcugaugaugugacaguugauuuaccucgaggguacugacucugggaggauuuuuucaauacucucuugucuaccuauuaugcuagggguuugguugguuugucugcucgucuacagagauugaaacucacgcauuucgguuaucuccacuugcuucugaccccauaguuaaugcucucagaguuuguuuuuuagaguguggguguggugcuucacuccuguaauggagaauguauaguuagaauacuugccgugaucucugguuaagauucaccuaaaauuuccauuuauuaaagaagaauacauauucuggcagacugaaucuacaagaaauauuaguacuuuauaguuguguaaaacagugggucucaaccaucuuaagguccugacccuuuaauacaguccaucauguuuugaugaccucccaaucauuaaauuauuuccauugcuaauucauaacuguaaucuuguuucuguuaugagucaucuuuguugucugccaguaagggacucgaguggaaagggauguccaacccucugaagggucacaacccacagcuugagcacugcaggucucaaaaauuuucacugaaaauagucaugauuuuuuuaaagagcaaucaugauacaaaauccccuccuuaugucauccugcuuuaaauucugagcaccgacaggaggaggaagagaaggaggaggaggaggguuagagagaauuuuucuuucuaagcuguucuuugguauaaaaccggaagaucaagcuaugaaaaagaaguguuucuguuuuaugaaauccuggcuacuauagguauaaugcucucuauuggaaauaaggcuauuaugaaagauucaugugugaguuauuuccugaggaguaauaucugaaaccagagggccauguuuuuuuguuuuuguuuuuuucaauccuggaaaggucuaaagacuuuuaacagcagaauuucuaugcugguauguggcugugauagagcucagauaggaggucuguauugcaggucuuaacugucaccugucagacaaaccauccuucauuggacaggugaggagcugaugugggcgguacugggccagucuucuuuuuauuaaaaauucugagauguccacagccaauaaccauuaugaacauuuaaaaacaaaauaacuuugcauuuauuacauggccuuuuuucccccuguguauaacaaaucaggagccuaaccacauuauaccacagcaguaauaaaaggauuguuuucauauuccucuggaucgggcaaccaugucagauguuucugaugguuuacauuuuuuucuuuauuugcaguuuguccauagugucacauaccuuuucagucccugcgcaugagacuuggccuugugacugcagugcuuccuaacucaguggaaaagcugaggaauguagcccacucacuguguuguccuuaacgcuuccauagaaacagacucuucuacucugugggcuuucuuggcauguccagaaaugcuuaucuccacaauuguguuguuuuuucauuaucugacaccacagcuguccagccuugcaaacaagauaccuuagauaaucaugacguuucauuauuaacuuggucaaacuuagaguauucaucucauugcccaucuuuguacacaaagauuucucuuuucauuuaaaucccuucuaacguucuguuccagauugagcucauuuuaaauucaccauugucuuuguaacauggucuucaaagagauuuuuaaaaaaagaaaaaaaugggggacaggcgggaaggaccuugaacaucuggagacccacaguuucugaaaucauucuucucagagggacagcaugacauggacguccaucuguggcgcugccugccccaccacagccuggggugccuucacuuccugagaacccauccucuuccccugcccuaauucuugugccuucguuuguggcuucgucuuccccuuucccauucacuuggaagucaaaagccaguccuggccucgcuugagguguuucugccuuuucauuccuggugaauuggugggcaccacucuagacuuacuuagaauugaucuuugugugacagugagugaggggacauccaucuccagccaguuuauaggcaucuugguuuccuuggugaugacagcguagcauugaggucuuauucuccccaguacaaaaguaaggaugccgagggcgugggagcuccucggggacucucagcucuggcuucagauuagaaugucugguccccauguucagagauaguaagugacagagccuaagcauuuaccucuuugucauuuauguguccgugguagacagagauacauuguuuaugugcacauugacaugugaguuaaauaaacugcucaagauaauggaagggcuauuucagcauuugaagggcaguaaagggaccugauuuacuuggugcuccagaaggaaauggaugaauucauuugccugauuucuaacuccuaagagucgcagucuaaagcuuauacuugucacgguaucccugccuugcauuugaaucuauuaaaaggcacucuaguccgcauucuuaacuuccaaggaagaggaagcuaaguuucaaagcccugugcuuccacagagaagcaaagugcauagguuuuguuuguuuguuuuuuugucucagugucaugguaagguucacuuaguguaugguuuagcacugugagcucucuuugcuuagcugaaaggugacacuuggagaauggguuuuguguucguguuucguaccccugcuaagugcuucccuaugcuaagcgugccucuaacauuacaaccagacagucuccacuguuguggaaccuaaauuuggaaguuaauguguucagaucuggagaguaauuugggauuuuuuuuuuuucugucagaggagaaauuaagaaaugaaucaccaggguaaggucauuucugcaaagaugaucuucagauccuuacuccugucuuuccugggagguuuugaaacacagguuucauuuacuccucaacaaacaugcgucucagcacacagcuuugugggaugcagaaagagccugcaacugggcucuugcagagcuauggauuuuaugggguaauacagaaugauaagugccaagagguacgcagcuaauuaucuuugggcauucacaggaaguagagauuaugccaguucagggauacagugaagagaccagagacuuucaaggauggaaagaucagcggaguccucuguaugcaugucucaaccuccucaauaggccauguuuagagauugucuccugcuaagugagcuacagccagcaggucuuauguccuguucucacuguuagugacgugccccuuaaucauuaaacagcucuugaaaugcaaugguagggaguuaacaccagucaggauaauucucauaggcaucaauucccugaagacuugauccagaaagaaguaagcuggcaggcuuauuagcugaaagaguuucuuuauuuucaaaccguucacgguaguuauaauuaauuauauaauuuuaguguauauacucauaugcuucucauuucuaaucacugcauguacauuugaaauauuuguuuuaaaauagaaaggacagcugagagaccuucaacgcuuggugauugcuugcuagucacagaaaucuaccccagugggcacuuuugcuuuuguaauuugcaaaggacuuuaaaauaaacaggcaugccaggaaauuaagagccagaccugaugguaucacucugauaucccucacgcugcucugcuaacauacaugcucgagugugugcaguuaccccagagauugcaggucacuuaacuuccucauauuuucauauucggaaugaaaucguccaauaaaaacauauugaaaguauuaagcaugccguauuagauaagauuuccccagaauaaagucaaaagggaaauggccuccaaagcaaacagcaaacuguuagaauagggucacggcgccccuuggugacaugugugugcacuaccaagcuccguccacauuccuugacuuuuuuugguaaauucaauuaacaucuuugugagaagagguugcuuuuggguuuuacauuguauuuucuuuuaguugcuggacuuccucuggcaggugcaguuugcucucucaggcuucuaauguccuuucuccaucacguuccucucagagcccagcugccccaucaccucacccuucuuuugcgagcuuugccuuuuucuguucuugcucugccuuuuuccauucuugcucugaccaaucuuacguccuguggacuuuggcuccuguggggccuuggugagagacuccugaguggacaagccuuuggcuuuuuuaaccagugaccuuuugguucacuuccauccugagacggggggcacaaccuccuuucuguggcuccggaaagccuugugcucaugcacucagccucauucuccgugaacuguaucagucaacgauggcauccaccucaucuuuccaggcaucuugguucuagaaucuuugaacccauguaaaaagaaaacuggaagacagagauggauacagccucacagugcuggguauuuaaucacucgaagcaugcaugggccuuuuccucaauguguuauacuugugagccauauuuacucuucaaagggugacaaacugaaccauuguaagaaauggccaaaugaacguuguagguccuuuguauucagcauuauuucuaugaccauggcuguaacugcugcagucgggcguccaucccucuuacuugggguggugguuucuuacauaggaguucuuugcacagauuguuuggaguggcuuuguccuaccaccaccuccuagccccaucuaaacaucucuacauagaaaaccagaccaucccacuccccaacagccuugugucuucaggcaaaaaaaaaaaaaaucucuaaaaagaaaaacuuaagacuucugcuaaaaugaacacacacacacccuccccuuuuugauacagggccucucugucuagcucugacuggcguaugauucaccaggguagucauuaacucacagagaucugucugcaucuguuuuccaagugcugggauaaaaggcgugugccucccugcccagcuacuaaaaucauucuuuacauguaaaacaucuuuauaagacuguaaauccacuuuuauuuaauuuucauuagcuuacaucugugggguguggcaucccacagauuuuguguccgcugcccuuugcaaagagauuguuugagaauuuggugcaaacuacgccaagguuucccugggccagaguuaucuuucccuagagcacucugguuuuguuugguuugccucugggaguccuuggauuguguuuuacucuauauaccuaagcacaucucuuaccuaaggagaauuuaguuucaucuccggcacacacaccuucaacguuacgaagagcugugcucucauuagcuacugagaccucccuuacaaccagcaaaaaaguccaugcaaacacagcccuccucauacacuugguuuuuagacauccuguuccuggcauggccccacaggugcaaagauggugcaaagccacacggagaauauauuuuaaucaucccaauugauguuaucaccuugaaguuuagagcauaugauuuuugcgaguuuuuuuuuucccccauuguucauuuguucuguccuguucuguacagugcuggguuuaacuuaaaaagagauuuauuuauuguuauuuuaugcauauggauguuuugucuaugugugugucuguuugccauguguaucccugguacccucagaagcuaaaagagaaggucagauccucuggaacuggaguuaaagauaauugugaaccaccauguaggugcugggaaucgaaccuggguccucuggaagagcagacauuguuuauaacugcugaccuaucuuucuauccccgagaguauguguuuucuuuauuccuuccgacaaagcaauguuuucagucacugcucuguaggaagccuaagauccucaagccaguggugauagaguccccucuaguccagccagcguuuuagacugucaccugcacucgagcugaauguuugaacaccuggccagugaugggacagaagucagaauauguaguucuacaauagcaucaauucuaacaucuuuuuauuugaucaaaauuacuuaauuuaaagaaagagaaaacauaugauuagaauaucgauuagaacagaagguaacacuggacaugaugacagaugacagcuuuugucugaguagugacagcauagucucaucuccacuccgaugagaccugucucucaauucaguuuauuuucagcucaaaccgaguucugcagugcacacaacccagaaggguaacucaggagaccugugucccuuagagcauucacagccaacucuugcuaugacucuggaauuucucugugagagugaaugauaaaacaaucuggaauaaguaaauaauuuaucugaaauuaggaauagcccugugugguaauacagauugguuucuuucuccauuucuauugaaguguuucuaagaccgcagagaaacuuggaaucuauagacccacaguuuacgauccggaggaagauggagcagaugagagaggagaaggagcugguggagcaacuccgagagguacuggggcguggccugugccugagcgcgaugcgcagaaucacgcagcgcucuguguguuggaaaagcuggccuggaggccucccuugcgcaccaucccaguuucaguucugcagcuucuaauucagacauuucaacacaaccguaucugucuuuauacagagcguuuuuuuuuuuuuuuaauacuugagauauuuaaugaaugugaguguuuuccagacauucacugugugucugggguaugcaugucgaugugugagagugagcauguaugugugugugaauaugcacauguauguggcggaaaagagauaacccgagguguuacguacauuuuugguuuugauucagggucucucucacucgccuggaccuuacugacuagauuaaucuggcuggcuagcaagucucaggauccccuagaauccacuugcccagcggcugggauuacaggcacacacugccaugucagacucucuggggucugcuaucaaacucgcauccuugcaaacacuuuccugacaaaaccaucaccccaucuccagacauucuuauguuuguccccucacugacaagagcacuuggguuuauacauacuugcagguguauuuaccaccguagcaaacuggcucuuucugcuucccauccccagagcaucgagaugaggcugaaggugacccuucaugaagaccugggggcggcacucauggauggugucguccucugccaccuggccaaccacguccguccgagaucugucgccagcauccauguccccucaccggcuguuguaaguacagauaaaggaaaauggcauagaaugagcucuguuuguacagaguuguugguuaaagaugccaguggggccuccaggaaccugacugccuggacccuuucuguuggaccucacccacacaaguagaagaacagagcaaagcaaggaagcagaauuuucacuaaaggaagacuauuuccaaacaagcaugagaaaggcagaaaaguaacugucucagguguggauuuuaaagaaguuacugaugaauguucuggguuaaaggccagagcacagagauuuggcccucacaaagggauauuuaaaccgugaggucucuucagaaggcugucugguugagggcuguuucuagguggacucucaugcuuuucuucucauagggucucacucuguguucacaagauagcccaaguuggcccugggcauguaaaucuccugccucaccuucucuguugcugguuggggucucuucucuuucuuguucguugaggauuuuacaguagcuuaugaagauagucaaauguauaaggcauccuuaauaaccuacccauuggggcaucacucagcugguucuucuccuuccuccccauccucuccuagggaucaaacccagggccuuugcucuccccccaccgcccccgagcuauguaucuuaguccugacccguguccuagauaccacagagcccguggcaggugaaagaacgcuaugggggcaguuugugauccugugugaaagacuagaggaaucagagacagccuugucuuugaagcccacguaggguuacauaaacaagagcagaaagaguuuauguaacagauugggugcauuagggaaagcuaaagagcuuaggggcuaagauuugagguuagauugagauuccagaucugugccuaaaagcuuugggcaaguugcauccuguguuuagcuugcuacgcccuucucugaaauagaccugcucuugaaaagaugaaaugagguacuggagagaugggacaccuaagcgugagccacugcuacugucuguguuuauauauagcagagccacucaucugaagggaccguuuggaccauguaaucagugcguccagugccacuugugugaagucccugcccucccugauccggggcucucacuagggcauuuuuuuuaucuuguuuuguuuccucaugacagcagaaggauuagcuaaugggcucaguuucucuucuauaauauuaauacugcuuuuuucuuucaaaaguuugaccaccuuuuuuuuuuuuuuuuuuuuuuuuuuuugccucagaaauaugaugguaggcaauguggcuucucuuugaaauauuucucuagcaacuuuaaugugggacagugaauucuaucauucaacucagugccacgaccuaaagauuuuauuuauuuauuuucuuacucauuuauuucccuaccccuucccuccucuuccucccucccccuccucccuccuuucuucccucccuccccuccccucccucccucccuuccuuccuuccuuccuuccuuccuuccuuccuuccuuccuuccuuccuucugacaggguuucucuauauagucuuugcugucuuggaacuugcuauguagaccagacugaccuugaacucagagagacccuccugccucugccuccagagugcugggauuaagagugugugcaaacacugucugauuagauuuguauguauuuuuuaaauucugcuuugggugugugcacauaagcacagguguaugaggaugcagaagaggacauugggccccccagaguggacuuguaggucuuauggggugcuaggaacugaacuuguauccucccuuagcugccaaccuugugugagcuguacagcaaacugucaauucuuuugcccaguguacaugagagguacuggguucccugaccuucaaauggaaugugcacugucaccuuggaaagugucaggagacaguaagaauuacaaacacuuacuauuauguuaaagcuucuaaaugaccagaaauuauccugugagcuucuugaagugguuuuguucucuugucugucucugucucugucucugucucugucucugucucugucucucucucucucucucucucucucucucucucugugugugugugggggggggcacacacuuguucugugggugugcagaggucagaggauaucuuuaagaaguuaguuggggcgaccuaagccacagcagcagcggucgccaucuugguccgagacccgccgaacuuaggaaauuagucugaacaggugagagggugcgccagagaaccugacagcuucuggaacaggcagaagcacagaggcgcugaggcagcacccugugugggccggggacagccggccaccuuccggaccggaggacaggugcccacccggcuggggaggcggccuaagccaaagcagcagcggucgccaucuuggucccgggacuccaaggaacuuaggaauuuagucugcuuaggugagagucuguaccaccugggaacugccaaagcaacacagugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaacugaaaagggagacauaacaacagauccugaagaaauccaaaacacaaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucuaauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggccggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauuaaaaaaaaaaugaaaaaaaaaaaaaaaaaaaaaaaaaaaaaaaaaaaagaaguuaguugguucucuucucccauugguguggguccuggacuugagcucaggucaccaggcauggcagugggugccuuuaccugcuaagccauccugucccccugccuuccacaguuccugcucugacccaugagaauuugguuucucucuauuuucccucauuacaaacccgucaccaguaagaacuacggugugucccaccggacccucuuucagcuccuuguuuccagcuacacuagaguuguggggcccaaggucauauauuuugguuucacuguugugaguucagcaccagaugcagcaugggaaagaacagacagccaguacggcucucaguuccaucagcagugcugaggguaccuguccugacuguguuacugcaagcauuaagugcucuggucuuucauuucacgagccccauagugaggggguuuguuuuuguuuuuuguaauguggauagauagagucauugcuauucucaguggacuaaaaauuaucuuugggggauggggaaaauuuguuucuucaguuuuucagauuguauuucaggcuguaagcaaaacacuggcaucccaauugaucuaauuaauaugaccauauuaauauggucacuuccugcuauuaacaugauaagucuuuacuauuccuauuauuuaucaucaucaucauccccauuauuaaacacaguuuuucccuuggaaaauuugggucagucauacuucuugcuuuccucuuuaaggaaaguaauggugguauauuaaaaaauuggcaaaaguguuuaaaauuuacuauagaagaauuuuccuacaugaaucaagugggccuguuacccaucuacccuucccaggucacuugaggugagggucugugcagcaguuggaagcuuugggucaaaucuacaacuuuuagugcuuuuugccuuuuuguuugugucuuucuaauuaaacuuuuuuuugugugugugaggagacaauuagccucauggauuuuaauuuuuguaucgaaaaacauuuguuguuggagaaagguguuggcuaugguauauuuuuaggugaacugaaacggcuuaucaaacuguaucgucgcacagaacucugaguuuguuuuugugugcacucacacagauacuuaggcauaugagaagaaauccuagcauacauauauguuagcauaucaacauuacaugcuuguguguauuuaaaguuaucuagcuaauaugcauauguaaauaccugugcaugcacacaccucaagaauauuaagaauauuaaguuuuugccucuagauggcuguuucuagauagcuuuuuaucuuaauaauauguugcuucuguauguuucccuuuuuagccuaaacucagcauggccaagugcaggaggaacguggaaaacuucuuggaagcgugcaggaaacuuggcguucccgagguaacaccagacuuaguucaaauggccacguuuugauaaaaaacgucagccuagcuguuugaaccaugaauagacaucuuuuuguuuguuuguuuguuuugcaucuuuuuuuuuucaguuucaagagauaccuucaaauaaauaaccuacauuuuuuuuuuuaaacugaaguugcucuauugcaguuuaacuaaaauggucuuacauaucuuuucaauucuaagaaaaagguggaaaaucauuuaguguuagaaaaugugaaauuccaaauuggaaagaaaaagcucuaauauuggugaauuacagaguagcuaagagaagcaggccuuccuuagcccuggcugcuuugcaaaguccauuaauugcuggauuucauucccaguauuuuaagauaugaaucaaacuaauguucauuaaaaauccagugauuguuaucaucggugaugaagaugcauaggccuguguagggugcuaacuacugacauuuucguuuuauccuguagucuacucucagcccguuuggcaguccucuguagccugccuaaugauacaguuuaccuuuucccuguccccggcucagucccacuggccuccuugaauggguacuuggagcguucagagacuucccuauuuaauuuaagauaaaacgacuccaggauuuaggcagcagcggcaccaauuaacaugaucuuugucacaauggugaacagaaaugagaaguuacuuuucuuauggcuucuuuguuuccuuaaugauaaagauaaaguaacuuaaaaagcaaacaguuaaacaaacaaauaaaaagccaaaacaaacaaacaaacaaaccucuucugagagacucugagcucaugaaucacauuucaaaguauacuacacaggcuauuaaaguccacccagcagcccuuucuuccuacccauccccuauuuuucuuuuuuuuuucccccuccuucuuauuuuagcuuaggggacgguuaggauuccaguguuauuugagaaaagggagacuauauuuaaaguguucuuacaucaagcugugucgaugaagagaaauuuaccaauucuguuuuugaaaaacaaaaccuaaucuuuauauacuggccacaaugucucggcgaccacuucugcuuucaacuguguucaucugugcgucugucuugcguguguguguuugaauauugcacaaacaucuuggcuucagauauuugugaacacacagcuuuucugauaauuugauucuaccgugggcucgugggggcucccacugugaaucagaaacccuucaagccaauuucaugugguaaauuacuugugucugcacuggaaagcccucaugaauuaugaaggagcguccuugucacugucaugacuggcuuacucugggaaaaaauggaaugcgagugcccuuacucacuuccugugagaaaaagaaggaaggaagggaaauuagauuaccauaaaaagagcaaaaaaucagaauuucugaguuaugccccuucuguggugcuucuaacaguguagguaacuuauaauucucaagaaggguaaaagcaagugaguaacacagaaucccaugucccaguuagcuauauacuuaguuauuuuuaauucagugagugguuuucagcaaggaaggcaucaugcaugaguggaaaaccagaacuccccgauuggaagguaguccacaagucuuccugcucgacucacaacagaacauuuucaucucacaaauauaugaggcauuguuucccuccaggggaugacaugaagcccaucucuucucuaagauugcauucguucuguuccuugggagaaucacgguuuggaacuauagccuaaagucagcguaaaccguuuuaaguuuaucagguacucagggacaugugcaggagcugagcagauucagcuaaaccauugcaugcaaaguccaucgacgggcugggaacaguuuuugaaguuguucuuacuauaauagcuucagaagucuccaccaguacaguccuugauauuugccccgaaguugggcaguguuugugaaaccuuuauggaugguuaaacaguugauccucagaaccaaguuguaggcuguugauuaucuaggacauaugucugugugggguaugggaaggcagccuuucaacucacuagguggauagcagaggguguggcacguuaagcccaucccugacaguagccugggaagaguagcucuggacuggcucucaugcacacauggcuucuuugguagacucgauuccaaacuguagacaauaucagguaacaaagcaguacccuguguggggcuaaggcuacaggucguauuugcagcuaucuuugguauccgugcaagcaucacuuuagucuugaggacaaugccuuaugggcuccuagaucuuucacaguagagucuuuguaucacccaagcauccgaaucuggugacgucuuaggcccacgaagccauguauaccucugagcuuccuuuguuguuucugagucagcuugguccuccugccuucugguuugcauguaccaggcucccuguuagcuaucaucccacauuuuggcuacuuuaggaauauuacugguagucucucaggcugagaggagucuuugaucgaugaagaaucaaccaccuaugucauacaguagauauugcuguggcucagugagaauguuuucacaagguuuaaaauaagcuagccauggccucaggacuugguaggaauggucuuucuuuuaaccggguaccuguuuagaauggcgggagaguuguaucuugggucagaaagguacuuuacuuuagaaaguugggauucugaccagcuagcuguggguguggacgcauuaucaggcacuggcucuucuugccuuguuggcaacccggucaugucagaaggaugcgaggccacgaguuuucauucccaauccacacggacaggcuauuggauggaucucaauuucugcaccaaguagaguuaagaagacauugugaauuacauucagagguuuccuccuuuucagcaucuuuuaguaauuggacuugaguuuuguagugagguuuguuuuuuuuuaacugaaaguaauauuuagaaaagcaguccuguaucucacguggugugaagggucaggagguuccacagauguaauaacugaucagaguuuuguuaugggaaauugaaacuauaguuuuguuucugcuuuuaggagaaaugagugucuuauuuucuucaaguuugucucauuugcccacagaucagugacuuuaguuaucacuuuaaauucacaucaauaguucucuggagcauggaaaugagauucuugacaugauauuuauuuuucuucuggagccucauuggauagcucuguaguuggaggaggaaaugcgagcuggcagguggauuauuuuacugauuuuuaaguucaugcuuuuggaagacccuaucuaccauuuaaaaaugcucaucuucuuuuaaagauuuguuuuucucuuuaauugugagcguguaugugggucugcucgaagguuccguguaugugaguacaguugcccuuuaaggagagaagaggguaucagaaccccuagagcuggcaguaaaggccagcucuccauucccauuauuuuuugcuaaggcccauacccuugcucaucugagcauucuuucucuggugugugcuuuguucuugccucuggucaguagguagccuuccaaccugucuccaugcauagcugaaaauaaaucaucuuaaaaacagcuuuuuauuuuuauuucauuuuaaauauaaggacauuguauuuuauuucagguauauacauuuaguguuuuguuuuuguuuuuguuuuuguuuuuguuuuuagaagauagcuggccaccaguuuuuguuguuguuggcagugacuuaagcauagaggaaaguuuuacaauagagacccaauuucuaauaacagucaaauugcauauguagauaaauuagcuagacaauauuagagcugcccucuaaauccauaagaucgcugguucuuguauauuuggagagaucuagaaauccuccuaucugccucuucaucccaacagacuguauguaccuggucacugagguugggccuuacaguuuuagaaugauuaucagcauaccguucugugauauuuccaauaguaauaugagcauguugacuuuugaaguucaauuacauuuaaguaagcacauuaccaucuucuaaguagaccgucuaccuggauacgacuagcucuuagaaugcagacucugcggcaugagucgugucccagcagaguuuucguugcugugauaaacacugugaccaaaagcauccuggggaggaagggguuugcuccauccuacagcucccaguauuauuuccauugaugcuucguaacuguaauguugccacuguucugagucauaguguaaauaccuguguuuuccaggggucuuaggugacuccuaugaaaagguuguuugacccccaagggguuaugacccacagguugagaaccacugcugugaaggaacacugcuuacuggcuugcuccgccucuucucuacuaugucacaggcccaugucuccaaggauaauaccauucacaguggacugggccccaauauaucaaucaacagucaagaaaaugccccacagacaugcccacagacauccgcacagacacacccacaggcaagucggauggcggcaauuccuccauugaaguuccuucugcccaaguagacuuagaagccacccuaaguccacccaugucaccuugacacagaagcaugugaccuucccuugccccucaaaucucaugcuaauaucacaggauaaaacauagaacaacuuuaaaacucccacagucuuuaaaauuuuucaacacuuugugacaggcauggugguacaugcauuuaaucccagcacuuggcagccagaagccugcauauauuugaguuuggucuguauaacaaguuccaggccagccagggcuauauagauugaucccgucucaaaacaaaacaaaaaccccaaacuaaagcaacagcaaaauaaaaaaaaaacaaaaaaaacaaaaaacaaaauuuacuuuaaaagugaaaaaaacaaaacaaaacaaaaccaaagucguuuaccgguaggaucuuguaaaaucugaaguaaguuauaugcauuuuuuuuuuauuuuuuaaagggaaaacuggggcacaguuacaauaaggucaaugaacaaacccccaaaucuaucacuacugaaguaguguccaauaugggacucaccuacgaucuucuggucuccaaggcucaguagccacacuucucuggcucugcccuuuaugguguauacaguguguccugggcucaggguggcuucauuccacacuugucauuguccuugucagucaucuugugguccccgcaccgcugauaucccaggguuuccacugcagcugagguugcaccuucgcuaguggccucccacgauggcaggccucaacuucuuuccaugacucuucaaucuuagaguugucacugucacugaggcuacaugaucacccagggacucuucuggucucuucagggagacccugccccugccacacagugucaacccucagcugcucuccaugacaccuucaugccuucaaaaccaggaccauacaggagauucuuccacaucauuuaccaaguucugcugccaaaccggugugcagccuuggccccuggacugcaccacaguuuccgugugcugacccugagccagcacuucccagaagaccucccgacugcggugaagucaaucauagaugauucuucaaucccagcugacuagcauccguugucccaauagagcacauuuuuacuucaguaagacuaggaucuuguugauugcagcugaugagacaccacagauuuuuaauuugaaauaccacaggaucagcccugcuagucuuugagggaaucccagacuuccuucugcaucauccuucaggccuccaucgucaacaaaguucuuagcuucaucuuccacguccccacaguagguuauugaacucugagcacucaguggcuuuucuaaccaaagcuucaaaacccucuaccuuccucccucaaaacaacccaguguauauaauccucaugguuagggaagucacagccaaccuucucucucugguaccaguuucuguccuaguuuccuuucugcugccgcaauaaacgcuguuggauugcuaugaagaggcaccgugaccaaggcaacucuuacaagggaaagcguuuauuugggcucacuuacaguuucagagauuuagugcaucacaguggagaagaugauagcauucaggcaagcagggcgcuagagaaguagucgagagcugcaauccugaucagcaggcacagaaagagacagagagacaaagaaacagauugacagcaacaacugaccaguacgauauuuugucagauuagagagaguccuucacagccacggaagugcagaaagccuuugccaacagcucagcagacagacauuaauagccagaauauggagagaacgcgaccaacaauagaacgcuaaaggagugagaaguuccaugaaggaguaggcacgugaguggaggaggaggucauucucacagguacagguggcuagcagauaccuggaagggacuuuuaaaacaaaaccaucacugucagaauagccgucauuaagaaaagagccaaaugagcaaagaccccagugaggguggaaauggcggugggagucaggauggcagcuccucagaagccuggaaaauguccucaugacccagcuugaaggaacccaggccaacauuccacagagauccccauacaccggcgggagcaccagcauuccacagagagacucguacaccagugggggcacuguaggcuccaguaggcaagcuuggggucagccuaggcacccaucagagacggucggugaggaaaaugugaagaaucugcaccaugcucuuugccuucagcgacagaguagaacaauuugauguuguugugcaggaaaauggauggaacuggugauugucauuucauaaauaagccagacucagagugacagauacaugcugcuuccuguacacagaagcuggaugaugaugaugauggugguggugguggugaugaugaugauguaaauguggaaguagauggggcaggcacuuuggguggaagaaggggacuagcuggaagaguaaauauaaccaaaguccauauuacacaacacacacacacacacaucacaucacaucacaucacaucacaucacaucacaucacaucagcuaacauacaguaaaagaacacucaugaauaauuuagcugguggugcuggcucaggaggcagaggcaggcagagagcucugugguuuccagaccuaucuaguauacauaaugagccuacgauccacaguaagacccugccucaaaggaaaaaagauaucacuuuuuuuuuuuuuuuaaagacaggcagacauccagauugucuaugacaaguaggccuuuugccagaucugucucucuucugugagggagcccauccuguuuggagagucugagucaauccuugcuagcaauuucagucacacacuuguguuuaaucuaagcuuauuucuuaggcucugcugguugugaguuuuuuuucucugccuccuauagugggaaauuaaaucaacauuugacucaaaggaguucugagugaauuaacuguuuugcaaauguuuucagucauuacgaguauuguguaaaaaaaaaaaaaaaaaaaaaaaaaagagggcguguagcuucugcaaauccccugcuuuagcguuuucugauuuaauucucaaagauaaaaaaguauuauaaccccagaauuuccuauuuaaugcuaguuuggggaaaguacaacaggucaggaaaacuccaguucucucagggauuuccuucaugguuagcaucacuuugagggcuggagcuacagcccucauggauacaugcugugggacugaguuagagaccaggucuuagauggcugcagcagcccaccacguuccauagucauuugccucaaaaccagacuuaguuaguccugauuguuuuguuuuuguuuuucuuccuuagagauuauaauuuaacuuaaacgaccguaaucugagacucuggguuuaucugcuuuaauuaagccuagcuucuaugacguaguaggauuguuucuucaaugaaagggacggucugagcccuuuacuuccccagaaguagacuucugagagugcccaccucaccugaagaaauacccccccaaacugcaaggcagucugagugcugcagugauacuacagagcugacugcugguguuccuugguguucuugcuuggcuuuuguuuuguugacagucuuguuacauaucccuggcuggccccuacauaagucagugucaccacccuuggcaaaguggcuugcuucugccauggaaauagccggagaaagucacauuucaguuuguguuuaugucucuuaugucugcuuuucuuagauuugacuggucaagcacagcauuguacuagagcguucuuccugcaguagaaaccuucucugugggaaggagcuauuucccaucuauuaauccuuggccagcaucugguccccaggaagauccagguuacuuguggcuguuuuaauucuuggguggucucuuuaacagugguaucuugguucucugagaucuacugugaaaaugugugagauuggcuagauuuaacaugauuuguuaaucuuaaaauaucucuuguuggugcuggagagauggucuauugguuaagagcacuaacugcucuuuaggagagccugaguucuguucccaggacccaagccacuagcuucuacuccaaggcauccacuacccucuucuggugugugugugugugugugugugugugugugugugugugugugugagagagagagagagagagagagagagagagagagagagagagggagagagagagagaggcaaggagggagagagagagcuugcacauauaaaucuuuaaauuauccuaccaucauaaaggauuuccauuaucaucagcccaccugguauuuuaccugaggguaucaggcugaacccagaggauacaggcaacaugagcccuuggacucagaguagccuuucauuugagauugcuguacuuaacaaggaaguuacaauaaaaagcuaauaccccagcaaaauauuuaaaaguauauauacauauaauaugcauuuuaaaugcuuugcucacuuggaaauuguauuugugaaauaugucacagauauugucaaucuuuaaguugaaagcaaaauacaacuuaucuuucuuacuggcauaucaguuauaauuccuauuaauuuugaacuccaugacuuaaaauccugguucagacuuggcaguaguacauaccuuuuaaucccaguucucaaggcagaggcaggcagaucucugugaguucaaggccagcuuggucuacauaguaaguuccaggccaccuccugguuugcaaacucagugcauauggaagcugaauccugauagcagcaggcugugagggcugcccagaaaucucaacagccaauuaugacacauaaauuccacauaaguagagauaaaacaugggagcagaggcauccugcugucuuugaagaguagugaagggauuuagauaauaaccuauuaugugccaggcuuuccuacugcacaucucagaagccuccuuuagacucuucuguuauaucaucccagggccccgaaggcaaguuuggaggcucuugaauuugaggccauucugaacuauaccaugaagcccugacuccagaagaaaagaaaagaagagaaaagaaaagaaaaaagaaaggaaaagagaaaagaaaagaggauuggagauucaacuuuagauuuuguauuuuucccuuaguaauguuuaagcucuaggugugaugaaugaaaagcucacacuuuugugccacugaugugcacauaaugccacuuggagcacauaaggccacuugaauauuaagacuguuccaauucaagagcagugugcacauugcacagccugcggugguggggugugaugguggauggagguuccuguccaguuuacauagggcucacugggggcucuacuuuugucauggacuuaagaacuugaaguaaggguugacuccugcuauuugcuaguaagcagaaaugugugcuucuuuccggugcuucuuccgugugguguuaauuguaugcacucucuuucuguucuaauggcugcccucggauuaggccgaccugugcucuccguaugacauccugcaguuggauuuucgucacauucgaaagacuguugacacucugcuggcccucggggagaaacccccacagucaacuucugcccuccgcuccagggaccuuauaggcuucugucuuauccauguucuccuuauaguacuggucuauaucgcuuaccgcuggaaugcucugucugccuaacuccugcaugcgcauccaaacgcucugcucuggcauccugguccagcccagcuccuccccccauuggagccuuugccuugcagacucucccaucccugucaucucuucaguuagcugucgaguuuugaaacugaacauuuauaagccagauuuuuccugaagcacaaacuuuguagaauacaguucccacuggguaauuuuuugcauuuaacuaaaagcgacagcgacagcgacaaagccugucagugcauaccucauacuccuucacacucguggugugggcagcgaugcuccuguagguccugcucucucccaugagccucugcucugugcaggagguaaggagaaccaggacaggaacagggugggguuagcauacaggagucuugauacuugauucugguccuaauucaggacuggcaguugaucuguagagggguugccuugcagagaaaagccagcauuugggcucagucuaauuuauaaacaucucuaaugguaccauugcugaccaagcugagaagucguaucuggagaaugacugcuuugcuggcugguuaguuggaguccucccuguuugcugcaaggggcuugugaagggcacccaggaggauugcagccaauguccaccagagcaugcccucugugcccucugcaggccuaaucuggggaagugccuuccuguuagagcgccaccugguggaucugcuuagcccgcuuuuccuuuuuauuaggugguguucugaagcugagaaaaggguuuuauagaagggauuucuauuuuugcauaaugugacggggucgcuuuacuuucuugguauauugaauaacugcagacccagaaugugaugcauuugacucuucaguuucaaauaagucuauggauccuggaacacucuuagcaccaggggccuuggguuacuauagcagcagaugauaagaucgcucuuauuuuagaugaauguuuuuccccauuuacuuugaauguccauuuggccuuugauuuuuaguaauauuaaugauccaacuguuuauuuuuaaguccguuuuuaaaggcuugcguaucggccucucagcuuuuggggcaaagugcuucuuuuugugguuaaaggaagaaauguuagacucuaaucauguuggcccauaucuugcugagucucuggaagccucuuuacaaugugagaaggcccugcugcaagcuccagccacauugucggcuuccuuuuauauccuucuugccgaacacugcuucucguguugggaagguggugguguuaaugccgucaagauaaauguccaguuugcugagauaugaacguuccucagauauggcugcuaugaagauuaucauauuuuucugaacauauucaugagaacaggggagaugagauucugagaugccuccauacuugaaggguuauauuuauagaaucuuugcugcuaaaucagauaugauuuuaaaacaaaaaacagaaagcauucuuuaugccauaagauguuagauugucugagccucuuccucccagcauuguguugauggugaauacaggguucgugaugugaguugugucugaaagccacagaguuaugagucgucuuuggugcuaucuuguacuuuucuguaacaauaaaaucccuuuguacagugucuggugaccacccugagccguaaauugcuuaauaaacacaauugggugauuaauccaagcuuuuuauuuuuuucuuggccuguuggugcauuuauuccugggugcccagaaugauucuuggcauuucuacccagcucugccaugcauggggacuuucuuucaguguuugccacaguuuguuuguuuccaucuucuuaauggugggcaaaaggagaauugagaaaacgugcuaguuugcuggcucaaggaaaaaaaauagcaucaauaaacaucaagugaguaaaacagucccaugagauuagauugaucuucaaugguagcuucccgaauauuucuccucuggcaucccaaggaugcccuggcuaugcuuuucaucuuccauguccuuaauuuacaucgaaugugcugcucuccguggggguugcugugugauauuuuucauuaucuaguauggucacucccagagcauaaucaacucaacccuucaggcaccacuucgagugggucauuuugcuuauuguaagcaaaccguuaauuucugguuggaacacugggccucucuguggugcuccuccgcaguuccagacagcagcucacaagcuuaugggauaccggccauugccacacagcuggggacaccugacuaaucuuccuucagggauucaguugugugauuugucccgcauaccagggccccaucuucuuuuaagaaagaguguuuuuaaaguauuuccuucaaauacgugauaaagagaaacagcuguuuacauuuccauuuugcaguagccauuugugagguaucccuucuacuccugcaauggguagaaaauguuccacguagggugagaauuuccaaaauguauaugaccgucaauuuucauggcuccuucaggauuucaggcccaaaccacuucauuguccuuaacacuacaaaaaggggaccaguaaaaaaaaaaaaaaaagaaaaaaaaaaaagaaaaaaauccuuguugaaucccaagcaggucaacugagugggguuuuuaaauacacuuaguaucacaaugcuauuuguauuguuuaguuaucuucugaauucacaucagucccaguaugaguuaaaauuuuaggagucugaggcagguaaaguguuuauaguuuagguaaaaacguuugggugcugagaagugcacccagggccuuggcuuugugucuccaucuccugaagaauaauuuaauauaaucaucuuucacgggcuuugguuuuaaaggcuagguuugagacuucaaaauuaccuuucaacaggcaacccuuuggguaggggguccgugcaaucuacuuuccuuccugcccuuggcuuuuccagcaguguuguucauacuugguucauucaguuauuccucauguauugaacgugcgcuguguacuggcccuaugggaggugcugcagauaaaauaguguucaagauccagguccccauccuccgaaaguuuguaguccagaccaggugucagcauacuuuaugauuuuuaggaugauggucucuguugcaaccaaccagcuugucauuaaagcacggaugccaccauacaggauauaugaaccagggagcuggucugagugccaauaaaacuuuauucacaaagaauagaggaggaaucggacuggcuugaagguccuaguuuguagacccucaaccaaauggcuucuuagaaagcaaagaggguuuccuugagaagggccugagaugggucaauuaccgaauucugugaaacacauagaaagagggcguggcauucaugaggguccaugcagauccccgaagcaguaauaucugcacuaagauuagagauguguaagcuaggcgugaguggcaaggcagugggaggaaggggcuggcgaguggccuggcugcgauaugaagaauaguggaagaauuagcaggagauugacccugggggcagagcuagaccuuugcauucauaugcauuaagauaacacacaguuaagcuccacacaauucagucacagaauauuuuauuuaaaaaaaaaaaaaaaaaaaaaaggcugaaccaagggaaaugagcuggugugaaggacuuugucguagaccaguggcuccaguggcuggccuagaaguagggaaggcuccauauaaccaucauaaaaaguuucagggagagccgggcgugguggcgcacgccuuuaaucccagcacucgggagucggaggcagaggcaggcagauuucugaguuugaggccagccuggucuacagagugaguuccaggacagccagggcuacacagagaaacccugucucgaaaaaaaaaaaguuucagggagagaagagcccgugugacaagcaguccagccuuuucccccacaguuagcauuauuuuucuauggcuggccugccuuuccuaauccuauuugcuauggcucagaagagugucagugggagagccuaauggaacccaccacugggggaguagccgaaagcaucuacuguggaaaacguucaguguuauugauaagcaggauaauauuuaagauuucaucguguuuaaaaaaaaaaaaauaacagcacaggaucccuguagauauacugcaugcccucugucacauuuucaacauguccucugauauccugugacagcuuuaguucuccugagguggcaucuggccugcuuggcucuuggaagcccuugcccuucugugcuguuuauggccccauuggaaacccacagcaacuccagucccacccaacuuccgagcccgcuuuggggagaugcugggacacaacuguugugauggaaaguggccuguguccauaagucgguguccccugcuccccauuucuccaggaucucuguguucaaccuuucaaacagcagaguugcagauccauuccaggccuguugcggaaugccgugacuguuuuaucuuuauagggcuucuggccuucuaggcuaguuuucuuagaugacgccaagccuucaacaugagcugaggccaucucuggaugggcguggguagaaagaaaaaggaaggcuugagggguauguuucugucuguguuuauuggugaucccugacuuagugauauucaauuaggguuuuccaugcuuaagauggugcccuucugaaaaaaccacuuucuuuuuucucuuucaggauaggacucaauaaacugcaugagcuauugagcacugcauagaauauauauuuuauauaaguauagaauaagacuuguauuagacaguuuuccccaauggugggcucauguaaguguccugagcaugugugugguagaugcugggcuaggcuaugauguaaguuagguugagaaucaaaugucuugccacagccuuaggcaaagcuauuguggaacucacuuaccaagugagauagcauccuggagcuaaggcaggcuucagacuccugauccucuggacuccaccuccugcauucuggauugcaagaagcgugcccuaccaccuuucuguucacggagugauugcucagaauucugguugaguuuguaucacacaaaaaguuuuguaacuugacgcaaauacaguuugcagacauuuuuuuuuguuuuucuuuucauuagguauuuuuauuuuucacuguucacauggacaccucacaucuuucaguuuacaauguuuucaucuuuucuuuguaguuuguaaaugcuucuuuacuggccuagagagguggcucaguggguaagauugcucuuccagacaugggucagaucacauagauccagggaauccaacacccucuggcauccaugcacaugcacacacauguagcacauauaaauccaugcgugcauacauacacguaauaagugaauaaaucuuuaaguacuuacugguuuagaaaauuccuccaaacccauuuguuaaagaaaauauuaaauaucuuuuuacucaaagccauuuagaguuuuuuuuuaaaaaauuuaaaaauaauuuuaacauaugauacaaaauauugccugacugacucucuucuaauuuaauaccagauaccagaaucuuaucuguauuaaguguuuauaauuuccuacugggucagagcuaaaguugggugcuggggcaauuaaaaagaauagggaggaccugccccugccccuuuaacuagcugugauagaguaagaacagagccaagagauguccugaccagugcagauggugacagaaaaggaugggacugucauccuguuacagaugccccuugccaugcccccugggucaccaucccuccaaccuggcucaugacucucucucaacuucagcucuacccuuucaacuuggacauuuggccguuagacggaccagcuguguaaacguacaugguuaccuaacacacgacagagcagaucauccuguuugacuuuuccuagaagcaugaaggcaugguaaaaguauguugcccuguguggcccuuuccugaggccugggaccaagccuuucuuauucaguaaaggcgugugaaugagaagguguugggggggggggggagacagagagagagagagacagagaagauggcgacacucuggcccuuuugggaacgugcaacaaguuucuggagauagcacggcaugccuuugaaguucuuuugcucacagugccugugucuauggagauuugugggaaaucuguggccagacauuggcaggaaagucugacucuucaaguuacacaaaaggaagccaucuuguucucagguuuuagcuugaugcugacgaacaccccuccuacucccccccccccccccccacacacacacacaacagcacucagugcagaucccauguaaacucuguuaggcuuacuaaagaaacuccauugugaaggacuacaugccuggaccuagaggacauucuuaaguuaaacaagccagguacaggaaaacaaauaguacaugaucucacuuauagggugacugagagaaagaagagagaggaggaggaggggaagaaggaaagagagggguaggagagagggggagagagggaggggagaguauggccacagacaaggaccaagugacaaagguggaaaugucuuuugauguuauuuuguaaccuccauguggcauaggaaagaugguucacacaaaggggcucagggucauuuuccccgagcggcauguguuaggcauuucccauaguuacgaguagaacaugagaaaguagugugcccuguaugucuuugcccguuuuauaaaagaaucuuaaaagagaaauuguugggagcugugcuaaggugccuuauauagaggcuggagagagagcguggugccuaagagcaugcaccucuguagcacagggacccaaauucaguuccucucaccacaucaggccugugacuacacagcugccugugacuccagcuccucuucuggccuccauagacaaccguacucggaugcacaaacuaccacgcagacacauggacacgcacagguuaaaaauggaaacacaaacaaaaaaauuggggagcuagagagguaguuuggugguuaagagcacuuaacuaccauuuuagagguggguuugguucccagcaccaacgugguggcuuacaacucuggaacuccaguuuugggauauucacugccucuucagaccuguaggcaccaugccuaugaugauagacauacauucagccaaaacacccaugcucauaaaauaaaguguuuuuuaaaagacccuuaaagauaaaggacuucuuacauaaggacugugucuaaaccacaaggagagcagugacccagcacauacgcacuugggaaacucacaauguaaaaugacuuaaaccaaggcuggcagacauuauaaccaucuguagucuguguaagugaguauccgggcuccuuuaaaacaugagagguuauuugcaguguugcucaccaaggauggaaaauacuauuuucuugggggugugguuuugucucagcgucccucaguucuguagugaaaagcuucuuacauguuuagagcaaauacagauuuggaugcuauuaaggaccuuucuggagcaaccugcccgcgugagaagucauauucucugcccacccaggaaaggcuucagcaguggugugguaucaggggaagaagcccagguggagggaagcaagcagcacaguggugcacaaccgagcucccaucagugauguagcaaggguuuaccaucaacgggcccauuguccgaaagcugaucgucuccucuucuuccuccuaggaaaagcucugccugccucaucacauccuugaagagaaaggccuggucaaagugggcacgacuguucaggcacuguuggaugucaccgucacaaaagcucuauucacaugagaccaagcccuuuccucugggugggcucagccucuucccagagcagggacucuggacucugcuccuggcaccuguaccugcuccccaacucaccucccugccaggucccggaggaggaacugcacuggcgugguuucagccuaagggaggacucaggaccuuuuagaguuggccugcagguuucagguugggcagguguuaccugacagcgggucagggagcuggcggagaacugaguagcagcacaucauugccuuucaauccccuucaucccuuccacacucaccaaccgccauuaccaaaugccaagcacaaccauuucacagugagucgcgugcgucuguuuuaucaaaaccaaacuccuugcagaaccaguagggggagggggaugcaaucagguuucuuuuuuuugccaccaaaauuuuucaagauguuucuugagaccauugccuuucugaaaaacuauuuucaacauacaaaaauauuuauauaaauguuauuuauuagcgagccauuauucauccuuuggaugcaaauuguaaauuaggaaacuauuuuauuacugcuuuuuugugguuaaacaauuuauuuuaauauuauaaauacugaguuauuuuuugagccucuuuggcauguaggaguuccgggucuuggugugcauucuguaguauauaugauucaggaaagaaaaauuaagcaagaaacacgugcuucuucuguggcagacagagagagcuguuuucugagagguguuauccaccuuuugguuuguggaacaucguucuuauuuauauuucugcauuccauccaguuuccuacauuccagcagcccucuugucccccaauauaauaaacugacugaaaucaagagagcaccccaaaguuauuuguaaauaguuaauguggaaaaaaaaagacauauuaaacuugaagauaaaaugugaaguuuuuuuuuuucuggauucauguuucuuucgcuaugcacaaaacauucacauuuuaacacagagaagugggaaguguucagauaugucuugaaguauaauuuuugcacuguacuuuaugucauugaggagcaucuaggaccagagguagauguugaagaaagggaugaaaacauggagcagguugaaguugaccaucaagcuacaagggccguaagagcucaagucaggaagccaacauggacguacaacugcugguguucaaagaacaagagaugccaaaauguagacauacucguuuuuauuauuaucaagcuggugaauuuuuuuaagagucuggacuuggaagggucauggugucugguaggaaacuugggaagugugcagcucacagggcagggccccuggugggcagcuaugugcacagcgaggcagacugagagaggguuaaguaaguggaguguguuagcagcuaguagggggcaggggcaagcacauuaggacuagcagggagccaggccaagaaaggagcacaccccauccugucagugggugagcuuccuucaaggaaggcuucauaggacuaugcaggggcagucacacccacacacacucacccuguaggugugggcagauaacccagucauucaucugucaaguuugggaaugcugacugcacuuugaccccuguacaaagccauuagcaguuuucuagagcaucaguugccacgaugggggggaccaucaagauggauacaaaagaccacaggagggaugagugugguccacacacaccgacagacacugccucagggcauggcagauggguucugagugugggacuucagauuggcagcuagugauacuuccuaucauguguacugugcacuuuaacauaaauauauuugaauauuuuucuguacugcacaaaugccuguuuugucagauggcauagcaguguaaagaugagaggguuuuuaacagaguauauucagcagaagcagaagucagagguuaucuacacaaggauuuagagugauggucuagaauguuguaccuucagggcuuugcaccccagaguccugaaguauauuuuuacauguaucuuugacaacaugaagcucaguaaccauuauuuuuggauauuuuuucaaaauuaaaguauuucuuuugauauuaauuuccaguauuuucaugaaauuggcuguaucauacaaacggcuucaauauuuuguaaaauguuuuuuuaugcagaucuuauauggauaagaugucuucaagaucccuguacacuaugucuauaugugcaaugaaaugugcauggcuggcugguaguaugauaaguagacagaauguauauaaugcaaacccuuuuauuauuuaacagccauuaaaauuuuaaacuuguaccaaccaccuuuggauugauugacuuaucagucugaugcuaauguugauugaacacacacacacacacacacacacacacacacacacacacacacacauaaggugcugaaauagaucacagcaaucguauauugcgaauauucaugaauaccacuauguauauaauguuuauguaugugcaagcucuguugcaauuucuauuucaguaguuacuguuagaauauuacuaaaugaugcguaaauuaaaauucuaucauauauau

SEQ ID NO: 7582 - RNA, 278 nt, Mus musculus
cagagagaggggggaggaggaggaggaagaagaggaggaggaggaagaggaggaagaggaggaagaggaggaagaagaggaggaggaagaagagaaggaggaggaagaggaggaagaggaagaggaggaggaggagaaggaagagggggaggaggagggcagaacagaaaaagaaaaaacaaacaaaaaaacagaagaaacuacagaauuuaggcuauugacacagauuuucaaugaagccaucuccuggaaccacucucauagugaccauggauaau

SEQ ID NO: 7583 - RNA, 16028 nt, Mus musculus
uauggccagaaaucgccuguguuugaucucaccguccaguccccagaacaucauuaucaaguguggcuggugcuugcuugccuggaguaauguugauaggaggugaguagcuccuugggauugaagccuaaagagugggugugggacagacuuaugagggacacaaaaucucuuucaaugucauacuggaaaaagacaggaaguagcguggaaaucagggucagagugaugcgugcucauggcccacacaagccacuuugggaaggagguugcaucaagagcuaacuauugucugugguuuucauuauccacugagcccauugcaaagaguguagaagcagcagaaaaagggaccguuuagggauggagaugugcucaucaaguaugcaccaaaccaucgguagcacuuugaaaaugggcaugcugccacaggccuguaauucuagcauucagagggaagagagagggagaaggauuugaaguucaagcuacacaguaaguuuggagccagccuaguauacaugauaauaauuacauuaucaaguaauaacacuaguaauaauauauugcuguuauuauaaacaguaucauauuauaguuauaaaacauguugcuauacaagauaucaaaauaguaguaguaauauuaaugaugaccugggcucuguuccuagcuguauuaccugguagcuucagugacugcucagacgcucugaaacucagcuuuguaauaggcacaguggagcuugaccuaaggcucccauaugacuguggggaugcucaaauaugauugccaaaacuccuuuuaaacgugaaugugauguccaguuuacaguaccauugagagcauuuucuuuccaguuuugcugucagguuaaacuguaaagugauuuaaguuguugugguuacacaguuucagagagcuccuaggagaacuagugucauccuaaaagauccgggggaaugggacacuuacuggagaaaagccauaaguuugaggaaaaauagauauagacuuggagucugaaaugaauaugauucuuaggacaguaauuuacuuacaggaugaagagcucuguauaaaaggguaacauugaaaucuaugcucccugcuuuguauuuggcacagaauccagcccauuguuuaacaaaacccaacacaaacaacuagcaacuuguucaggaugcccuaggcuuugaagugucaggguuucaacuucugcucuuagcgcuuuggccccagugccagagaaaagaccacaggauuuuaucggcccauuggaaagugaaaacaguaaugguauuuaucagcagcugugccauuuagcccuaacuuggguuguaauugcuggcagaagagauaaagucaaccuugggguggacugucaguguuucucacucugcaaacagucuucuuccugguaaacuuacccugcgggaucucagcuuuacacaugagucagaugacagggaagcucaguuguggaaacugagccuguaauguagaauaacacauuuucuuuagggaaugaaaaucucucuuuuucagagguuaaaaauaaaaugucuacaaaugcuagaaauuaauucucucucuccucuguuguaugaaaaaaaaacuacuggggagcuauaacauacacacacauacacacacacacaagcacacacacacacaucuacucacccaugauggggacucuauaauaggucaaaguacaaauacuaccagccaguuuuauuggggcuaccuacaggaacaugccuccauucggugaaaagcuagagucuccucuuaagaggccagagcugauguuugaaagugacucagcucauuggcugcucuuagaggaaagccgccuuccuguccuugugacgucagcaaggacugcuauucugccaggugacacuguugagacccaggaauuuguuaaugucuaauggcugguguuacccuaacuaauccucucaccucguccaaauccuauaaucgcacucugaaguagauuauuuuauuuugauuuuauuuucugagacaggcucucuccauguaguccugacuguccuggaacuagcuccauagaccagaucggccuggaacucagagaucugccugccucugccuccugugugcugucauuaaaggcaugugcuaccacugugggcuaguaaaucauuuuauuaauccccauuugauagaugagaaaacagaggccaagagguucuaagaggcuugcaaugagcucuagagacccagauuuggauuuugaacccaaacucacacgaugcaauacacuuucccccuaaccaguccugaucaugggagugggaugauauuuuuuucuucaagcuuagaaaagccacuugcugucacugagucuuucagcuggagacaucugcuugacagccagaagggucaacgcugcacauaacagaacuuuccuacagacugggaacuuauggcagccccuuaaucuccuugucuaaguccacaccuggcccagagguuaauucccuccccaauacucagagugauauuuucguaagaauaguauacuuuuccuuuaaggaaaaaacuguaaauaaaugauauuaauagcucucucuauguuguuucucuuggacacauucagugagacuauagggucacuaauagcuauuuauuuuaaaauaugacucaguguuuuuaaugccaccaaauuacacucaaaugauaaaaacaauugacaaacuuuauauccuguauacuuaccauaauagaaaaaaauuuaaaaaacaaaaacaaaaccauuguucuuggagcagcuggguaacucccacugagacuaacaaucagauuuugaucccuggaccccucaugguggaaggagagaauggacucuuacaaguugccuucgaacaugucccguguguguauguguguguguguguguguguguguguguguguguguguguguguguauguguguguccacuaaauaaauaaacaaacguaaacuguuuuaauuaaaauagaaaacaugauucuccccuugggauggauggaggugagggcuugccgguuggcugcgcgguguguguuuuggagagcacacguuagugugcugccagggugccuuaucagcuggaggaaacaggcguugacauuugcaggaagaaaucauggacuggggggucagaccagcuccuugcauucaacacgaaugacuuuuuuucaguuaccagaggaaauccagcaacuuggugacuucugaaauguugugcauaggaaggaaaagccaagaggcuuuguuggcccaagccggaaacuggacccacugagcuuccguaggacaaugaguuaggagaaggccuuuccccuccuaagcaggagaagcccuagcucagcaguuuggagucccugacucugccucagaugaacacaaaggcuuccauucugaggcaaacacccuguguuucccucuacucauuguuuccuagguuccuucacggggcuuucaguggcucugaggugaggccauggggguggaaaaaaucucauccauuuugacgucagugcucacuaaaaggccucagaaaagguuggaggaacugacuuggaaaagccaacggccucucaaagaagcuucuaagcccaaugcaacauuuuccagucuuugacuuguuggguaaaauagaaguuugggaucagcccuucugugugguguccagagauaaaauaggcagggaaggggacagguguguguguguggggggggguaggggguaauuauuguuugauguuggcugagccagacuugacuugguggucagaguauccagaagacaaggccagcacuuccgguuccccaguuucucccuggagaggacagccauuuacauaaagagggugggaacacucccauuuacauaaagagggugggagcacccccauuuacauaaagagggugggagcacucccuccaguagggacuuaggagcuguuaauccuucacuaaccaagccagauccauuucccagcuucuucucccagcuuguacucugaguccuugucccacagacuucaagguaggguguccuugcuuucucucugacaguuagauuagaccaacuuucgucaugagaggagugggguguuuucucugugguguuucucccgaucuccuuccuuccugugucaucagugugguucuggaaauggcugagaauuaccuucaacacgacauugucucuugacacccacaaguguuauuugauuccuccacgaucccaggaacagggaagggaaaugguuucugcugccuuccagcgucuucucuauuuuuagaguucuuaaccuugugcccacgguccuacccugaaguucucuuguucuucucgugacuggccuccugcagcccucaggggcuugcuaucacagcauacuucccaguuccgaggaucucuugcuuguaugggccaaaguuucagauaccaugaaccugaaccugaaaaacagcuuuuugcuaucaaaacagcuccuuuggagcuagagggaaacugaugcuaagaguguguccugcucuuguaaaggucuggaguuugguucccacacaagacagcccacaaucuucuguaacucuagcucugggagaauccaacgcuaucugcugggcuucacaauccaacccccacccucgacaccaccaucacagaugaaaauaaaauaaauauuuaaaaagcacugcuauaguuuguagcagugaaauuuuacucugaaggaguuacucaaacccuugcuacccacagugugacccaaagaucagcagcaucugcaccccuggagcuuguuugaaauauggcagccgaggguccaccuccauccuucugagucaguaucuaugcuugaauaggggucauucaaaauacacaggugcuucgcugaauucuucugcagcucucaggucauugagaucacuggacggagccuggcuuuggaaaaugcuaagguaggagaaugggugagccuugggaagccuugagggguuugcuucuggaacucuaaggucauaugagcaaggggacuugacucaugucugcucuggucauccccuccucucagacaccucauacaauccugcuggguuucuuuaucuaaacucuaaagaacccacaagagucacucgccccauagucuacgucaguacacagggccguuuuuuggaccaaacaauuauuuaagugucuauucaacacaaaacagugaaaagaguguugaagggauuaaauacccaagagaucaaauugucuaagggaaaggcggugauucguggugaaggaugaggguagaggagagaggagauuuuacccccugugguuggcacugggaauaaggccgacacaugcaugaggcaaaggucaaaggaggaggaagcuuggagaggggaaggaagccgugcugaguuagaaaaugcgcgcgcgugcugcaugcgccagccuggagcucaggagaaggguuuucaaaaggacuuaaauuucuguguugcuccgugcuugggagacagagccaggcaggucucggggguucauuggccagugcaucucaccaaucagagagcuccaauuucacugggagaccuugucucaagaaauaaggagaaagguggucagggaucaccagaaguugcuguuugugagcuugcaccuguacacauacauucacacacgugaaagcuuacacacauauacaccgcacaccacacacacacacacacacugucccugcucuaguagagucuggcuauccucccuccuuacucuggcuggugcuggauggcacagguggucugugaaagaaacaugaggaggagauggugaaguaaggacuaacguggucucuaaggcagccgcuccaccacacauaaaagucaucggaucugcgcaaugacuccaguuuuccugcauccccgaaguaccgcuuggggauuaaauggaaaggagccucuguggguuuaugcuguugugguaaacacaaagggaacuccaaucaugaaagccaugcuguguguguucuuccaggaagagagaguucccucugcuuuuaucuuugcuuccuguuucugcuugguuggcuguucucuucauucuuacuggcuauccucucgagacccaaucuggcucuugugcagaaaacccagacugcagccugugaggucuccuuguuaauuuggaggaaaaaaucagagcccucaguccuuaggucaucuagacacagacuggaagcuccccgauaaauggauuacaaaugcuguacaucgaacaguuccuugugacaagcuaaagaagggcuuaugugagccgggcaugggugugguggcgcacaccuuuaaucccaacacuugggagacagaggcagguggauuucugaguucgaggccagccuggucuacaaagugaguuccgggacagccagggcuacacagagaaacccugucucaaaaaaaaaaaaaaaaaaaaaaaaaaaaaggcuuauguggcacauacgcuggugaaugaaacaaaccagaggcaaauggcuuugagucucuuuacuugugugugcaucaugugugcauugcauaugcaucacauguguaugugcacaugcacauagccauguguguucacagaugcacuccuguaacaguacuggugcucaggucaaaagacaaccaaggccucaccucucaccuuguuugagauagaaucucuuugcuguuugccuuuagcaagcuaucuggucccaaacuuccagagauucuccugucugcggcucccaucuugccuuaggaacacugggauuagagaaguguacuacugugcccgaauuuuauguggguaccugggacuugaacccaacuccucacacuuuuaugacaagugcuuucuuugcacaguaaacauucuucccagcuugcucuacuuuuuuuuuuuuaaucaaaagauaguaacacacauuuuccuguucuuuuuaauacaggagaaaaagccuuaaucaacauuaucugucugauuuguucuuuagucuuccuuucaggcuaugugcagcacaaggaaaaauugguacuuuuccuuuguccacauucacacaauaaucuucaacaccuaugaagacauaucacaccucugggaggagacuagcaaagauaagaaaccaggugugagagagggggagggagggaggggagagagagagagagagagagagagagagaaugcuccugaggguacguacgagggugaguaauucuaauuguuugggauuuuguuguuagugguggguuuuguucuuuguuuuuuaagacaagguuucucuguguagcccuggcugucuuggaacuuacuuugaccaccagucuggccucgaacuuauggaaaucugccugccuuugccuccggaguaguaggauugaaggugugagcuacugcuuccuggcuaaauaguucugauuugaugggcggggugggagaauaggaacgcuucaagguggaggugacauugagguaggaacuuccaggcugaauagaagucugaccggcagcaugagggaggacaugugcauuucugguaaaggaaccaacaagaaaggcaacaguguagcauagcaacaauucucaaccugugggucaugguuccuuagggggucacauaucagauauccugcauagcaucgacauacauuacaauucauaacagcagcaaaauuacaguuaugaaguaucaacaaaacaauuuuaugguugggagucaccacagcauaaggaacuguauuaaaggguugcccccuuaggaagguugagaaccauugguguugaauaggagcgucuaggagggaaggaaaaggagaguuaggaccagaugcugcuugucuuguggucaaaccaagaguucagauguuaucugagaggcagugauagcugcggaguggguuuucaucaaccauugcugucuucauugucaagaacacaucuaaaaccgggccauugagaugguucagcggguaagagagcuugcugccaagucugauggaucggaguucaauccucgggaaucacauggcaggagaagggaacagacucccucaagcuguccucugcuugccacaaauauacaguggcauauucacggucacacacacacacacacacacacacacacacacacacguguacagaguaaacaaauaaacgugagccaucuaaaacucguugaaaaagaaaauacccggaaccucugucaccgagagaagaaaauccacaccuaaucuuauccccugaggcccuucccuucugaguaagccacuugugcucaguaucauugguuuagucauguccccacaagcuuuuuggaccaagugggacauuguagcauggaguuugagcuacacugcuuuggcucccaguggguccaugcuuccagccacaggcccaggagcuaucuggguucuugaacagaaggcaugcccacgagcgcgcgcgcgcgcgcgcgcacacacacacacacacacacacacacacacaccaguuauuuuuaaaaugccuuggcuaccucaaagacugaacacucuuaaaccuuccucugcaacccagaccuaaggggaaaguagccaguggccacucaccugaauccucgcauggcugguuggcuuucucuccugcagcuccuucauuccauccuucuccugagucauggcgauucuucaccucuuccccgcuguguccuagcccucacaacuuugaggguuccacuccaucucccuuuaccuagccauuggccacuggcaucuuuauugaucaaucaaaaaccaauuggagacaaggaccuuuagcauuugaacacacgcagauucucgauugaaucaaagcauuacaaccaucuccaacaggacagguacaucuuccaacuauuuaaugauucuccaggauccgauaaagacauuaauugcaauucucaggccauggcuaauuaaacaaauagggcauucaaccaaauuuugcuaaguuuugacucaacaaaaauaagcagagauagauaacaacacagcaccugagaugcagcuugcucucaauguguaaagaucugaucuuguccagcucugugccugugaagcucacugucagcuuuauacagcagcacuguuauauggagauggggcaggagagacuagacauagaaauguuuagagugugcugcaguggcccagagguuggauauauugucuuuguacggcccccagcaaggagaaggcucucaguaucaaugugugcacagugcaggccuguucccacacacaauguuucacaaguaaguaaagaagcguuucuuacgugaagacuggaaacuuggaaaagggacuuaaaaaacuaauuccauaacggcaaggcuuugaagaggucaugcugccuuucugguuucaguuagaagcacccguguucuuucugaacauuuaaguaaauagcuaacuuuuagcgaacaaguauaaggcucuguauggaugcauagacaagagagauagacacacagaucaaugggagagaacagagaaaauggcugauuuuucaacaaagacacgaugguaguuacugcugauugucagauaaaauuaccugaagagaccuaccucugcgcaugucugcaagagauauuuagauuggacucaccgagaucugaauaugcaugaauugaugaaaugugaaccauguaugaguaaagcuguguaguuuuaacuuauaaauaaguggguaucaaaaugucuuccugaaguccugggaaaguuugaagagucagaaaggauucugugggguacaaagauucagacucauauacccagugacccuggcuaugcuaccuguaugaccuguucuugugagauaccuucagggcugaggcagcaagauuuucuuacgcagccgugacuguucucugagcaccaggccuggucuccaaggaauggcuagacccuggcucaaaaccugagacccaggugcuaggaagauuccuggauugagccucugguaaaguuucauuuggccuuugaccucagcagcuggaaccuacuauuguuuaggcagaagauaaaucagugugcuggggcuugcugggcugggcagggugagaggcuggcugcucugccauccaucagaauaaucagcgcaccugagacagaccucuguaggaccaugcugucauguuaaugaauuagggcaaacaaacauuacguuuccagccugguguaaggugcucgaaacccagccaugccauuuaaaccauguaauuuaccauuacuauucaaaaagcaaggaucucuggguaaugggguaaguuuacccuggaggggccacagacaauugauggagguuugagagcaccaaaggagaauugcugcauauucuuuauuuucucuaucuaaguuucugagguuuuuuuuucuuucuuucuuucuacuuuucaacauaugguuacauaauauuuuaggaaaauuaugucuguucauugccaguagauagauuaauauaaauggagguucuuaaagacauuucauugauaguucuagcauuuuuaaaaguucagagacugguggauauguggguuacuacaugacgauuaauuuaauuggaccuuauuagauucugagacccaguccaaaacaaacaaacaaaaaaaucaggcaauuacuauuuauuuauuuauuuauuugcuuacuuguuuauuuauuuggcaauacuguaguccaggcaggucugaaacuuacuguguauccccagguggcuucaagcaugcagcaaucuuccugccucagcuuccugaauucuuagaucacauucaugagcaccaagauuuauucuuuaaaaaaaaaugaacucaucuuaacaauuaaucacuaagcuuaauuucuauuucaucauagaugggcaaaccugugugaucacuguggccugcacuuuuuagcucugaauccuuacuuccuagucacuagacaaugacaccuccagccauagauucagcccugcccuagcuuugcgcaucuacacuggcuggcucuauacugauggacucaaugugucuuacaccuauguucuugacuaaaguacgaagucaccuuuauuucucgcccagcugcaggcugccuccuuaaucgugagaacuagcuuuguguauuaacccagggauguguucuuacacaacacccugauucuagcaagcgaguccuacuucauuuucuauuugcagagaggaauggaaagagagaaagagggagagauggguagagcaacgggggaugauagaacaggagagaacagaagaggggaaggggaggguaugagauggcaggaagagaagagcccacuaaucuucaucaguguguuugcauaugguuuguaucugccugcucuaagcuggaacccugguucccaguguggcaguauuaaagugguggaacugugaugagguggggccuagugcuuccaccaucagguacacauacaugcauggaugccaaacacccacacagaacauaaauguugcauauaccaguucccuguaaaagugaagcaaaaucuacgugcuuguguccuauguccaaccuggggucaauaccuggcuccaggcuccaaggucaccugggagaacuggauguuggaaaggauugcgagguaucuauuuguggucaacccaacuccagaaccuuggacaccugaagacugaaggccucucucuacaucagcauguacggacgcucagaguuugccucaaugaauuacuuaguucuccuuucucuuaaugaaguuuuuccucuucuuaacuguuuuuuuuccuugcauuuucuagcuuaaaagcaaauuuucuguaagaaauacauguaagaauuagcaggaaacagccugaggauuuacauuuguuauucuuagauacccugguugcuuuaaaucuccuucaugacacggagcacauacucuccacuagagcucaugguuaacuaagagaaccagauuccacuacaacucagaggauguggcucaugaaaagccacucugccccaccuagucaggucuaucagcgaggcucucuggcuuauccauuacacaacacccaagguacuccuggagaugugucgaggaauuucaucaucccacagagcuacuucauccccagacuuccucauaucuuaaaucguuacaauuauccaccucgugacauaguuguugaaacagaguauccuaaugacuguaaaauaaucucaauucccagcugcccuaucagcugugcaacaccugccaauaucuuccaaaugcucaaaagaucuuucauggaacaauuucuuaguucuuuucauccgaguguagaagaccuggaaguucuucaugguggccagcuugaguuguucuucuguaacccuugaccacucuagaagcacucgccaucaaaaaucuagauguugcgugaacagggaguaauuauaguuuucccucaauuuugcucucuaguaaaauucaggucagagagagaucauuugcaaaggauaauguugucuauuuuauuauuggcaugcucagauuucccuuucuuccccucuuucuuucuccaccaggguucccuaauuucuuggcccauugauguuauaaaacuauccugacaagggaaacuugagagaggagggggucuugccuuaucguccgagguaccgucuguaugauagggaggccaagcagcaggaguuggaagcagcuggccgcgucacacccgagaucgggaagcagagacaaguguacauugaugcucugcucauuuuauacagcccaagauccucugcccagagaaugcucccaccuguaacuaagacgaaucuuaccaaaaagguuuuuggucaggguggggauaggguggaggagggaggaagagaugguguaguggagagugagaaagacaaaauugaauuagauacauggaugaaacugucaaggaacaaaaaaaaaaaauuacuuuaacaagauuucucuagccaagagaagucaguuacaagcuuugcuauagucuucaaaggcuuuguguaaaauguucuauucauuaaaauaaaaacuaaagagagauaagauuccacaucaguacucccccugucccaggcaugccuagaggcccauauuccaggccauuuuggauuuugugaaucagagaacuuugucauauggaguuuggacucagggcuuuguaugcugagcaaauguuuuauaucccccagguccauaaguuaaaaaccuuugugauagagccaaguauccuugguacaggaaagacacuugaguagagaccacgauauuuauucaugauuaguguuguauuuuuuuuaaauccuuuuuucaggucagaggauuuuuauguguuuucuauauuggagcaauuauaaauaaagucacuagaaauauucacauguaguuuuuuuuaugugaauacacauuucuauuucacagccaaugcuuaaaagugagauuucuagcuuauauggucuucucucucuuucucucucucucacacucacacaaauagaauuuuuuucauacaauguauucugguuauaguuuuuccucgccaccuccccacacccauucgugcugucucucauaaaauagacaucuaaaagaaagaaagaaaaagaaaagcauuauaaaauaagauaaaauaaaaacaaaguggaauaggacacaacaaacaagaacaauccaaagcaaaagcacagaaaacacacagacacggagacgcaaacauucacacacugagaaaucccauaaagaccuagcaacugagaagcacagcuacucuuccccuacccacacuacaaccuaucaucgguuuccguucugaacucaagcucuguguguggcugccuaucucaucuuaggauguuuucccugcaccaaagucugugcaccaugcacguaccuggugccugaggaggccagaacuggguauccuguggguguugguacagaacccuuggcccucuggaaaaggaaccagggcuccuaauugcugagaugucucauccuaccuguuuuccuuauaacucagguuugguguagcacuuccuccaacugggcggguuccgcccaacaguuaccuagcaacagccaguucugagccuggcucacaaauaugaagauauucucucucucucucucucucucucucucucucucucucucucucucucuccuuuccccccucucucucccccuccccucucucuccccccuccucccucuucucuccccucucccucuucucucucccuucucucucucucuuucucucucucccccucuccccccucucucucccccuccccucucucuccccuuucucucuucucuccccucucccucuucucucucccuccucucucucucccucccucccccccucucuccuacugucucccuuucuuccccacauacccacauauccccagccugccucuuucccuuccucucuucucucuuucuguucucuguccucccucccuucucugccuguccucuggcugauuucucagaggaucacuucagcaugaaccugcccaguuggaaaucucugccuucucacguacuaacuaaccauuguccaaauauuuucuuuuauuaaauuuccacuacugaguuuuagacuuucauuuuauuuauuagguuugguuuuauuuuuacuuuuaaugaacacacgaggugacaagcuucguguuuugguuggucacacacacacccuucccuccacccccccaccaccacguguuuacugacuuugacuuuuguguguguaccagggagaccuuucucuaaggagagccccagaaaacacauuuucccuccauuguuccaaaagagaagaagggggaaagagcuggaaggccugugugcugaagggcagagggauccaccauagguaaaacugguaaauguuuauggcuaaaaacagaggagaaaacaagcgauuggcccucaugccugagaccucacugaggauacuaaagugccagcugcuuucaauauuuuguaaagauuaaaaagaaagaagaaaaucuuacuguuuuguuaacauauaucaucucuucuaaucuucccuggauaauaccccucccuguuaacuuuucuucagaacuggggacuacaguuugaaauugaacuaacuugcgccacaacacacauuucuuaaaacaaugaugcuugggaucacuuuccuuuuaaaauaccacacaguuccgggguguuuucaccagcccgcugccuucaguggauaaagaggaccugggagauccaacccggugguuacagaaagacccuaacugagucacgacacuuggagucggagucacgacacuuguuacauaccaaaaagagaaguguggaaccacagcacugcuggccuucauuucuacucuucccuugguagacaucccaucccacagccuggaugaugcuugaggcaguguccagaugagagccacacauaggggaaaggucacuucuucuaagauaaacaucccuccuucagccccaggcucuucuuccagcuaauuggucagaaccgagucacgugguugccucuacuauuugaacuaggcuuaccauuagcuggccuaauagagucaagauugacuguagcagcuaggguguguguguguguguguguguguguguguguguaacuuccaaaugagccaaagcaguuuagcugucucacaagucugguugauuuucucagccuucuguggucuuugagcucuuugacagcuauguagagaccucguuaaacuguaguaaauuuuuguguacccaaaaucaggguacacgaggaugcaaugggugauuguuuuguauggcuuaguuguguaucuauuuguaaauucagcucuuugguccuuaucagccugugugguuauuuaaaucucccacauggguuauaauagcuuauuaauucccuuacuaaucacuguguuaaauaaagccuuugacaaguuga

SEQ ID NO: 7584 - RNA, 1027 nt, Mus musculus
ccgcaccuuucuacagagaccgaagggagcugugcuacggaugacucgguaagcuuucucauggaaacgucagguguguacgcgugagaaacgcacccucuguucaaagugagccacaaacccacuuccuucuccccguuucagaaggcgaaaucuggagccuguaucuggcgaagucgauaugaccuccgcagagagaaccaguuucccucgcuuccuccuguccucagcaaaaacccuucccuccuacuuuagagacauaaccgagauaccuggaaucagcccgucuguugaucuuugcacauuuguuucugcgggguggaggucacuugagagaagucuauuauuccggccuccugucuacuuccucuggagcccuuucccuucaaguuuccuuauuccuuuagccacagccuauggacagcuuguuuacaaaucccagccuccgccauaggaggaggcucuugaagcuuucaaagccccaucaggcuaaugucucugugcauuacauaagauaccucucccagagaacucuuuccccuuuggaaauagacauaagcaaggggaacacauguucugagacgugccaaguccuuaggaauggcuuuaagaucacaauagcucacaguacaagaauaguaaaaccgguccuucuugucccuaacuaaauaauuucuacuaagcagagcuggacauuaacccccucguucuacuuucuguugcuucaggauauagcucucggccuuuuccaaauaccagggucaucagugucccugucuguguuauuuuauucuuuauacauuuguagucuucacugaagacaucaagcgccccacaaguaugcacuacaaacaccccaccugagaaaguagagaggguuuucuucuccccaguaacaccuuuguaaagugauacaccccauuacaaauccucaggaagugaucucuuuaaugcguugaauccagguauggacuuggagcugaauaaaaagggaucauuccguccuugcucaccugugcuaccuuac

SEQ ID NO: 7585 - RNA, 3075 nt, Mus musculus
ugauggcuuagucccuaggaguucuuggagggggggggucuguuugguuaauauuguuguucuuccuauaggguugcaaaccucuuuagcuccuucaguccuuucucuaauuccuccaucggagucccugugcucggucugaugguuggcugcgaauaucaguaucaguauuugucaggcacugacagagccucucaggagacaacuauaccaggcuccugucagcaagcauuucuugacaucagcaguaguguuuggguuuguugucuauggaugagguggauucccuagcuggggcagccucuggauggccuuuacuuuagucuuugcuucacucuuugucccuuuauuuccuuuagucaggagcaauucuggguuaaauuuuuugagauggguagguggccucaucuuuccaccaggggccgugccuaaccucuggauauggugucuacagguucucucuccccuuuguuggguauuucagcuaaugucaucccuguuggguccuggcauuuucaguuaccauuaaccaugauaacauuuguuacauugcuauucugugacccacauuugcacacugagacagugggaaggagcagggucuuagcuguggagaagcugcuucaaagugggagacccaaagagggccucugccucuugcccaugcaguuugucagcuacaggcaccuaaccuggaaucagccuuucuaugaugaaagaaagccauuuucuguuagguccauauuuucuuugaauaaagggauaaaacccucuuucucagguaacguguagaguccauucagcacguuuaucuacgguuuggugaagaagucauaaggugguuaaccaucuuugagagauggacuaguuuguggguaggaaaguaagaaguauguuuuauuuuacaauuuucuauaagucagauuuuaauaccauauaaaauuuuugauugaagcuauucugucuccaaaauuuucagccauaaguuccuuaauuuauuaaaguugaacuaagaaguagcuggugcuaucuccuggggagauguacaaauccacaucaguucuuuuuggaaggagaugguuuauucaaaggccccuugaguauacauuguguacaguauacauuguguacaguauacauuguguacaguauacaucgcauacaguauacaucggguacaguauacaucguguacaguauacacaguguaccguauacaugguguacaguauacaucguguacaguauacaucgugugccguauacaugguguacaguauacauuguguacaguauacaucguguacaguuuacaugguguacaguauacaugguguacaguauacauuguguacaguauacacaguguaccguauacauuguguacaguuuacaugguguacaguauacaugcuguacaguauacauuguguacaguauacacggugugccguauacaugguguacaguauacacuguguacaguauacaucguguacaguauacauuguguacaguauacauggugcacaguauacauggugcacaguauacaugguguacaguauacaugguguacaguauacauggcguacaauauacauggcguacaguauacauggcguacaguauacauggcguacaguauacaucguguacaguauacauugagggugugcugccaccuguuuagugccugugguggagaugaaucuuuuacucucuccuugauuucaaacauuuuucuuguauuugagauugacaucuguggcaucuuugaaaaacaaagaccccuugaucgaaugacauuguccaaugugucauucuaauaacaggccgccaugacuaugggucuucacagucaggacacugcagugccuaggcagcauggcucuuggggacauucucuugaucuugaauuaauuugagcccguggcuuaagauuuuagucuucuacagugcuuauuuagaagcaggagcuggcuugcauucugcauguuuauguaaauggaacucuggggcaugauacaucuuucuuacaauagaaaccacuggcaacaggcauggcauggcaguacagcuaagcugaccugaugauuagcuaacgguuguuuuuuccuuucuggaaagacccuuucuccugagguagggucuguggguuucuuuuguuuuuuugguuuuuguuuuuuuuguucuuuuugcaaaauuguauccuaacaauucugaguugggguauccugggcuucauuagcaacauaguaaaugacagaacagauuggagugggacacacuguuuugucacuugacuuuuuuuucaaucuaagugggguccuucauuaucuuguaaaucuaucuucuucuccuuuggccaccuuggaaguauggaguuggcuuuucaugaucuguaaugaauaaagcccuuacuugacugucagagagauuuaugggccucuuaugguagaucaaggacagcagucuagaaauuguugggcccucugcccucagcucagguucuggggagaucaugucaggauaaccacacucccgcagaaugaguuacaaauuaagaugcuguuuuuguuaacugaagguuggaaauacaucuuuuuuagaaguugaugggcacuguuuucacaagccugagcacccacuccaaguccaguucagugaccucuaaaguauuuuagugacgauggaacuagaaucuagggaggagguaccuggaaggagccuucauuuauuuagugaagaauaagcaauuccugagagcauugguacuuuccuaccauguuuuugcccagucuucugucagcuaaacuuuuuuacacaauguagauugaccuaugggaagguauaaaacaaaaaguuacuguucuguaccugcaaacuagucuucucaaauauagccaugauuguagcgucuguccccagauuguuuuucuaugugcacuggcacacauggacuugguuaaucaggugagauguaccauccccauggucacuuccuguguggugugcagccuuugacaccagugugcucagcuguucauucucuucacuacaccaugagucucu

SEQ ID NO: 7586 - RNA, 26937 nt, Mus musculus
agccguucccggcuugggccgcgcccgccguucggcggccuuuucuuccgcucccgcaccgaggugcucccaggcggcugcacuggcuccgaggaguagcaggaggagcuccgccgcggggugaguucccggccgcgcugcugccuuguggaccuggccagagaaccgcugcggcggguuugcuccgggcugaagugcgcugggguucgcgggcugggguucgguggguacgagguuccggagcccgggcucgcucugggacccgggcucgcucccggguucuagugguucugcgggaucugcggaggauggcugaggggggcguccgggaggcucaaggguugcacccuuugcugcgacacuucuuccucccaccggugugcgccccucccauccgugggcagagacggugcagcuucagcacccgcgagcucaguacccgggauagggcucuucauccauugaauugcugguguagggcuggggauguugcucagugguugagcuauuuauuguauacagggucccggguucaaucaucagcguugcuaaauaggcgguuaauaaacaauguccauuuucuuuaagguaauggggcgcgcgcguacacacacacacacacacacacacacacacaaauugcucgugaaacaacaagcuagguugcugcuugcgaguucgcaagaaccugucaaaugaauugcucgaaaaguuaacgugcuaaugcguuuuaaaggcuuuuuagguguaauuucaggcaaaacacucaguagucaggauuguucuugccuaagaauagcaaaacaaugcuagaacgaacgcccuuguagauucuacauucggagauguguuagugugaagcugaaaggcauggauuuagaucuuagcaguggcacugccaacuuuuguaacaugggcuuaauuaucucgugaaaaaaugguacuauuucuaaaauguuuuuaaaacaccauauuucauaaguauguguugaguuugguuuuuucuuuuuuuuaccuguacacuuaaaaaaagauucacccagucuuauuuaugugucugugaguuuauaugcgaaguacuuuuggaagucagaaugcaucagauucucuaaaacaggaguucuaagcaggugugagccacuugauguggauagugggaaucgaacccugguccucuggaagaacaggcugagccaucucucggccccucacugugugcuuuuaaugaagaauaggaauaggaaaggcuuaugaaaagacaguguaaugggggagagauuuaugagaacacgaagggaagaguaugugauuacgguuuaagacuguacacugaaagaacagaccaaaaugaaaaugauuuauuaauuauauaagaggaacuuggagagcccgcagaaguacuagcagugccaauuuuaaagaauaaucguacaaagcagugaguuucaucacacugacuucauagcuuuguuucucauccuacccacccgcccccucccuccaucgacugccugcccaguuagagcccuucuacuuucuuuuuuuucucauuuuuuaaaauauuuuuuauuauguauuuuccucaauuacauuuccaaugcuaucccaaaaguccccuauacccucccccccccacuucccuacccacccauucccaauuuuuuggcccuggcguuccccuguacuggggcauauaaaguuuguguguccaaugggccucucuuuccagugauggccgacuaggccauuuuuugauacauaugcagcuagaguccagagcuccgggguacugguuaguucauaauguuccaccuauaggguugcagaucccuuuagcuccuuggguacuuucucuagcuccuccauugggagcccugugauccauccauuagcugacugugagcauccacuucuguguuugcuaggccccggcccuucuacuuucuaguccaucagcuguuuccuuucucuccgaaggucuuuuccuccuuucucaugacugucuuccuaguaacaugauccguacacauacacuuacaaauacacacauauauuuauuuauuuauuuauuuuuuaaucucuuuucuuuuuuuuuaauauuuauuuauuuauuauauguaaguacacuguagcuguccucagacacuccagaagagggagucagaucuuguuauggaugguugugagccaccaugugguugcugggauuugaacuccugaccuucggaagagcagucgggugcucuuacccacugagccaucucaccagcccauacacauauauuuaugaacauaaaacauggaauguuugucuuuuggagucuagcuuauauucuauuuuuuuaaaaaaagacuuauuuauuuauuauuauauguaaguacaccguagcugucuucagacacucaagaagagagugucagaucccauuacagaugguugugagccaccaugugguugcugggauuugaacucgggacuuucggaagagcagucggugcucucaacugcugagccaucucaacagcccccuaacuuauauuccuuuauauagugacuuucaguuguauacauuuucccacaaaugccgugauuucauuuuuucuuguggcugcauaaaauucuguuguauauugucacaguuuguauaugcuuggcccagggaguggcacuguuaggaggugaggcccuguuggaguaggugugucacuguggcuuuaagacccucauccuagcugccuggaagucaguauucugcuagcagccuuuagaugaagauguagaacucucaguuccucuugcaccaugccugccuggaagaugcccugaugauaauggacugaaccugauuucauuuaaaccuaugaaccuguaagccagccccaauuaaauguuguccuuagaagaguugccuuggacguggugucuguucacagcaguaaaacccuagcuaagacauauauguggaucacuuauuuuuauuuuuaauuuauuuuugguauuuuugauauuccuuauggagcuagguauuuuggggccucacuauguaguuuuggcuagccuagaacuugauauguagagcaggcuggccuugaacuaacagagauugacaugccucugccucccaaguacugggagggaaagugagugcuaccauguuagucguggaacacauuuucuauauccauucauccgcugauggacaucuagguguacucugugccccaagguauugugaauagaccaugaaugugcgugugucucugugguguguuaacguggaauuguuuggguauauaccuaaacuggaccauaugggaguucuuuuucuucuuuugauuuuugaggcaggguuucucuguguaauccuggcugcccuggagcucgcucuguagcccagcuauccuugaacucggagaucugucugcucagcuuuuuuuuuuuuuuuuuaaauuaaagaacucccuccauauuuaauuugauaguggcugcacaaauuuacauuucuaccagcagggagugauauuuuccuuuuaaggucauacucaccaguauuugccaucuuuuuaaaaucaauuaauuuguguguaugugagugugugagugugugugugugugugugugagaguaugugugagugugugugagugugugugaguaugugaguguggaugagugugugugugagugugugugaguguguguguguguguaugugugugugugagugugugugaguguguguguguguguguaugugugugugugaguguguguguccguguacaugaggucacaugcgugagauaaccuacagcacaggugcagagucugagaacagcuuucagaagucacguguccuguggcucucuaggacugaacucagguugucaggcuuggugacagguacuuuuccugagccaucuugugacccucauuuguuuucuuggugacagccauucugucugcagugagauggaaccucaaagcaguuuuauuuuuuuauuuuguuuuugguuuuuuuuucaagacagggucucacuagguagcucagacugucuuggaacuauguagaccaggcuggccauugaacucacagagauccaccugucucugccuccagagugcugggauuaaaggcauguggcuccaugcccagcucaaagcaguccuaauuugcauuuaccugcagcuccuuauauguccugguuguuaaucccuugucucauguguaguuggcaaagguuccuaugccccacccucuucuguaagcuaccucuucacuguuuucuuuaugcaaagaagccuuugaauuucauguaauccuauuaauuuuacuuccuguaaguucugugcuuuaauggccucucuuuacaguuguacaaauaaguucagguggaaauaaaugcucauuaucauagaagagaugguauaauagaauggguaacaguauauaucuuaaguguagggagaaauuuugaguuuuuuuguauagauacuuucauauauauaacccuuagcuuucuacaugcuugcuaaguacucugucaccaagauacaccccucagucuuuaguaagcacacacacaggcauguguauuuaacagcuuuggaagauacuguuugacugcaaaauauucugaagaggaaagaucacgcaguccuucagagagacaccagcugcaaugccucauccugacugaagaguugcuuuucggaggcuuguugcuucaaguccuuuguguggaaaauguauagcaaugcccgacaucaaauauuugaaugacagcugaugucaguguugugcuuaugaugcagcaaagagaauuggccaguggguuucagucugacuucgaguguaugacgaaacgugaggcgugguuggagaugaccuacagccaccgccggacucuggcugucugcaaagcuguaaagccaguucucaaguugagacacaucugucugucuccaucuuggucuucacuauguagaguugggguucucagaaaaucacuccccacaugaagguuggagauacgaaugggacgcuccucuacaggggagcguagacaggaauggguuuguuagcugaacacagguuacagcccacgauaacuggagcucugucaguuugcuguggucagcacagccuggaccacaccugcuggcagacccagccuucagcgagaccuuuuuuuuuguuguuuggaugcuuucugguucuuuauguuuauuuguuuguuccuuuucuaguuucucaagacagggcuucucugcuccgacuguccuggaacucacguuagaccaggcuugccuugaacucaacggagauccauuuaucucugccucccacaaaaaguucuguggcaccacucugggcuuggcuuucuggcuuuguuguuguuguuguuguucuuuguaauaagguauaacaaucuuuuaaaaaccauaacacuuuaaaaguuuacuaucucuucaaaaguucaaacucucuuuaacugugggcuccuguacaaccaaaacccaaaccaaauuauuuacuguguuauuccuaaaggaggaggacacaguuacagucaaguguaagcaaaaccaaaauccagauccuauagcucaguguccggcaucugggcuccacucaccauccucuguuccccaacacucuggcagucccaccucuccagcugugcuuucugcagcgcacagcuugucgaguagacucagacccccuccagcccacguuugccauugcccuuggcacacauuccacacgccuggcaucuccaguaucccagagucuccacugaaguggaggcuagacuuucaccagcggccucucuugguuguuacguagccucagcuuuucucuaugaccccuucagucuugccuuucucguguuuucaaaacuagaaccagguaggugauccuuagauguugccgacuuccagccagcagccugagaugcacccuuggcccuuccggaccacagcuugugugcugacccuaaagaaguaacucccagaagaguucacuucagugaggcugaucucaugaaucaaucacaguugguucuuuagucccggcugaccagcaucaguugucucaggaaaguaaaaagcuuuggcuuuggugacacuggucacuuguuagucaagcugcuucuuuagccucagcuggucagcauccacagauuccuaauccaaaauaucaugaagaccccaauagagucuuugugacccucugaaaugucacaggccagaccuccauugucuguguuaucaucuaagcucccacagcaacuguguauuaaaaucugaguacucagcagucccagauucuaaccauuuccauagccuucccccucuaaaacgacaccccacucuugguaccaauuuuugggcuuguuucuuuucuguugcuuuaagaaaaauacucccaaaagcaacuuggggagggaaugcuuuccucugacaggcugcauguaguccacccucgggaaguauaggcagaaucacagaggagcacugcuaguggccggcauccaggcucacacucagcugcuuucuuaugcagcucaggcccaccuaccuagagaugaugguacugcucacagcaggcuuggacccucucacaucaaguagucaucaagaaaaugucccacagacauacccacaggccaccuucucaauagagguuaccuuccccuucccagguggguaaaggugacaaccaagaguaguugucacaccuagcaugcaugaaacccugggcuugguccucagcacugcguaaagccacauggagugaugcugcuuauaaucccaggaaucaggaggaucagaagcucagagcugucccugucuauacaguaaguuccuggucagccuggcauaggagacugccucaaaaacaaaacaagccaaucccgaggggaaaaauacuuaauauuaacacagauagaacuaaagauagcucagaaauagcaacaggaaacuagaaaguuaauuagugacagagcaugaggguaugaugguuguguaguuaauuucuaaaaauuaaaguuaacuuuuaaagaauguuuauuuuuauuuuuaaauguacauugguguuucgucugccugugugucggugugaggguguuggauccccuggaauaggaguuagaaacaguugugagcugccgugugggggcugggaauugaacucagguucucuggaagaacaaccagugcacuuaaccacugagccaucucucuagccaguaaauuauucacuuuccauaaacauuugcuggcuguguuuguguguauauauguguuaugugugcauauguguguaugugcagaaaucccauccacauacaucuaguuuuauauauuauagaaaaacacuugggcuggagagauggcucagcaguuaagagcacugacugcucuuccagaggucccgaguucaauuccuagcaaccacaugguggcucacaaccacuggugugucugaagacagcugcaguguacucacauacauaaaauaaauaaaucuuuaaaaaaaaaaaagaacagcuuaaaagucacugauuuuuuuuuuuuuuaagaaaagcacucguaacagaugauugaaaagaagcaucuguaacgucaccauugcagaacagccauuauaagcagaaauuuagagcacagggcccuugaggccagccuuuguugaguuuacugaguuacagaaacagcauagaugcuugggcuucacucaugggcgaagaacuucuaaggaagcccagguaccacacaguugcuugauggguauauagcaucaagccccugaagaccagucauguagacagugggcagauacucacuagauuggguucucugucucuguagaggaggagauaaugaacucaauaacuaguaacuaguaaugguugcuggaggagggggugucaugagaguuugggguaaugagaguuuuggagggcucgagagcauggugagagucaucaguccauuucagugacuugguuuauagugcggaggggcagggagggagcucagcugguagaaugcuugccaaggaucugaguuugaucucccaaacacauuuaaacagccagguguagugaugcacacuugcagucccaguguggggagaacuggagacagauggauccccggacucuguggcgagccacccuggcugaaucagucaguucugggccagugagaggauggagaggaauaucaugaaacacugccauccagacauggcauugcugcugcgccauaggcauguggacuuuauagguacucacuagauuggguucucugucucuguagaggaggagauaaugaacucaauaacuagugacuaguaaugguugcuggaggagggggugucauuuuuuuuucuuaaugguguagccacugggaaacugagugggaagaagggaaagggagaagaggauaauuggggugaaggaugaauauaaucacagugcauuauguaugcauacauauacauacaggaaauuguccaaaaguaaauauaauuaagucuauacucuuaauuuguugggauggcugcucuugugaugguggugcaaacaauguuuagcaugggaggcuaacaggaacaaagugcauuuucaccaaggucugcccuguccuuuccugcaugcccagcuuccucugugcuuguaacacagcauggagagagugagcugacauucacugagugcacacucaaagaggguuguguucaugcuaaggacaaacucauuuaauuuagguucagagugguuuccaacucgaguauuccucaggcgucugauguuaccccugagggagucacuaagacggugguaaaugaauaguaaauauuuauugcacgagaaacuaagagaucuacgguaaguaagacuggcuagaaggcagccucccauguacugugcugagugugcaaacacgcaucagggugugucagccuggaagaauguagguuaaggcuccugaagaaguaagauugcccauuuggggccugucuuagaguuuuacugcugugacgagauaccaugacuauggcagcucuuguaagggaagacauuuaauugagaauggcugacaguucagagguguagucauuaucauccuggcgggaagugugguggcacacaggcacacauggugcaggagaaggagcugagaguucuacaucuggauuggcaggcagcaggaagaggcaaugaacuacugggcuuggcuugaacuuuugaagccucaaagcccaccuguagugacagcuuccuccaacaaggccacaccuccuaauagugccacucccuaugagccuauuggggccauuuuuacucaaaccaccacagagccuaggacacagaggcucugcuuuaguaaggcaagguuugucucaguuguugguaguaggguuguuuggggggcauucucugaaucaagccuagggauaagaguuuggagcagaagcugccuauguggggaguucucugugguggugugaauaaggaugguccccaaaggcucauugauuugaaugcuuagucaccagggaguggaacugugugauaggauuagaaggguuaggagauacagccuuguuggaggaggugugucacuggaguugggccuuggcguuucaaaagcucaugccaggcccagucuccaucuuagcuugcagaucagaagaugccucugaucugcugcuccagugccaugccugcagcccugcuccugccaugaugaugauggacugaaccucugaaacuggaagcaagccccaguuaaaugcugucuuuuauaagaguugccuuggucacggugucucugcacagcauugggacagugacgaagaccuuaugguuuugaauaguuuucccuuuuguaucuagaacaaacccggaggcaaaccuguaggaggcaaugcuugaauaacucuaagacgacuagacagugaaaaugucagcccucaacuggaagcccuuuguguauggagggcuggccuccaucacagcagaaugcgguaagagcccggacucugacucugaagcuuugccugagggaugugguggcugucagguucuguguuuggugugcacgguguucaagugcaggcuugugaacucacacccuccauaucuagacgugccucuuuggguauguuuuuagacggcucagugauuuuggcuacuuauuagcaacuuuggguuuaaagugcacuagggagaaaguugacccauuuuaugacucccaucuggguugaucggacacuguucccuugccccuuucuccccuuugccgcugaaaauccauuuggcugcaagaaguuuggcaugcuccagggccuucucugaaccugagcugauugacgcuccauugcaaacuuugugcaucaccuccaucccauccugacuccaucaguuggguucuguaucugagugcacugcuaugcauccaauugcauugcuccugcaucugauugccuugcuccugcauccgauugcauugcuccugcauccgauugcauugcuccugcaucugauugccuugcuccugcaucugauugcauugcuccugcauccgauugccuugcuccugcaucugauugcauugcuccugcauccgauugccuggcuccugcauccgauugccuggcuccugggugugugcuguuuuaucaagcacuugcuaacugcuuggcuucuggcuuggaccuuccguucgcucaguugacuugcagggcgcauggaucaccacucacuaaugcuggucagcuuucuaugcauggaugauggaauuuaaaaggcugauuccugucccugaaugcguuaaccuggacuuugugagccagguuacuguuugaggaugcaguacauacauggagucuauguuuggguaacuggucaggucaguauuaagcacucuuuuguugagacaggguuuuucugugcagcccuggcuguccuggaacucuguaagccaggcuggccucgaacucagaaaccggccugccucugccucucgagugcugggauuaaaggcgugccaccacgcccugcaguauuaagcacucuuaccugccucauccgauuucauuuaucaaagaaauuuccuuaaacuuuaaaaccucuguucagucacugaacacaguccuagccuuuuuuuuuuuuuuuuugcauaaagacuauuugggguuguaaguggauuuccucuucguguaaaugauuuuguuuauccguguucuguggcaguucugccuccucacucagcuuuauaaaaagauagacauaauaaauaaauguuuaacugaguaugguggcacaugccugcaaaccagcauugugggagggaggggaaggcagaucgggaguucagggucagcuuuagcuauagcagguuucagacucagcugggcaacaugaacuagcucccagaacaaaaacaacaaaugguguugagucauuuuuugaguuuguuaauuuuuuuuugcccacucuuugcuuuuuuuuuuuuuuuuuuuugagacaagauguugcuguauagcuggccucgaacucuuaaccuucucucggcuuccugaguucuagaaagccagcaggcaaccuuggcagucauuccuuggguccaccuauuuuuuucuggacaggucucucaauacccuggaacuugcuagguaggcuuggccacguggucaguaagccagcccguuuccaccuccccagaguguguuccaccaugcucagccuuuuuaauguggagucugggaaucaaauccaggucuccaugcuuguaagggaaauguguuaucaagcgaacuauuuccccagcuuggcuauuucuuauuucagggagauucuuuuucuuuuacauuuuaaggcacauuuccaauugauuuaacuaagacacggcuucagauucaaggccagacaaaugaugccaacuuccgagagaucagguaccgaggcaugcugcacgcgcugaugaggauaggccgagaagaaggccugaaggcgcuguauucagggugaguaaacgucuggguguuugugucuaacugugggcccuuugaagugcaugcuuaacgcaucaccuucauagagggagaagaugaacauuaguuauucucaaguaucuagguuuuuaccaugauaaaaauaucagcuugugguuaaggcuugcaaacacuuuuaaauucauuaagcuacugaugggaaagugagcaagaaaagacuugaccuauauaucagaguucuuugcagggaacacaacacccuugaugguuuaaaugaugggccuuaagggacuauugaaggcuucagggaacaauugaacgguagauacugaacuaccuagaaacuggcgaagugacccuaggcuaaagguccaggggcagcaaucaugguaccacaguccgggaggcugaugccuuguagaagacugaacugucaguagaugcuuaggguccugcuccuguguggggucauuugcaguggcgaggugggauggggugggguggcuugcugcucucuccuuuuccuuucccccucccagcaguuggccuccuggaggucugcuggaagggugucugugagauguggucuguaagcaucagccuuucucauagcauagagaggggcgagcaugaguguagaucauacauuugugaauguagaacugucaccgauaggggcugcacauguggaaaugggauuacagagguaucuggugucugucccacacuauugagggcagggagguggagcuguucaggaaagucacuccauguaggaggcacagaaucagacccugaaaguucaagaagaaugaggcaggcaaaggggugagagugggguguucacauacagcuaggcagcauugcaguucuacgaauagcaaguauuccagcauggagaugguugggaguuggugaauagcaagaaaugaagccagaguguuagagcaucagaaaauggacagcuuuaugcccugccaagcaccugucccacacagguggcccucagccccuccauggacucaucaguccacagaggucuuugcuuuuaaauccagccaagacauucauucauucauucauucauucauagagaaggccuugcuguguugccuaggcugccuugaacucauggcucaaaugauuccccugccuuagcuuccugauuaggggcaugugucacugugcucagccaagucaauauuuuaaaaauguuuaauugugcaugaaaacaagagaaaggaaagcuccagcaggcccggacccacucacugugacaguaguagcuacaguugauauuuucucugccuuaucugaccuugaggcccggcaaaugcgugcacaguugggcugaggcugcucacucauccuuggcaucugccuggugccuaucaacacuuucguuugcaacgccugugacgagcgagggcugagguagagcuuuuuauaggaagagugccuugagcaggucuccugcaggcccagcagcauugugugacuuucuuaugagguccccggguaggagagguagugagaagggaggaaauaaacacuaaggccuggacuccuggcagucacuaguguguagcuauaacccccacgucacccccauccccacaggagacagaagaggagagcugaugcagagaaggagggagugagcucaaugcaggacauugaaugugggcauguaugggauaucuaaacugaagagcuagacagcagcugggaacuggucagaacugguuggaauguggcucuaggaaucaccuguuaggaugagcaugacaccaugggaguggaugggcugggagguguguagaggaaagagagaaaggagacaggguccuggggggccucccagagggcauguaugcagcugugguguagacgaggugcugcugcaaaggcuauaugagaugcuauguggacacuggccgccuuggugagggggagcccaggcuauaauauaggaggagguaggaaauguagaacaaggggcuagggggugaaugaaaaaaagaaaugaagcgggaaggaaaggcccugacugcucccaggucugguagagaagagaguuuaugguagaugugucggagaagagcuuaaacaguaucagagacaucugggagagcccagagugggcacggccagacugagcugggcccugggaggggagggcaagggaaccaggugcaaaggccuaaaggguagagguacaaaaaggggcgaguaaccaagaugucuggauuauauggggaagagccuucgggguaaggcaacccaggcccugggcuggagagcccaagguagagcagggucugccagccauagucucuaacacucagggacuaaggaaugcugggagaagcuggaggccaggacuguuuggguauguuaaguaggcaccucagcuuuuguuucuguccuggguuugaaagauaacaugggcuaagcacgccacaggcuggccucuguacuggcuaguuuugugucaacuugacacagcuggaguuaucacagagaaaggagcuucaguugaggaaaugccuccaugagauccaacuguaaggcauuuucucaaauagugaucaagggggaaaggccccuugugggugggaccaucucugggcugguagucuuggguucuauaagaaagcaggcugagcaagccagaggaagcaagucaguaagggacgucacuccguggccucugcucagcuccugcuuccugaccugcuugaguuccaguccugacuuccuuuagugaugaacaguaauguggaaguguaagcugaauaaacccuuuccuccccaacuugcuucuuggucaugauguuugugcaggaauagaaacccugacuaagacagccuccuagagaugggagggugguauccaggauggagaacuaugucuuguguuuguuaauucuggcuugaauuguguauccuauuggaaaaacuuagaggggcaggaaauaacuauguguguucuucaggugguacccgccuucccgaguucuuugcaaggaauguuuaugcguuuuacuugagcgggcaaacugaccccacauuggcauuuuccucagguuaaguagggccucaggcuuccacuuagggacguaauaauuaccucugauuucaagacccaagugugcuuuucuuaacaucuuuuuaaaugugaagauauucauuuuaagcugggugugguggugcauggauuuaaucccaacaggagggagguagaggcaggugcccuggaggccagcacagccuacauauggggcuccaggacagcagggcuacagagacacccugucucaaaagagcaaaccggaaaaguaaaauuaaaaaaaaacauucuagccguagugucugccuuugcauggagugagggggaggcgcgcaggggucccucugaggguuucugaugcguagguuggcuuucaucugucugcaugcccacaugacaggauugcacccgcaaugcugcgccaggccuccuauggaaccaucaagaucggcacguaccagagccugaagcgguuagcuguggaacgcccagaaggugagcggcccccuguccaccugcagagagucaguggguuguugguugcuuuguuccagacauuuuggaaugaguuuucaauuauuugguuaauuuucuaccaguaaagaaaagacuggguacaaagaguaaacaaacugcucauacugagccaagccggagaacgugugugaggagcuguuuguacaaauguuuuagucauuugcuuuuuuuuuuuuuuuuaaagauuuauuuauuguguauacaauguucugucugcacagccagaagagggcgccugaucucauuauagaugguuaugaagcaccaugugguugcugggaauugaacucaggaccucuggaagaguagccagugcuuuuaaccucugaaccaucuccccagccccccauuugcuuuuuguuugucuguuuuuucgagacaguguuuuucuuuguagcccuggcuguccugaacucaauuuguagaccaggcuggcccugaacucacagagaucugccugcuucugccuuccucaagugcugggaagaaaagcgugcaccaccacacccagcccaucauuuguauuuuuaaauccgugccucccuaacuccccugaccucccccaccuccugaccccucccaacauuauguuucuccuuuaugaaacauuguuuccuauguuccagacucuaauuugugcacuguguauuugugagagcauccacugcagugcaguugacuaccagcugccguacucuuaaaggacaacagcucucaccgucccagaagucgucagcugucagcagcuccucagcuagggguggggacagccacuugucuuuaugcucacagugcuuagccacaugcuacacuguuucugcuugucaacugaauuuccuaaaauugagugaauuacagccauuuucaggaaggcacagcaugaauacaugucuuacaguuaagagcucugauagcugcacgagacugggauaaauaugaauauuuacaaggcaauuggacugcguguccaucuaggcaaacaaagaugaacaguagauaguuauuuuaaaauaaaucgcuugauucacagagcauauaauaauauucaggugaacagguagaguguaauguuuuuauauuggagucacuuacagcaaaaacucuuacauacaaaaaaacccaaucacugugucuuuguagaugaaacccugcuggucaauguuguguguggaauucugucuggagucauauccucagcuauugcuaauccgacugauguuuugaaaguaaguccuggcugugugguagggcacauuccacacuuauguacuuacugcagcgagugcacugggccacucuuacugaucauacugcccuugauauuagucacuuucucuaguagggcauguggugugcauccuuaaucccaucacuugaagaccagguguagccuguuucucuaugaguuacugaguaggaaaaaaggguuuucuuuugagacaggguguguguguguguguguguguguguguguguguauguguguagccuuggcugucuugaaacucacucaaucaauagaccuccuaguuucagacuuguagagauccaccugucucugccuccugagugcugggauuaacaaugugugccaccacuggcugacuuauugccaguuuuccccaaacaccguuacaccauuaagcacuaggugggugguuuucuuaagagucucugaugguggggguggagaaugggccaguuuccuucucacgucguucuuuaugaucuguagauccgaaugcaagcacagaacagcgcuguucaaggaggcaugauagacagcuucaugagcauuuaccagcaggaggggacuagaggacuguggaaggugagccucgcugcagucuaauccaaguguccucgcggcguaagaagaaugccacuuccugccuuugaagaugccuucuuucuuuguuucucugucuauaaaaugagaacaugaauaugcugugguuuuaaagugucuuuugguuaguacauacacaggguuuugugauagcugaguaccguuuauuugaucuuuacuuucuguuguuucaauucuuagaauguccccugggucccugucucuuugggugauuggccuguucaguuucaugacuuaggugaagucgguguuuaggcaagugcccaugaagaaugcuauuuccuaggaaccccaugacucagggcucauugguucacagaacagacccucccuagacccugguaugaucccucagugugacagagaagcuggaggcuuucaggcaugguuugcccuagccccaggcuggccagagucagaacugcccuccgagcuuucagaguucuugcuugguugcccuuuucugcucugucgugccacgcuucucccuaguggcagaacuggcagcgggugggauagaacugcccacaccucggccuugucuggagggaugcggaaaucauuugcuguucacguuucuccccagggugugucccucacagcccagagggcagccauuguggucggcguggagcuuccagucuaugacaucaccaagaagcaccugauacucucaggccugaugggagacacugucgcaacgcauuuucuguauguuuauggauuuuaaaauuaauauuuuagguaugcaugagcuugguagggugaaaauuuuacauaaguuuauggaaguuuuagagaaaguauuguaauagugugguauuuucuuauuugaaaaauuauaacucagaagucgaaugggaugaggugaagucuuugccuuuacacagguaauuauauaccuguauguguacaaacuguauguuuguaagcaccauggacuuuauaaacaaauaaggucauguuugcauuguauuacuuuuuaaaaagugacaacacaacccaaauacauuuucacuucagcucuuacaccuuagucauuuuugauuacuguuuguguaugugccugcagaggucagagggguguuagagcccagagccagagcuccaggcacuugugagccuuuaggaaaucuaacuuguauucuguaagaacaauacacccucuuaagugcucagacaccuugcccguccuuaauuuuugcuguuguuguuguuuuuuuuguuuguuuuaguaauugcagcuuaucacauuuguaugaacauaucauagaucauuuaaucugugugacuuggucuggacagggacacuuagccuaguguggcaagugugcugauucucaccacuagggggagcgcuauucacaacucuguaugccgcaagcacaaguaaaccuuugugcgaauagaacaacuucccaaacaaagagugaccaauucagugugugaggaaugccgcgcugggaaaaccucugagcugauuggugcugauaaaauaaaacccgcagcaaaguuaaacucaguggaguugagugugaacagaaggaaaguucaggagcaggagcgcucgcucaugaugagaaugguagagagcagcacccacagugugcaggaguguuuauggccagagacaugggaacggcggcagacauagcaucucccugagguucagcguaggacuucccagcucucacgggagugaaagcguaaccauuccauuuuauguuuuauauaacucagcaagucauaggaauuacguuacgguuauuuauguucacaggcaaauauaggcuaacuauaacucaguuuagcaacgguacucaguguagccuaugguagucuagugagacugaaagucuaggacaguguuuugcaaccugaggguugaacgaccugggguugccuaagaccaucagaaaauauagguauuuacacucugauucauaacagaagcaaaauugcaguuaugagguugcaaugaaaguaauguuaugguugggggucuucacaacaugaggaacuguauuaaagagccgcagcauuaggaagguggagaaccacugcucuguagaacccaagaccauggaugggugugcagugaggcggucuuauguuuuauuuauucuuaggccuauuuuuuuuuacauguaugaguguuuuaccugugugagaguaugcauauauguauguauauauguauguauauucacuguguacaugccugguacgugcagagaacagggcaucagaaccacuggaacuggagugugcuggguucuaaacccagguccuguguaagaacuagugcuuuuaacuacugagcuacuuccagccccaaggaccucauucuuggugcaguuuguguagcuucuccauauuuguuuugaaggaauucugagaggaagcugucucaucucccuccuuuguagcuguagcugagugguagcucacuucuugucuuuuccaauccuguguucuccaacagcucgagcuucaccuguggccuggugggggccuuggccucaaacccaguugauguugugagaacccgcaugaugaaucagagagcccuucgagauggcagaugugcgggcuauaaggguaccuuggauugccuauugcagguaagugucucugcuggauugucgugcacacacacacauacacacacacacacacacacacacacgcacacaggcacacauacacacacacacacacacacacacgcacacauacacacacacauacacacacgcacacacaugcacacacauacacacacugaagucacuauuacguuaugauaaguauuaaaacuaagaugagugagcccauagaagacagagucucucaguagugcagcccugacugucaugaaauucugucucccaggugaccguaaacucacagagauccaccugccuuugcugagauuaaaggccugugccuggcaggacauacauagcauuuugccacacuaggauuggaaguccaagauuuacaugacaucuuauaaauggaaguucauuuuccacacacaccuccccagcuaggaaggaugcuaaacuaguaacauuuuccggguuauaugacaucuuauaaguggaaguucauuuuccacacacacuuccccagcuaggaaggaugcuaaacuaguaacauuuuccggguuauaugacaucuuauaaguggaaguucauuuuccacacacaccuccccagcuaggaaggaugcuaaacuaguaacauuuuccggguuauaugacaucuuauaaguggaaguucauuuuccacacacaccuccccagcuaggaaggaugcuaaacuaguaacauuuuccggguuauaugacaucuuauaaguggaaguucauuuuccacacacaccuccccagcuaggaaggaugcuaaacuaguaacauuuuccggguuauaugacaucuuauaaguggaaguucauuuuccacacacacuuccccagcuaggaaggaugcuaaacuaguaacauuuuccggguuauaugacaucuuauaaguggaaguucauuuuccacacacaccuccccagcuaggaaggaugcuaaacuaguaacauuuuccggguuaugugacaucuuauaaguggaaguucauuuuccacacacacuuccccagcuaggaaggaugcuaaacuaguaacauuuuccggguuauaugacaucuuauaaguggaaguucauuuuccacacacaccuccccagcuaggaaggaugcuaaacuaguaacauuuuccggggucgugaaacuguuccuuuuccaaaguggaccuuuuuccucuuagucaaacuggaacaaauauuccccuccagaugugccucacaggaguaaaugagcccuaccacaguucccacuguagagaacuguuuggggcagagggagguguucugcugcccccuggguugccaguggccaaggcuucggggugcuuugcaggucucggcacgaugcugacgcuucuuagucuccaggauugcuucacauuuucagaauuacauuuucauuuuuuugcuuuggggcuaggggugguaagggcagugguuguucguauguacauauggucccuuggcaugauuguuagaggucagaggucaagugggaggagucaguucucuccuuccguuauauggauucggaugaucaaacucagguuggcauguuugacagcagguggcuuugccugcuaagccuuccaccagccuuucccuucuuuauuggaggcaggaucuuaauauacuuaacuggcccuuaacuugguggguagccgagugugaccaugaacuugugguccuccugucucuaccucccaaggggugagauuauaggcaugugccaccacacuggguuuuauguggugccagggagugagccagcuuauuaccugcugggcaaggacuggacccccugagcuccauccccacuccucugauauugcuuuaaugaggcagacaggagacuugggaggcagaggugcuaugaaugcuaucuucaucaaaauugcuuacuuauuucuggcuuguuuagcagcccagauggcauggaagcuaauggccuguucuuagaacuaaguaauauuuaagucugauuucuuauccauugaguuccugcuugccugcuuugggagggguucaucuucucugugugcagugguugucaugcagaagucuuuaaggaacaaagagacagaaaaggucuuuagucaguccuucuaaaaaggguuauauuuuguuuuugaguaagcacguaaaauguauucauuucucucuguucuuugauuaaagcugaaaauauucagcaguucucuguaauauugagcguuugaguagaauuaaugaccgagaagagcucagccuucugcauggccccugaugguuuucuuuuaaaagauuuuauugauuuguuauauauacauauauaaauaugauggguacacuguugcugucuucagacacaccagacagaaaagggcaucaaaugccauuacagaugguugugagcaaccacguaguugcugggaauugaacucgggaccacuggaagagcagucagugcucuuaaccgcugagcuaucucaccaggcccccugaugguuuucauuggaaggauauuguagucuguaaauggcaucaucauccaaagcucguugaguccacucaagcacuugauuucgcuccauccucugccucuagauuggacuaggucuuaggaaauuucgcagaccaguggcugcacuuccccuucugaguccccugccuccagcagccaggagauaguuccauuaggaacugcaguccuccugggcugaacacuaacuugacaggcaccacacacgggcugguuauauauucaucacacuaccaaccuuaggcacugugggcuguggguggcagggugggugguagguggugggugguggcccgagcagcacuguggggacacuccuugccacagcugagggcaguuggaaagaccacuguggcaauuugggguuuccccaggcucagcagagacaacccgugggagucaguucuaucuucuaccauuuaggucuuaggggaaacauccucaacuuuuggauuuaauuuuaauuaaaaaguauaucaauuugacacauuguuaaugcauuugacauaacuggaaaauggggcuugucucaggguuucuccugcucugaccaaaacaucaugaccaaaaagcaaguuggggaggaaaggguuuauuugguauacacuuucagaucauaguccauuguuggaggaagucagaacaggaacucaaguaggcaggaaccuggaggcaggagcugaugcagaggccauggaggggugcugcuuauugguguguuccccuuggcuugcucagccugcuuuauaaaacccaggaccaccagcccagggauggcaccucucacagugggcuaggaccucccccacugcucacuaauugagaaaaugccuuagaucucguggaggcauuuccucagcugaggcuccuuccacucugaugacuaguuugugucaaaguugacacaugaaaccggacaguacagaacuuaaugcuguuuugucuucuuuuuaauagacauggaagaaugaaggguuuuuugcucuauauaaaggauuuuggccaaauugguugcgccuugguccuuggaauaucauuguauccuuuucuguuguggucgaucuaaaaacugcuaucauuagauaauguagcuaguuuuuaacuagaaguuacaguguagaaggaaguucuuguucuucugaguuccucagaucauaagaaguagccacuccaucucuaggcccugugaggucuccucauucaacaccgaggcucuucguucaauggugucucuauugaaagguaucgauucucauuagaaucugcucuaggaguucaggguauuugugauuucagagugaugcgguugagguaucucguggcguccuggggaaggauguggauccgucagugugcaagcaugcuuacuguggggugcugacugaacaugggcacagcauaccccagaaguguuugauuggcauccagguggcaggcaaagcgggguggaugucuuuccuggagagccaaggugaagggguuugcaggucucaggucugaucucucuauucugaauugaccuugggcaacagcuagggagacagccugagacucucagcauggaacuaaaggggacuuagcaagcugccugcagguauuugcuaguagauaagcuaaguugucuguugggguugggaacauuacauucucuuggcagccuuaacccgcaacuguaguucuuuuugacuuacgaacaacugaagaaacuggacuugugaccacaagucgucguucugacaaaccgacuuccgcgacgguagccccuccugugcuucuggcugccucuuacugcacagcucaucauggcuucugggaugggagcaauggauggagaccagguuccucagauugccaugcguugguccuggaugcuuucaucuguguucagagccuagagcauaggaacacccacucaccggugguuaccaucgaagugcccuugacauccuagauaacugauguacauaacagaucguccuugcuguagaaaaccugcaaggaaaugagaaccgccugcugcuuucuuccuggagaguagccucgcugccucuggucuucuggcuguguacaucgccccucugagggggcuccugaagugggggagcacuguuaucccccuaccaucgggagcuuucguuuccugucagugaagagauuuuacauugggacaguuguaggaaguacgucucuagcauacugcacggcuucaugguuccugcuugggcagaaucuuucacuuacaguaagacucgaccuuugugaggcaacacuaaccauuugcccuaagauuuuuuuuuagcaaaguuuauuauuuccauauaucaaauggggguaauuaugcuuugugaaguagggauuaaaugaagggaaaacuacagaggcggcugcgagaaggaugagugugcgcacaccugucaguaaacaguuggucaaccguagggacaggaccaaacgccuuuguuaaauaaagaauccugcaggugaagguuuuuuagucaguuagugaacugaagaggugaggcuccagaguuuuagccuuuacuuuaucuugaggugaguuuguuaaacaaacaaacaacaacaaaaaaccuuuaucugaguuuuuccuaauuuccuggaaaauuaauuucuaccuuccucuuucauuugugugaugacagggcuaaacccuggugcauucuggguaucuuccccacacugagcugcacgauggcccacaucgauggcccgagggccuguuuaucuccauucugauaagagcuguauaguccucuaccuaguuuguuucuucugagacagugucucuaagcgccaacagcuuucuagaagggugcccagugccugcagguuggcccugugaaaaccucauuagcacuaaaggaggcucgaagcuggagcaauggccagugcacucccggggccccuuccuccuugaggcagaagcaugcagguuuucucugaggguugggcgcuuuuuauuccauaccuuuuccaucuggcuuuugaaauuaaugguuccuuugaaaaacaguuugcgaaguagaauuuuguuucuaaaaguaaaagcuaaguugaaguccucacagagcuggcccaaugguggcuuaaagacaauucccucacaugccauuagauggcaguagaggaucugagcgacugcuggccuggcuccuaguauuaugaguuagagacuuuuuuguuuuuuauucugaccugaacauuccguugaaguguuagaauccagagucuuucucucuaguugaaaggauuggcuuuuucaaacaacuuuuuaacauacaaaaaaaaaaaaagaaucuuuuuuuuuaauuaaaauucuugucuuuauccuuucuucuuucucucuuuuuuuucuucuuuuucuuuuuucuuuuuuucuuuuucaucuuucugucuuucuuucuaauuuuuucccccaauuuuccaagacaggguuucucuguguaauccuggcgcucucucucucucucucucucucucucucuguagaccaugcuggccuccagcccaaagaucuuccugccucugcuuccugaacucuggaauuaaaagcgcacaccaccacuagugggccaaaacaaacaaacaaaauucaaaacaacaauaacaacaaaacuacuuuauuuuuuaaguuugaagguaauuucuaaaguacaaaaagguccauuuugaagaccauguaaagaguggcuaucaguauuaucaauuuauucaaauuagguauauaucuauaccuggauaaaaagaaaccuacacuucacuguaaaacuucauguuucaaggcaagcuugcaguauuuuacgaccaggauagugucaauuuauuaagugccuuauagggcagggucuuaaccugccuucucucuggaguuaaugugguuguugauguuucuaaccccgagacaacuugaaacacuuggugauguggguguggcuguaacacuucaccaccugucaauuuccucaaguauggugaaaacuacuucacacuuuuguagcuaaguggaaggcaguuguguuuguguuguuacugaugcucuguguaauguugcuagucuguaaugucaaaaauggcuccugugcuccauauuuauucgugagcuaugaaacuguauguauuauguaaagaguacacauuuuccauaagcuuuucuauuccaggcucuuuauacauuguuggacuguguggcauaagccuuguuucauuauuuaauaaacugaaauaauauaugauaauauggc

SEQ ID NO: 7587 - RNA, 3327 nt, Mus musculus
gucuuguagaguccccacugcagcaguuaacugaagaggcuuagcuuucuagcgaugcucaaccaggcucuagcuucucagacuacagggucagcacaaucacagcaaagaguucuuaaguggauuuaaaugcacuuuauuuuuagacaacccacaugacauguuuuuuuuccuuaaaaaaacaaugccaccacuccaaauaaaucacggucaaaauaaaagcucaagaugacaucagucccauuuguccuaaguccugguguuguauggaugguaagcagcagccaauuauggugacaggugauagauccaauuuguuacugcaaaacaaagagauggcauuaacaacugccccagccugagcuuauaacuguccuagcauguagauguacucccuaauucaaucugaacugccacaaaggcaggcaggaagcgcagggagaguuuccuuuugcauccuagugcaaaccagaagaacaaccacaaacuguucgaggucuaucaguggaugcagacccucaccgaguuggcagcacucacccaucuuccugcccacuccagugcucuacugacaaacaccagcuguugucugaauaacacuccuaccccacugucccaggcggucacccacuuucuccaguacaucucuaaacucaccuucuacugugcuuacaaaaaaagccuccaaaaucuaggacaaggaacacugucuccaccagucccuuauaaaacagacauuucuguauuccuucuuacugaccucaguaaacacugaaacauccuauugcauguaauaugaaauggacuugaacuaccguggggcagagaccacacucauucuacgugaguuuaucccaggccagugucaaacuacuuacacacaugacccugagcacucuagcaagccagcuaaucucaucuucaagccccuuucauguucaaggcucuacucucccacaggauaaagaucucacaaucuacaaggccugccaccugcagauggcaaagaaucacugcugcacucccugucuugacacuacuaauuuaaagauacuuacacauuucuccaucucuaagccauccuuaaagaaaaucaugaauggagucacaccaucuucacgguaguccaggagagcaaccauaccaucuggauucauguuuucaccaauaaaaaacuuaagaaacacguaacaaaaaccuacaauuagacuaucuuauacacacaaauauaaaaucaaacuauaaaaagcagauccagaauaaccccuggccaaaauuuggcaagaaaaaccccuaguucucaaaaauaacacauaugcuagccauguuggcacacaccuuuaaucccagcaauuaagaggcacuggcagguagaccucuggguucaaggcuagucuggucuacagauaacagucucaaugaaaagaaagcaaugccuaucauuuuaauaccagcuccuugccugguguggugcuacacaaaaugggcugagacuuucaucucagaaggcugagguaacugggucuaaggguguuccaggacagccagagccauguacgagacagcaaacagacuuuuucggaucccacaguuauuauacaacccuuugguccauuuaccugguaguuauugaaauuagcaaggaugugcuuaaucugcucugcagcuccagucauaaaaggcuuuacucuuucugguuucugcucuucaaguuugccuuugagucuaaaacaguaaaguaacaggucaucaaaauacugaauaaucuuucaguaaaguaagaauauaagcuccaauagguaaugucuucuagcaaaaugauaguuuacuaggugacaagaaaccauuuaaaagaauguaauuccuauauuaccuuuaaaguaacuuucuaccggcuugcucacauuauugaaaaucaaccuucacuguauaacaaaagacccuccuuucuuaagcccuuccuaccuaagcaaccaacuucuucuaggaagcugaccaccaaaacgggguguuuaugucacuuacgauuucauguagucuuugauguacuuuuuguaagccucuuuugugaagcugguuucuuguaagugaugguucaugacaaugucaacaccggugacuacugugcuuucgguaccuucgcccuccggaccuucagcggaagcauuuccaccgaugagcgagucaucgauggcacccucuguucuacugaccaucuacauuuagaagaaaacaaaacaaaacaaaaagacaauacaacuuagucgaaggggcaaaaaaaaaaaaaaaaaaagaaaaaaagagaaaaaaaaaaaaagguccggcaacgaucagucagcucccugaaacaucuuaaccuccccccaaauagucgcugcccggacugagagagguggucacucucaucaagcggaaccaaguugcuguggccucucucgagucgccacggguuaagcgcgcacagcgcaaaccugucuuauagacaauauguccccguucgcccggaaagaggauggcgcugaguucgcggaccuauuuccaggcucggcuccgccuccacuuuucuagaaaaacccaagguccgcaagagcgucuccuccgccuggaggcggcagcgaggauugcacgaguuccagcggccuccccgcggcgcccagcccagcccggcccggcucggccgacccggcaggcaggcggccagccuccccgcgcgcggcgccccgcucaccuugcccuccaccuccaggcacagcccguccgcgaucucccggaucuuguagaugucggagaacagcucgucaucugaaagcgaacagagagagccgcccgugagcgagcgaaggcccgccauuucccgcgccgggcucggcgcacgcggcggcucccggcccaagcucugcgcucguguccccggccuccccggugcccacccgcacccaggcccgcgggcgccgggacuuacggcugaugaggucccgguagaugaucauggugacggcuggggacggcggcgcuagccugacagcgcggaagcgagcgcggugcagccggagcggcgcgcggggggaggggggagcgggcggaaaaggccgacgcgggcgcuccccaaccucauauagagggcacgcucggcuacgucaccguccgcggcucccccggaacugucgucagcggugacgugaacgcagggcggugcgggggcguggcuacgcccggccggccccgggagggcauccggggacucugcugggacacaaugcggagugccccugggugcgcggggcaacgggggcggugugcggauagugcgcccggggcaugcuggga

SEQ ID NO: 7588 - RNA, 927 nt, Mus musculus
gaagcaagcucuuuuaucuggaguaaaaauaauaauaauaauaauaaggaaaaagagggcuggagagaugacucagcgguuaagaguaccaacugcucuuccgaaggucgugaguucaaaucucagcaaccacaugauggcucacaaccauccguaaugagaucugacgccuucuucuggggugucugaagacagcuacagcgagcaaguggagccagagugagaagaaaaagucuaaagacagcuacaguguacuuacauauaauaaauaaauaaaucuuuuaaaaaaauaaaaauaauuuuaaaaaaaucugucaacagccauagaaguaacuugggccucaagugagacccuauuccaugguggaugucacauugauuacagauuugugaggucugagcagaggaaccuguguugccaugccuagacuccaggcaaaaaugguaaauagcaaaugcuugcuauuccaaagcugcuguguuccugggaauuuggaaugcccuaccacgcaagugcuggggaugugaggaccccaggggcaagcacagcccuguccuagggacucaaacaagaaaggggugauuacauguuaucagauaaaaauggcaucaccgcagcaagccuacauucuccccugaagcuuccuugcuccgauggcugccaggaagggaacagacacugcacuccaggcaguuuagaggucagagaccaggaagucccuuccaggaaagcaagaaaaggaaaaccaagcccauaaaguuccaacaagacgcagagaggaaauggagggaaaaccaccuggucuugucuccaugacuccuucuucagcaccauguuugccuggaugcugccauguuuccuucuaugacgauaauggacuaaaucucuaaaacuauaagccagcuuuaauuaaauguuugucuuua

SEQ ID NO: 7589 - RNA, 876 nt, Mus musculus
uccuucgugcugugcuugggaaauuaguagaaugcucacaccagggccaggaagggcuagcaguggugccugugaccccagcuauauggggcccccaugagagaggccccagaccacagccagugccugcagagagugcuaacaaggagcccgggugaguguggugugaaaacuuuuuuuaccuuuuauauuguuuauugcacaagcuugccuuuucuccccuuccugguuggaucaagaauaggucacggugucaggaagacaggaaccuauguuguauccccuguucuuggauacuacuuauguauauucaguguguggaccguggcauggguguggagucagaagaugauuuucuagaauggguucuuguugaggcagagccucccuccuugcuucugcggcuauguguguaccccaugcaggcuggcccaagaacuuccaggcuauucugucucugccucccaucuuauuagaaguguaaugguuguuagcaucagaaauguccacgggcagccagaaacuuuacagccagcuucugaacccagcgacgaugucaucccuaggcgacaaggggaugaugacccuccugaguccaucaccacagcaccaccugugcaugcucuaucugcaucaccuauacaucaucaccugcgcaucaccugcacaucaucaccugcgcuaguuaccugcgucaccuguguuaccuacaucaugguuuggauaaaagacacauaccagcauguauagcacucucucucucucucucucucucucucucucucuccuucucuccuucucuccuucucuucuuccuccccacccccaccuccuucaggggugacucugucaauaaagaccucucuaaugagaacu

SEQ ID NO: 7590 - RNA, 1899 nt, Mus musculus
uacauaacugauaagcuuuauguggagcuaucucccaccaaaaaggcaaauguaauauuccuaugaauuucauuagcaugaaaaaggaauuccugcagcaggauuauuauccuugcacagaacacagccucuguagccucccguuagugcuucuuguaagaacccaauaauugaaaucgagacgccggcguuccugagucuuaguggugggacugggcaugcccaguagcucggcugggucugguugcaaagagcaagcuugcgggcaggguugagcgccgccgcagggacugcuuuggagacggggucuuacucccuuagacguaagcgugcgggcaccgggagcuuucgggaacccugacgcgagcgagccuuggaggagguggcgcccaacccccucccucuccuccccuccccgcuccgccggcgccgcgggcaccgggagggacugcagcccgggagcgcggggcgggccuauggcgcggccaaucggcgcggcgccuccccgccuauauguggcgcuggggccgggcggccuccucuagaggaguggagccggcagccgaguaggaccgagcugcugcagacgcgccgggucacucgagccagcaccaccguucucacgcccugagcugcagacagcuaggcgguuuuaucuaguuugaaccaggcugcuggagcuugcucccucccgcccucucucuuuuuuuuccacggggcuguuuuuuuaauuuggcugcaauugcaugaaaucccaaugguguagaccaguggcgauggaucuaggaguuuaccaacugagacauuuuuccauuucuuucuugucgucuuugcugggaaccgaaaacgcuuccgugagacuugacaauagguaaaugucagcugggauaguugguuuaaauugacucggaguaaaauugacuugcgguauuacagguacaggauagccaugcgaauuccuuuguccaugccuaggguuacugugacauagauguugcuuuuugaaauggccagaagauccuuauuuucguagaucuggcucgagaacaggcuuucuuccauuauguaauuuaguccuuuguggcuccuuaaaauagggaaaugccuggauagaguauggcugguauuuucuggagucugaugcauuuuggagcguuuaagaauacucaaaauaggaugcuaguaacgucauucgaauucagagaucuguccuuauccuggauguuaaagaucaauuccauuuaucgaugaucucucuuuuuuuauucucucuuccagcucuggugcaagugugguagcuaucgacaacaaaauagagcaagcuaugguauguacugauuuaaaauuacuuguacucaaugugggcgcugcacaaaaaccgacaugucuuggaaacgacuagugcaucccuuagcuaaauccagacggugcugauugcucuucauacagucagaaaugccagcgcuagcucguucucucuccccugccagcguggagagaagccacauccccacacgacugccagggaaggagaagggccccagguugugagcggcccugcucuggacccauucacuccgugucgggauaaggcaguggcccagccuccucguugcuggucuugggagcaccuucagcaguguggcuuuacugggaacccugagauuuuacuggggagcuggaagggagggugucccccuccacugagggcagcuggagaaggggucccuagaccccaccagacccucuccaguggugcugcggccgcacaaaggaggggaaugggagaaaaguuuugucuuucucggccugcgccuggauuucuccgauuuuuuauuuccgccuuggucguucuuuguuauuggagcagcgccuguggcucuucucacgggauucucu

SEQ ID NO: 7591 - RNA, 1899 nt, Mus musculus
agagaaucccgugagaagagccacaggcgcugcuccaauaacaaagaacgaccaaggcggaaauaaaaaaucggagaaauccaggcgcaggccgagaaagacaaaacuuuucucccauuccccuccuuugugcggccgcagcaccacuggagagggucugguggggucuagggaccccuucuccagcugcccucaguggagggggacacccucccuuccagcuccccaguaaaaucucaggguucccaguaaagccacacugcugaaggugcucccaagaccagcaacgaggaggcugggccacugccuuaucccgacacggagugaauggguccagagcagggccgcucacaaccuggggcccuucuccuucccuggcagucguguggggauguggcuucucuccacgcuggcaggggagagagaacgagcuagcgcuggcauuucugacuguaugaagagcaaucagcaccgucuggauuuagcuaagggaugcacuagucguuuccaagacaugucgguuuuugugcagcgcccacauugaguacaaguaauuuuaaaucaguacauaccauagcuugcucuauuuuguugucgauagcuaccacacuugcaccagagcuggaagagagaauaaaaaaagagagaucaucgauaaauggaauugaucuuuaacauccaggauaaggacagaucucugaauucgaaugacguuacuagcauccuauuuugaguauucuuaaacgcuccaaaaugcaucagacuccagaaaauaccagccauacucuauccaggcauuucccuauuuuaaggagccacaaaggacuaaauuacauaauggaagaaagccuguucucgagccagaucuacgaaaauaaggaucuucuggccauuucaaaaagcaacaucuaugucacaguaacccuaggcauggacaaaggaauucgcauggcuauccuguaccuguaauaccgcaagucaauuuuacuccgagucaauuuaaaccaacuaucccagcugacauuuaccuauugucaagucucacggaagcguuuucgguucccagcaaagacgacaagaaagaaauggaaaaaugucucaguugguaaacuccuagauccaucgccacuggucuacaccauugggauuucaugcaauugcagccaaauuaaaaaaacagccccguggaaaaaaaagagagagggcgggagggagcaagcuccagcagccugguucaaacuagauaaaaccgccuagcugucugcagcucagggcgugagaacgguggugcuggcucgagugacccggcgcgucugcagcagcucgguccuacucggcugccggcuccacuccucuagaggaggccgcccggccccagcgccacauauaggcggggaggcgccgcgccgauuggccgcgccauaggcccgccccgcgcucccgggcugcagucccucccggugcccgcggcgccggcggagcggggaggggaggagagggaggggguugggcgccaccuccuccaaggcucgcucgcgucaggguucccgaaagcucccggugcccgcacgcuuacgucuaagggaguaagaccccgucuccaaagcagucccugcggcggcgcucaacccugcccgcaagcuugcucuuugcaaccagacccagccgagcuacugggcaugcccagucccaccacuaagacucaggaacgccggcgucucgauuucaauuauuggguucuuacaagaagcacuaacgggaggcuacagaggcuguguucugugcaaggauaauaauccugcugcaggaauuccuuuuucaugcuaaugaaauucauaggaauauuacauuugccuuuuuggugggagauagcuccacauaaagcuuaucaguuaugua

SEQ ID NO: 7592 - RNA, 6302 nt, Mus musculus
uaugguucuaggaauccuuguuuauuaacagacuaaauaacaaggucuaggagcagguuucaauaaugacuguaauuuugaagcaguaauggguuuaaugacauuuucaaccaccugacacaacugucacagaucugaaaauagugaugauguucccagagaccacuggagaugugguuguggcgauguauguugcugaaggagacacuggcaaagaucaauguaaccgagacuuuuuuuuccccauccacauugaugcagcugcugaguuccagaguuggugaugagccaggcugaccaucuucagcauccuuggcagcugucauuuugaaggucacagguggucauggggaagaggcacccuugagguggggccccugggagcuugccacaggaagcauugagccuggggcucacugaggaagcuaggcugaccagccagcuaucccagggaucuucaguuuccuccuccccggcggugggauucuaagcaugcaccuggcauuuucuucuggguuauaaggaauucaugucuucauggccauacugacugagcuaucucccaggcucccagucagugcuuuaaaaaacaaaaacaaaaaacaacaaugaaguaaacagaaaaccaaagacgucacucacaauauaauugcaaaaccuacacaaccaaaugcuacugggauccaaaagagaaccagaauaccagagcauaccagaaaacuggacguguguugggaccaaugcccgcagcacuuacacugcgaacgcuggcucucuccucacagggauccaugcacugucacccccugcuccucugacguucuggcagagagcaggcauugugugacacagucgucuagaagaacaggagcagcauggagaugaaaaagaggaagaaaggaagggaagacagguggauaggacggacgaggaaagggaaaugaagaagggacuagaagggagggagagaagaaggugagggagggcuggggugggagagaaggagggggagggggaggagagaagacaagagaacaggaaaggugcuacaagagaagggaaugucugggugugacauucaggaaggcccuaugcccuuccugaagauucuuccgcaguugacagcggcaagucugggugaacaugcagagagcucccucucccaguuugcaaggacacucaucccaggcuuccauuguggcuggaugaggagguuuuccugccuucagaccaccccaaauaccuuccucuccaccccguggagguuugaaugagaauggcuccagcguaauugaaugcuuacucaucagggaguggcauuaccugggaagagauagaaggcgugaccuuguugguguggccuuauugaaggaaaugucccugggaaugggucauugaaguuucaaaagcuagacccuggccagggucuuucucuuccugccgcgcucccucagaacuggcugaagaacacuagcuacuucuccagcugcgugccgccauguucccugucauggggauaaagggacuaaaucccucugaaacgguaagcaggccugaacuaaaugcuuucuuuuauaagcacugccguggccaccgugucucuucacagcgauggaacaccaagacaaccuccuucacuccgggagaggcaagggugguaggcuuugaaguguuugucaggguccagacaacuccaggcaaggagcgcaggggcaccgcugauaaggucagaugucuggaauuccugaugugguacuuugcucgcgcgcgagaaacggcucccagagauugucugcaucuuaagaagaaacauuuuaguaccuucauccucugcuccacaaauauuuacuaagcaucuucaucggagacaguagauggcuuguggcuccuuguacccuuaggacaccucugcuccauugucaaaaagcagauuccagcuguuuuccucugugugguuaaagggagguccuuagauaaaguggauggacugugagaggaggaauccaugucucagcucaguggaugcugcucuggggugauggccaaauggaaggaccccagagggacuaucaugggcacaguaguaaaggccaugggcucugcaggagugaccuggacugauagacaugggacagaucaguaggcuuucgagccuguguuaagacucuucagagaaacacccaauagaagauacacagaggugauuuauaauggaaacuggccacacaauuagggaugcuagaguucuccaccaucuucuaucuagagaacagggagaguuggugauucucacugaguucccagacacaggaaccacaagccccagguugggacaggguggauaugucccuuguuuccaccaugucuuuguucuguugagacccucaguggacuggaugguaccaccagguuuaucagccagaugcugagcucuuuccagaaacuacucagcgacacgcccaggacuaacuguucaucaguucucuggcuaucuucuagcucagucccguugacacgugagauuaacuaucauaccuucaccuguaucuaaagcguucuuuggggggcuggggguuuguccaagcaagcaugaugaucugaacucaagccccagcacccaugucacaagcugggcguggugaugcauacuuacaaccccagcauuggggaggcagagacagagacaccccagaggcccgccagccagccagccagccagccuagcugaauuagugagccuaggucacugggagagaccuugucucaaaaagcaagguagacaguuuccgaggaccaacaccugaaguugaacucuagccuccauacacauaagaaugugucuucauuuacauacacauauacauguacacacacgaacagacaugcacauucucucucucucucucucucucucucucucucucucucucucucuuuccacacaugccuacaccacaucacaggcacauagacauacagacacacacacacaccccucuuauguaacuacucuauagucuguguagcucugaccaccccucagacaauuucugcugccuggaagaagacaggaaagcaaacaacuguaaguggaaugcagugaggagagcuggagccaagaaggccacagcagcuaaacugaggggcuggggagagggcagaggucugugcagaaggaagaguguaagagcagagcccuguaaaauagcacugcuggguuugggaacaggguccugcggucaaaacugaucaccgcaggaauccaguagcagggcaggcaacaggcucugagggccaccaaaagagcugacagacggacagacagacagacagacagacagcauuugcucagacucaccuuuagaaguccuguguugauaaggugggccagguggagugaagacaaggguuucaguaggaagcuauaccugacugacaguguaguacagaaaacugggagauuagcuaugugagguuguggccugucuggaaggaaggagcagcccugagauuugagggguaaugggccuagguaggaugugaugguaaagaagggagccaaggaugacuguguucuaccaggcaagcugagcauggagggggaggaugaggcuugggauugagaugguucugggaaagcccugggggagcccaguggacacuggaauugggguuugaagcucaggagggaggucagaccaauucugagucagggucaaacuucaaggauucuguugucauggugaaagggacccacuguagaccuagaggcaggcagaggggccauucuugugcaaguuccuacaacucugggaaauugguuuucuuucaucacgucuguuucucccacuguaaaagguagauggcuuaugcuuguggugaaggucacaccggauggugcaugaggaagcucaaggacgguuagcugcugccuggaacucuucacggcugaagguugugauggcuggaguggcccaggauaggcagccugagaagggagaagccugggacagcugggaccgugagcaagaaaggguguucucucucuccuggggcuugggguauagccaguugguggaguguuugccuagcauacucggugcccaggguuugaucuccagcaucacauaaaacacaacuauaaucuagcuuuugggaaggaaguggaaguaggaagaugagaaguuucaggccacucucagcuacacagcaaguuugaggccaggcugggcugcaugagacccugucucuaaacaacaacaacaacuuuaaauuaauaaaauaguguucucucaguuuauuacugagccaacugaugacuaaagacuguaguucaaaaucuuuuaaaaauaaauucucaccucuucuauugaaauacagucaauagcuuaguuuuagaagcaggccaaaugaaauguacucucugcacuuuuagaugaacggagccacacucuaagcaccacaggguagguuuccaagggauguggcaaccuccacugagagaggagcuuucugguaaucagcugugugacuuugaagagccaccagcucccucugagccugcacuaagcucucuguaauguugacucucuggcuagauggaaaucuagcacgaaagccuguuuccaaguacuugguuggacuugagagagcaaugagggcucugguuguaagggaugucuguacgccagcagagaagguuccauccgcagcaggcccagagccuacacagucagggcuggagguagggcagaacaaaggugcucuguccaggaguugggggccuggguucuguuccuaacugguucugagaguucauggguggucccaagcuccgugacuacaacggacaccugcgcuaguggguacccucauguuuacaauagguuggggaagagaggaguugaacaacuucucauaaugaaugagaugucuuuuuuaaaaagacaaguuaguagauuucuguuaaccuugguuucuuccacaaaacaggguucugaauguguaucucagggucuaugagaguaaauaugcuaaaguagcaucuauuaugcuauauaacacacacacacuauacauacacaaauacauauacuggggcauaaagagauauucagagcacagcacgggucauuggggaaggggauaaaaugagaacagaagggaacaugagucuccuacguacauacccaguuccacaauggcugcuaggccaguggcuuccaaauggccagugaaagaagaaaauaaaacccacuugaggccauccuuucuggcuuaaaauuugucaguggcuuacuuaacuauagcagaugccuucauccucacgggcucuuucucucucaaagccccucauacagauccucauucucuggaucauggagaacugaaggagagcucuucccugcugagacaacuguuucucugcucaauucacccaaccuuuuucuuagggagcuuccugugguccaaggugggcuggccagcaucacucuguggaagcguccugugggguucaucuccuuucaaacuguggguccuccaucucuccagccucugcuuccucucacccaucaugcuccacgcagaagacagaaccccauccugcaugcugaagaggcagggugugaggacuagaucugagagcuugcugucuggagaucuguugcccccccccccuagucaacauuacagagagcuuagcgcaggcucagagggagcugguggcucuucaaagucacacagcugauuaccagaaagguucucucucucaguggagguugccacaucccuuggaaccccccccccccacaaugcaucuucauagaggacacagcacccaguagcagcuagguguuggauugaguaaauggugacccaagagaaaccaaaauggcggcuacuaaggcagggcucccuggggaaaaccucuggcgagguagaagacaaggugggaauucacugaugagaaaaacagugagcucuaggucaauuacugacaauuuaccuagggcagaugaggagauguugucuaauugcggcuucacauaacacucauaaaaacuagugauauuguuggaagcaaguugagcccugaaaagagaaagcugaagguggcacagaucugugacauccagacacauucuccgggggaaagguuacaaaguuacugggcuagugacuagucaugagucauccccagaguaaacagauaacaggcaagaagguuacauggugacaauucagagaccgcugaacugugaagauuauguggggccucucaggcuaagcacuuucagaau

SEQ ID NO: 7593 - RNA, 14746 nt, Mus musculus
cucagaacuggcugaagaacacuagcuacuucuccagcugcgugccgccauguucccugucauggggauaaagggacuaaaucccucugaaacgguaagcaggccugaacuaaaugcuuucuuuuauaagcacugccguggccaccgugucucuucacagcgauggaacaccaagacaaccuccuucacuccgggagaggcaagggugguaggcuuugaaguguuugucaggguccagacaacuccaggcaaggagcgcaggggcaccgcugauaaggucagaugucuggaauuccugaugugguacuuugcucgcgcgcgagaaacggcucccagagauugucugcaucuuaagaagaaacauuuuaguaccuucauccucugcuccacaaauauuuacuaagcaucuucaucggagacaguagauggcuuguggcuccuuguacccuuaggacaccucugcuccauugucaaaaagcagauuccagcuguuuuccucugugugguuaaagggagguccuuagauaaaguggauggacugugagaggaggaauccaugucucagcucaguggaugcugcucuggggugauggccaaauggaaggaccccagagggacuaucaugggcacaguaguaaaggccaugggcucugcaggagugaccuggacugauagacaugggacagaucaguaggcuuucgagccuguguuaagacucuucagagaaacacccaauagaagauacacagaggugauuuauaauggaaacuggccacacaauuagggaugcuagaguucuccaccaucuucuaucuagagaacagggagaguuggugauucucacugaguucccagacacaggaaccacaagccccagguugggacaggguggauaugucccuuguuuccaccaugucuuuguucuguugagacccucaguggacuggaugguaccaccagguuuaucagccagaugcugagcucuuuccagaaacuacucagcgacacgcccaggacuaacuguucaucaguucucuggcuaucuucuagcucagucccguugacacgugagauuaacuaucauaccuucaccuguaucuaaagcguucuuuggggggcuggggguuuguccaagcaagcaugaugaucugaacucaagccccagcacccaugucacaagcugggcguggugaugcauacuuacaaccccagcauuggggaggcagagacagagacaccccagaggcccgccagccagccagccagccagccuagcugaauuagugagccuaggucacugggagagaccuugucucaaaaagcaagguagacaguuuccgaggaccaacaccugaaguugaacucuagccuccauacacauaagaaugugucuucauuuacauacacauauacauguacacacacgaacagacaugcacauucucucucucucucucucucucucucucucucucucucucucucuuuccacacaugccuacaccacaucacaggcacauagacauacagacacacacacacaccccucuuauguaacuacucuauagucuguguagcucugaccaccccucagacaauuucugcugccuggaagaagacaggaaagcaaacaacuguaaguggaaugcagugaggagagcuggagccaagaaggccacagcagcuaaacugaggggcuggggagagggcagaggucugugcagaaggaagaguguaagagcagagcccuguaaaauagcacugcuggguuugggaacaggguccugcggucaaaacugaucaccgcaggaauccaguagcagggcaggcaacaggcucugagggccaccaaaagagcugacagacggacagacagacagacagacagacagcauuugcucagacucaccuuuagaaguccuguguugauaaggugggccagguggagugaagacaaggguuucaguaggaagcuauaccugacugacaguguaguacagaaaacugggagauuagcuaugugagguuguggccugucuggaaggaaggagcagcccugagauuugagggguaaugggccuagguaggaugugaugguaaagaagggagccaaggaugacuguguucuaccaggcaagcugagcauggagggggaggaugaggcuugggauugagaugguucugggaaagcccugggggagcccaguggacacuggaauugggguuugaagcucaggagggaggucagaccaauucugagucagggucaaacuucaaggauucuguugucauggugaaagggacccacuguagaccuagaggcaggcagaggggccauucuugugcaaguuccuacaacucugggaaauugguuuucuuucaucacgucuguuucucccacuguaaaagguagauggcuuaugcuuguggugaaggucacaccggauggugcaugaggaagcucaaggacgguuagcugcugccuggaacucuucacggcugaagguugugauggcuggaguggcccaggauaggcagccugagaagggagaagccugggacagcugggaccgugagcaagaaaggguguucucucucuccuggggcuugggguauagccaguugguggaguguuugccuagcauacucggugcccaggguuugaucuccagcaucacauaaaacacaacuauaaucuagcuuuugggaaggaaguggaaguaggaagaugagaaguuucaggccacucucagcuacacagcaaguuugaggccaggcugggcugcaugagacccugucucuaaacaacaacaacaacuuuaaauuaauaaaauaguguucucucaguuuauuacugagccaacugaugacuaaagacuguaguucaaaaucuuuuaaaaauaaauucucaccucuucuauugaaauacagucaauagcuuaguuuuagaagcaggccaaaugaaauguacucucugcacuuuuagaugaacggagccacacucuaagcaccacaggguagguuuccaagggauguggcaaccuccacugagagaggagcuuucugguaaucagcugugugacuuugaagagccaccagcucccucugagccugcacuaagcucucuguaauguugacucucuggcuagauggaaaucuagcacgaaagccuguuuccaaguacuugguuggacuugagagagcaaugagggcucugguuguaagggaugucuguacgccagcagagaagguuccauccgcagcaggcccagagccuacacagucagggcuggagguagggcagaacaaaggugcucuguccaggaguugggggccuggguucuguuccuaacugguucugagaguucauggguggucccaagcuccgugacuacaacggacaccugcgcuaguggguacccucauguuuacaauagguuggggaagagaggaguugaacaacuucucauaaugaaugagaugucuuuuuuaaaaagacaaguuaguagauuucuguuaaccuugguuucuuccacaaaacaggguucugaauguguaucucagggucuaugagaguaaauaugcuaaaguagcaucuauuaugcuauauaacacacacacacuauacauacacaaauacauauacuggggcauaaagagauauucagagcacagcacgggucauuggggaaggggauaaaaugagaacagaagggaacaugagucuccuacguacauacccaguuccacaauggcugcuaggccaguggcuuccaaauggccagugaaagaagaaaauaaaacccacuugaggccauccuuucuggcuuaaaauuugucaguggcuuacuuaacuauagcagaugccuucauccucacgggcucuuucucucucaaagccccucauacagauccucauucucuggaucauggagaacugaaggagagcucuucccugcugagacaacuguuucucugcucaauucacccaaccuuuuucuuagggagcuuccugugguccaaggugggcuggccagcaucacucuguggaagcguccugugggguucaucuccuuucaaacuguggguccuccaucucuccagccucugcuuccucucacccaucaugcuccacgcagaagacagaaccccauccugcaugcugaagaggcagggugugaggacuagaucugagagcuugcugucuggagaucuguugcccccccccccuagucaacauuacagagagcuuagcgcaggcucagagggagcugguggcucuucaaagucacacagcugauuaccagaaagguucucucucucaguggagguugccacaucccuuggaaccccccccccccacaaugcaucuucauagaggacacagcacccaguagcagcuagguguuggauugaguaaauggugacccaagagaaaccaaaauggcggcuacuaaggcagggcucccuggggaaaaccucuggcgagguagaagacaaggugggaauucacugaugagaaaaacagugagcucuaggucaauuacugacaauuuaccuagggcagaugaggagauguugucuaauugcggcuucacauaacacucauaaaaacuagugauauuguuggaagcaaguugagcccugaaaagagaaagcugaagguggcacagaucugugacauccagacacauucuccgggggaaagguuacaaaguuacugggcuagugacuagucaugagucauccccagaguaaacagauaacaggcaagaagguuacauggugacaauucagagaccgcugaacugugaagauuauguggggccucucaggcuaagcacuuucagaaugucgggaagccaugguaacccucacaaacauuccacaggcagugauugugaccgccagucucucuucccccacucccaguuuggaauguacuuugaaacagugggaccauguuuucuucuuaacuccucccaucaucuguuccagaaucuucaacaacuaccuccuugaauucacaggauuaccugggauuuaggaagucaugguaugcuucaugaugaaacucugaauuggaggucaucuaaaaagaguuauucccuuguggcuacaucuccaagucuguuaaaggcuaaucccaagccuacaugaaaagagauuuauaguacagaaaacugugcauuuaacuccccacuccauaacuauggcguucuuacccacagacccaaucaaccaauacaacagaauguauuuggacaaagcauugcagccacggugaacauguauaauuuuuugggggggucaugaucccauaaaccaugaaguacaacaacagaauaguauuugcacugugugaagcuugauagggucuagagacccuuuagcacaugugagaagauguaaugaaucauaagaaaacacuaagccauuuuauguaagagacuuaagcagcuauggacucugcuaucuacuagagcagggguuccuggaacuaaucuccaggaaggugcgggauaauuaaacugcacaugagucaggauuggaaaaugcuugguuaggaaauucuuagagccucccagcuauguucacgaaaauguaucauggugccuuucuuugggcuggcucagauggaguuccauugcguaccucuuuaucuuccuagagaagugggggagcugaguauaugcuuucagggggacuaaggaguaugagacccucugcaugucccaaacauucacucccaagccaaccguugcuccuucuacacgcuuucuucauucacuuugcugaguucugauacccaugugucucccacaagcuucuauuccauccgggacuuguacccuuccaaccuuguucacagaacucucgggccaaacuuucugaagaucuuauguguaucacccccaggugugauucuuaacacacaucuguaugguuaccuccuggcucaagauuuucaugaucugaccuaggcccaugguuauggccuagcuuagugacauuuguccucccgcaaguaucuuaggcucucggcaggacacacaccccgccaaguccuuucucauuuccaucuuacuacacccacacuuuccucuacauggggagcuaggacagacauucaaacucacucagaaggagaccauauuaacccauauacaguaaaugccagcucuaguuucaacucugaggcuuugucccccagggugaacuaccggggacuggugagaucuuuuggggacuacugggagguccuuaugucauugaagcuauguccuugaaggagaucguaggaaccuaguccuccggccuccuaaccaucaggugggcagauuagcucugcuuccugcuucagucauguauugcuuuaacccaggcacaaagcacaggugccaaucaaucaugcaauagaaacucuaaaacccugagccauaaagagagcucuucucucuucaaggugguuaucccaggucuuguaacagaaagguaacacaagacucaaacacaaaguagcucagaguguaaaacacauccaagccagaggcuccucuauccugcucugaguuucccuuaaaccauguguggagcuuuuuuccagagaugggagacaguaguuguaacuuuacauuuucuuaguguccuguugucuuagucaggguuucuauuccugcacaaacaucaugaccaagaagcaaguuggggaggaaaggguuuauucggcuuacacuuccauacugcuguucaucaccaaggaagucaggacuggaacucaagcaggucagggagcaggagcugaugcagaggccauagagggauguucuuuacuggcuugcuucaccuggcuugcucagccugcucucuuauagaacccaagacuaccagcccagagauggucccacccacaaggggccuuucccccuugaucacuaauugagaaaaugccuuacaguuggaucucauggaggcauuuccucaacugaagcuccuuucucugugauaacuccagcugugucaaguugacacaaaacuagccaguacaccuguauuggugacagucucuguugugugccuucccacacaggcugggcucugaauguggcuuucuucacuuguccucucuagucuuuuccugcucgucacauucuaggggugacucuguguuuguaggcuuucccacccuguccuuugcucuccucacauuaaacagucagaguaaaccacuggcuucugccagucuccucacagaacacuggcuuuuauucgacuuuaucaucccagcaccuagcucagugccuucuauaucacaggcauuccauaaauuagggaauuagggaaugauuaagcauuggcuggauauauuuuuaaaaauacgauaugaaagaugaggcauaguaaguacuauaugaaaaaugaacuagaaaacuuucaaaaaauuuugacuaagacucacaguaagauacaucauacugcaauguagcacacacacacacacacacacacacacacacacacacacacacacacacagguugagaagcugaggagaaagggcuuaucuuugcuaugugagauaaagugugguuuuuuuaaauuuaauuuugcuccauuucaguuuucaauuaacuucucauuauagaguguuaaaaugauuucauagcuuacaagccaauucaaccuacagcuuagaaagcauuggcuuggaagccuuggugagucccccccaucauagagaacucacccaccccagccucauuaguagcaucuuaauggugauguguuuaaugagaguuggugucguugccaaaaacaaaacaaaacacaacaaaccaaagcaaacaucaaccacagaggcaguugcuauccuaaggauuucauagguuguacucagugcuagccuuuucuuuuuaaagguucagccugauuuaggaaugaucuaauuuuagaccuuacaaagcaagcugcuaaaaugagugguuuuuagaguuccuguucaucagaguuugugccuggaaacccuaggucucuguguuggccagguacagugggcuccagccuggagaagccagcucaucauggaugcuugccugggccuugcucgcuguaccccacugucacagcagccccuccuugccaaugcuugguuuuguuccuugcuugaccagcagagaacaugggccugucugccugcauugccagggccuuaaacuccacuuacaacucaaggguccuucaacaguucuaacuccaucccagucuacaggccugacugacacaaaauuguacgguucauggcugaguuauauguuacauaacagaacauagaacacauaaacaacuccaauuuucucuuuggagucacuaccugucugucauucucuugauaucuaaauugccaaguuacagggcagaaaacagccagagguguguguguguguguauauauauauauauauauauauauauauauauauacauauauauauauauauauauauauaugccauuuugaaucaaaucuauaaacucuacaaggucuugagagggaacuggaaagaguacagcauaggugcguagaccuaugaccaggcagggauuuagucuuugucucuaaaggagccuuggcaagcuguaucaaccaucuagcugccaauuuaucgcccacgauuaguuuacugaccuacaauaggccagacacaacugcagugaaggacgggggaaaauaggcuuguguucaugcucuagcaggagaaacagaaaagagucagauaagcuagguguguaucaaaacauagaagauaugcuaaacacaagaguccccaagggugugugcagggcagcuaacacaagugugugugugugcaugcaggcaugcgugcgugccugcauuuagugguguacccacaccaugggaggggagcucaggaagagguggcguuuuaggugaagaggggugaauugaaauaaagggugcauccagugagaggaugguccuguggaaaaucccaauguacuggcugguuuuaucugccaacuugaugaaagcuagaggcaucagagaggaaggagccucaguugaggaaaugcuuccaugagauucagcugaaaggcauuuucuugaucccugaucaauggggggcugggggugggcagggaggguccagccuauuguggauggugccaucccugggcugguagaucugaacuguauaagaaagcaggcugagcaagcuauggggagcaagccaguaagcagcaccucuccauggccucugcaucagccccugccuucagguuccugccuugcuggaguuccuguccugacuuccuccaaugauggacuaugaucuggaaguguaaaccaaacaaacacuuuccucucaacuuccuuuuuggucacaguguuuuaucgaagcaauuagaaacccuaagacagcugggcagugguggugcacgccuuuaaucccagcacuugggaggcacaggcaggcagauuucugaguuagaggccagccuggucuacagagugaguuccaggacagucaggacugcacagagaaacccugucuugaaaaaccaaccagccaaccaaccaaccaaccaacuaaccaaguaaccagccaaccaaccaaccaaccaacuaaccagccaaccaaccaaccaacuaaccaaccaaccaaacaaaagaaacccuaagacacugaagaugauaaagaggugacuuucucccagagacagagguagagcucagugacugucaacaguggcugucucagccccuugucaccuccccucagcucauggcaaaacaguaggcaauguuuuggcacauaaacccugauuguuuuauuaaaucuuuugaaagacuuuuuuauauucaugaguguuuugccuguguguauguauguauguauguacguauguauguauaccacaugugugccuggugcccauggagaucagaagaggauguuagauucccuaaaacuggagguaaggacuguugugagccaucaaaagguuacugggacuggaguuacaaggaguuguggaccaccaugcgggugcugggaaugaauugaaccugguccucugcaagaacaaugagugaccuuaaccacugaagcaucucuccggcucugacacgaagauuuuuuuaaugguuaauucgagggauauggcuggguaguaagcaauugcuuagccaugcacuaccccagguccagucccuagaaucacccucuaaauuauuaucaucauuugucagagaugaggauugacggaagaccuuguaucguuaucaccgaauuauagcccagccuuuaaaauuauuguguuuaacuguggucaaaaucugcauggccaaguuugucaucugaaccgcgcugagguggauagaucugcggcagugucuucaccagagccacgaaacugucaucacaauccauuuccugaauguuuuccccauccccggcugaaacuugcagccucucccuuuagccgaucgccaccccuuuccuuucugucucuaugagucagaggaguuaaaguagcccuacgucaccugguaccaugccuuccagguucaucuaugaagcagcuggcuccagaaccuucugccugccuaaggccgaauaaugcucugcuucugaguaugcugacuuggguugucuguuuaccucacugcuggcugcuggcugcugucccccugggagcucccugcuuggcugcuguggcuaaugcugccaggaggucaguuguccaagaaucucucucuucaggcccuucuuccaguuccucaggcgccacauccagaagcaggagaagaaccuuaggagcaguguccacucugcucacagacccuguucaucauggcuccaaugacucucgauuuccaucucugcuguguuucuuagccagcacggggccugcaacuacaucuccuaucuggaugcuguguaaggugcaagugggguccauacuaggcuccuuggauaggcaaacccgggcagggcuggugcagauggggguggugaggagugugcagggaagugugugucccuccccuccuguugucacacauuucuacacagugugugccucugauuuuguugaaaaggacaauucugcuccugaaauaaaaauagaucuaaucuauucccccaugggaaaaacagaaacccacagaguaaacggccugccagacauccuggggucagaagugguucggccaggacagaauccaggcucccugucucaagugagcacugcugucaccaagccaggugucagagaugacagaagcaucuuccucuguuucucagcucccccuucuucuugucucccuccuucuuagagcaggaggaagaauggacccuugcaaggacacagcuaccgcccaggggugccuggcgagacagauucugcaaauguuugucagcucagagccaggucuagaauguggccucucuggagcucgcuuguuggcucccccagaugcaucauggaaggaguuccgcaugcucugagacaguuucuucccaggaggggaucagcuuacugguguggacaagaucauguguguguuugugcgcgcgcgcgcgcgugugcgcgugugcgcgugcgcgugcagagaccaaggcaguaagagacccaacuaagacuacccacagauuucuaggcuaagcaaucugaugcgcugguaacaguaucuggcacacaggaguaguuauggcaguggguuuuauuacugaggcaaagacacggggggggggggggcgaagaagaggggcagcaagagguagagaauaauuuugguuuugaagccuccucaauuugacaaaaggcugagcuuagagaaugugccuggcagcaggcacagggagggcacugagacaucacgcugaaggagcugcaguguggcucagcccgccaaccaggucccccagcucagcuccuugcuguccccauacgucaucugggccucauccucguuugggggugggguggagggggaagagagguuucuuugcagauauguaugauuaaguaacagagaaaggcccuugacccuccaaggccugcaaugauaccacacucugucuccuucugaacacaccugaccuugaagucaccccagcugggcugauuuacgacauguuaaugugacuguuucaaacuccauuuuucugucugcuuucuggauggagauggacaagagcgaggucggggaggaagggccuuauuccugacaaggcuggcugcugugguggcaggucccagcacccugcuccccucugcacugucucuguccuuugggugcaagggagcgauagugaggguacuccucccacaccuuuguguuaacagcguaaauaaccacgccagguaacugucuguguuugccccagccccucccugcuguguucuguuucaauagcagaaacuaaaggaaaccaggcuucugugaccacugagugcugccaauuggccuuugggaaggcagcucuagucauuuugggguguguaugugaguguguccugggccaagacuagcgaagccugagaagauacucguguuaaaggccacaagcuuaggcaaagcuugcaacugaaaggcaaaaauaaguagcccuguaagagacaaaguagcagugaacauggggcagugguguggaggcaggcauuaagaggcccuagggacaugcugcccaggguggcggccuugcuguggagauaggcugacuguuuucagcugguugguucucagaugccuagcugccaugggaaggcuguguacuggcuuccuccugagcccuugugccgaaacuggcagggaaauucaagcuggcuuauuaccucaucgacuuuccccucucugcccccggggagagucuaguguggaaagcagcaggaccuuuuccaacacaaauaaaccaucaucucgggagugaccaugaugcuagagauggggauaggguuucacugagaaugcaggacuuccccagggucaccccccucccccaucaaggaugcaggccaaucugaggccugaaagauggagacguccucugaaaaucagguuuggugacucuguccacauaauggcucugauucacaggagcagcgcuguuuucuguggacccuugucuaguuguggcgguugcugggaaagaugaaguccccagacuggagcucaggcugcaaagaggcuggcaugguagguaaucuccuagaugccuugguauucuugagccuagauuuauuuuugagacuuaccuaaagcccacauucauauauuacuacaaagaacaaugguacauggaaacaugggacugacugcagcgugugcguaagaacacuuugucauuaguggggccagcgagucaaaccauccaucccuccauccugggcacucaugcugcucugagcauguccuaagauugggcaagauguugagugcgaagcaaaauguucccugugcagggcccccugagacuaucuugacuagcaauuauuauaagaugauuauaagaucaucagcugauuauacaugcaauuauagguagauaacuauggauauaauucauguaguguuuacacuuuuuaaaaagcagcguaacucacauuguaccauuugcuuuccacaacagcccuggcagugucaaggcaucuuuaaacacacucgugagcacacugagguccagaaaacaaagccaugggccgaaacccaggaccaaaauuccaauccuggccugguucuaugauucuauucugucuucuauggcuugagcccugccaaaaucauguacucaccaaagggauauucauuuguuucuuugugugguucauggauaguuccugaacuuugggcaccaucucuuucuuggguggaguagagagaaacauaaaagaaucucacucuucugucucuggauggggaagccuggcaguuuggguuugauaacuugcuuacuuauuucugccuuggccaugcuucccaaaccuguuugaacccaauguucugagaugacaauuuucacucuugcuguaccuggaacagccccaaaagcucauuuuggugucuuauuagaaugauuaauaauacucauuuuugugugugcuugcaugcuuaaaaaguauccuggcuugggugauagaccacaugaucaccuuccagggacacccagcacaaggcugcaauucccaacugagagcugugcacaagagagcaacuccagaagccaagggugcacagugagauuaaguaccuaagacaaggugcaucuagaaagcagaccucaauuuuaaaagcccuguaauuacacaguaugcagaaagcgccacgagugaagcuuuccagaagcagagcucaccaaauaaccaucugugcuuuagugucgccagacuuccuuucagaacagaucaggucaugugacuaguuggguccuuguaauggcagaagcgagaugccccuucuaggccaaggcaagaucugcugcccucugacuucuaccuguugcugagaugacuucugucgccaaggcaccuggauaccgagccacuccuugacaaaagcccucuccagccugcguggaccucgcgugagagaagucuagguggcugugggcagcccacaggcuuccguugccgcugcguuacagcuugucgucuuaaucuugaaaugagaccugguucacuugaucucauuaauaaaaggucugugcucccccuagucaua

SEQ ID NO: 7594 - RNA, 9543 nt, Mus musculus
gguuuauaguguuuugucguguuugguuuuauuuauuauaaaaggacucagcagauccgaaggcuguccaccagcagaggugaugucuacauuauaagucaucugucacagccccugcacgggauggugcugcuggucugaaaggaugucccaggagcaugcaggagggcucggccagggaucccaaagccgcugucuuuuaucuucugauuaauuuucucauccugguuuaugugcucuggguuuuaacacucucuguguccaucaauggcagcucuguuaaugugaagagaaagcaaagccaguccauuugaaaucaacgucuccugggucucacugagugcucuccccuccccccaccagaguugaaaaugcucgcaaccuugagauugaaaauugaaugaaauugccuuuaaaaaaaaucauugagaaacaucuggcagcuaaaauuaaaggucauagaaguuuuggaaguugcaccugucuguuucccucuggggaucuccguuggcucuuacacacaggucaccagggcccaauuauggaugcucuuagcacaggcaaugucagcugcaauucugaccuggccugcauguuucccugccuuucugcaaagugucuaguuacucuugcgcuugggcggcuggcuuaagauaggacugacaacaaggagcuuuguuugagcucuggauucuugccggacccuagaauccacugggaaauggacagauagagagaaagaagauggaagauggacagauggacagacggacgaaacgcucucagaccagcagcaccugcaugccugugcgcgcgcacucacacacacuuuaaagacauggauagaggggccuagagacucugagcacuugaucaagacuccagcugcuuauccauagacucaagaucagaaacuaguuuucauaaguccuagccucaugaucuuuucccacaucuacacuacgcuguuuggaaggcauuuaaauacgccaguucuuugagaagccgagaacaaaggaaggcggcuuugcaugguguuugauuuuaaguggugcccacagcgaacaucaaagagaaacuuuugcuuggagagccucuccacacuuccuguccuccacugaauauagcccaaacuauacugcaugaaucugggggagucaggacagccgccuagcugcaaucugcauugcugagagccuacuccccuccaaagcagggauuugcuccagggggcauuagaacuuaauaacaaaaacagacucauugucuucaaaaaggagcucucgguucucagacacccccuuacaaaaaugcaaaaguggcagagcaggagagaucuaagcacacaguacuauggaacccacaggguuccuuacggcucacuuccuaaacaagcccaaccuuggccaggcuuugacuguggcuuuuccagcccggagcuucagaagcuaagcauggcaucuguaguuucagcagucaccccucaugucagcuccaugaacacagguuugcucuuguugcaccccaagugcaggacacccagacacuacguagcuuugagaacaauccggcguguaggcugaagccaauaaucuuucuugucuauaccaacuuuccccauuuuaaaagguguauagaauuuggagauuguugucuugaucucauuugagaaacagugcuagugagugucagagagccugaguuucacaauucuccugcuuuucuguguucuccuggcagacuagcagauguccuaauacuuaacagacacaccuugagggaccauaugagaaaaggcauggaaagaugguagguggcuacuguuuguuucuucacuugaacaguuuucuuaagaucaguuauguggccacaggcagagaugacucagagagcacuggccccucuuccagaagaccuggguucuguucccaacaccaacaugguggcucaaaagccccuggaacuccagcuccuagaguauaugccuucucugacacccacacacuuaugcacacaacaacacagggacagacagacagccaaugcauacguauacaugauuuaaaaucaaauacuuuuuuucuuaagaaagaaaagaacagccagcaaccgaguggugguggcacacaccuuuaguagcagcacugggguggggggcugggguggcaaaggcaaguggaucucuguauguuugaggccagcuuggucuacauagcaaguucuaggacagccagggcuauaugggauaaaccuugucuugaaagaaggaaggaagagaaaggaaggaagggagggagggagggagggagggagggagggagggagggagggaggaaggaaggaaggaaggaaggaaggaaggaaggaaggaaggaaggaaggaaggagcaauuguguaagaugguuuuauuuuacucaugcuauuuuauaugaaguugacugugguguucagacucagcugugauaccaaaacagcauggucuacuggacccuucugcugguugaguccuuucccucaaacaggcauugcaaucucguaaagauuucacugaaucuccagcagcaagcccuuccuggaaaaaggccaaagaucuucccagauguuaaacugacuuacacuaucccuaaagcucaugcugcaucagcguaaaagccucuggcuaaggccccucccagaguacagcccaauuaaaaaccacagaugcuuggccugacaucaaugcaaaaaucagaaaagccacaaguagcaacauagguaaagagcuuacaucuuaaguauaugcaugaauuuacugagucuuaauacauaaggggucaagagcgauggcaucauauuuaucuuaccaaagagaacaauaagaaaaggaaaagcauuaaagaucuagagauaggacccagcuugugccaccuggaucaucuugagugccacacuuagcugaaaucugauuaaaacaagacauuaucuauguuaguugaugugguccuguaagucaagcuuuggggguguuuuaguuaggguuuccauuguugugaacaggcaccauaacugagacaacccucauaaaggacaacguuuaauugaggcuagcuuacagguucagagguucagucaauuaucaucaagguaggaagcauggcagcauccagacaggcauggcacuagaggagcugagaguucuacaucucauguuccgaagucaaacagaagaggacuagcucccacacuagcuaggaggaggguuucaaagcccaccccacaguagcacacuuccuccaacaaggucauaccuacuccaacaaggugacacuuccuaauagugccacucccugggccaagcauauucaaaucaccacagagauagaaauacuguaaguucaaagucugccuaggcuaccaagugaguugaaggccagccugugcaaaauaagugagaccuugucucaagacuaaaaauaaaaauaagagggcaagcaaaauguuuguacuagugcaaaagugguaagccugccaugcauggggguaacugccuccugacaggauuugaggccggcugcacaguggccaauccaugccugguacuguuaaccuaguuagaaguccuugacuggggaagccauagacccugagggaggggaacugacuacuguuguuuuguuaaguguacauacagucaaauguuuaugcuuaugcccauagauuagggaugcugucagcucuggucagaaaagguucuguugcuguagguaacagguaacuauugacgcagacucgaggcugagauuaaguggcucccaaggguuuaguccuaagcgggacaucuagaucccauguuugggaaacagaagaacaugaaacaggccaaagauaagaggaaagggaugggaaggagcacuaugaaacagugacuuuugggcaucacaugaauauuguaacagacugaaucccucaggacauggcuugguggaacuccugggagccccccaggaccucugaaucauugaugguuccugggagagggaagaaucuccuugccagugacacaguccugguaaguugcccuuucugagguaaauaaccucucacacauguucaugcaaguacacauguacacaccgaagacacauguacacaccaaagacacauguacacauguacacaccgaagacaagaggaggaggaagacuugcucagaaggagugacucaugauggggacaagauaagagagaugagggggagacacacaauaaacggacauuauguaaaccugugaagaauaaauaauauuaaaugaaauaaauauaaauaaaugggucaaaaauauagcucauuagaaaaauguuugccuagcuugcaccaagaccuaaguucaagguuuaacacugaugacaaaggugaauacuugagaauacaaucauuuccacauccucuugaugaacacugaaauggccaaggauguuucauuugacauagaaagaacagcugacgcagccuggaauuugcuagaucagaucuccucagagaaacuugaguucagaaucugacagugugacuuugaacaaauuaccuauguaaccucaacaucagcuucuuucuauguccaauaagggcgaagaaaacagugcuguuuaaaagucacagugaagccgggugguaguggugcacgccuuuaaucccagcacuugggaggcagaggcaggcagauuuccgaguucgaggccagccuggucuacaaagugaguuucaggacagccagggcucuacagagaaacccugucuugaaaaaaaaaaaaaaaagaaagucacaucgagugccugccagccuccgugucaucaacuaagcuagauaaauaggauagcaauagcaagaagcauuccucuaacugugacugugaccuucgcucuucugaaaacacacccuugacuugugcaaacacuuggcuuccucucuuccauguauaagagaugagcugccaauauuucucaaccucgucugaacaauuuuucaguagaaaaauuuguagaaaccaaauuugcuguauucacucguccacagcuuucaaugguccaaacuaaacauuccuauuuaauacaggguuuucuuucccaacaacucaggauacacacacacacacacacacacacacacacacacacagagagagagagagagagagagagagagagagagaguugcuuaccucagcaauucauuucucauuuugguuugggccacagccaguugguaaaagguuucagcguguguguuuaccgccucuuuguucucaggcauuucuggggccuccuggcagcucucuggucugcagcaaagccuuccaggguugcaaaguccagacagaucccaggcucugacacugccuugggcugacagagaacagcuggaagucguucaucuccuaagccaaacucaugcccagaucucuaggcaaguuugaggcaggagcugagccucuggccccaggagcuagcuuuacuagagcuguuuaacaaucauugcacacuagcuucuggacucucaauucuccucaucuccaacaagaagucagaggacuauaguugggcugcuguguguaugcccaucauauuugcuuuucaguaauaaugcuacacauuccaacuuccaggaggcccgggcaucucuuucugcauucaucacccgagucugagccuccaguccugaucccaguuaaggguccuacugugauugaacuugagcuuagagccugcuccccaagucggguucagccacccaucaucaauaaaccaaguaaaagagccaaauuaauaguggagagagagcaaaaagugggauauuuucuccauauggccaauuugggaaaggaacagagauucagugaugcgccaagucugucuuuggaguccugaagucagauucaaguuuaaagaggguuaaggacagucacacuuaagucgucggaucaagguguggucuuacccgccgcugacccaucccugucugagccuccacuggugaucugacauguuguuaaaauugaaugaaaucucuuguucacaguugaacuuuuccuuccgguaggagauuccuggggaaauucucauuuauuaggggcccauuguuguuuaauagucugauggauugagagacgcuguguuucuuuagaaauucuucggcugcacuucucuaagccuggacguaagaaaaucaauuccauccgagcugaaguccucuccagcccucucaucucccugccgccauuauagcauugaaauacauaccuacauuuaaaugcauacuguggcaaagauaauucaaagauuguaugacucuacagucaaagauaccaccauuagccuucaacugaccaggauccaaaacugaucuggccguugucugguguucugggaucuugaaccaagucuaucaucucccuuugccucagcuccccuaauguaaagcaaggauuuagacaccuagagcuggcauagacagagggaguggcuaggaaaggccuaguccacgcugguggucaguaucgaaagucuaaauacaaauucugcuagacucuguucuccucaguacacucuggguuuguuucagccauugggaacugggggguggggugagucuggaggauagcaaugagacaagaguagaguccuugcgugauuuaagugguucucuccacucucaguuuucauuggaagcaaacgucuuuaucuacacagugagacucuuuuuauuuaaaugcuccaacaucaguguaugucacccugucguggggauuaccuaaaauguucuuccaguaaggggcugucacuguauccuauaagaagacacagaagauuucugaaauccacuggacuccucgcacauggcaaugaacguauuuucccaguuucccuguggcccgagcuugaccucuguuuggcacccuuugcuccaaccaggagacgaugagcuacgaaaucucaccauugcuuccugagagaggaaagagaucaugucacaucauacuaggaggaaacgucugacagguaaaguacacaaguccccccuagccauucucugucauuccucuccaugagaaaaacaaacaaacaaacaaacaaacacuaaaaucuaucagggauuuuggggugaaggguggguagaacuacugccuaauuucacucaucaacaaagaaacaacccugaagaaauguccugaaagaaguggcuucuucuucuucuucuucuucuucuucuucuucuucuucuucuucuucuucuucuucuucuuuuuuucaagacaggguuucucuguguagcccuggcugaccuggaacucacucuguagaccaggcuggccucgaacucagaaauccgccugucucugccucccaagugcugggacuaaaggugugagcuaccauugcccggcuacaagaagugguuucuuuuguaccaccaaugacaccgucucagagcucuauggaauagcaccuucuuccaaacuauugccaacuuaccuugaggccaaaaccaggcaggauguccuguacacgcugauagaaacugcacaccauagccuuggccacugaugcaucugacuauugacaauuccacauuuuauguaagaaaucugagaugcucugucagacgccaacaaguuccucaguagaaaagacagaaaguuagccaccuuacuuaucuaucgcccucgugaucuggaggauccauaaugacuucaagaauguaacacauccaguccucaaagaacccugguggguggucaggguccuaggagaacacagcagaggucuaagaugaauauuaaagugaacaguauauuuagucagcaaaaucccucugggcauagcuggcaaccagacuucuacacugaagucuacacuuucugucacgaugacaacuacagaaauguucacacgagaaagugaaaggcucaaaaugccuuuguaaaaacuguucaguugugaauucuucaaaccuccuccaaaguccacaaauaguugagugguggcuuccugguuccaguuuguccuuccucgcucuuauugaauaaauccaucaaacgcccacccugcucugggaaagcaucccugcacaaacaauagaccaggcagagucuuuguaacacaaacccagccugcccagaagggaaaaagccaauugaaagacacaaugcagggggugaucuggcagggacaauagagcaucccgcucuugccuugaauuccccugguuuugaugucagugcccaggcccugggcuccuuccucaguaaaaugcauagaucugaaucuucgagagguugguggaaagagaaagcaugacccugagacaacuucugggccagcgaggggccagcugucacugcacagcugugcucuaugagguuacccugugagcacaaacccuucuaggacagcacccuggggacagcccuggcagaacuaagacaugaagacucagagaauuuggccugggucuuugauuugcagaacuggauauugaaucuugggacuccugugugccagcaagaacucugucauuaaacuaucauaucccagcucuuuuuuacuuuuuuauuuugagggauugucucacuaaauugcccaggcuggcucuaaacuuccccuauagcccaggaaggucuugaacuuucauccuccugcuucagccucccaaggcguaugguuacaggccucccacguucagcagccuuaccugguuauuaagcgguaggaaaaccuccaaaggaggucugguggcaguagaaagcaucuugcaguuuuggaaguuuguguauuuuuucccaagugauugcaauaguaugaccucauccaucucccucucccuuacgcuccaccuaugugcucucaaagaaagacagccauuacuccaguggugggccuggggagucggcagugaaucccaccaggcugagaugucagaccaucuccacuacugccacucaacuugucuggauagggugaccagaggcaugaggcuagccauggccugcaccacaucuacagcuuccugggauucaggaucuaccugaggcagacuaugcuaauugacccagagagccaggucccucccccuucucacuccuacuuccaacuacagaggcuacagcuuaaugguuccuuucuugaggcuaggugaugacaggugaacccuuauucugccuaugaaaugggaucagaagucucccaaaggcuuuccugagagaacaagacgaucuuagcugccacaccccuucuguuucuacccucaguuucugucuugacugugcccugggugcacaacucucuuacaaagggggaaaugugacuuggggcucacugacuucauagccccugcucccaacucugacuuuccacacagacaacaaucaacagaaagaaaugugaggcaguacauaauagagaccagagcacugggcucagcugcucuugcugcauucuagugguccagccuggccucagcucaucaauccccucgagucuucuucucauuugugaucacgacuug

SEQ ID NO: 7595 - RNA, 12707 nt, Mus musculus
gagucgccacggcccgcggggagaggggacgcuucuucccuucccuuccgggcgccucacgggacgcgcucgcccgcggcucuccgggcccccgcgccucagcgcccgggccucaggcggccuccacggugacugcgggcgcugacccggaacugcugagcggcgcgggaaucccccgcaaggggcucggccuugcgucuccagggcgccaccucgcggccguggcgggaacacccaaacccgggcgcacgcccgcgggagcccgaggccgccgggaggcccggggacgcggugaggcgggcggaccggccggccggugacuuugggagccacugggguucgagcgccgagccugcagcucacgccccagcucgcggccgccgaggagagcgcgggaagcagcccugcggugagucccgggcggaggggaggucggcgcggcgacgggacggacggacgcacaccgugcaguccaggcuccuccgaggucgccugcacggcuggcggaaagaaugaaugaaggcgccagugcccuacggggcgggcggagguuggggugggcgucggggugaaggcucagcaaugguaggugucagaauugggggucacagggucggcagaggggagcuccagccuggacagggaguucagagaaucugcaaguggucagaaaucgacccugauccaaguugcaguggcuuuugggauuaucccaagugcggaggacuguguaaaccuggggggaaagcccagccugugggcuagcuuuuaccuuuaaaaaaugaguguguuuguuuguuugcuugcuuauggugacagacaccuuuacucuucucucucucucucucucucucucucucucucucucucucucucucuuucuuucuuucuggugacauacaccuuuaaucccagcacuugggaggcagaggcagaggcaagcaggugucugaggucgaagccagccuggucuacauagcuaguuccaggacugcuggggcuguuagacagagaagcucugccucgaaucccugucccaaccgcaaccccaaagaagauuggcugcugauacugcucaacuuaauauccuaaaggugagaccucaguauuucaugagaugugaucuaaucuuauagacaugauggggauaaugacauaacagauuuacauccuauaauuaaaaagacuugaucucagacaacaaguaauuuuguacuuaaaaucugcuauaaggaaaacaaagcauaauuucuauucuauaaaaauguacccagcuguucacaaaauaaaagauggcucugcccuuaauugucaggaugaauggugcacuggcuuuucugcucugcacacuacauuuauuuugguuacuuuuuguauugaugcaauuuacuuccuauuuuuauuuuuauauuuauuuauuuauuuuuguucaccacaaauuucgguuguaucuauaagaagaucgaauuuauuguuauuugugaucacuuuucuuuacagcugcuauggcauaaaaagucuuuggggcaaaaaagacugccugauugaagaauggcagaagcagucuugauugaucucucugguuuacaauugaaugcacagaaaaacugccaugagaccuuacuggagacacuggaugguauucacuaccaccacgcucccaaggccaaguuccuuugcauaauauguugcagaaaugccagcaaggaaaaggauggggaguauggccucugugaauuggaagcaggaaauggcuuuucacgucucgcgggaaaauucgagacuguuagccaucccugccuggcugccucuuuguauacaauuaaacaaaaaauugaugaagaaaaucugagcugcauuaaggugauuguccccgagcacaggaaacuguuaaugaaggcuuacguuggucaacucuucaccgagguguaugaguuugaguuugaagaucuacagggagcuuggagggauagccuuuugaaaccauccacuggaauaaacgugaccacaacucaagaacuagaagacauccagcaugaaauagaaacauacuugagaagccugccagcgcugaaaggggaccuaacuauugucacaucuccucugaucccagguaccuuccacacuguccucuguauugcacugaaaacccagacuuucuucagaaguuccucacuucccuuucuuuucucucuguugacucuugugaacuguucauguuucgcaacauggggaguuuaggaccugugggucagcggcuucaaaggaugacuucaucagagcuguuccuaaaaaacaaaucugcacuaugcaaauucagcucuaaggcaaaucucccaacacuccuaaaaaaguucuuuuuuucugaccuggaaaaucuuuuacguagacaugcugaaaccccaacucucugggcauuuuaauagaagaguaaacuuucaaauaauccuccuuggauaaguaggauuaauugugagcuguauguuacuucuaccagaugaaaugaaaguacccugggaagagagcagcagucccacggggagguaaaacacacaguacugugugacaucacacggagguacaaagagcagccagaguuagaaacaagaucaauuauugcaggcuggggugaccagggaggccugauggagaggcugucuuuuguaugcuguuuagccuuuuguagaacauccuuugacuugcucccacuuauccucaauagacaacuuccugcauggauuuaccacacggacagggggcauaucuuccguacccacucucagcucccucaaucuuuucaguaguuccaaaaggagagaucccaaagugguuguucaagaaaauguucgcagguuggcaaaugcugccggauuuaacgcagagaaauuuuaccgaauaaagguagauuuuuguuaucuauuuuggucuuguucucaguauauuuauauaacccuuaagcuauuuaacuuuuguuucuggugcuucgucuaacauuuacgaugaugcugaaauuacuuuuucucuauaugugugugcucauucauguguguuuguguuucaucuagaccgccucaauucuagaaguaugguuaacuuuugagagaguauaagaccacucagacccuuucaauauagaaggucccugagugaucagggaaaaguuuggagccucacuucuuaagugacaagcaggaggacuagggccuaagagaggagaaaucuguuaaauaagaacucuagauagaagugagucuaauaaaaggggggaaaucacucacuugguacuuucacauuucugcaaagaaagugaaacuugccuuuugggagaaguacucagagcgaagaugugcauaucucugaugggggauggucaggacuucugagucuacuucccuaggaaccacaucugcagauguuguuauauuugucauuuuaucacuuauggaagcgaaugaucauauccugauuaccucauuuugugaccaguucuuguagaaaagcucgcauguaagauguuucguuuuccagacauuuugcucuguguuucguguuagacugaucacgccagugaaguguggguuauggggaagaaggagccugaaucuuacgaugggaucgucacaaaucagagaggagucacaaucacugcucuuggcgccgacuguauacccaucgucuucgcagauccugugaaaaaggcaugugggguugcucacuccgguagguguguuaaucacuuaagguuuucugaauuugcaauacagggugguuaucucauuggcauagauguaaauugcauugcuuugugguaggaugaggccuacauaaucugacuacugaaacagauacaaggaauauacaacucaaauuagacggaucagacuagaauucccuaagagggugguaucuugugauauucaacaaucuguagguuuaagauugucaauauuucuaagcaaagcuauagaauuaacauuuagggcaagacaauccugaagugcaaacuaaauuaucuuuaguccuugcaguuuuuaaugugcauaauaaccauaguuauuguaauaaccaaauagcaacucuucaaguuuuucaggauacucugggcaccagggaauaaggaauguuuggcauguuauagaagggaguucacagaggcagagcagcaugaguaaaagcagucagaggaaagcaaaacaaaaccaagaccaugagacaugcuuaucucuauccaugaguggagaaauagacuagagagcccacacgcuucagauaacuucacugcaguugaaagcuuuucaacaaagaugccaaaccaguuauucaaugaggaaagaaugguccguuccagcaguggagcggggagaagcagacauccacgugcaagagaaggaucuggcccuuaccagagcacuguguauuuaaaaagucggucagaauggacaaggacuuaaguuguaagaggcaaaauuauaaaaccaacauuguaaguauuugagucuuuggauuagguaauagaguuuuucggucuccaaagcaggaaaaaaaaaaaaccaaacaaacaacaacaacaacaaaaaacaaaaucaacccccaccccacaaaaaaaaaaagcaucaaaggaguccagaggcagaauuuuuuuugcaaaauccaacaccugaaauuauaguaaaacaacggcuggauuuuaaaguggguaaagggguugggguguaacuccacugguauagugcucacuuggcaagcaugacagggucuguuccguaucuugcaucaauagacugggugugguggcacaaaccuauaaucccagcacucaggaguuugaggcaggaagguccgaaguuaaggaauagaauuuuuccccuaaaaugauuugcaaauggcgaagaagcauaagaaaaguuaaucgacaccauucauaaugaaagaaaaugcaaaucaaaaccaccaucucaucauucauccauuaguguggucuagaagacaaaacaccucucaggaggugagugugaccgaaguggggagucgcucuagagagacauucuggguacagugacacuucagucucagcucuugggggacagaggcaagcagaucucugaguuugaucuacagaguggauucuggcuacauagugagacccugccuccaacacaacaacaaaaacuguccauuccuuagcaagcucaaaauagaguugccauuggagcuagcgauucugggucuguguccaagagaacucaugucugcguguauagcacccugauuuauacggucugcaaagaagaaacaacuugaaugcccagugacaaacgaguaaguagcaaaaugugauguguuauaugggauacgauguuuuaccuuaaaaggacaguacauucugacacacgcugcaacacagaugaaccuucugguguucauacucggcgcaguaaggcagucgcagaaagacaaauucaauaggauacccuucccaccaucaaauccauaaacaacaaacacaacauuuauaagaagggagaaaugauuuuguuugugaauauaguuucaaauuugcaagaugaaagaauucuagaaauugaacacugcaaauaugaauacugaguugugcacuugcaguaguuuaaaugucacauuucauguguuuccuuacccuagaaagaaagggagaggacugaaaggacaucauuccuauggaggcuaaacaucaauaccacuuuucaaaagaaacucccauuaaccguccauucuguaaggugcucugugugguucaucgaaugguaaagucgguacuguaauggagucauuaguuuuguggcucaucuauuauaccuggacuuugaacacauaaaccacagcuguuaauuuuucacugagucaugaaagcaguugcaguucuacauuuuuuaacuucccuugucuuuucuucccguuuaccaggcuggaaagguacauuguuggguguggcuauggcuacugugaaugcuaugauagcagaauauggcugugauguggaagacauuauuguuguucugggaccgucaguggguucuugcugcuucacucuucccaaagaaucagcagucuccuuucacagucuucauccuucaugugugagacacuuugacucaccgagacccuacguugacauccgaaaagccaccaggugcguuugauugcaaugugaugcugaaaguuugauuacugcguauuguuucugaggugaaaaggaccgcaaggaacaguaaguaacuucccacacaauucagguagcaaauacuuaaggagcugacaugcacacauggaaaaaaaaacauuuuaaauaagguaucuauucucacguuuguaucacagauaguuucaugauuuuuuauuuauugagguaaauuccaaguugagaucuucagaaaucuacuuaaacuuuguacagaauagcugauauacaauuuacuucacagcuauugcuuaggucaacucuccuaaaacaauaugaaaguugauauuuugaaaguauucuuauuauguaauuaacuaaaaaacaguucuuguaaaauaauaggaaguauaaguauguaacuacuuguauuugugguccugugcuuuuuggauuuaugaauuugcucuuuagucucuguugaaaauugucauuuggauaaaaggaaacagaugaauugaguuacauuucucuuccagucagcaaaaccauaaccagacccauuuaacccaugaguaggaaggacucaguaaaugggcauugacucuuaaacgugacuugugaaauaaguacaccuaauuuuuauuucuauuuauaucagaauauuuuuaaagaaacuuuucugugaaaacuaguaaauaggagaaaaaaaagaugagaagauuggaugauuaaaaauuauaacaugucugaaccaaaagaguuuucuauacaaaugcucugucccuugagaaguuuauuccaaacaggcauucaguguuccuuacacugucccagagccagcacgugucugcagggcaguguggaacacuaccagcucacauuugagaugugcugacaaaagcucccauuuccugacuagccccugcuguggagugaauagcuauuccuguuguucugagcucuuuccuggaauguggccacacaaguaccuuuuucaugugcuuucaccaguuguaaaauaaacucuuacugucuuuugaaaaaucuuccuucuaaggauucuucuagaaagaggaggaauucuuccacagaacauucaagaccagaaggaagaucuugaccucugcacguccugccauccugagaaguuuuucucccauguccgcgauggccuuaacuucgguacacagauuggcuucauaucccuuagagaaugagguacagaacagucucugcuguagugccucccucugcacucuccauagcuccucccacucaccucccccucuccuucuuucagccuuucucugccuucacugaaaaaggaguuuaauaacauuccuuccucucuguaagaguaucagaucuucauuuuauucacuaacugauugauugauugauugauugguugguugauugauugaguuuuugaaacaggguuucucuguguaguuguggcuguucuggaacucugcucaguagaucaggcuggccucaaacucagagauucaccugccucugccuccggagugcugggacuaaaggugugugccacaacacccagcucaaauuuuaauuuuuaaguggaaaaauagcauagaaaaguucauuuucagcaaccuucuccauggugaguaauguucauuucuuuuucuaguacauaaagaauaauuaggcagguuuauguuaaaggcauaagguaauuuacucuuuaaaagucaucuauaaauaagucuuugccucugcucuaacuugagcuaugcauguucuaguaugacaucuuuauaccuuucauuauuuuuuauuuucugaaaaaaaaaaauggacuaauacuguagaaauggcgauccuaccaaaagcaaccuacagauuagaugaaauccccgucaaaauucuaacacaauucuuugaagaucuugaaaggacaauguucagcuucauguggaaacacacacgcacauacacgcguacacacgcaccaaaacaggaaugcuuagccaauccugaauaauaaaagaacgcuggaagugucaccauucuggauuucaaguuguacuacuaaauuauaguaauagaaaccacaugguuuuggcauaaaagcagacuccuugaucaguggaaucaaacugaagacccaggcacccaggcaugcaccuacaugauuauggacaucugauauuugaaaagaggccagaaauacaccccgggggaaaaaaaacccaaaaucuucaacaaaagguacuggucaaacugggauaggugcauguagaaggaucaaaauauauccauacuuaucaccccacacaaaacuuuacugcaaauggaucaaauacuucaacauaaaaucggguacacugguaaaagagaaaagggggauagcuuugaacucacuggcccaggaaaagacuuucugaacagaaugccauugguacaggcaccaagaucaacaguuuauaaugggcccucaggaaauugagaaacuucugcauggcaaaagucuuuaucauuuagacaaaguggcagccuacagaaugagaagauuucccaacuccacaucugauagagcuaauauccaaaauauauagagaacucaaaaaauugguuacaaaaaacaaccuaucuaaaaugggguacagauauaacagagaauucucaauagaagaaacucaaauggcugauaaacacuugaagaaauguucagcauccuuagucaccaggaaaauagaaaucaaaacugcuuaagauucuaucuuauacuugucagaauggcuaagaucaauaauacaagugauaggucaugcugguggggacauggagcaagggaaauacuccuccauugcuggugagaaugcaaacuuguacaagcacuauggaaaucaauauuccucagagcaacgggagucaaucuaccugaagaucuagcuauaccaccauugggcauauacaaaggaugcuuccuucuaccagaggaauucuuccucagacauagucacugcuguuccauucauaauagccagaaauuugaaacaaacuacaugucucucaacagaagaauauauaaagaaaauauuguacauucacauaauggaguauuaguccucuauuuaaaaaaaauaacaucauuaaauugaugauguuagaaaaaaaucaccuugagugguaucucucaaacgcagaaagacaaauaugguaugcaguuacuuaguguguuuauauuagcugugaagacaauaauaagcaaguuagaaauucuagaaccacagaggguaggcauagaguaagggacuagagagaacagaucuuguuaggaaagggaauuagaauagauagguauggauggaguggggauguagaaugaagauaaugggagaauggggagaggagaagagguugugucaaggaauacaggaagaaacugcuaaaauaaagggggacauuugagagguacuauggaaacucaauacaguaaaaacuuaauaaaauauuaacauaugugaaugcaauguaaaugaaaucaaacaaggggaaaggcagagccccaguggccaucucuugucaccaaaugaagcuuccaguacugggauuggguuacaucuaauugacuuguuggcuaaaggagccccacaggaaucccccaaacaaccccaggcuguugccaagacuuuagguuucucuccacaagcugacagcaaagcucuauuguugaaaacaacacccacacaacucauuaagaauggagaugacaaaccagcaccuauauaggagagagagccuucaccccuauguuccagugguuuuuauuacaagaacauacucugcauguucacaaaaagagacauaaacaugaagacggccacaaaaccuuucucuauaaagauacauugccugcaaaacacuagaaagcaaugguggcacaaagcuguugugaggaguaaccaaccaguaauugauuuggcguaaggcccacuccucaagauggaaccaauaccugacacugcuugagugacuaagaaccuaggacuagagagcccaagaaccuaggacaaaaaccacauaauacuggucuaaagaaaaaaaaauggaauaauggaaugacaacucuuaugauauucggcuaugcucauagacuagcagcuugcucggccaucaucagagaggcuuccuccugcagcagaugggacaaauacagagacacccccccucccagccugacauuauacagagugagagaccuuggaacucucaguccuaagugggaugucuccaucaaauuccuccccucggagcuuggagaaccucagggaagaggagauggaaauugcguaagagccacaagauggaggacaccaagaaaauaaggcccucuaaaucaacaugagccaagcucauaugaacucagagacugaagcagcaugcgcagggccuguauaagucugaaccaggucuucugcacauaugaaugauggcuuccaguuuaguguuuuuaugggauuccugagcauaugagugagugggugggucucugacucuuguguccucucuugggcuccuuuucuucugauggucuaucuuguuuggcuuugauguaauagguuuugucuuauuauauuuuauuuuguuacaguuuuuuugaaugaaugaaugaaugaaugaaugaaagagugagugagugaaugaaccuagccacuaggguaaagguuaacaacugaacugucucuuauaccugagagagaaaaucaguuagcuccaauggggugacacugaguaugucaacuauuccaaaacaggccucauguucaggaggaguuagcagacauaauuggacuucauagguauuuuuauuuaauuuuauuugguuacaguauguuagguuuugcuugucuguuuuucuuuuuuuaauguaauuuuauuuuguuuuguuuuguauuugggggcuuuuguuauauuucucuuucaugagaaagaacuuaaauuuggguaguuaggggaagagcaacuugagagaggagaauaauaugaucaaaauauauuuauaauuguuuuaaauaauaaaaaaauaauaaaacuuuuacauaaaauucuaaauuauagaauaaaaaauuacaaauauauaauauaaaguaacuuuucaauauacugaauaacuccugccaaauaugguacuguuggaauuuuucuuuaaaggggcagggaauaaguuauuuuuaauauuuuguacucuguguguguguguguguguguguguguguguguauguacgcaugcacucauacauacccauggcauguauauaugugaagguaaaugacaaguuucaggagucuguucucuucuauuacuguaaggcuuccagagaucugacucaggucauuaagauugggggaagagccuuuauccacugacucagcaucucuucgacucaauaaaucuuuuauguuguguagagcauggaguuucugucucaucuagucagcucgggcacuggagagcaaaggcagaugcugacaacagaaaugaaggcguccuagcucccauucaaugcuguuuacagaaagaaaguccucuagacuucuauaaggcaauuucauggcagugacuuagcacauacucaguuuuucuauaguuuaacucaauugguguauguuuuuacucuuuagaauggcuuuaguuuguaauguacaaaacauuuuaauggacuuuaugauucuuaccuugauauucuaaaaacacuagcuaggagcuaacauuuuauuucuguguguauuuuacagguucuuggcuggaguuuugcauaaaggauguuuccugcauccuuccacacuggcugcaaaagaaaauacuuagcuuucugauuuauauaaaaccaugaggauuacaaaagauaauucaucuuuaggguaugcucuuacuguuacccaaagcccagugaucuuggucuaauucuuaugacaacugaucaaaaaacccaaugugaugucauuccugaaggucguucucuguauuugucuauaaaucaaggccagggcuguucaguuaaguauuugguagaugccaacuuuuguuuaggcauggagcccagcacagggaauugaaaugaagucagcuuucucauuugaagcagaugcagcugggagauaccuguucccuuagguuuccuuauggcauucucaagcgccauguuuuugcugauccuucccuccccuucccuguccccuguguccccuuccacucccgguagccccucuuuccugucucaugggcuuuaauacuucucccuugcucaguccucucuuuauguucccuuucuaguaucaacaccuauauccacaccuaugaccacaaauuuacagauccauauauauguauguuuacauaaacaguaaaaguuagaauuuauauuuauauauaagaaaaaauacaugcaguguuuguuauucccagucuggauuauuuuggucagcauaaaauaauuccagaucucucaauuuuccuacaaguuugauaacuucauuauggcuaaauaaaauauuguguguaugaacugcau

SEQ ID NO: 7596 - RNA, 559 nt, Mus musculus
ccugggaauccauuuuuuuuuuuuuuauggugaaaaaaguauauauuuagaauuagccaucuggacucaguuuagaugaucccaaucuuguuggcaacaucuagggcaucauaaucaggagccaagcgaacauacgccuucuucucuccgucgggccuuaucaggguauugacuuuggccacaucgaugucauagaguuucuugacagccuguuugaucugaugcuuauuggccuugacauccacaaugaacacaagaguguuguuguccucuauuuucuucauggcugacuccguagucagugggaauuugaugauagcauaguggucaagcuuguuucuccugggcgcacucuuccgaggauauuuuggcugccuccggagccgcagggucuugggccgccggaaggugggugacguucggaucuucuucuuuuuguggcuguggacgccuuucagcaccgccuucuuagcuuucaaggccuucgcuuuggcuucggcuuugggaggggcaggagcuuccuucuucgcuuucggcgccaucuuggcugaaaagccca

SEQ ID NO: 7597 - RNA, 559 nt, Mus musculus
ugggcuuuucagccaagauggcgccgaaagcgaagaaggaagcuccugccccucccaaagccgaagccaaagcgaaggccuugaaagcuaagaaggcggugcugaaaggcguccacagccacaaaaagaagaagauccgaacgucacccaccuuccggcggcccaagacccugcggcuccggaggcagccaaaauauccucggaagagugcgcccaggagaaacaagcuugaccacuaugcuaucaucaaauucccacugacuacggagucagccaugaagaaaauagaggacaacaacacucuuguguucauuguggaugucaaggccaauaagcaucagaucaaacaggcugucaagaaacucuaugacaucgauguggccaaagucaauacccugauaaggcccgacggagagaagaaggcguauguucgcuuggcuccugauuaugaugcccuagauguugccaacaagauugggaucaucuaaacugaguccagauggcuaauucuaaauauauacuuuuuucaccauaaaaaaaaaaaaaauggauucccagg

SEQ ID NO: 7598 - RNA, 55319 nt, Mus musculus
cccuuuaucuggcaagaagacaaagcagcagcaagccaggccuuuucaucaugugucauuucaucgcgcuuuguacuugugacgcucucucccuccucuuuuucuucuucugggugucuguguaugaaagagaaaugaaauuaugcuaacacguguuaucuuuuuccuggacaagcacagccacucugugcagaaaugaacaugagaaauaaaggggggggguugacggggaggggagaagaucaggaaacaugaugggggaggggagggaggaguagccaugggguuggggagacauaacuugcuauaaaaaugacugugucucagucuggagacaacucugcaaguggaaccuuugcccugugaaccugguaaagagccgaucgauaaaaagacaaaacucuucucauugugaucuuagaucuuccaccuccuuccacaagagaacgaccuccaggguguaagacuguguuuguuggaggauuaccagaaaaugcaacggaagaaauuauucaagaagucuuugagcaguguggagauaucacagccauccgaaagagcaagaagaauuucugucacauucgcuuugccgaggaauucaugguugacaaagccauuuaccucucugguaccuugcuuuaguaaaaggggguuugcucucuauccugucuucugucuucugauguuacugugagcuccuucccuuuugccuuaauacacacacaauaaguccugguagcgugggggcuggggaaggaggcauucaccuuucagcuuggcugccacggggcucuuuguuaagccugugccucucuccacaggcagguuugccuaccaucuagucucaaggaauuccacagaguuucuaauuaauguucucaagugcguauuagaugaaaagcaauauuuugaguacugaggaccauuauuauuauuggauguaauccucugggggggaguaaaguacucucucagaauaauuucaguuucuuaaaagugcauuuccaaucuucaccccgggguguggggggguguggggggaagcaagauccccuucuugcagggaauguguuccugggccugugacaggcccucuguccucacacacagcugccugcucuaccaucauuauccggaggaccaggcuuuaggagaaguuuacacaugugaaaaggaagccuagugcugccuucagcuuucuggguuucuauaggaaaagucugacuaggugcacggaagccucagucaaaccaaaggacaccgaggcuaauguuaccgugguacuuuggaaguauuuaguuuuagguuacccucccugcccuuugcugcuccuccagcgacauuagugccaucugccacccugcagacugccuaccuaacucagagcaaagguaacccccccccccuggggugggaaagaaucaagugaaaccugggcuccacccccagguuuuccugaugucugcagccagucuccauugccuuucauucugugugaaccccugacagguugagguuaucccaguaccucagagaccuugcccaagacggggauccagagaauguuaaaucccuuacuguacuuaagcucucaacgagaaacauaaagucuggacauuccacaguggaaaugaauaaagauauuuuaccacacgcacaguggcacccaucuccuggagagaggagggcguggcuuuccaucucccuaacccagauaaauugucauacuacuuccaccuguggguggaauagucgguuuaccagcaggacuccuaggugaggucgaucacguguguaugaagcacacuguggggaucucugagugucagacuguucuuaacaaaacaaacccggucaggauaaaggacagaugguucuuucugucagugccugccuggaaaucuggguucuuagucacuauagucaaucaaacuauuacucaaugcuaagacacuaacuucacccugcgugacugaagaaucgaguaggcgaauguccuuuaaaacacuaacacaagccaacuuuaagaccaaacagaaaacuucgaagacgcuaacaaagaugaacagugccaaauauauagacauauggagggaaauagagacuagacaaacucugacgcuucuugguagcucuuuugaaucgggaggaaacacaggcuccacccacuucaagccuuucacugccucagugcagagaagucuccagcuuugcuaggguggucucugcagcugagacagucugaaacccaagcuguugggggaagggacaggaaggagagaagguuaccaccaccaccaccccuguaaucuccagcaagcccagcuggaaagccuaauuuuaggagcacuuucacauuugagggccaggcuaaguuuagccucagccucaucagagucuuuuaaugcuguaaugaugaagcucugaugaaagaggaccagaaagguuuuagagagccgguucucuggaauaugagcagagaaaguuguuccgaccaacucagacagcuggccaggacacagccugcugacgucacuuuccacagcccaccaccaagucagcacuaauucuguucacgugugggcggcuguuugcacccaagauggguacuguuuuguuuccaccauccuguugaaaccuggaagagaguucagucugaugagaucuguagcaagcacauuuguaacuuuuuaaaaaguguaaagugcccugcugggggaaaagccagcuuccauggggauuugugacugggcuuuaacucaaauccuacuggguaaggauugaaaugguccaggacaaggugcaggcagcacagcacagccuagcucuucccaagugcagcucaucugcaaaucccuugcaaagcagaggugcuuauuuuugcucccuuucucuagcagcccccccucccagauaugcuccugcuaagaccugaauugauguugugaaaaucugaguacuccaaacugaagaaucaaucaccgugcugugcuuucaauucuucuaaauuugaaguuaggcuggcuggcagcauccaguccuguguugaccccucacgaccucucuccccccucauccccaaucacuauaagauagguagugcucaguaaguccucccuucccccuaaagguuccccccucccccccuuuuccuuucuggccuaacuuugggcccuugcacaagccuauuguggccuucaaagacugcacagauaauuuguguggucgugcaggcuggaugagguacuguggggccucuugauugaagguaacauauucucccgcaugccccagaggauaagugggaauaaaacaacauugcaaaauugccuggguaauuguggcuuugguagcggcagagaaaaaaaccagagcggcaguguuugcuaggggaaugagcaauaggcuccgaguaaaguucugaaauuuacuuuccgggccccuucaaauaucauggauguucuguauuuacucauacccugccucuuugaaaaagaauuuuuaagagugcacaugcaauagaguuauagaacauugaaaacaaaaagcaagacagacccccccccgaccccccccccaagccaaagggaggaaggcguggccaggauuuagugcucgguuaauggugcaacaggagcacugugagggucccucugggaaaguaacgugggggggggggggaagggagguauauuuaccuccacaucugugcuuaaugauuaagucuuuaaaaggauaccugcuucccaucccccagagacaaaaagguaucuucucuccugaggcacaguugcuuagcuugugggaaauguguccccugacuggaggugaccuggcuuuccacugcuucuagguuacagaaugcgauuagggucgagcacggauaaaaaggauuccggccgccugcacguggauuuugcucaggccagggaugacuucuaugagugggaaugcaagcaaaggaugcgcgcccgggaggagcggcaucgacgcaaacuggaagaggacaggcugcggccucccucgccgccggccaucaugcacuacucggagcacgaagcugcccugcuggcugacaaacugaaagguaaagggggugugggggggggcgagcuaggaucugcagaccucuggguuccaucaucgggcuagggacagagccauugcuuagucaggcucuccuguaugaaggucggaagggcggggguggggugggggugggggugggccucugcaaugccagcagcagccugugguccccaggaggugcuuagugagucagggcaguggccucaccgagaaguugaccuugucuagugcucucugaguucuguggaccauguaguucuaccagacacugaaaguguuuccaagacaucuuacacacgaugucuaggguuuguagaagagaaaagagaaauguagacagguccccuguccuagagguggagucgaaggaaccuucucacaccuacagaugaguaacaauagaaaaaguaaguccuuaauuuuugccggggccuucccuggguuggagagugaagaaaauaaaggauccaaagaaauaaggauuagaccugcugaacuucagugaugaccaggaaggcagguuuugaaauuaguguauguauggaggcgaggagaugcacacauauaugccuguguuggggucuagggcuacuagagaccaaaugaaugagcugaaugauaucuguuuuauaugacuaucuuauaugacuauuuuuaugacuggcauuuuauaggcaguugguaggaggugaacagcacuccugagggugcuggcuaccaacaguacuguagugggucacaguuucuacaggcaggugacuacaaguaacugaaugacuuugagcaaagcugauagcccuccgugugggagcaaggcauccacaacaugcuuugggaaugccagcaaguguaaccugagcaaggaaagggguugagaauaucuucaaagagcaggcaggauuugaacuuguugggauaaacaagaggucuuucucccaaguuagaaagguucacagaggcaaucuaaccagagcccggagcccuaagaacaaagauguaccagaaacaaagaggauuugguuugggcacuguguuccuaaagcaaggugaagcuggagagugucucaaccagauggugaagccccaaggcuauugccuaguuuggcugugcccuguaaacagugaagagauggcuucauggauuccugacgaaaggagagaugugauugguucuuggcaagagugggagaauggggguguaagaaccuaccucauguauuauuggcaaugucuuaauggaugggauggucuuacugaagaaaaccaccaauuuuaggaagaucagaaaaagcauucuaugcuugaucuaaaaggcaagugauagccuccuuaaccaucaucccugucagcucugaggacuccuaauuagccacgguugccacugaauugccucuccagccacugaguagcacugccugcuggcuuucuuggugccugcccagaaggucuauaauauagucaauaaauauacaggcagaggcuaccccuccaaugagaaaaaauaugcaauguaaauucagccuagaaacuauuaugagagcccagaaugagaaagaauaagacuuauaaccaggaacacucauuggaauaaauccucucucuuuugugccaaugucaagugaauuugguggcaccacccuguggucucugugaccuguuuuccagcccagauagcucagucacuagagcgcgagacucuuagaauggguucagucauggcuccaccuuaguucuguacugcauggaggaauuucaugaaggucuggcaucuaauguuagguuauuucuaugaagccaacaucaaaagugccaacuccauguauaagguacauggcauuugccucuacuuuuggaggauagcagauugggaugucaauuugcuggaguaauuugugagccuugccauuucaaaaauguauauuuauauagaugaguauaauuugcagaauucggaagcugugccuuugccaaguacugugugaucccuugaggagagaacagauuggaaauuuuaauagauggcucuuacaguagaaugaacucgcuguagauacgucuuaggcaagagucagguaauaccgagcuugacaauuucaacccaagcacggaguuuggaauauaaacagcauuuaauugcuuaggaaaugggcugcuuccaagaggagauccacucucugcuccuuauaacacugcaaagccuggcaggaggagccaaggaaacuugucucccugaagacgauuucauugaugugggggauauaaaauucagucaagucggaagcuauggaaaccugugacagaaugaaucugaaaauaccuaauuggauuugauuuuuuuuuuuuacccuccugugagaaaccuugccauccuagguuuauuagauauuuuucuucuauuuuacaccauauguguuuauucuuguaauuuuguuuugaagaucauucacauucagcaaaaucuguaucaaucaaaccuuucuuaugaccugcaaggcuucccacacaguugcacacaguagguauugggcgcauuaauuccucucucucucuucuccaaguaucugaauccaugggcauauugcauuucuggccacuagagcuaccaugcauggcuggcagcgagggaagugacuauguucagccugcugccaauccaguaagaaguauuugcuuaaguguuuuacaaauaccagacccuggguacuagugcuagguacugggggaagagaaaacaccaugccagauccugccucguagaaucuagguaauuucuuggguaaugaaagaaaugacuaaucagucugcuuuggcugcuuagaacagugaacugugguacguccuaacacuaucagcagcagugcgcacuacggugaguggcaacuacaggauguuuucccuucagagacagccaguggugccgcaagcaugagaaaagggggcgucucuggugaacacaucuccccacuggccggcugccuggcuucccaaagccagaggaaacaguagaguugaaacugugcaguggcuaaggcagagagagucgccagccauugguuucauuaauacaaauucuaaaacagagagucagugggcacccugcugauuaaauagacauuguugugagacaauucaacuuaaugaagacugacuuggaagugacugcgcagggaccugaaguuuauggcagggcuuugggagagcgagaaggagcacaacagcaccauaauuacacuuuauuggaaacaguggcaccagacagaugagauaaugaauucuaguguuucuaacacagaccaagcagccuugaagggggcugggggcugggccacacaaggaagagauugauuuggccaugaggaagcacuauaucuucauccacuggagauuucguugggcgagaacauuuuaaaaguuuuuucaguacuuucucccacuuggaaagauucacacaauguuucacuaggaaggacucugucuucgaaucacgugaacuugcugcgaccaaguucucuaacccaugcccuugggaaucuccucaucugucacugggaacugagccucccuggaauugugcucauaguuuucaaaggacuaggcucccauuugcauagaguaugccuggcguccgucaguagguguggaaguguggcuggcaucuggagaugugucucaauauuuauaguucuaugaaaguaaaaaucaauaaugcuaugggccaacuggacauuccauuagcuaacagccagaccuccuucuucaggcaaggaaaauaugaagcacagggagccuccugagaagcacuuuuuagggggguguuauugaccuuuguggaagcaagagaggccauuucauuuagaaacauuuuccuuggcccugcaggggaaauaaccaguacacuuuuguauugcccccuuaauuugcacauuuuaggaacacugaguaauugaggagaguguguuggggcagaaggggaacauuaaccacuuguguagccuuuauauacuguucugguuaacuggcacacagacaguuaagcagccaaaaaaaaaaaaaaaaccaaaaaaacccccagacuuuuguaggccaaauucuccuuugaaccaguuuuaacaucuuaccgcuucuucauuaauuaacgaguuaaaugacaucauuggaacaugcccaguuuauguuugcaagaugguccugaguucucugccacagauuuuuuuuauuagauauuuucuuuauauacauuucaaaugcuaucccaaaaguuuccuauacccuccccccgcucugcuccccuacccacccacuccugcuucuuggcccuggcauuccccuguauuggggcauauaaaguuugcaauaccaaggggccucucuucccagugguggccgacuaggccaucuucugcuacauaugcagcuagagauacaagcugugggggguacugguuaguucauauuguuguuccaccuauaggguugcagaccccuucagcuccuugggugcuuucucuagcuucuccauugggggcccuguguuccaucuuauagaugacugugagcauccacuucuguauuugccaggcacuggcacagccucauaugagacagcuauaacagggucccuucagcaaaaucuuucugucugccacagauucuuaaccccagaaauaugccuuuuuggaggcacggaggacacuaucaucacacucaaaacucccaaccugcagaaggucagggcacuugguaaauuuuuaaccagacugguauguggauaauguguagcaggugcuuaccaaacaugaagaagaggucgcacaaagucggaaauaaccagauguaaaacaauagauauuggggggugguggcgagaggucgggaaggggggcaccagacuccuuuuuuccuugccccugugcacuaagggaagauuuaucccuggauuuaggaacaacaggcagaucaaagccaggcugugggcuugggauaagaaacucaggugggcuuugugccuuuauuuaugucugggucuaugaaagaguaguaugagagcuuccaugauugaacagaaagaaaaaaauucaaaagauauuccacaacacuuuuuuuuucccucuaagaaauaaucaauacugauuucuaacuaugauaguagcuggaaauucuucauguaauuuacuuuacgaagauuuaaauuucuacugaacaaaaaucucuugcauuguuacagagaaguauuugcgcuguucauuuccacaauuuauguucucucuucagagcuguaaaauagucuagccaaagauaaaccaaaguacacagcccagugaaggcgaaaguggggguugugguuggcugcuccaugcccaguaucccagugagaggaucugcauugaucucucugccuguuuccaggucuuagguaacuuuucucuuuccuguuccaagugacaauuauucuuuuauugaaaauggggauuuagagacagacacuugcaaagcucauaaaaaccacaucaaauccuuucaaaauucacuuaaauuuuaguuacuacuuuccauuucagguucgugcuaucuccuaacuuagcuuagcaucuuaaccacguuacccggcuucccaggaucgaucaguccuugcugugugucugggacuuccaauugugcguaaggguugaagcacagucaccgaugggggauucugagaaaagcugagucuuuuuuuaaaagcuuguuuuuuacaagcucucaaggaugcuuuggcuugcagacuucgaauagcagguuguccuguuggcaauuuuaaugucaacuacguaacagguguucacccaaacaugaagaagaggucucacaaagucagaaaauaaccagauguagaacaagauagcauagauucagcuggagucacugagagacaaaagauaggaauuauaauuacuuacuuagcccuccaaaccuaacaaauugguauugccucccccaaauuacacaugcuuucaaaaacauuuuuuaaccaacugagaauccagugagauauuuggcugucacgaguacuuuccgguucuccuagagugucugacaucaauuguaauucucuccucuccucuccucuccucuccucuccucuccucuccucuccuccccuccccuccccuccccuccccuccccuccccuccccucucuucucuuucucuuccuuccuuucuuguuauuuuuuaaaggcucauuuauuuuauguaugagugcucuaucugcauauauaacugcaucccagaagagagcaucggaucccauuauauauagaugguugugggccaccaugugguugcugggaauugaacucaggaccucugaaagcacagccagcacccuuaaccacugagccaccuuucuagucccacucuugacuuuuauccccagugcucaugaccccagaggccuauuucucugucaugagagcauuuaccucugguggacaauaacauauguauaaauccucuugaacacaaaauuaaacguccuccaugucaacaucccaccuuccagucauuuauuugugcccugaccagcauuagucacuacacaucuuugagaaagauaaaauauggaccagaggguggcaguguauuugugaaguaauggugagugguaaugggaagaaggccaucacugcccaggaugacuguaccaguggaguucauagggaacguuagaaacacagcaaggauguguacucgucacacccuggaggcagggagaucuccuuuacgaagaugacauaagcugacccuugaaggaggaguaacagcuggccaugggauggagaauccgaaggucccugagacagaggcacagaggcccaugcugacccgaaggaaaacgccagcgggggaaggggccuggcaggcgcauuuccaguagcccaggcugaggggugugaugugguaaggacccauccugggaacacugagugaucugaaauggguggaugguccacacuccuccacagcacagccaucuccccaguucuugcuguggaaaggcacaucugcacacuccaguuucuaaacuucacuuccugcucagagucacgcccaagcggggacgaggagagcauuuggaaguuuucuaagugcguucuuugaugugauuuuaugagcagcguuaauuuccuuccacaugaauagcuuuaauaacgcugcaaucuaaacccugcuuaaauuaguuuauauuguuuucugcuuucucggugaucuuuccacugaauaccaaauugaauuuacagucgcgaauugaaaaugaccguccucaguaugcuccaguagccauccaacaggaguuacugaguugguguuaauaaguauaaauuaaagucacuucuaauauggcaacaaauguugacuggcauuucuaagugagccucaacuaacacguuuuaaauuuaaugugauugguagcacaucaaucauuauccuccugccaggcccaaaggguccagaaaccaagguaaacuugggaguuuucaaaacuacacacuucacuuacauugguuggauucugcgugccgauacucaccaauggggagaaugccucucuggcuaccuacauuuucuguucugcugcucaguccucgugaugcuauuuucugucagacaacuacccauaacugcuccuugucacuaaagcucaacucugagucccagucauagcggugaggagccugaaggcgcacgcuuuucaagcugagcaaacauaaugguuuuguuguugucguuguuguuuuguuuugcuuucuaaccauuuaaguguguucuuucugguugaagcucauuagaccuaggaacuagcaaccaggagugagagaagaggauaccaggggaggaaaacugaguuaaaugagcauucuuacucuuucucuuuuuuccuuucugagcuaagaaaaaaaaaaaguugaagaugucccccuuccuuggugcuguguggagacuuaagucacagcaaggguuaacaaaaauuagcucauaaagucaaucgugaauuuuuuuuuaagggaaaaaaaagauuucuuaaguauccgguuuauucccgcugucugucccgagguccauucuccuaacauauauuggcagggagagaguguauagggaggcagaauuuauucugacucuuaagagucacagugggccucucacaaacauaauguuaaauuaugggccucuccaugggcugaguguaauguuaaguuguaugauggauuuuaucuuaacccaagccgcuucgguccaugaagugagauaggaaaccacagcagccggaguucacagaggguugaacccagacugaaaucccagaguuaacacaauugcaccagucggcucccguauuaagacugugcucugugcucaagaaacaaaucuugcaaggaaaccggagucucccgugggugugccucugccaguaccuccucuaggucaauggugagcacagguuugaucagcgggcugcugggggcgauugauucccuaagaccaggaggaagcaguguauuauggccugccuuaaaucugcaacagcagcuuugagucuggagaagguagacucgacuccuccacaggauccuaagcagaggggcccugcccugaaaugguaccuggcuagagaggacucagaaaaauaaggcuagagauaucuuagacaacaugcugcaggauucacaaagcacuccgaaaauagcauaccgauaaccaggaggcagugguugacuuagacaaaaaacaaaacaaaacacaugccaaauaaaagcaaaauuuccuucuaagacucugucuguccaccuggaguguauauuuguuuagaaagcuaaacaauacaggggcugucucugaaaguccccccauggagcagacagacagcacuggagagaauaaguggguaaguaucugguauuaaggucuaguuucugcuuguuuugaggauuaagagucugucuuccuuacuugaugaacaaaggugcuuuuuccuguaucacauugcccagaaguagaaacaaacaaauggaaguuuucuccccucgauuuugcuugcaaaguacucauggagccuucagcaauagccacaucgauuagugcuguaauagguggcguacaccuuccaguuguaauuaacuuaaucaccugcacaccugccuuccaccaccuccgagccacacaacauuccccaaacaagcaagccuauuuuguuccguuugaaauaaacuuuaucauuuauguacagauucuccacuuccuauucucaccugaggcucacaccaagcucaaauagacuuugcacuagccacccaaagcaaaggcugacugaccaccucagggaacacacccccuuguguggaaaacuagcuaacacuccauuuuucauuguaaugaaaucuguuaucuuaaacuaaaagugaaauuacuuuugaauuucaguagaacaauaaaugacuuuauuucuccugccugcuuuggggacaguauauccuauuacaagaaguuucaagauaauuuuuuucuguggucuacauguugaugcuaucuuagcuaucuuguauaaauaccaaaaauaauuauaucaucauauagcauuucugacaaauacagugaaggccaaauagguccuuaagguuuuggagucgaccuuauaaagcacagucuaggcuuguuaugagaauguguuggcagaguauagcuaaguaucccagcacuugggaggcagaggcaggcggauuucugaguuugaggccagccugggucuacaaagugaguuccaggacagccagggcuauacagagaaacccugucucaaacaaacaaacaaacaaacaaaaacaaaaacaaaaaaaaaaacaaaaaaaaaaaagaaaagaaaagaaagaaagaaaggaagaaaaaaagaauucccagcacagcucccagagaaauaccugaauagguucuaggugguuccauggagccagaggaagaagagaauagcuaagcuauggaaugacaaagccuccuucagaggaaagcuaauuugucaaguucugagaaagcagcacuacucggggagaccucacaugcuuugagaacagccugaugacguggcuuuuucuugccgucaccuuccguucuagaugacagcaaguucucugaggcuaucacaguucugcuguccuggaucgagcguggggaggugaaccggcgcucggcaaaccaguucuacuccaugguucagucggccaacagccacgugcgcaggcucaugaaugaaaaggcuacccacgagcaggaaauggaggaagcaaaggagaacuucaaaaaugccuuaacggggauccucacucaauguaaguaacgcuuuggggggccaucucuuuugucacgguuuggccuuuucuuuuguucccauuuuauguucucauguggggguaaguagcucagaagucucccauuuuacuccauauugaauggcacaccucauaaccgacucauguucuguggcauguggaagagcacggaccugcccugagagcuuacuucucaaggugagcaacauuucuguagcuuuuccucagaacuccgugccuggcccccaagacagggcagccagguucaucugggcucauuggacccaccucaguucacaccacaccccuguggggcagccacuguccaccugcaggcugcccacccagaccuguauauccuacugggacugaugacugggaacaggccuugaacauguccccgggcucuguuuagggagcaaacccccuccucagucuccuugugaggugagcuuuggccaucugcgcugaugacugaagaauagacuuucuucauuuggaaagcaaauugccuuaaacacuuaaugcccgcgauuuuucaugucaagauccugaauugaugaaggagcauaaauggagcuuucuaauagaacaauagucacaguaauuaccccugggcucuauucaaaaaaaaagggggcgucaacuuuuucuguggcacuccaugucugcaguuaaugucacagcagcacaaugcaucucagcugcugauggucuugucgcuugguaaaaagcuguugagugacaucgcuccggggccucugcuccauuccguuccagguguggggacccacacaugacagcaacacaugcaauuuacauauuuuuucugaaaauaacuauuauuugcagugaucuagugcgccaaaugccugccgcuccuucaucagcacaauccuaaggggugaugugucuguuaggguaggaaggcagagagggaugacugagccaggaucuuaaguaugaacacauuuugcacgaccuuguugccagcuagacaguuuuuguagcaaugcagaguuaagugccgagcaaugaauccccaaauguaaacugguaggugaccaaaugcccagcccaggagcacuuggccuugaaaggaaaggaauguggggaacaggaguguuccaccucacacggaucgguacuguacuagcaaaacucaucagcacugaauggcggccuuagacccagcuguggagguccagccacacuagaguuaggacugcuagguggagaagaaggaaaguuaauacugacucuagcuuugaaaggaagaacgacggcaguggaugaguggccagagagaagguaagaguugguuggcagagaaaaaaggaaggcuaaacaguauggaaagaacaguuccuggaggggcugggggguggauaugguuggaagccacgugcccaaacaguagaguuguuacuguccacaaccucucugcucaggggacucaauucuaaccacgucuccaucuguaucugcaugcccuuuauugccuccuuuugcaauguccccuugacaacagcugugaagccauggugggcuucacaugguuggaauaggagaaaaucaugcucuccuuggcagugcuguuacauagggacuaguggggaugaggcuggaagaauugaacaugccuuccugcccucgggccagauuagaagcaacuagguagacaggauacaauguauaucgucaaugggccucucagugguaaagcucggggugggccauugcagcccugaugccugagcugagaggaacacacccaggacagggguuuaccuuugaggaaugagugagguugcaaucagggaaucccccaccaaguggcgauggcugucagagaugacucuugaaaugcagacgucugagcucaggccuucagucucccaaccuucuccuuuuucuggcuuuccuuucccauucggauaaauucuucgacuaacagcuuguaagcacuuuuuauacucuuccuuccaccagcaaaccccaucucgaggucuacucuuugggcacauggcuuccaaccacauuucuuaccugaaaaggcauagauagccccauguggcccaagugucucguuuugaugaccacugcucacauucaugguaccuaggcauuuggcauugcagaaugugucaguuagauguaguguccacuugcaaguaacacaaaucccuaccaacgugguuggcuucacacccggaaaauggcagacgaguccaaugguccaagguuucuacgcaugucucccugggcccaacaggcuacauauggccaagccuaacaacaaggaaagugggagauagaagccccagcugaucacugaucuccaggauaagcuugagucacucacaauauggaagaggaaggcuucacugagaagcgugauugccuuuccuuuucaauuccccauucucauaccaucugucagacaucugagcgccccacccacaccucuaccuugagggagcuucccauucuaccuuaaguauccuucacccuucucagcugccacagcucuccagucccagccucagcauguuugccccggagucaaugggcauccucaccagccucauccuuccugaggucaacaaugccccuucuaaccucugggcuuucuuuuauacauuugacucccccugcuuaccuggcucuuccucugcuacgcgugcuggaaucauucucguccuuuaggucucaguuguaaggucggccuccugggaggucucuuagucccccuucuucugauggccuuuccaccauaguaccuuugcggcacuuauccaggugugugacgagaucuuggguuaugagugggaugaggacggacacaaggguuagaagagacagaaguguucugaauugaggagggagggagggagggagggagggagggagggaggggauuaguaagcgauggguaagcugcaaagcaggugagaagaaaaccugaaguaguucauucagacccugcccauagcauagccacuugugugguacucugugacaccagcaccagggaggcugagggacggguguaaggccagccuagacuggauaaauaagacccugucuccaaacagaaaagaggaagauguagagggagggaaauuuuucauggguaacaggguuucagccugcauauauaaugaaccaaauaaaucaaagaaagcuugcuggcugcgcucucauugaaaaucacugugccaggcuagaggccauuaguaggguugugugcaggccagcaaagacacugaugcuggacucuuccccuuuauaaccuuccuaccaccuuuagguuuaccaccuacccaucccucuuugggaggcucuccuuggcucuguaauucaauucucaguaguaucucaguaaugggcaguuaucagcagaccgugaaaaccccagcugacguugccagcucagugcuggcugaaaagcgcaagccccaucgguagcacggggagggguucagacguauccacgaaagccgaacucuucgaggaugacaugaagacagaaguagccuccugugcagccugagcuggaauuaagcagaccagguugcguggcuccauuaacaacaucaauuccccauucuuuugugugugcuuuuguguaacgaugaccacucccugaaugcuaaggggacaaaguccucacauucacuuugaaaauauuaacaguggccucacuaaccugguaggcagugugcugacacaauaugcauggcuuuaggauggaucuaacugaaguagggaggggacaagacacacagacaggagaaaaccaaaagugggugcccacgguucucugauggagccccagccucaggaagcucagcaugcuuauuauauagaguugaacgaggaagcauggcuguuguacacagcugaacaaggugguggguuuagcuaaucucaguaaaaaugggucauagagagcagucuucagccuguaaacauggaggaggagcuacaggggacauuuucugcacacucaucauucucacauggaccaaagaaggcuuugccauuccuauaggaucauguagcccuuaguaaagccuugcccgugucaaggacacacucacucagggcuucacuagcucccugcccacugagaaugagucugucacaucuccugaccugagcuuguccucuuucuuauggcguuuuuguugguauauguaguuucccaggcuugguccauuuauguugaaccugguucuggaauuaauaccauauguccgcuuugaacacaguaacuacugauuagcaaauuuguugaaauuuccaaauucagaaccagucaaaccccauucuuccacacuugaucuuagccaaaaggcccagaagcaauaaccccauucuucuauauuaauauuccuggcaaagucuacaugaauugcacuuagcuuucucacauaaaaugagguugggguuggguaguauugauauccaggagcuaauaacucagcuuacuuucuccuacauggucucuucauuaggcaguaguacugucuuaguuaggguuuuacugcugugaacagacaccaugaccaauacaagucuuauaaaggacaauuuuuaauuggggcuggcuuacagguucagagguucaguccauuuucaucaaggcagcauccaggcaggaaugguauaggaggagcugagguuucuacaucuucaucugaaggcugcuagcagaauacugacuuccagggagauaggcugagggucuuaaagcccgcacccacaguaccugccacacuuccuccaaaaaggccacaccuacuggaagcauuuaaagagaugguucuguugccagcuagaagaaagaaaucaggaaugcucuugacuucucguacacuuccaacaccaccaguuagcuaccuucuagcucugcuggugugcucuuuggccaacauucacacauguucuggaaacaucuuccuaaugaguccaguaggcucuguuuccauccuagcuuugccauaaaguaucaaggagcuauauucaguaauagaaaagggccuauugauauuaaaugcagaaagaugcauuugauauuauuauugauauuaaaugcagaaagacuguaaugucagagugaaggcuaaggcucuugcuucuaaucguccuucacccucucguacccuuguccaucugaauaguuugcuuuuguuguuguuguuuucuagcaccaaugucugguuuguuuguuugucuguuugcuuguuuguuuuaauaagaauggaagaugccauaaaacugcaagcuugaguuuacagggagggauucauugggucaguugcagcauagcaaacagaagcauggcuaucugaaaugcauacuucuggcaugcccuccuccuacucccacccacccacacccucacccacccacccacccacugauccacuauuuccuggccugaaaggcuucuccuccaauaccagauucaaaccucauugccaaucagacuuccuuccuaaagccuguccagucugucugcacccaucuuaguaugaauaugugaguccccaacaaccccuaguucugugugcaucaaguugauuuauguucuucuagaacgauuuuaugccagagacaccagccacaugcacuguucauuuuacauaguucaccacagcacuccugagcuuggcaguguuuguaaaagcacacccaaguccugacuagaaauaccugucacuuagcaggcaugaagggaagcaaaacuugaguuggaaauuggauaggaaaacaguagguucagagcacauucuaaagcuugucuaguuuggagguggguuuacaugcgugcaugugugugcaugcacgugugccugugccugugugugugugcaugugcaugugccugugcguguguguguauguguaguacugugcucucaacugacucagcacuaauauggauucuguuuaaacuagaacacacaaaauacacauauguuaugagguaguaggauuaucuuauuuuuacuacucugauuguaucguagagacuguaacaguuccaaccaucaugcagccuggcuuggcccauuuauaugagaggaaguggcacuagucucaucuucaaucuucaaaacagcaaaugaugcagaugcuuuugacuggguuugaagagauuccggcucuaaucucggcucaagcaguaauuagccauauccccucaggaaagucuucuaagcccuugaaucucuguguccuccuuucugugaugagaagguuugcccagauaaucccccaagguaccauauuagccccacagcccuugccugccgugcggacaacuuagauccuugaguguuccaggcuaccuaaaggcaagcggguaggcaggacccacgugauguccaguuugccucaggugauaauagaacagaggagcagcuagccaucccugcauguaugccagugucucacugugguggcugccucucgagccgcugugaguaucaggagccacaucuccaccaagagaacaugugccgagagcccugcaggugccaaagccggucacaguuauugucagaggcggcucugcaaugcucugacaucccccccuugucaugcugucaucugucuucucggcugaaaucguaaaagccucugcuguuggaaugaaugauuaaaaucaucccacaaauauuuacuagagcccugcuaaguaccaggucauaugcuaagugcuggaugaaagacgaggguuucugaccuccacgcacccacaccucacaggcagacugcuguccuccacauuucuucugccuaaaaggcuuucucugaaaucauuuacuucccaggaacaucucagcuaaauguuuuuuauuuccaccaagggaaauuugguuccuguauccccugcugucgaaaaagaauuuuaugaaguguuaaaauguuuucccaugccuguagaagucauugccauagcucauccaagggaaggggguuaaaaaaaaauaucuccaugauacuuuuuagcaacuugaaccugacagcuuuucuuuuucuccucaauauuauguugauaguuuuuacuuacuagaacauuaaaugcuuuaaauauuauuucuaagagaaagggagaaaggaaaggaaaggaaaggaaaggaaaggaaaggaaaggaaaggaaaggaaaggaaaggaaaggaaagaggggaagggaaaggggaaggggaaggggaagggggaaggggaaaaggggaagagggaaaggggaaggggaaaaggggaagagggaaaggggaaggggaaaaggggaaaaggggaaggggaaggggaaaaggggaaggggaaggggaaaaggggaaaggaaaggaaaggaauggaacaaguuaacacaaaacacauucuuuggucucagacaauaaauauccaaaggaaauaaugguguaugaaggcuccaaugaagagugagcaccgaauauucuacuucucacaguacgaaaacugucagaggacacuaaaagcucgccacgacugaacggacccuuuuuaguauccuuccuuucaauucuuaccaaaaauacaauucuaaguuugcaaagaacauuuuaaucacaccaaaauacgugagaggaaaguuaagccuuacccucuggaacaaacaagaacuguggaagauuccauugugcaccaugaucaugaaugaaugaccucagaaaagacacagcuuuaucuggugcuaagacccucagguaccuugcauggcugccaguccugggggcuaaacaaaagacuucuaugaaaugcaggaagggagggacagggagugaaugucuguugauaggacagaauccacucaaaagauuguucacaaaacuuaauuuaaaaggaaaccauucuaagugagaacaaaucacucugaggcugagaugauguguuccugaggcagacaugcuguguaucuucaccucauuuugccagaggaagaagucaucccaggagaagugugggaggagcuggaaagucaguggauuucuucccagaccuaaacagagcccacauggagcucauucagcagaguugcucaccccuggcccugagauacccaggacuagagagcagauuuaguauugcauaguacagcaguucucaaacugugggucuuagccccuuuggggaucgagcaacccuuucacaggagcagcauaucagauauccuacauaucagauauuuauauuaugacucaaaacagucauaaaauuacaguugugaaaauaauuuuaugguuggggaucaucauaaccugaguaacuauuaaagagucacagcauuaggaagguugagaaccacucaccuagugcaguguucuuugccuuguaguugagaaggccaaaggcuggguccagacacagacagugauccgauggacaaaagguuggcuaguccugguuccguagccuuguauuucucuuucauaaccacccucagugucacagucuaauagcaacccuguucugugacaaaacuuuuccuaggggaagucuacucauuccagacaggaaguucacaacagaccacaguaccaccaaagucaacuugaguuauacuggggcuuucuugcauuaugggugaggaauuacagaagcagaaauggcucaaagacagcuagcugcaucacuaaggccuuuccaacauggguggcagcucacauagcugggaaccgggaguacacugcacagccugcaggcagcucaaaagguuggaaaauguccccucccagggcccucgguuggucuaaucuuuucuaggcagcugggugguuucagagucuucuugguugcuuggcuucucugagagggacucaacuuuuauuguuuacuagaccaggcagggacccagugauucuguucaguuucagggacuuucugauguuaguuugaguuguuuacuuuuuaacuuaaggaucuuucuucccuguaggauggaauguuccuaucucagaggaaacuuaacucaaacccggcucaguuucucacugaggcuuacuguucugccuguuuuauuucaacauuaaaaacaauggauuucagugaaagcuggagagggaccucaggacuuaaaacugagagaagcagaagccaguuuaguagggacaaaggaaguaggggcccuucauccaggcacuuugauucuucuacccuaugguucaguuuccucaauaacauuuuguagaaaggcaaacagcuuccuggauggucacaaccucgcagguuuggccucuuuguccucgaaaauuuuacuugccuugaagucacagcccacucaugguuacugaagcccuuuccagacucucuuggcucccugccuuggaaauccuugcaacauuucucauuuaguagcucaccuaacuacacaugacugucucuugcuuugucugaagccagugaagagcuggccaggucuuuggcucuuucuuccccagagcaucuguuauauuguuggcacauuaacuuggugcucaaagacuuuggucuauguggguaaguauggauagaugagauucuguucugacacagagguuacauuuuaccauccaucagaguuaccuagauagugucaacuagucagguaccuccacaccccaguuacugauuccgucacuggucugaacucugcauguaucuaugagugcccaaauugugcuugucgaagaaacagacauugaaaacuauagcuuuauaaucaccuagcaguguguuaaguagccagagcuagccuguugccacuaaacaauucucucagaaucauuuggaccccaguggacacccagacggaaacugaaucacuauuugaggacagucucucagaaucuagcuucccuaugauagauuauucuccacgguguaccccggcuacugaaaaaagaauaguuuuccaacucuggacuuguuuuggcuuauaaaggaaacuucaaauuucgguauugccggaauggagacuugguugauaugugauucuuuccuucuuucuuccaucugcuagaaaaagcuaaacuuaaugucaucugaccccuuguggguuucuuccuguuacuucccauaacuauggccagguggaggaagauggucugagaaaaaacccaaacccagcaaccaaacccaacauuuagagagcauacacuggagaacaagucgacacugucucucaauauuaaaaauuuagauaacuccuuuuuucuuagucacugccgggaacuuugaaauaaagaugcuuauagaagaaggucagaagccaugucugagaauucuuguugcagccuuauuaaggguagacaugagaaguuuccaagacaaggcuuaauugaaacaaagcaaggugcaggaacagugucagcacaaaaggcgcaacauagaaagagucacaccuguguacugugugcacagcugcccgacugugccaggaucuguuaacauccuuuguuguuaauucgggaagcugucgaaggggccugggcucagaggguagucuucacuucucguuuuguguaacuuuguguuguguguguauauuacuuuuguugagucaguaguggagacuagucaggacaccugucagauuuauaaagccuuggagaugcugggcauuggaaggaaccguugcaauuauaauugcaugcauuuuucuuucggcgaguuuggaccagaaacaucuggacgcaugcauucgcaaggacgcugcacccucauacagccccagggguugaccuaaguggauugaagcuaaugaagaagggacaagcacagagacagagagaagcuggaaucccauggguuaggcuuucugauggagaacggacagcaccugcgaagcucagcagacuuaugcagcugaacagggcaguggugucguacaccacuggacagaggcagagucauugcauacugauaggcaaaggagacaucuuguuuauacagagcugaccaaagaagcagguuuagcuaaucccaggagucagcucuuuaggggagcaaucuaaagggaggagaaagcgaugcugggcauacacugacgcaacauuggccuucauaccaaaggacgucgucuucaucccuccaagccucacccagagaaggcuuugcugcucccauggugcugaggcacaggggucuucaacauagccucacuggugugaacagcacacuugcacucagaacuucaccugcucuccacccaagcagaucugcaguucaccccaauggacuaggauuucuaucaacuagauauuuaugucauugucuaccuaauguccuuuuauuuauuugagcaguuugaccgucuccugcuuaccuggaauuugccacaaaaagauaaauccucuuaaaaaauuuuuuuucaguaucccuauucccuaauagcaacaguugguuuugccucaucuaaccaaagcaguugagaaagcaaguuggaggcuggcauuuggggacucaaguuuagcagguccauaaugaauucugugucacaggaugcucuuuugaaucaucuccagucaacgcuccuaacugcccuguuccugcucaccuuguaagguucgugcaggccccguugaagcaucgcuaucacuguauucugcuuccuggacuccccuccaggcagcucaucucugucaugggaccaugcaggagucaggacuuucagcaucugauguggcugccuccgccagagguguggugcuuacugcugcccuuggacauuuguucuaccaccgugauucauauucucucucucucucucucucucucucucucucuuucuccucucucugguaagucucccacuuaugcucaauacacagcagcucuccaacuccaucugaagucuugguucucaucucucaucccuccuuuccgugaaggauucuccaggcccagcuuuuaguguuuaaagacccaguaacaggcuggugguagugggggguggggggguggggucaacuauuucauuugauauuugccuuugaaaaucccuucugagcuauugacggaggauuuggaaauauguuaucccucaaaaagacaauagaaaagaugggcaggauucuucugaacccaacaggguuaaagcucuauugugagcucuauugugagcauuaaaaacaaaaauuaggcauucaagaucuguuugaggugcuuucuguaggaaagucugcuuccagggagaauguaaccaguugcuccagauaucugggacacuaaauggauuuaaggcucuuuucacacccaugcagcuggaacacgggauauuggaaguacgggagcuguaggggagagcagcggaggagaagggaccauguucuuuugaugcguuugucuuuguuaucucauugcuuccaaugcuucuuugccccaugcuaaaaauugaaagaucuuauacagucccagaaucugagaucugcacugguuguuccacuuuuccuccagagaacuuguuuaaauguuaccugcaucuaugguugcccuguucuaugcucuucuuccugugggagacuaaagacaaauguuccucacaacaguucauaagaaaucauugggauuuucuuggccacuacgcucuguuccugcugaggaggcccgggggcuaucacuguccagugccucugcccuggugcugggagaucccuugcaaggaaggaugcuagaugguccagacacuggauauggguuccuauauccagccagacaccaaggaacacaaaguggagccagaggaauccuaagaggcacugagugaaacagacaugaagauagguacagagauccugagacuugcagagagaacagcaagccacauguagggccacaggauguucuagaaggacaaugaucugggaagagauuaaaaauggcguggacuauggacgucaccugaugccaggaggauucuauugggcucagccacauucagacaccauaaaccagauuuccaaaccauguaccauuuccaccacuuggaauguguuggguccaucaguguccuauaaggacaaccauuacaucacagcaggagagauggcacagagcagccaccaauguuaaagacacuuccacucggggaauuuauacuuugcccggugguaugaccgaaaauugauccaccgaagaucacggacucugauuugcaaccaaauggcccuaccacgaguguggccaccauaagaagaauagacguagagccaugugcugcuagcuugguggccaguggcccaauguggggaucucaacugaaguuuguuacaguucaguagcauugaaacuaaauguuuuaagacuuugggucaaauaucugaugcaguucuuuuggaagcucccugagauaugcacauagcccucugcuuggcuucuuuaguguguacaaggcaaugguuuucaguguauuccuuagucaugcagucccuaucacagccagguauagaauagugucaucucuuuaaacaauuaauauauuguauucauagcuaucauaucaccaagucagaaacauguaccaccaccuaugugguuaguucuuucuucugggcaugcauauggaaggaaaugucaucuagucuugaugacugacuaagcaucguuuucucaaggaacauccguacuauaguagauauuaauacuucaugauuuuccaugaauuucuauucuacacuaugguauaucuaauuuucaauuaauacauuagguuguauccauucaaagccucuuuggauauucugaguaaaguugcuaucagaauuuuuaaaguaguuaauugaguuauccuagcaauaaagaaaucugcucuauacccagauguccaaauaucgagggacaagggaaagcacaaaagaagguuuauaaacuaguuaguuuuuuaaaaaauguuuuuguuuauacauacauauguauguauuuggccuacauguaugucuguguaccacccacauaccugguacccauggaagagaaugucacauccucugggacugguguuacagacaguugugaaccaccaugugaaugcugggaauagaacccuguccucugaaagaagaaccaguguggucuuugugccaacucuccaggcccauaucucugugugcaugguaugcgucugaaugcaucugcacaugugcacaugccuaaccuaggggauaaucacaaguagggauuuggagccaccaaggguaauuggcagagucacgaagucuacaugucucuuuacuguguuuguuuaagccugcagggcauaguugacauucuaggguggcaucuguugaagacgggcaucccugcaagcuucugaggaguugaucgauuugacuuuucucaugauccucagaaaacccauagaauacagaaaagggcauaagcaaguguugcacagugggccuggaaggucuacauuucuugacugaaugccaucuagaugauaguuccaaauuaucagggcaaugguuuuacuuuuuaaaauaaaaauuuaaaaaaagaauagcacucuuuucuuuucuuuucuuuucuuuucuuuuuuugguacagaauucugacacagaauucuagcguccuucuuaccuuacagacugcugaggugacguaggcaucauauaguuugcucucugaauguguucuccagcacaacuaucugcgagcuguuauuugaauacaggccagccauccuuugcucuuugcaucccuuccucugagaagggaaguugugggccucccuugguuaguacuuauguauggcugcacugcacauagaaugagcaaugggggacagaugucagagaagcaaugagcacaacguucacagagacaguggacagcauaaggcccaucagugacaucaugacugcaccauccugauuggugguuuuaaagccagacgcucuuuguaccacguucacugggacauugucuuugaaguggcuuucuccaaagaauuaccccagcccgaacccuugacuugcaagacaaaugucuggaacugugcaauguaaaugcugugagaaugaguuucaaacguaaauuguguugcaccauuuuuacuuuucugaguguuuuguguggggggguggcagggugggggagggaggcaauuagguaggaaguauaaaaaugucauaagaaaggauauaacucuauagauaauucuaaggagaacucuauaagagauggagauaacacccggaggccuaucuuuagaguucuggaucuuuucugaaccuugauuuauagaucagcuccauuugggcagccaucaucacauccucaggcucaagugugucucagagccaguguccugacguuuuuuugcucagaccuccaucugugccuguuuucugcaucccugaugcucugcauccacauccugaugcucuucccaagcuugagucauccuggccucccucccgccuccccacauccucucagggagucacccccuagcugcuuccugucagagggcugcucauucugccuuccauucagagcuucugcucuaauccaugccuuccucaagucuccaaggcucacacuggcuaguguccccuaacuacacagccuggaucaacagauggugguccuuccacacaucaucucucauggucuuaauccccucccuuccaguuacuuccaugugaggcccucccacagcuccauccuugcaaagagacacucugacuccuuugaugagcaaacagugagucaccaaccaagaccuggcaaaaugucaccuucuuccuggcaggaucccuuaguccaugaucccgacuuggccacuuuguacucuguuuuccgaaaagugguccaccaagccucuacuguucagaauaacuaucugcuuucauuucuauaucaucuccaagacuuagaucucaucaaaaagaagaauaauauccagugugcauauuucuaguaaucggcugccugguguuugaccagauucccagguguuuguugaaugaaugaaggaaggaauuuacuuuacgaccucaaauaaaguaaucaaguccucuaacugaggcacagaccuucagucagcaaacaucccugaauagauguuuuuguuauuagccaguaccauaguggcuucuguuuucccucuguacuccuccauguuuguuagugggaucucuucccccaccccacucccuucuccauuuaugagaauauaucauguacucuuuaccguaucauuuucaguaagagccuucucuaguaggcagcagagcuuugauuaucaccacacaaauacucacccuggcccccauugcuuuuccccuucuaugugaugccagagaauuuugcuguuuaagucauggagccucacagucuccagcccuaccaaugggcuuuaucugagcugacugcuggcucuucagggaugacccugcaagggggccgucagaguagcccaugauucuagcccugcagaaucugcagcggaaaacuguaguggccacacccucuagcacggaugacagcucaagguggcuaaucugaaauuuuaguccuccagcugaggcacagaagcacagggagaaagcaagccacgccuguuguuaagaucaagugaaacagauucauaguaaaugggcguggaguuuucuauguaaggaaguuuacaauugagagauucuucuuggguacaaaaauagcaaacagagauguuccauguguaacuagcugaagaccaaggccaagaaguauuuauuaguguuauaggauauguguugugggaaaugaaacauucuuuacguuccucuggcacuguggcucucaaucuuccuaacgcugggacccuuuaauaugguucuuuauguuguggugacccccccccccagccauaacacuauuuucauugcuacuucauaacuguaauguugacugauguuacgaaucauuagguaaauaucuguguuuuccagauggucguaguugaucuuugugagaggguuuuugaccccccccccagguggauaaccacugcucuagcacauuauguacauguucauuuugugugcuaauauuuauaugcuaauaauugcaugucacucuucuuugggggccgugcuagcaugacuuuauuuauuuauuuauuuauuuauuuauuuauguucuucaacauuagaagaucugaaagagaauucucuuuuguaacagagcccugagaaucacuuaggaaagaacuguggggguagcagccauaagaauugaacucacuauuuuaaaguuccgguuuggucaugugacuggcuaauccuaugcuuaccagguuaagagcuguucaccaagacugagucuacaguuggucggccuguaccuaaccaccaauaaggccccaccccuuccucucuacugugauuuuucacagucccucaacauuuaccauccaaauugcacugugcccggagcucacggaauugaucggugagguuaggguaacagaauuaaacucucaaguggugugagagccaggagggaaugcuggagucaugaaaaugacuguggaacagcagaauguuggggaugaacucacuaaagaguaaaagcaaccuccugugguacuaaagucagaccccacaggcuagagcuguugcucgggcaaacuuuggucugucuucacaaggaagacuccuguuaccagccaaugggcagcaagacuuguuucaguccuuaaagaagaaaagaacagggaggggggcaaaaugccuccugagccuaaggaagcuauaacacaaguacucauggccccagguuagaccuuggacacaguaauaucuugaaccgguuguuuuaagcccugaagauggcagcaaaagaaaaucaauacagauuggguucuugggcuucagucacucuacccugauuuuauuuugaagccucuagccagguagagcuuuauauaccucuauuuguaugacaucgucagggucuacagagcuauagaucuaggucuauaaucuaccauauuaaauguacaaacaaaagccuaaaugguucuuggagggagauagccaugacucuuuccccagucaucuauagaaucuguuuuaaccuaaaguuauggagacagucuugaagggagacauccccaaccuugcuaaaauguaaguacagaaaaaauuuuuuuaaaaaggcacaaacuggauggauauugaugauguugugucuauugcaacaucauccauagacuccuagugucuuugcuuugcuucccuagagugaucacaacauaaauuacuugucuuguuugaauuccuuguucaccaaaguugagcagauuguggccguuuucaacgcuucuaccagacaaaaagcuugggaccauuucucgaaagcccagcgcaagaacauagacauuuggcgaaagcacucugagguuggugauuuuacuguuccuuucuaaccaccgucacacaagcuggauuggcagagaauagcguggcuguagccguuaaugguguugucacaguggccgguccuuccaccgucgucccgugucauuguccccuccacauccagcuccacuucauuucuuguccagagaugcagcuggcuucacacuuagaacauccucuuccuuccucuccaaaggaggaaagaaucuuucucacucauaguaaagaguucgcucaaaaaacaaaccaagaugcucugucuacaaugagacugaaaaaaaaaaugccaauuuacaaaacuaaccgcugaguaccgaguuuuucuuccauaauuuuuguggugaugacaauugucucuuugggcuugaaauggcaagugugccguccuuuccauuucuucuugucacuagccacaccuacuccacugggcuagccaagagguccugucacaugucuccccagagcaaaucucaugguggggacaaauguccaugcuagcugauuucacagccucaaugcauguaugaguaucuaccaccaaggacagaggccacaacuucacuuugcuugccaccucgacagaccacaccgugucauuagccauuggucauccagcuguuauuuuuugacuccaccuguaguguucgcuuugaaccuguaauguaaaaguaaguauccugucuuccuuugcuucuucucuucuuuauuuuuuuuuaagauaagaauguugcucacguggaugcuucuccaauucuagcauguuaaaauuuaaaguucuuuaaaagacacccccucuuucaaaaaucacaaaguuauagaagguaagguuuauuuauguaaugguuuuggcugacacuuauaaauuuaguguuuuuaugaagaguuugaggaaccacaaaguccuaggacaucagucaucuggguagcauuuuaagugaccauuaacuagugcuaaauugcuauugaaugccgaugguacuacauguaauauccacaugaauacuaaauagauucuuuauugccacugucaugauggccaaugcugagugaugggguccugaaaacacuaaugcgguuguugcuaagggcauuuuuuaaaguugugcucgccagugccaaggaaggugucuggcgacauauacagcucuucuuccacuuuugaggucuguaaggaggagguaggauuucucuucaguuucucaagggcuccauaacaaagcugauguucucccugacccugaaauaagauccaagccgaaguugauugucaagaguggggacuaaggagagaccucugcuuccuuaugaaaacucaaaauugaaguucacaaacuauaagucaacgaugaugauucagaguuuagaauggcaaaccuucggauucuuuuuaaauucauauaaaauaaaaugcaacuaagggaaaauuuaacagacacccagcaagccacaguuugcugaaaacacuugauagaaaggccacuguccacagguguccguggcugucaacagacaucagacacugggcucugccuugccuccugccugaucccaguccauuucccagcuuucccuaucccgagucuggugcuguuuagagcagaacauggcaggcuuccugccugggucugaggaauccuccuugcuuucuugguccuggggggauaggauggagacuccagagggaucgagugucccuccugccaucccaccuuaucuuuuggaaaacauuagaaaacagaauucuaaauugccuuuuuuuuuucuccuacauguugcuuaauugauuaaauaccaguuguaauuucacauuguggaugguuucucaguugcaucuaagcuugcuaauuggcuugauuuuucuacauucccauguacagcaucuguuaauuaucugcaacaccucuacagauuuauuagagugugcuagugauuuacugaugaaccucgggcacccuguggaaacaccucagauuccccucccuccaguacuuucccuuucuggaccuuccacacaaaacaacugucauaugacaguuuguccuuaauugcggaaccaaguaaccacccuuucagccuuguuuauucuuuccaccugguuuuuccuuguuuggauguuuuccagccaccucuuugggaauugggcucuuuaucaagagaaaaauuagcuguacaacccccagaaaauuccccgcuaaucacacaugauauccaccgccaaagccugagacuuaagcagccccacacccuuucuucuaggugguguggucacaaagggagguguuguuucuugacccggggcuguccuauggcugucugcccucuuguuucccuguacuccacaaggccaauuuuccugggugcagagauguccauugggaucuuaguaacaaugaggauguccuucgcauccugccaugguuuaagucugugagcuaaggaaagaugucccaagccagggccacaagugcacaucugcugaaugggcaguaaccaugcccuaaugaacugguagaauccugugacuuuuaucauaagcauuggguuuuuaauuagaggccuuaaaagaaaagacgagaaaagaaaaaagaaaaaaagagaaaagaaaagaaaagaaaaggaaagaaaagaaaagagaaccguugaggucuuucucuguucuaggucuuuuugagaacggcacaugcuagagaacagaaugucuaaggcuucgcaauucaauaauauauagccgggcauaaaacaaugauagagccgauuguaaauguaaacaauggcaauguugugcuuccaggaacauuaguaaggauuuuauguaggauccuguuccucuccaguggguuuucugauggacuauugcaaccaaacauucuugucuuaauaucccccuuuauggacaaguagacagaaacucaauugaaauuuucugacuugauuauagucacuggacauggcaggcccucagaucuguggucauaagcaucauguguaaaccaucccuccugcaguacuacagcccugugagaaugggcuaugaaagagaaggucucucuauaguuauugauugaacaucuuuugaaguuuauucauggauauaugaauggccugaggguuuagauaaaccauauacaggcucaugcacagcagcucaacauaguaucuagcaugagagcaagagccuuucacaugcagggccugagaaauggcucagucuguaagcaaauaugaggcuauaagugcagaucccuaguauacguaauaaauaauaauaaauaaaaaaauuuuuaaaauuguuaugcacuugugauccagaccuggagaagugaacacagguuuuuaggacuuuauggcuauauuguauccagugagcuccaaguucagugagagacccugguucacaaauuuaagguggagaauagaggaagacacaaucucagucucuggacacacacacacacacacacacauacacucacacucacacauaugcaugccacacauauacacauauauacccucgagucuuacauguguuaauucaucucauuccccaaaacauuaguagcacaguguuccaggaagcaauuugagcaaauaggucuauaguaguguucuuaaguuacaauaggaccagugcugaaauuggccuccuucaaacaccaccucucacauaguuacuagcaguugaugucccuucuaugugcccacuguguaacagcuauuucuccauaaccucucugcagcccugccagaggcagauguuauuauccccuuuuuauaaaucaggaaacugaggcuacagugagcuuaacuaacuuaccgaagaacauuuacaguccucagugagcaaggauuucucccaagacccaucccccucacggcaguguucuagaucuugggagguggucuuggguggaagcucuggacucuacaugcugacguaugagucacaaccaacaagagaccguggggagacggcacaacgaggagcaggcguguuucugauguccgcguguccugugcuuucaggagcuccggaacgcucaaagcgagcagcucaugggcauccgccgugaggaggagauggaaaugucugaugaugagaacugugacagcccgacuaaaaaaaugagagucgaugaaucagguaaugcuagggacugcccaguccccaagagguaucaacaccagcaccgaaucuuaaacggggaauaagugcggggaaauggccacauaauucacuuuuauuugaguuacacuaaacuuucaucuuuugagugacuacauuuuauuaauagaacguuaaacuccuccuugggaacacagugauuuaaauugcuccaguuguuucuccauaugcagaucggaggccauuaugcagggauauuugccuguucccauaaaacccccuuuccagagugugacagccacggcugaugcugaauuacagauggaauuugguuucgguccauguaccuccuccucaggaguuguuuaauccacaaagaagcuuucuaaccuuccagcaugcuggaaaauuaaauauuuucccccaguaaaauucaccuaaccucucaucuagaugggagccguacucgguaccaagugagggacaucuacuccuuaaaauaaggaagccugccuugugggcuuugucuccuagauugacauguaaguucucucucaguguuuagugucucagucagacuggaagcaccaaggaaagauagcuuguaugacggaagggauauugucgaauggacucaggaagacccacugucaccaccaccacugucaccaccaccacugucaccaccacugcuacuuuaugcaugacuaaacacaaagugugaccacucaccagcccaacgugaugaguuuuucccuagagacagcgcaggguaagggaugucagcgguucuggguaauaguaagugauuucuuuaguaguaguucaugagccuggagcacaugggaccugaaccucagacaaaaucagauguaugucagaacagcaaaugggcaaucaaugguuaucugugcaauguuaaaugucccccaaagcaguggugacagacaucggucucucuccugacaauaucaggacccaccgagacagagacuuguaggacagggagaugagacccggcagucuguuaucagagcccuuuggggacagcccacuugacacuuucugacacuggagagccauugcccuaaaaaucccaacuuuccuucuaaauuccauccuugaaauuguuuagaagcuuagcauggagucagacauuguacuccaaugcuguaccuauugucagaacacaaucccagcauuuaugccucucccuagauggaggcuaguuucuguccucacuggcacuucuguaagacuucauauaugaaaagaaggcauauuugugugauuuuucuggguuccaugugaucuugauauaaaacguuucucuuuaaaauaguuguauccuuuuugaaggugaaaguuggguucuuaauauccuuauauuagguguacaagaauugacucaaccugaaauuagaauugaaccugggccucuuuucuuucuuuuuuuuuuuuucuguguauguaaaauuucuuuuuagaugaccugucaguuuuccuagagagaaaugcauauaacaucacaguuuguuugggauaaguuagcauaagaaugaguaaacaguaggcucacugaagaaaucaggcaagccacagcagcaaccauacauccacaggacggauguccuguggccaugaagguggcaaggaccugugcccuccuaggggaccagcaguucuccccagaggucugcaggagagcaauucccagaccucucuuuguucacucaccaggcauccaauaagagcaugaaguauaaccuaugcuuuaaggacuuuccccaggcauguugcuuggucagcagaauuaaugagcaaaugcagcgcauguugucugccacguaccgagggaaagagaugaaaggacuggaguucaaaugccaaggccccggcaguucaaaguccuuucguguuucuucaaaugagcugggccagaggauguggcgugugguuugggcagagagcaugggacugauuaaaggcaagagaaagcagcugaccauuuuuauuccacugggcccuggagauccugccaacaagcaggcugcuguuugccuuuccauccuugaguauucaggggcauugccugaugggcaagaauucccaucuggucuuuggauucaaccuugcuaaugauggcuuggagcaaaggaggagggacagagaccccauugccuggaggaaacuccuuuucccaucgcucaucuuuaggcacaaauguguggugccugucacccacaugggaguuguuuccccaaaauggagugcgcugaugcacucgacgggaacugccaagcacagacaugaaaaggagagucucucuccucuaccagcuccauugcuuacccagcuccucuaagcagaaacgguuuucccuuugcuucaaauaucuuaaggaaguagcuggcccccaaauucuuggaaaucccacagaaaagcauccuucagggaacccccugccuguggucgcaggacacuuugaggccauauuccucaggguggucaggcuaggcuccccaugccagccuugcaggcugacucccugcaggcaggggcauuguccagugagauggagcgaacugacuuugugucuagaaauaauaaguuugugugauaccucagguuucguuuuuuaauaaccaaaauauuuuaaugucucugccuuucuggcuguaaagaccauuuuguucuauuuuuacuuuuuuuuuccuguguaaaaugauuaacagcguuucuuuggcuagaguucccugcucaugcuuuaaccguaguacaguucuuggcagaccguucacacucccuccuuggucagucuucggagggaagggcaucuguccgagcaaagcuaagcuagugacaaaaguggagaugauucugcuaacacauugaaaaccauggcagacuuacugaaguguccaucauggaaggucggccuuuucccugggagccugcaaagguagcuuuugguagauguaaaugugcuccucucggcuugguuugccuccugcugaaaucaagccaaaaaucuucaaggccacacccaguugccuuucccuccccuccucccuuuccugccucuguccuccccacuucuucacugcgguagacagugcaggcagggcagcaacguacagagaggaagggagacaagccgggccuggauggcuugguguggaugagcccagcaaguauuagaaucgucagaguuaaaggcccagagcagguuaggugcauggcgcuuuugcucuccugaacaaugccaguacaacauaaguaccugguaguccucccucugcucauugucccugccguuccccagcaccuggcccucggccuuucuccaaacagugugaccuucacgugcauccuucccucacaucucccccuucauugaccuuacgguguggguugacuuucuuccaugaagaagauagcgcugaaacugucugcucugauuugauuuaaaaggcauguguuaagcugcauauucaaugaggaugcuucccuuugcccaaauguuuagaacuuugcaaaacucagugucucugacugaauaggcaucucuguaauuaccacaauggcacgcugaaggcaucugaugccccugcccuccaguguaauguggaagaaauaaagcagcccugcuaacugauauacuaggcccccaaaacagguaugucuuaaagccaggaagcuaaguguaauaucguccaaacugaacaucaccguccaccaauauuucaugugcguucagugaacauaaauuucagaaaaugaaaaaaaaauccuugcuuaauagacaacccuuaaaccauucuacggcuuauaacaaaugcuuuuggauucuaaaugaaccucauuuaaagucuggauucuuuauauaaguauguguguguguaugugaauauguguguauguauguauguauguaugugugcauguguguguauaugugcacguauguguguauguaugugugcauguguauguguauaugugcauguauguguguguauguauaugugcacauacauguguguauguauguguacauaugugugaacguguaugugugaacauguacauguauguacaugugcauguacguguguauguguguauguauguaugugugcauauacacccguguguaugugugucuguauguguauaugcauguguauguauaugugcauguaugugugugcguguauguguguauauguauguaugcacaugcaugugcguauguauguauacauauguguacauaugugugaacguguacauguguguauguacauguguguguaccuguguguauguguguauguauaugugcauuuacauguguguauguguguauguauaugugcauuuacauguguguguguauguguguguauguguguaugaguguguguaucugcaagcaugcaugugccacaguguaaguguauaugucaggagaugaccgccaccucguuugucucaccaugcuguauauucuagacuagcugcguccccgccuuccaggcgcaucuuuuacccucaccucccaccuugucuuagcaucacuaggauuacugaugggaauggccaccuguagcccuuucccuccuaaccauuucuguuuaauauggguuuucaggacccaaaaucagauuucaggcuugucuaguaagcauuuuuacccauaaauauuuuuugaacgaugaauuuuucucuggcuugucaaucuuccauagaacuuuacaguaccauuuuuguuuuauuaucgucacuuuuaauuuaacuaagaaggugaacagugauuuccagcagccauagcaagaugcuucauguuuaaaauuauaaauguugagguuuucggcucuccccuuaauuucuuugaguuccaagacugucucuggauuucugauacuggauccccccuccuacgugguuuccuucugaaugucccauagugaggaugccccacaggaagucccuagugaagucagucacaagccugagaagagacucggugcaggccccacagcagccaggcucagggugguggcugaaugcuaagccagagucuugcagccgacugaggaugguguugcagggagcuugccugaggcucucuuuugagaagaaggccuagacuguguucucggucagcugaccacagagguuuagagcccagcaaaagaacaagagcuguccgcugugggagguggaagggcucaguuggugaggacaugccagggcccaugcuccacaaggcaggggcaucguggagcagaggccuagaaggacaaggaccagcuguuuucccauauccugucggccugggauaccuccugagagaauagugacaccuguguaggaaggacccuugaaccaaagauaagcaccugcuuccaggccucaucuuagcauccuccgggaaccuagguucaacaagggaauaauaguuuuuguuuuguuuuguuuuguuuuguuuuuauaaaccgugaacgucuuaccaacggacaucaaauaaaggcauauuuuaggucgauuuuuuuuuuuuuaaguuuccugauuuuauguacaguuacaauucccacccauaauggacaggcuucuuuacaaauacaaaaaccauuucuccuugaaaauugauuuaccuuuuaaauacuuggagacagauguuauuaucuggauccugucgcuaaggagcccuuuucuaauggaagccuuucuccugugcaaauggacccuauguaucuggguuguaaauuccugaucuuaguggaaauuuaugcccuuacuguuacguggcaccuagcgaugccacaguuggcuccugacuucuuucauaaugagcaaacuuucuauaauagaguccuucccugugaauaaaauugcccugugcuuuugaaauugccuugugucccggagacccaagcauccccaggacuccccuauuuugcugcccuuucuuaaaacucaguggagcccuuguuagguccuaacaaccacaccugugcucugcguggagcaagguaggcgcccccaguggcuccccauguguccuucagccuggaacccccacauguacuuacaaagcacacugggggcucugugccacucuguguggcucuggcuuccugcucaaugcagugagaccuuuuaagccugaggaaaggcuucagcuacugggcagcugccaggcaaaagaaaggaauggggaaaguuaaaugguugucugaaauggagagccaaggaugcuugaauucagacaaggucucagccucacugccugcauacagcccgcagaaccccaaugcuucucaacuucccagaacaccaucaucuucauuauggcuuacugugauuuggggguaccucauaguguuaagcaaggcucagaagagaacugucacaugagagagacuucacccacuuccuuagcaggcucugaggacacugagggaauauuuauguaauaagaugcaaaguugcuauggaaaauacuauagcaaccuaacaccuccuggagccaggcaggggcuuguaacagcagucuaaauuuacaucuacuggagugucauuuuaucgacucuuaguaucuccuucugacaggauguuaaaauauguuuucagcuccaguuugggcaaaauuaacacagaaugucuuuggaguuuaaggguagucuucacaacuucuggaaaaaacuaucagaauaacucuggaagggguuagaugacagagucuuggugaguuuguagauucccucaaauuagucacugaucucagccuuuacucuguaagcaguaaguggaaaagccugauugugaaaugggaaccaguucuuagcugugccagcaagggcucgcucaccugggauuuuaggagaugcucaaagaagaugcugucagcacguuagcucaccacccucaccuuaagagcaucuagcaguuuuuaaacacaaagcuauuguucacuauauauuguucaaaaacaaaauauaguccuguaaggaaggcaaguggcuaaggaugaaaauacaguuguuacagugcuauggaaaaaauuucuaauuuucuuuuguccuucuauguagcacaacuguauauuguaguuuguaaaucccaguagauucaauuuuacauuauuugggucuuuuaaaaaccuucauauauguuaaugacauaaaaaaauacagagcgccgggcggugguggcgcacgccuuuaaucccagcacuugggaggcagaggcagguggauuucugaguuccaggacagccuggucuacaaagugaguuccaggacagccagggcuauacagagaaacccugucucaaaaaaacaaacaaacaaacaaacaaacaaaaaaccaaaccaaacaaaaaauacagagcaaguauauguucugcauuggcuuaugagcugcuucuccugaaucauugggaggugaggcuaccgugagucuuuggucacaguaaacaccuggagguucuugaggccugauuccuggcacaccccucccaagaccaugguucagacccauuaaaugugaauguggccgagaagcuguagcuguguaggccaguuacuaaugaaaaguucauauccauugauuuucuucugugucucuccaucuaaaaucuuaaaaggguggcuuccaggcugucaauaagagugggacauuggccaaaggaaucaauaugacaccauauuagagcguacaguuccuaacauuuuagcacugggaugugcugacagguaucagugcccucauccccuucugcuuugagguuccauuguucaucuaaguacaguugguggcaucaaguuauuagacccggaccagacaucauccugaccagguaaccaccuacuaaugaaaaagggacuugaaagaagugacuauuuucuuccucuucuucagaaaucccccuugccaucacauacuuaucuuguacuucgaagcccuggcaauugauguuuaaagcagccuauuaauuguuauuacaugaaguguuccauagcuuugagauguuucccuuguacaucacugaguaguucugauacuuggaacagacucaugaucaguagcugugcugccccgucuaaggaugcaaugugucaaaccuacugagaaguuuuuugaggaagaaaacuuuuugauuuaaacuccaaacauuagcagagaaguagaaagaaacagaucuaaggcaacaguugcaaggcagaguguuaaccacagugcauccagcaggacauuguaagucccacagugagucuuuccugggucuccagugucugugucccaaaacccuggauuuccaccugggcugccuugagucugcauagcuuaaggcaguuguauacauucccauugcccagaauuacuuuaagaauuuuaaauaucucauuauauuauuauauacacuauacuagacuauuguuuaaugcuauaucagaucagacuugggaaaagaaucaugacugagagauuuuaaauggcacaauagaaaguucucagaauaguugccaagugauuaaaaacacuuacaaaauggcauaugugaacaacuccaaauacaugcuuauauaugcauuauguucacaauuuauaugcuaugaggagaucuauagggaaaugggugaaaauauuuaguaucuguaaaagauuacaauuuguuuuuuuuucuuuauaaaugauuuuuguucuuuccucuuuguguacucugaaaaugacuaugagaggcacguguguuacauuaauaauacuguaaugaauauugacuuuuacauuaugaaucacaaaaaaguuaaccagguaucaggcucaguacuggacccagcaaacuguuuuuaaguccauucuaacaaaaauaacuguucaggaaguugucaccaucccucgucugcuugagugcuauuuccuuggagagucuacuaucuggguguaggcagaaagaagaaaugauuugaagaaaugcuagggguggaugaaacacacacacacacacacacacacacacacacacacacacacacacacacagagucaccgccagugcucugucuccuaagucucuggagcaauaacgggaaaaggaaggcuacucugagcucugagcaugcgcgaacccucaauggcggaccugagcugccauccucauccucuucggcugcccuuugauuucucaucuuuuuucccccgcccccagggcccgggagagcccacaaggccaucaguguauugauucaacaucuaauuucagggcuuauugaagugccucucccugucucccugcucccaggguuuuucuuuaugagauaugccucuaaauauaucuuaaaaauaaaagucugagggagaacacacguggcaauaucaaucuuacugcaguucccacacucagggcaggcuggcgcuggaggaggucuugagagcaauauguuucccuucuccccaauauucugaaucuaauaaggaccaaauauugagucuuugugcccccaauaauaagcugaauuguuuaauaaauauaagaagucaauaauggaucuuguugaguuacuguaauuaugagucgugaggugaaaucugaucuauuuggccuagucuuugcagggcaagacaugagcuuucuuucuugucguagugacuuacugaccaguuucuaucuuaucuucauaccggauucuucuaguaugguuuguguaauucuggaaaccacgccuuucccuggccucagcuccuugccucugugaauuaucuuacgcauugucacaauacaaagcagugacagauuuaacaacauuuacugaauccuuacagugugucugggaccagggcuuuugucuggaagugccagauuaaaggggaaauuacuaacgucgucuuauaagacuaauuaagacucggucccugaagugaaaguauugcucauaaauucuagaaaaucuuuacagccuguugucaguccucccuucccuaggagagaauccacacaguugugcuuugcugugcagucacaguuacuaccaaaagccagccgagaaacggggagcaaugagagagucugaaaaauguuugcucaacucaacuuugugaacaccagagaaaccuuugugggcauuuaagcugauacagggcgggcccuccugagaagggagagccucucacccuugugcccacuacaggguccuuuucucuccaggugccccagcauuguuuacagugggcuuauuggacagauaagaaacuacaacuaagaacuaauuucuuaucucucagagggacauuuuaaaucuucaucuugagccaaagaugaugaaagcaaagacuaugauuuucauauacuucacaauauuuuuauauuuuucagauaaggacccugagaucucagggacauuucaugauuugucccaagucugaugucugagaauugguaucaggcuuccaacccccucccccaacucugucuguauaaguguacaucuugugcgugcccuuacucgccagcaaagcagacuccacaacaggauccuucugcacacguuuauugggagagcuugauugcagaggcgaagagaccccaagcccagaacuggugcugcuuauauaggccuaggagaggcaugucucacacccggauugguuaugcauggguuaugcuuaccaccucauuugcaugucucacaucugauugguuaacuucuuucucaucugauugguuaacuuaucucucaucugauugguuaacuugucucucaucugauugguuaauucucaaaaccucuucuuggcaaaaaacuuuacugccuauguaugugugguggccagcgccacccugcaacggcacauguggcuucccacauguacacauagaggccggaggacaaccuuggcaguugguccucaggcaucauccauuuugguuuguuugccccucaccuccacccuccacuggcauaaaccucacccaguaugccgggcugguuggcuagccagagagguccaaggauuuaaccaucuaugucuccccauguguaggggucacaggcaugcagugaaauaccucucuguuugcuuguuuuaacauagguucucagagauaaaaacucagggccucauguucacaaggcaagcccuuucuuuaccuccugagcuuucguccugccccuccaccuuuccaucucugacccacuagugccucucuccuucacagaguccaugucaccugcacuccaguagcgacagggacggcaguauaggcgggguguacagagaaugauggcauuucucucacauccacugcuccucagaaguacgaggcagucccccagacuacuuccccucuuuucuguggcauuccgcuuuccuaacuguguaucagaggcuccauauguaacuccgcgggguugaaugaaugagcuguccuuucaggucauuaaauccugagcaaacaggggaagguaaaggacgaagcugacaaagaacagcgagguugaaaugagagguaggguaaaauuaccacagaugaaaaauacaucuauaguugauuuuuuuuuuaaauuuuuugaggggggggagugugaaaguugcuagguccuugggcuuuucaaauagaaauuaacauuuaaauuagacucuuucuuucagccccugccauguaacauuuaggcuccuaaggaauauucuaauugaugccggaucaucagcccuguguuaacaaagcccuuuauagaagcucuccacagcacuuucucuuguguucaauaagaagccgaguaacaagagagggccuccuccaaggaauucuuuuaaccucucagaaacaaaauauuucaugcuaauuccugcuuaauuggaaggaagucuuuuuuuuuuccuuuuuuuuuuuuuuuuuuuuuuuuuuuuuuguaaaaagaauaccauugauuggguuugaagccuguuccacuucugaccucuuuauuuuaaucaaggucaccuaauaaacuugcccaaacagcucuaguucucaauuaaaaaaaauaaaguagcacacuuuaaaagcauuuagugugugauuaauugugcugaacuggggauucagcacucgcaagggccuuuguggggagaguggaacauuaguaucugaaaaauuauacccaucagaaacucaaaaaaaaaaaaaaaaaaaacccaccugucugggugaggauucagggaaaguuguuaucauacccaauaggaaaagaguuuuaaugccugaacuacucuguucaauggaagaaaggcagcuaaaguggccaugcagacaguuuauaaaaugcacccugcuccuccuggccaaggacucggagaagauggagcuguccaagccagguuucuugggagcucacacucuggcacuagaaagcaguguucuuagaagacugaacuuagaaacacccagcguucuaacaguccucccccgaucuucugcacagacucugcauucugugagcuugaggagggccagacucaccuggaggcuguuuggaaaagaauauuuguuguucaggugacaaaggcuuuagagcagcugagaaaggaacaugcgagaccaagaacugguguccccaguggagugcagaccagcauggaggccagaacaagucagacuccuuggugcaacuuagcauugucucugggauagcuuaucccuucuucagccaugagauuucuuuuuuuuuuuuuuuuuuuuuuuuuuuuuuuuuuuuuuuuuuuuugguuuuuugagacaggguuucucuggauagcccuggcuauccuggaacccacuuuguagaccaggcuggccucgaacucagaaauccgccugccucugccucccgagugcugggauuaaaggcauacgacaccacgccuggcaugagauuucuuaagggcagcuuacucuuaguuuccgccgccuccuccuccuccuccuccuccuccuccucuucuuuuucuucuaaauaagauuauggggaaagauucaauaaaaggauuuauggcaaguugaaaauaccuugcacuguaauagcagaaauuauuaacaggagguauagaugaacaaccuaggcugggcuacacacaggaucaccuggggaaccugguacgcauagccaugcucugagcuaauguccaguccuguuaucaaaccacuacacgggggauucugagguacaaaggauggagagggauuuuaacaugagggucaaugguucuuugugguaggugggaagggaaagagcaagauaagacaagguaacaggaugagagagagagagagagagagagagagagagagagaaaguaacgccauagucaaagaucaaaaugugugauguacaggaagagguuggucaaaggcaagagaauggaggaagugaugucagucuaguuugcaaggaccagguaacgaacugcccgcaucagccgcauucacagucugcaccaauuggugcaggaaaggccacuugaaauggguggguacagaaagaccugguauaggccagggccacaguucuuacguuuccucucuucuagaacagccaagacugucccccuguguugcuaaucagagaggagaacaaguaugucacauuuuuauagggagacucuugcugccugugaacagucugggaagagguugcccaugugagggaccuccucucccguggcacugaccaggccaaaggccaggguucaacggcgcuuaguucuagaaguucaaucugaccuccucagagugagaaccagaagccagucauggugggaaagauagcuacuaagaaaaguauugcaagauagggcgcagggaucaggagaauggagacuuagccuggaggacucuuaacaucacucagucguugcguugcaggagagaaaaugguagcauccagaguagaccaggagagaaauuaaggaaauaagggagcauagcacagagggcagagaugccucgaaggccauggccaguggcugaagcugagacagggagcucucgcugacagagaugccauuaaggggggacuaacagaaaucaagugccccaaacuaaugaacaacaagacuggcagaacauuuuauaggucacauuagacaucugccuccagacccuguuacacugaggugacacuucuuacagugggaggggagguggagggggucaugggggagggguaggcagaguaagaggcugcucagaaccaaguggggaugagauugcguguaaucuuucucaaaguaagugcagcugggcugggcagagccagagaucaguuucuaaagcagagcucaagaagaggcauagaggacugguggauggcugugcuucuuaagaaaaugguaccaugugcgugcgugugugugugugugugugugugugugugcacgcgcgagugugcaugggcaagguagagcaugcaucaggaaaggaaaauaaugccuuuuacuggggaagauuccuaaagaaaagucagucaucauuugcuaggggaggcagcuguggacuggaggaguggcugcuugcauguccacagacuugggaaggccuaucccuuccucccccagccucacccauccaccuaggcacccacucccagaguccacugaguccuuauuaaacccguuucuaggaugcacugucugccccuaggucacuuccacuuucucuccagcucucccuggagcaaaggccuuucuuuccccuccacuggccaccacccauuguggagagagccuuguucacucacugcucagacucuccugucucugaggccaggacagcugugguaagagccugcucccuuggccagcccugccacagccuagagcggcacuuggcuguccuucucuugccccgaggacuccaaaguuugcucagaccagucagcacauccuuuagcauuguggaccacagacuuuuccggcucugggaagucagcacccagaacaccucuuucuuuugcuucugcuccucugaggaaaaggggggggggggagauagcagaggauaacaguguaauuggaaauguaaaaccugaccugaaucucgacagugucaggagcccagccacaccccacaggccugcccauugggaagaccuaggauggggagccacgcaagacuuuuuuuuuucugagucgccugcugccgcuugcaccucuagacucacauuuaagccauuguaauaucaggcucugguuuaccugcacuccucaaauuacccuuauuccaccggccucacacaaagacggaaauagacacugccuugugcgucuguuuagcucucccuaauaauagcuaaugugcagacgauaauacucacugcaaacauaaaauguuaugucaaugcuaagucguaauaauaauaauccugcaaaaauguagcauaaggaauuuccaugagcaauuugaggaagauuggugcuucaguggggauacaagugcuacugagaaacagaccuguuguacuuucccgccucuguaagaggcucaguagaaaagacugguuuuauuggcagauaucccacuaucacccccucccccuguccccucccugggucugugccuggccaccaagaggcaugggcagggaacagccccagggcccaggccuucaucgaaaugauugucucuuagccucaucagccacuaacaguaaaccagggggacagaucuuugggaggucagagccucaggaaguggccacuuguuuucugacuggagagacauagacacacaggcagaagaugggugaguucccauggauacccaguguuuaucaccuucggguucuuuaaggagcccagauuuagcauugaucucuggagaugauguaauuaaggaagucacguuaacaauaaggcuccaugagcccagagcccagugagcauccccagugcccuccuagaggacagggggcauaaagcggguccccaugcaguuccugucaggucucuggauugcagagguaugagauuaauuucugugugaaucaccuccagauuuuuccucagggaaaagcuauguuuauuuuagacuaggcuuuauccccucuguuuucauagcugaaccucugcagcggaugcaacccuuccccccaaagugcugggauacacugcucugccuccacuucaaacaaaccauuccuucugagcacccauuuucaccuuuuucagacugcaguguguagcuggcucuuugccacccguagggccacacuguacuuuuaaccagcugugccaccucugggucacugaaaccuggucccaacaccucuaaaacagaugccugagaaucauccccacugugccacagucuuucgagggugaaaggaggcaacgacagcguagaggacaggguuugguuuggggguuuggaauuggguguuugucuucuucugguauugucauggagggggcauuggcaguccugaacacagggccucauggguagaaggcaaugugcuaccacagagccuucuauacaagucccaguccugaaaauugcauuuacugcucuuagugggcaggcagacaaaauggugacuauagcuuuuguacaggcuuccccuaaguccuagagaggugcugagagcguuggauaaggaugagcucucacaggugugagacaagaggcuggggacauagggaauaaaccaaggaaucaaaccagaauggccagccaggcugugauuccuucaaaaggagcugcccagucacccaggauagcucgggagaugggggacauggaugaguggugucagcgccaaugugccagcaccaccuggugcccuggggugcuccgccuucagcccugaaacuacaaaccugggaaagggcccagaaacaggugugccagucuacagggagauucuaauaggaacuaagcugggaagaacaccagguuaggauagcacuggaggccauauaaguuuuccaauuucccugaucuaacaccuagaacaaaaaguugauuuuuggucacagaacagccuauucacuuucagaggcagacauugaagacugugcaggagacccggcggaucguggcuugcauucugcugguaagaaccagucucaccgcaccuccuagagcggucaccuugggaacaacacuacaccaugaaaggagaagcauggguuuggguucgcugcgcagcauggcggucucuaccacagaccagccaauggacaccuuggcucccccacaaggagauuuauacagagaagcagauagacccgagaaagaauccccaggucacuggaucauagcuucagcccuuucuuaagacaucaggaagcgaaguugugacaaagaggggagccccagagggcucugggauauuauaggauuaucucccaagccuucugccuaccccugucuccuuguauagaaggacaauuaccuaccuggacagcagccaguaaaauccuuaggaaagggcuuucuuuguucaugggaaagaaaugcaguuuagcuacaucuucccaguguucaggaacacaacuggcaaagcagagaaagaauguuaaacacagcauuccccaaagacaccaagaugaacagucccagagaagugcagcuauugcuagcaacaauauguuaaagcauuuuauuauuuaguuacaucuugccugagcaugaaaaagauauuaacacacugucagcuuacugggacauaacccaaaauaacuuacauuuuucauauauugcuaauuauuuuucugaggcuggcucagacugguaagagagagauuucaaggcuuucaccagauuauuuacuuaaagaaguuaagcaugccauuaucgguucccauggaaacccaguaaguaauacaggcaauggaggaggaggucacuuugaccauaauuaauauagaaaauaauagcuuauagaggauuccauaaaggauacaaugagaugcuacauaacaccuuuaaaccuuuucuucucagcgaugcaacuuaaucucuggaucaaguuucacauuucacugucacuucagaaguucugcuaguucaaugcuaauuucccaaaugcaacagauuuuuuugcuuagcaggaacuucccaauguuugcaauugcucuuucgcuuuagacaacuccaguauccagaauucucuaaagucuacagcaaguguggguauguaaaugucucagccuuacccuccuuguauuggauguggccuggcuccuugccuugauuucucaguaaauaguagguuagagaacuaacuacaggcgucacuagacucagugguacuuuacaaaauugccaacaguagguucagcuguguuccuua

SEQ ID NO: 7599 - RNA, 44620 nt, Mus musculus
gagugagugggcggcguggggaggcggcggcgguggcgucgcgggcuggggcgggcgagggggagcgccgcugcgcugcggcucgcgccaccgggcguugcgggccgugacgggaggcugacaugcccgggagcugagaggcugugccgccuggugagcggggcagggaaccgggagccagagggccggguccagacugcggccgggcgccguggccucgcugcguggggcgcgggcgggaggacggugcacuuuguccuccgcagcagcauccuucccugucagcguccgaacccagguccccggcgcugcccuaaccccagaugccgcuguuugcaucgcugucacgucgccuccaggcuggccaagcauccgaauugcgcuaucaaauagaaaaugggcuggccagaccacagugacaguacagucuaaaccccugguauagcuuggugacaguccuuuagcucugccuacggucuuuaaaaagaaaagaaaagaaaaaaaaacccuauuaguuggagguggcuuagcuuuaggcauuaaggcauuuugcggugagcaauacugcugagacacaucgcuaauggccuuggcgcauacuggaguuaauauucgcaguucuuuuauagccuugugauuauccauuugcuucuaaaucgcuuguuuuccuuugcaucuuucucaccuuguuagcaguguuauuuauauugguacucaauuuuguuauguaugaaaauauauaaaauaagggcaucaggaaagauggaguauuuauucaugcaaaggugauuuuguuuuaaugucuuuguguuugcuugguguguguguguguauguguuggugugugugcugguaaaaggcagccuaguaugauugaugucauuuucaauagucccaccuaaucuuucaaacuauagaagcauuuuuuucaaggaauaaccugguuauucauacuugauuguguuuuccaggcaggauugugaaucauagguuggcaguaaauuaagcaauuaguuguguaguuaguaacugacuuaugagggaugaagggauaugagggaauuggggaagacguggguuuauaagcugagcuguggcuaauguagauagcuacagaacugcucaacugaucugccuggaaaggaauuggcaguauauacucugugcccagugauguuucucaguuguugaagauucugaaguuggaggcccagaacuguagugagagauuugcuagccuucucaagccucugaauuccagggcuucgucagggaaacagaagaaaauccuuugggagaaaggaugguacauuuuauuuuaauuccaaagacuuagugucugggaaaggaacucagccaauuccgaucauaaugcagcagguuguguaaagggaaauuuccagcuauaaauaggggaauucuagucacacagggagauaugaaaaacuuaggugagugggcaaaggaguuagcaaaaguucccuuccacucaucuuuguugcuagucuuucuaaguuguggcaaggguuucagacuuuuagagcaaugguugcuuugucuuguguuuggaaagcaauugaaguaacuuuggauggagcaauuacuuagguaauccaaguguuguuuuuuguuuuuuuuuuuuucauuuuuucuuuuucuuuuugugaaguggccccaguaguuaaauaaauaaauaaauaaauaaauaaauaaauaaauaaauaaaaaauuagccacucagagagaaugaguguugagccagguuagagaacucuugaguuuagcuugugugaaguugggcauacccuggcauucuggcacagggaaaacaugcuuuaccaucuuaaaagcaaauggggcagauccauauauuuucauuuuuuucuguucaugcuuacagaaagaaauuaauugaacaugaccuccuggagauaagcauuuagacuguguggauuauugacuagacuugacagaaggaggaagcggagagauuuuggauuagccucugcuuacugggagcuuuuucuuugaccuuccuuaaugguuugaggauuauuuggcugccagaaucaaaaagccauuagaauuagcuuacuugaaaaaggcauuuguuggggcuggcgagauggcucagugguuaagagcgccgacugcucuucugaaggucccgaguucaaaucccagcaaccacaugguggcucacaaccauccauaacgaaaucugaugcccucuucuggagugucugaagacagcuacaguguacuuacauauaauaaauaaauaaaucuuaaaaaaaaaaagaaaaaggcauuugucauauuguuggagcacugaugcuaagguccaguuugugauucuagcucaguggccuggagacugggaagucuugagguugaaaugcaccaaguuuucucuuaguucuuugcuauuaguugcaugcucucuucaguugucaaacacugaccuucuccugagaccuccugggcuuuuucuuugcuuuguaagaguguucacaucagacccaccuugacuuugcaucaugguuccuaacagagcucuuccacucucaguucuaaaugucuguguaucgagagaaugucguggucagcuuucuacuucuugucagguugguuguaguguggauuaggaagaugggacuaggagauggaggguggggagccacacuguaguccuaaaaaggacuugagccuuucagacugcuucagcaaggucuuuaacaugggaggucuguaguugggagcagaugauggauaccuaugguguacuguaguaucuuggaguuggaguucuucccccaagcccagcauuucccuuggucucagcuauguagaguuguaaacugcguccaguggucccuuuccaggacagguuaucuuggguuuguuagguuggacaggcugcuuaaaacaguuuauauaaugggcauagugcuaccgugagaauucuagaugcacauguguaaacuguugguuuccagcuggcagauggcaguuauggugcagaaguauguuguguacugucuuguugcugacuguggacugggcgucuggaguguucagagaagaaauuggcauuuuucuuuucaggcuagugcugaccauacaauaguuuaagaacuauuucuuaaaaauuucuaucaccugcguuuuagauugcaacauaauugugguuccccauugcuuucuucuuuuuaccugccuugaaccauugauggagauuauuucuuuagauuuugguuaaucccauauucucuucucgucuuggcucagcuuuaaauucuggauaugugaaugauucugagaguaacauuuccaaguuuaacauuaaguaaaucuguucauuaguucaucuuuggauacugccauagugauggaaagcaccaucuuccagucauuguguaauuggugaaggcucugcuuuuccucugcuuuucuuuucuuuuuuuuuuuaagauuuuauuuuuauuuauauuaguacacuguagccaucuucacacaaacaccagaagagugcaucgaaccccauuacagaugguugugagccaccaugugguugcugggaauugaacucauuaccucuggaagagcagucggugcucuuaacugcugagccaucucuccagccucuccucugcuuuucuuaaguucaaaccuuaacaucauauuucacacucuuccuuuuuuaguugcuccuuauauauccuauuagugaauggccuaugugcaggcuuauaugggcucuccugugagucaagcagcaugccuugugugucagauucacucacugaguuuugcuccucgaagccgggggcagaggcuuucuguaucugcagugcuuuucauuauuguucguuaacucagggaguugcagguguuccaugauuccaaaaucuaccaggauuuuguuuagaaacaaucuuguagaggauaaugcacaauauuaagaacauaacuguguggucuugacagcaugaucacacugacaauaacucuuuuuuguuuguuuguuuguuugguuuaucgagacaggguuucucuguguagcccugacuguccuggaacucacucuguagaccaggcuggccucgaacucagaaauccaccugucucugccucccaagugcugggauuaaaggugugcgccaccaccgccuggcugacaauaacucuuaagguuuuaguuuguguauuuucuuuuugaaguuguauuuacagucgcuuuagaggaguuacaguucauacuuaauaucugucaacaaggcccugauacuugaaauaccaguggcuggcugugcuuaaagagaagccaaaccuggaaugcggugggagagccaaugacauuuuucuguuuaagaaagcaaauaugguuaccuucaaacaguucuugucuaagugccgggcuugucauucagugaugucaccuguuagcacaugucccucaauuucauaugcuugacaauuccuucaucuuucgguuuguucaguucaguaaguaugguuuuguuuucgauaaggccuuugaggagugcagagagauaaguaaggccuggccuugggucuaagugaacucuugauugaaagguuuucugcugguuacuuagacacuugaggacuggcaggugaguguugcuaguaguuaaugcaaggcauagauguguccauuuaauuguaauauaaggcaccacagucaaaagugcuaaagucagcuuugcuccaccagcaacuugggaugacuucuggagaguugauuuucacagcuggguaggucugcuggcauccagaggacagauagguccacugcuucagcauagacugaucuagccuuuauggugguaagaacaagauguaucuuguacaugcaagaauggguugacuuaggaguaaaacauaaaaagccagaaacuaucagaaagcaaaugucuuagucauuguagagauguucuuucuucuuaauauaauuggcuauuguuuuggaaggcagaggauaguugugguauuuuuagauuuaguaagucaagcagcaggucugugcuugagggaggaaccagcuugugaguccugccuugccaugcuauugucaagccgugaggugaggugagccgagccuuagccuugucucugcaggagaggguggcaucacccguacccucccacugcucacuguuuuuguuaauucuguuugguuucucugguggucacuguagggcuuauagcuuuagcucugcacauacauuucauacaugacauugcaucuaauggcugacuucucacugcucacccaccacauccuuuguucucucugucgugcuuuucacuucagugucuaaucaauugcuauuuuuaucguuauuauuuuaaaagcaacuacgaacugaggaaauacucuuauaucucaguuuuuaacauuucauccuucauuauuacauugguagguccagguuccaucugguauuguuuuucuuugccugaagaauuucuuuucauaguuaauuucuugugaucagcugaugaugaguccucacagcucuuugaguagugagaauuuuauuuugucuuaaucuuugaaagguauauauauauuuuaucaugugugucuguuaacacuuuccccucuuuccauuguuagagcugaugucauuggccugcuuccggcugccuaggugucaggccugcuggcccccucacucucuuuucucauugcugggaagauggucuuuuguuucuagcaauuuggcuaugauucacauggaugguuuuuaauuuguuaaaauauuuacuggauuuucuuagaucugccauuauuuucaucaaauuugguacauucuagaccaauucuagacugcuuugccuuccuguuuuugauucuguccccaccugaccuuuaggacuccacuuuaccuacuuuuuuuuuuuuaaugaugcuuaauagauucugaugcuguggaauugccuguuuuuaaauuccuguguuuugcugugauauuuucuauuauauuaucuacaauuucacuucaguauuaaguuaaaguuaaugcaucuaguauguuuuucauuuuagagauauuucccuuuuuuaaauguuuuuauuaauauaggaacuacacagugucacgacaguuuugugcaugaauaugauguauuaaucauacucacuccauuaacuaauuauguccucccacuccugguggcucccuuucucuuuccaccucgucucuuucuacuuugaugacuuguuggugacccagugaguuucaguaggguugcuuacauaauauaggugaggcauuguuuacaggauuguagcuccucaccaguggcuacaacacuaaaggaaaucucucacugucccucagcaaccauuuacugccuauccgcuguuggugagggggaggucuuguggggcccuauuccaucacuacuuuuaacugccuauaaauucucagggaggaguugagccuugugagucccuucuuugaaacaaaugucgaugggcccagucuuaugugggucuggucuaggucaguacagcuucuuugaguucaagagugccaugccaaaucauguagggaguacagcauccucucuguugauguucucugaguuagaaggauaauguagaucuccugagcauucaguagucaguuauucucaucauugucugguuguuaggcugaguuuaccacuguccaucauugaucuguguagcuaaacagaguauuuagaagauaauguggugggcacauuauucuguaaaacuauagcuauagcuuccucacuagagccugugacccaccagcuauuagggccuuugguuugcaguaccagaugugaacucccucuuguuccaguuagaaagccauugguuauucccauaauuugccuuuauugcaucagugggcagaucuugccuggcagguuaguaauguaguucagaugaguaagccuguugaugaaaauucacccccaacaaccuacauagcaccuuccagcacuauuagagcuaaccagcagggaggaaacuucuauuucaguuccaugcgcuaucuucaguaauauggccuaccagcaaccaccagcaguggcaguuaccuguauuguuuuguuggcuguagaaacuccuugacuaacaacucauaaggagguaucccacccuggcauugaauuguucacuuaauaaccugugcaggcuaccucuucauacuucguuuuaucaagcauguauauggcauuuuucauagucuuugguuuugguuaacccuucaccucauccucucucccaucuccccacccacuccucucagcuuaaucugcucaucugcagggcuccccuucuugcauucucagaagcucugcuuuagucuggugucuuauguuucuuccuuuaucgugaucauguuuucuucccucuugacuguauggagcacaguguauuaauugauucucuaguggaacauaauuuauugaauguguuuauguauauuaaagggagauuuauuaguguggcguacaggauguggacuggcuguccaaaaguggccacuccuaaagaaaaaaacccaaaguucaguccuugauguuuacucucuggcuagucuucaguccacgcuggaauccugcagaaauaggugcuaauaucaguguguaauaucaauucuaggugugcaguuguagcccauuuuucucucccuguuagacuucucuccuuugcauauugucugcccaccguugaguuuuuccuuauugccuccucgaaguguacuuuuccagagagcuggcugcaguuggaaugcacaguuagauuauuuguacucuguaggguuguuucaagguccauguuuagguuuuguuaguggugacgcuuggauuucccaaugugggcagcuucuguggaggcugcauguuaucugaugggcuacaggaguuuugcuuuuuccuacucuguuggggagaguaugaaguauuccaaacccuguuugguccuaaguguugcuugguauacugcucuuggaucccuucucaaccucagaugcucaguuuguauuuagcuaacaguuccaggaaaccuuucuucagaccucugcagcacuugcugccauugcguucuuccuuuaauacgcuguucuuuaacaugagccagcauugucuccaagacucacuguguugugaccuggaaguagcuggcaggcaguguuuccuuucugagggaucagcugcacccugccuugcugcugucuaauguuuaaaaaaccaguguuuuauguguauguuguacugauuuauuguaguucaauggaaaguuaaauuuaacacuuggccauuugguacguguugaaauauauuuagaacauuuauuacauaccucaaacacaguagaaccuguuaauaaacuuaaagagacauuaaauguaggcauaccuauuugaacauuuaaguauacuuugcacuuuaaauaagauuacuuuuuuuuugagagucuugccuagaccagucuugaccucuuaguccugcuucagcacugaaccuaacauuacaaauuuaugcaaucauaagauugcuuuuuauuuagcaaacaguugaguccuaccauuuucaaauacaaauuuaauccccugagucucaaaagagauguguacaaacaguggccccgaagaguaaccaauaaacuacuggagagcauagaggaaauggugagugaaggaaagaugagggaugagguaaguuuuccucagagguccuggaagaugcaugaaaagugaguggacuuuagagcauaauagaugagggauuuguaacugauuagcugugaucagcaguaaggauugagggaaaaucaugcuugacuauagaguuaauuugcugguuuauaaugagauaacaguggagaguguuuaaagaagcucuacucagguuuuaagcauacuuuuugguuuuuuuagacaggguuucucuguauagcucuggcuguccuggaacucacuuuguauaccaggcuggccucgaacucagaacucagaaauccgccugucucugccucccaagugcugggauuaaaggcuugcaccaccaccuccuggcuaagauacuuuuuaauucacauuuguuuauuuaggacacaggguuuuucugugugguucuagcuguccuagaacucccucuagggaucaggguggccuugaacuccaccugccucucuaucuuccagugcugggauuaaagguugugcuaccacaccuggcuuuaagcauaguuauuuuuauuaaacuauucuuggcuuagucuguuuuguguugcucuaacaaaauacuugaggugaguuguuuucuagagagaauagaucuauuuagcucauaaauuuagagacugaaagucccauuuugagcaguuccaccuuuugagcucagggcuuucuggguaaaucacuacauaguagauaguaucauggccuguguguguguguguguguguguguguguguguguguguguguaagagauugaguggugggacuggaagccagagagcuggaagaagcugcuuuauagcagcccuuggagugcuugcugugguccagggggagcgagaacugccauggagcagcacuaauucauuugugaugcucugccuccagggccuagagguccccagagccccagcucuacuauuccaccaccucuaccauacuggugaccagcucucuaggaugugagccucuggggaacagcccgcauccaaaccauagcaaugauacuuccaugucucguuagaacguuuagauaagaggaauuaaaacuaaagcauaggauugaacugaaacucuaaacuaggaacuuaguugugucguucaaaccacagguaaaguaucuuuggaaaacuaaauagaaagaaaaaccaauggggacaaggaauuaaaaacaaaaguguuaaggcugcacggaggcuugaagugcuaggauggggguccgcaugggggggaauagggaaggaauguggaggaggugaccagggagggggacagcgagcaggauguaaagugaaugaauaaaauaaauaaacaaagaauagaauuggugaaauuggaucuuguguuuggcguuagaaacaaucugauuuucaaguuguuguuugagagcuagugcagagggugagucauggggugcaguuacuguuggaaggugauuuacaccugauuauaaaaaaggucaagguucagaugcuauuggcuggaauggcuccuaagcuagagaugggguagggaggcuuaggaaguuguguuuguuuugcauuuuuaaucguuaaggaauuuauuugcuucuagacaauuacaagauaaguuuguccccauaaccugucccccccccccaaaaaaaaagccagaggcccacuugggcugggugggcagaaaauauccagaggcaugcaggccacuagccauguggcaggggugggcugcagacaccaagagacccacuagcugcauggcuuguccucugccggagccacuaccggcguguuggacuggggggaaagacagagagguggaacuggagacucagguggagaggaauaaccugaugugaggagccugccccaccuccugaggcaggccaugaggaagucccagcuucugcugccacugugggccaugucuggguccauggcuaugaagcaguaggggucugugucaguguaugugacccauuaacaccaaaggccauguggaugauccuaaucugggcuguuucuugggacaauguugaaguucaagggcugugcagagcuggcccuaccucucacuggcugcaacacucuggaaagcuggccaugccccucaguggcuacaguacuugggagaguggaugggcaccuugcuuaggcagcacaguagagcugacucugguguuggcagcaugggugagcuggcuagaggauaagagcacaggagagcuggcuccaccccucaucugcugcauggugaugugggaugggccuucucuacuuugcucuugccaacugcagcagacuggagagcugaccccaggcucauaagagcugaagaacagguccugccccucauuagcugcagcacucugcaccucuccucaacagcacaguuagaagcuggcccagccccuugucuguggcauugggugaucuagccugggcagugcuggaaagcuggugggcugaccagcucagcugcuacccaggcccagauccagggcuuugaucagaguuggcucacuccaacaucuaccucaucuaggaucugcaggauggcaugaaggugcugcucccacagauccaaaguugcagaauauccaugacacaggacagugggaugucugagaaaaguccugguggugauccagaauugauaguauagcagaagccagaagccagaagccucagaccagaccaauugcaaugaacauuugcaaguaaagauguguagacaaaaggguguacugugagacacacugacaccagcuuccaaggagauuuuuguuuguuuuuguuguuguuuuugaagauuuauuuauuuuuauggaugcucuauuugcauguguaccugugugccgugccacaagagggcaucagaucccauuauagauaguuaugagccaucaaucauauguagccagggaauugaacucagggccuauggaagagcagccagugcucuuaaccgcugagccaucucuucagccccauuuuuauacucuuguagggggagguugugaggacugagggcagauaugaagugacagggagaugagugagauugggugcaugaugugaaauucacgaagaaucaaugaaaaaaauuaaaaaacccacuaccuguaucuauuuauaguguguauauauguuguauauauguauaauauauauauuuuuuuacauacuuauauuuuauauuuauacauacuuaaagauuuuacacugaaugggauaaugaaugcauccuggaacuggcauuauuuugauaauuuaucaucuucccauaaguuggauagaugaaauuuuguaacauaaaaaaaaauccucauuaucgguuugcagcacugucuucaagauguuuccuaugcuugugcaaauauucauauauaauggugucagucugccaaucugaagucauuuguagcauuuugcaaaccugcuucuucacuucauguguacuauucaaacucaucauuucccacagcuggguaauauauaauaugugaauuuauuuggaucaaugaguaguuagauuauuuuuaguuuuguuucugguucagugacuagccuuccacugugcuauauuuggcacuguauuuugcaaaagcaugugugaagggagguuucaagaugugaaguugcaggaucagaggugugcauauuuguucagugcccugcagcucuggucuuuguuuuuuauaguuguuucucugauuguuuucaugucucucuauaaauuuugugauuuuuuaaaaaaauucuagauauguauguaugguuaacaaauguguuaaaccuguuuuucccgauggaugaauauugcuuuugcacuguuccucaggaaauuuacuuuuuuggugguguuuuuauuuccuguguuuugccugagcucuagccauuccacuaccaguuguuucccuucugcuuggcuugucucuuacgacucugucuguugauaagcaggccuuaggugugacuugcuauggcaguaguuuaagggaagaugcaugcuugcucuugugcaaguguaacuuacgagucuuccuagaucuacugcuugagggaaucaucccuugcuauucucuuuguccucuacaugccuuuggauuugcaaagguuuuuuuuuuuuucucuuucuuagaagagugccauguuauuccaaacugguucucucuuacauugcacagauagucuuuugguagguguuuggcuuaaauuaaauacaaagugacauggccccauguuccucaccaugaugauaauugacuaaauaccugaaacucuaagcaagcccucagucgaaugcuuucuuuuacaagagcugccuuggucauggugucucuucacagcaauagggcagugacuaagcugaugugugcuguguguucauaccucuguaguaagaauaugaaaauagaauauaaaauuagaaccuuaguaaaauuuagccuuuuuaaauucuggggcggggacuaggaugaaguugugcugaagacacagucuuggauccuucaaauaggcaggccuugaaguuugcuuaacugaagauaaucgaaaccuacgugagauuuucuuaaauauuuauugcuauaauuuucuggauuuuguuacuuagaauucaguucucuacuucuggccuuuacuauaaucaaauauuucccuccaaggcuuggguccaacaagaccgcugucuucucaccauccucagugugugugguacaagccgaccuuagugaacagauaguuugcuacacugagauagaacaguuggcuggcuguguaguguuugaguccguugaagucccccaaaauuuuuaugaaagcaucauguagaagugaguauugaggaguucuguguaagguauauaguucuacagauuguuuucugaguucuagucacugguauacucugaaacuuccagauaacaauuguguuuguguucaucugucauuuuauaaucuauguacagauuuuacauucucauuuauauaguuuuaaagccuucuauugaagggguaauagugccugccccauuuaguguugcuuuggggauagaugagugacucgggcuaugaaaauggauuccuucugugacaguauccaaguuuauaaauguuuucccugugauauuuguuaagauuuugcagcuaagguggcagugcaauugaauguaauagcaaacuauaguugugauucuaaaaauauuucauaguacuuuuguauuucauuaaggugcucagauucaccuuucauccccucccccaugcacauauccaugggugccaaagaagcuuuuaggucuuagugcuuguguucaggguuuucuuuaaaugccuacauuugaaaaaauuauguagcauaaaaugcuugcuugaaucacacagaugaguaaguuguuuucuuuacuauucuccuuuagguguuguguggauuuacucuccagcuacauuacacacugcaguaauacaguuauggcggcuuuccagccccucaggaguagucaccuaaagagcaaagcgucuguccgaaaaguaaguccuugucuuagguuccucucagugggacuuuaaaaaaaugugcguuugguuuuuuagaguuuuuaaaugaaucuuaguauuuauggaaauuauaacauuaaaauacuaugaaggcgaacguguaugaaaguagugaugucaaucauuacaguacaguaccucuuccccauuucuucuucacacaucuuuuuuaccuuuuucauaaaaaagcaaacuguccccaggcacuaguggcgcacgccuuuaaucccagcacuugggaggcagaggcagguagauuucugaguucgaggccagccuggucuacggagugaguuccaggacauccagggcuacacagagaaacccugucucgaaaaaccaaaaaaaaaaaaaaaaaaaaaaaaaaguaaacugucuuacguacuguuagaacuaccuuaaagguguauaagaaguauuaaacacucauuuauucaguauaagugcauuugaaugcuuaugacuugucacacuacacuagauggucaguaacugugagccaaugaaaauuuacuuuuccuguguuuguuguacuguggauuaaucucagggccuuguacaugcuacauaaauugcucuaccacugagcuguguuccuaguucccacuucacauccucuuccuuucugacuucuuuugauagaagguacauuaacuaggcuggcuuugaaguagcuuuuuaucucagaaaagacuugagcuugccauugcuucugucuaauccucucaaauaaccaggacuauaaaccuggacugacagccuuggucauucuuccuucaugaagaccuuccuuugcccacgaagaccaucuuugcguuucaugaaguuguuuucuuugcuuuuuuuuagucucuuuuaauaauucuucucucuuuugacagcauuuauaaagggagaagauaguucaccuaaggauggguaaaggccuuuuaauugccaguuuaaugacuugucacuuccuaugcuggcaaguacauuaguuaccuuccccacuucuuagucauguguauuccucuggacucacaggcuuuuacaauucucuacuuuacaguuuuauuuguagcgauuucugccuauaauuacuguuuguucuagagugucaugaauuuauucauauugguaggucaaguucaugauuuauguguguguguauauuuacaaauuauugugaaagccuccauucauuaaugaaaacuaaacuauaaauacugauguuuuaaacucuaccaaaguugggaaaaaaacucagagcaaugcacaacucaugcauuuucuaccuucuguuaacaucuuuuuacaaccguucucuucucucuuuacgccuccauuucccuuuauaauuguguguguguguuacugucauuaccacuccuaagaaaaccuuucaucuguaacuucaucugacauguaaucucauaaguuccccccaacuugucucaaaauuuuucuuguaaaccuuguaacuuuuucuuguuucuuuuuuuuuuuucuuuuuuuuguuccuuuguucguuuguuuguuuuucaagacaggguuucucuguauaacccuggcuguccuggaacucacucuguagaccaggcuggccucgaacucagaaaugcgccugccuuuaccucccaagugcugggauuaaaggugugugccaccaugccuggcuuuuuucuuguuucuuaucuagagucuccucaagguuuguuacauacugcauugaauauuuugguuaccucauucuggaaccaguccaguggucuagauccuauuuucaugacacuauaucuuuggaaaaaucugagcuagcucuccuguagaauaugccacauugguuuuuacuguacaauuuaucaggaacaucucagagguucccuggucuucauugcucccgugucgggucaggagguaauaucgucagugcucuugaggaaguggucaagguuguaaccaucugcugucuccaauauaaaugcagaauaacuuugauuaaaugcuuaguaaggaagcuaugugaugauaguuugagaaaugugaguagccugucucccaauagcuuuuaacuucauagauuuaggauauacuaauaauucuuuccaaaucaguauguuuagccuuacaaagaggauuuucuaauggaaucaguuugccccuauuugucauccagcaaucauaggcaaagaacacuaugacugaacucagaaguuaggaugcauuaccauuucuguucuuuuuggugcccugcuuguuccagauguagccaguggggauuccugaguaauacagugacuucuguguucuuuugaaauugcccaauuuagccuuugagcgcuucucuguauucuggcacaguuagaugguauaguuucuuuuguauguucucucuguccaggaucuggaaccagacauuuuucugaggagcucugguucuuuuaauugcugguuuguguuuagaaaccacaaucuggguaugcgaucugcuuauugcuacuugaggguuauugauucuaagacccugcauuagaaaagguaguauuuuaaaaauaauagacacaucuugauaggugagauugaaauuuaacguuacauagcuuuuucuugaauuccuuaauauuaucucuuagauuacagauuuaaguuagaugaacuuuuuaugguuagcagcuguuuguugacuugauguaaagugugaggagaugaagugaauggaauauuacaguuuuuaugauacaguucagugggcagagaagauauacacaugaauauuguaauuaaaauauguuauaauacagaucaaguaaccuuaaucugcaaacaguaaaggagaaauuuagacugacgggugaggacaucgucuucagccuuggugugauaggguucuauagggcaggauugugguguaaggcagucccacaggugaggagagcaggccacauaugagaagaggaauacuggaguuagugggaaguuaguguuaucuuucuguccgacuguaauauucauugucuccugcaugcacuuggcauuuuugacaauuuucuuucccagacacggagucucuuauuuuucuuauuuuuguuauauaguugcuuuaagaccacuaggaagucuuauuuuuaguuaauuuuuucucugucuuuuaagggaagaauaguugaugcuaauguacccuuuucuagcuacaucauuucacucaguauacgaauuguuucuauucuguuagggacuuggaaauaauauaugcaguuugcuaauuuuaguguaaggcagugauuuuuuaaccuguucucucuugacccccuuuggggggugucacaucuguauuauccuacauaccagauauuuguauuaugauucauaauaguagcaaaauuacaguuaugaaguagcaaugaaauaaucuuaugguugagggucacuacagcacgaggagcuguauuaaagggucacagcauuaggaggguugagaagcacugguguaagagguaaguauaagugaaucuggaguauaggucuguauuguuuuccaggaacuugaauuuuuuucucagcagaauugagcuuaacagauaauuuaaaaaauauuaauuggugaaugaguaacuguaaaacucaaauaucugcaaguuuucuuacuugucuuagaguuaaauuguuuugcuuauuuauuccacagagcuucagugaagauguguuccggucuguaaagucuuuauuacagagcgagaaggagcuaugcaguguaucaggaggagaguguuuaaaccaggaugagcacccccaguuaacugagguuugccauaugacuuucugaacccuuuugcaauugugcacaauauguuuucauggucuucuuauaacuucaggcucuguuuuuaaaagcuguacauaauacuagugauugggaagcaguuggguuauuuugaggguaugacuuguagguugaccgugcuccaagacaggccucauaauggagaguauuugggcaacacaaauugaaccugaauuuuuuuuuuuuuuuaaugguaacaccauguuagguggguaugggguuggagugaaucugggauuaauuggggcaggcugaaggcaucuauuaacaaccauggcaaacggacaaguggcauggcaguggacaguccagugauggcggaaguaagagugcauggcagugacgauggggaugaggagggcacgggaaagguggauggugagguucaagagcuacagugugguggaaaccuuggucauuaggaacacugccugcccugcccaguguuuagugccuuguccacguucugacccaggacuuaaacacaguaaacuaauggagauuuuuuuuuuaaauucaggucacguuucugggcuuuaaugaagaaacagaugcugcucauauacagguggggccaguuuacugaauggcagauuguggggggcuacuuaaauuuugaagacugaaaacuuuagugcucaaauuuuacacugauuauaagguaucuuuuaaagcuaaaagaugcuauuugaagccaggcauaauggugcauuccuuuaauuccagcagucaggaagcaaaggcaggcugaacuuuaguucaggaccaguggcuggucuguacaguguguuccaggccagccagggcuacguagugagucucugucccuaccccaauccccucaaaacaaagauaacauuugaguguggccuguacaucuuuaauuucaguauuuuuauuaagaauuccuuuguuguuauuugugagacaaggucuugucagauauccuugcuguggccuuaaacuugucgaaagcuucugccuccaucucccaacugcugggauaacaacugugugcuaccaucacuagcuuuuguugauauaaaucuugcuaaggaaagcagauuuagauuucacaauuaaaaucauuuaucugaaaucuuuaaaccacaggcuguuuauuucauucuguucauuauauugcauguaacauuuguauauuuuaauggcuuucacaauuugauuucagaaguaagguucuuauauuuuuagugaaguagaauuaaauauaaaagaucagauuuguaaaagcucucaauuuuugcauauuuauagauuuguguacaaguuuauagcccauuucauuuagacauuuauagggggacugauauuugagguuaggaucaaugaaagguugccugaaaguugcacaaaucacugcagauagguuuuccuugugcugcugcuagaaaacuagcaauucuguauuaguucucucuggugaguauaccugcaaacucuguagucugucuugauuuucauggccagaaggaaauagccuggacagcaaaaccagagagggcauacucuccagaacaacaugcaaauauagaacuggacuugcaaggcugaugcaggagugucacugugaguuagagucuagcgugggcugcauaguuccaggccagcuucaccuacagagugacauucuuucaaaaacaaaacaaacagcacaccuucucuggcccucaggagcuuagacaggaccaccuguacgaagccucuauucuucgggggcaaagacuggagggaaccuugugcuggaaaaaaugcuuuuaaagaaaaggcaaaagaaaagguaacagaaaagaaagcuagcuuuccuuaaaccugcauaaacucuuugaaagcuuacuacaauaucuuuggaaaaaguaaacuuauauuuuaaagagauaaaacucagucucugaagaaggguguucaguagcuaagaauucuauaugaaaaacuccagcaucaacccagaagaccugagggugacaacuacuaaaagcauuuaaaugcugaucauuaugggugugugagguguccuguuuuaagauugaugagguagcaaaaugcucgaaaggcuacaauacaaagcauuacuaaguaaccugugcuuuauuugugaguuaaaaaaugacucuguagauaaacuguguauguaugugagcuguuacaaagcagacaauuuauugaccaguacauuucaugaguuuugaguggacaacauuguggaaaccuugacauugcuauucuguaauauuguucauuacugucacuguuauuuaaaauuaggaucuagcugcaguuucauuggaacuuccagaucuucugaauucgcuccauuuuugcagucuaagugaaaaugaaaucauuuguaugaaggauaccaguaaaucguccaauguaagcaguaguccucuaaaucagguaacugguggaucauuucucaucugcuuuuucagggcagguuuuuaguauauuugcucaguaauagugaucgaagcuuuucuugauuuaauuuagucuccaggaagugguauugaugaaaagucuaacucacaaagcauugccagccuugaaguauaaaauaauuuugaucauggcuuauaaacuaaauucuugccagugaaguacugucaguggugugcaaacuuuuagugaacuauuucugcucagaugucuuuguaugacuggagcuccugcuuuauggccgucccacauuuguauguguugcaagcugaauguuauagaauauggacuucaguuaacuuucugauuaaagagcuuccauguaaaauguuguuuucauaaaacagucuuuaguucaucacuaauuauuuuugauaauguaucaaagaaaaaggcuuuagggaguaagacauuuacaguuguaugaguauguuuacaauuuggagaacuuauuccagcuaugaaauacugcuuuguucuuugugaggucuggugauuagagcuaugccuuguuuccuggauuguguuauuccgucuuaaacacuugcuuuauuugcuaggacauaaagggcaauuagcuguuauauuugguuucuuuuuuuuauaaaucauuuaucaaugucugcauuuaaaaugcauuguguaugggaaaaacuaauggcuuguguucuuaaucaaagcuguaaccaugauuguacguuuuaauacuggagaaauacaagucaagaaauaaggacaguucuuuugugguagaauggaaggugacauguugggagcuacaggaaaauggaauaaacaaguaaacuuucuguccauccauaguguaguaggugagauuggcaaauauuaaagaggacauauuacaaacauacaguaauaaaaaaaauugcccaagagacuagagugauagaagguucuauaacauccaaggaguuagauuggggagaauuuggauacauaagagaaaaaaaagauuggaaaggaaaaauaguaaaagugagauuuaaauaaaaaucaacacauaucuuuagauaacuucaggaaauuaaauaauuacaauuauuaaacauuauagaaugaaggaaccuuucaggaugcaugcauuucuugccucccccuccccuugagguuuauuuuuaggcuucacuuccagaaaauguuuuauauuuaaaauuaaaauugauuuuaucaucuuucaucucucccaagagucaucauucgggaaugcuuugugucaugagagugucaccuacauuaccgggacucagaauugauuuuaucuuuagucuccuaaguaaauaugcugcuggcauaagacacacccuggacaugcacgcgcauccgcagcaccaccuugagaccacugaugaagaugaugaugauaccaaccagucugugucuuccauagaggaugacuuugucacugcuuuugagcaguuagaggaggaagaaaaugcaaagcuauauaaugauggugugugccuuuucuuagacuuuuccuaaagauagauugaaguugaaaguucgguuuugaaguuuuaaggagacuuaacaauugaaauuuauuuugaaagcugaccuaguuuauacguuuaaauauguuuuuuauuaaaggaauuaauuuuccugugauauuuaaggucauugucaugguuguauuguucaagccuugauuaccucauaaccuaguaucuagcacuuugcuauguucagaugucagagugguuagcuggcagucacuaguaauuuuucuaacaaggagcugacuuucccguaggcauguaucugaaggcacaggguaaaauggauuauuuuauuaaaaggugacuuguaaguguugcuggggaugaacuuucaguuaaauagcacauagaaaacagucaugauauaaacauuuuguguuuaaagucaguguuuuaaaauaauuuuucuagaauaauguaauauucuuuuccuauagaaauaaauauugcuacacuaaggagccggugugaugcugcuucucagacuacuucaggccaccauuuagaaagccaugauuuaaaagugcugguuaguuauggaucaccgaagucacuggcuaagcccucaccuucaguaaauguacugggacgcaaggaagcugcuucugugaaaacaucuguuacaacaucgguuucagagcccuggacccagaggagucucuacaggugccccagugccuccgauaaagacaaggacacacaggagacauucuuuccuucuccugucuacuccucagagucugagugcucaagcccaaguccugugauuuuuuuggaugaagagggauaucaaaaaaguuuaaaagcgaaacuugagcugccugaaauuccugugacaaaagaugauguagaagauucagacucagaagugagugaauuuuuugauagcuuugaucaguuugaugaacuagagcaaacuuuggagacuuacuugcucauggaagauccuaucauagggaagucaucacagaagauagggcacaaauaugaaaaaucuuguaugaauccucagaaauucaaguuugagcguccagcucuuccagcuaauguuagaaagccaacuccucgcaaaccugagucuccguauggucaccugucugaugcuccagauuccccucguccggugaugacaucagaggauaguggcuuguucagcccuauucgaaccucagcuuuuaguccuccuggaagcuguacuccugcugaaugguuuugccaaacagauacuagugaaaauaggaaucaugaaaauuacugcacuuaugaggauuaugcaaauaaucuuucgugugaaguacuaggcucaguucuucauacucaacaugcaaacacaaugucagauauuaauaguauuaaaaggggaagaaaucauacgguaacuuuuaaguauggagacucugaucaaaaaaguaaauguaaaaaaucuucagugauuacagguagcguucagaaguuugcagcagaucuuguggggaaaaguuugggcagugcguuuaaagacuuacagaaaggaguuucuucauguaccaauaccuuaugccacuuagcugucaaauugacuucgucuguauuucagauggcauuuaaugaacuuagaaggcagugugcauuuucacuaaaagaacgagccauugguagccuggccagucuuuuggugagugaugccuuaucaaaugccuugaaagacuuacaguauguaaaaaagcagauguuuacaaacacaguugcuagguuugcugcggaccuugcugaagaacuuguuuuugaagguaucauggaagugugucaguuuucauguccucaaacaccugcaucuucacagugucagucauuugacuuugaagacaaagucgugaaguccuaugccaaagauuugucugaaucuguaauacaagaagcauucauagaacugucacagacuaaugugacguuuacaacaaaggcagcaguuaauguuucuauggguaaugucaaguaugugagugcagaaaguguaucaccuacgcagaccuuuacauuuuccucauccuucagcggucaagcaguuaugaugacaaaaccaaugcaggagcauaagaaggaauacacagugcagcaggcuuuguuuuguaccucaggaauugucacuucuauaccagugcccuuggccgguagugcccuucucccguaucauaugucaucuacuuuguauccuuccaagugucuuucaucugagccuaguaaagcaagugguggcucuacccaagaacacauugccauagaacgcagugcagaggaaguagauugucucagaaguaccugucuaccuucagaacucaauccaugcaaccagaaugacuucaaaccaacuaauggugauauugacaggcagaguccuucaaaguuaaugaguggcccuguaauuauuagcaacuuuuccgcagcaaugguacauacaauaguaaaugaaaccuuagaguccaugacguccuucaaagcuacaaaaacuauugauacaaaugcagauuauuuaacuaaaacaauaaagggaaaagccuguucuccuucccuuugugaccaagcagcaccacaggagaacaaagcuagcaguaaggacauguuugcugagcaguuaucaaagucuauuauuaaacauucccuggauaaaagcaagucaaugcuuccaaauagagauaaaaaacccgguaguaaggaacacgugcuuguucuuggagaagaaucacagaugaccuugggggaaacucccaaauuccuugacuuuucagauaacucaccucaucguucacuccugguuggaaacuauugugucgcagaauguaaagauucuguggguuuuggauuuucucuagaggcacugccaccuuguucaaugaugacaaaucagaaaucugacuuaaaggaaguugugaaggacaaagaagugacaaggcacaauuugaauaauacugcacuugagcccaugccuuuuggacaggaaagcucuuuccgucacucacagacuuucucaucugcagugcuuaccuguguagaugguuugcaugaggaagauaagcagaaaauccgagacagaaauguaauaccugauacucccccaucgacuccuuuagugccaucccagacuaguucugaaugggacaucaaaacauuaagcaaacaacucaagggggaguuagccaaagaauuugcacccgcaacaccaccuucaacgccucacaacucaucuguugguaguuugucugagaaugaacaaacuacuauagaaaaggaagaauuuauguugaagcucaugcgcucucuuucagaagaaguugagagcagugaaggugaagaacacccaggaaugcauguaaaggcagagcacccggggaaaaaaguccaguuugcagaagcauucgccacacacaucauuucucuugcaacugaagcggcagccucccacuuagaucaugagacuacucaagaauucaagguucaaaacccucacuuaaauguaccaagucaaagaaaugugcugccagcuuuaagucauuccgaugaaagcauacagacgugcacuuuugcaagugauauggcagcugaugucauugcagaagccgagaagauugcaaacgcuagaagcuguaugcuuuucaggcaugagaggaacauuugucauguugaagguggccgagguaaagcagaagagaaacuggauguggaagauguugcacauccaagagaagucgauacuuguguucuuucauuaccaaguggcaugccaggucugacauacaaguaucccaguugugaaagugugacugaugaguaugcagggcauguuauucaggugcuccaacagcaagguggcaguggagagcuaaucauggagcaguaugccagcagacuggccuaccggucugucacugcagcagcucgggaagcagcuaagacagugaaaaugaagugcgguucgaaacucuucccucugcacggcugucaugggaaaacaaacaaggaacuguugguguucucaaguaaagagcgucaccaagaagucgauagacaaagaaaaagaaauggcagccaucuuugcaaauaccagacaugugaaaggacacaggauccguguagaaaugaacuuucugaacuguacaguuuuucagccucucuugcuagcagcauaacaagagaugcaaagaaacagcucacagcaccuaaaguugacuugccaaaauccucaacagaugguuguuuuuuugaaaaaucugaauguguugacagcagugagaauguuacuggaccagaacguucaaagucuugucaaccuuugcaaagccauggauuuugccagaauacaggcuaucuaaguggauauaguugugcagagaaugcucaagcuauagaacaguaugcuagaaaaguagugggugacacuuuagagcuaaguuuaggacccacaguuuuucauaauucagagaccacagcaucagcagauagaauuacuuacgcagaaaaauugucaccgcuuauaaaugaagcuugcagauacugugaccuuaaggaauuccaugguugcaccagaaauucugcucagcucuuuucaaagcagaguccgugugcuagugcuaagccaaguucacguucaaaacuuaguagcauucgucagaaaucaagaauuuuucaucuugauguaccucagauucauguuaaucuugauaaaagggcagugcuugcugagaagauaguugcugaagcuauugagaaagcagagagagaguugagcaacacgaguuuggcagcugauaguggaaucggacaagauggcauuagcuuugcugagagccuuacuacagaaaucaugacaacagcugugacaaaugcugggcaugcuguuagcagguacguuucaaauuuuuugucaagucuuguaauagaaugaagaguuaacuuugcccuguauguuuuagguucuguucauaaaaacucuacuuauuuucauccuaacuuaacagaggucuucucuguugcauuuguauguagcuucauguccugugcuugguuuucauaugaaauuuuuguuucccgguuccuuuugugaguaauuauucauuuacagggcuggaagaugagagaaaacacaauaacaucaacuaagaagcagguaaucagaauaaaggaaaugggugaauuuuauucaagaguuuagacugguauauuuacuacucugagauuaauaucuguuucuauggucgagacaguuuucuacacauggcuuggacaguuuuuauucuuccucuucuaucauagcagcuucagaagaggaaacuagauggugauuccuaagcccucacucccaggacucggccaauaacucugcuauucauucuucagauuauucaucuucuucuuagaccuggccaguaauguaccccgcagucuuccuuaagcuuguuuuaauccagacuggaauuuguaggcucucucuuuguacuucuguucccaggcuucugugagaacugcagaguccacucaguuguauauaauucugccucacauuuuauaaaguuaaaaugauuuacaauugaagaaugauugauucaaauagauuauucacuaagauguuaacuaaauuguuucacuaauguuucuuuucucauaacuguuugauuaaugguagaauauauaauaggacguuacaaacccauaacgaucagcugggagccauaugaauuucaaauaggaaagcauaugacaguggaauuuuagaauaauaauagaucuagacuuuauuuucaauuagcaugaguccaguuaccuagcagucauuacaaacccucuuuuacccuccuccugugaaucauuuucuuaaaaaugugguagguaacaggaaaaaguguuaaauaaaauaaaguugugguggaagauaccuguguuuggaaugccaagccuaacugaguugucagaucuuuuuaaaugcaaagugagaggugcuuuaaaaaugggaagggcaguucaaggcuuaauuuagguguuagggauauaaaagaaauugaaacaggcaaaaaaaccaaacaaaaaaacaaacaaacaaaaaaacaaccccaaaccaaaccaaaccaaaaaccacauuguucugcaagagcuggggguccuguguucugggcacugcuguagagugacucaacuuggaggauggcagugagggaccagcuuauacauauaugauguuuggaagucaauggaaaguuuugaucagaaaacugauaccuuuucucuuccugcuuaagcaucacucuuuagaacuguguugacgauauacagauggagcaauuaguuuaguuucucuaagacagggucuuacuauguagccuuggcuagcuuagaauuauguagaucagacugguuuugaaucacagagauaccucccaaaugcuggaacaucaguuucugcuaagaaauauguuuaugauucauauuaugaagagauuucuuuaguuugaauauaggcuugguugacacagcuagaauuucaaacugcauuucuaauacuaaaagccagaaggaggcucuuuuagauucaaaugaagguaguauuuuuauaggucagaugauuugcuuagaacuucuagugaggcguacuucugcucaguguccuguugaacguggaaagugcuuucaacugaauguagaugcacaaggguauugucuagguagcagaugcgguccuugcugugcugauguucagucuucauuaugugcagaugcagcgacauguucagggguguuagugucaccggggauauaauuccuuagugucagcuuuaucaucuucuuucuuugucacaauuugugaugcuucaauuguuuuuuaaauuauuaccaugugaucguuuccuaguucaagagaaauagaagauuuucagucaacugagucacuuggcagccagcagaugaaucucaguguuggugaagacagcacagguagcugguccaacuuaaguuuugaggaugaccaucaagaugaaagcagcaguuuccaucaucucagugaaagguaacucugacuguauaguuaagugugugagaaaggucucuagacuuaagaaaagugagcaguggguuuguguuauuuaaaaauucucaauuuggaaaucugucuauacauccaacauuuuauuauucacaauguggcucuuuuguaguuuuuacuuuaauuguucuuaaggguauggcuuucuucugguguggcccagucuggucuugaaguuaaguuuuucucuuaacuuuccagggucuggauuauaggcuuguggauuauauugccaucccuggcuucucaauggcuuugacacauauuaaaugcagugagggaacagagcaaauaucuucggauauacugacagcugaccugaaaaaaaguauugcaauauugaauuuuauuuccauguuaaguuuucaucuauguugugggaguauaauuuaucacuuuaaagagcauaccuucauuagaaagcuauucaugaggacaguuaggugucuguaaauggcauuacuauaacccugcaguuuccugauacaagcuauaauaaauaguguuucuagggacaggacuucugcuaggaacaaaauauuuuaugucgcuucuuggauugaaaaugcaaacauugcauagucuuagauuuuuuaaaaccuacuuuaauaaggguuacuaaauacuuuaaccucccuucuagcccaccacucaccugagguaguggaaaugaaagguuaauagggcacaggggaauguggaccuauuuagaaauaguucuuugggguaauuccagucuucauugucaggacaucagugguugaauugaugugagucagcaauaguacuccauccacucacaaacaucauucacuaaccagcaacggcaguucaguccaaagugguaagccacccagaauaucaccacaaguucuucgaugcauuucucucuaugaggucaugacaaaugaugaucagcuaaggaggcaagacaaacaagugccacagugcugucagccaagaccagcaucugcaaagcccaacaaagcccagcaaagaguggcaagguaaaccaaugccacaguguaguccacugucugcuggguuauacuuauacccuuuccaaacaucacauguucucuuuccaggcagcuuccagaaaaacaccaugugucuguucucagcaaaacauccucucauaacacaguuuucagaaaaacgucacaugacacaacugagucuccaaagaaaccagaaauuucacuuuacaugaaucuguaaaaaaaaguuuuauauacuugaagacauuuacuuuacaugcaaauuuucuaguuaacuuuguucacaauagccuccuuugaaauauuucauuaugauauagauucuuauauucucaccucuaccuaaaggcauucauggguugcuuaugaacucccgugaaguauuuguccauauuaacugacaauugaaauagaaguaacagcaauaguuagaccucagggagggagaaguucucagcauaccucuaccaggagguauauguggaaagaaccgugugcagucccugcugacaucgacccuggaaauguucuugcugggagagggaaggaagacagugugacguuggaggagaggcugggguggcauaaggagaggagguguggccucuggccuaggagagcgaggcguccuagccuaaggcugggaggguuucuuuucuacuugguuacacauuuucuuuucuuuuuuuuccuuuucuuccuuccuucuuucuuucuuucuuucuuucuuacuuucucucucucucucucucucucucuuucuuucuuucuuucuuucuuucuuucuuucuuauacuguguuuguuauguuaugggaaaaaucaguauuuuuuuacaauuuggaugccaaaaaauagucuuuaaaauggaaacaguagagcaaggucaaaaaucaugauuuucccuggaacacuguaauaacacuuaaguuuuuuuuucuucuuuaaggaaaacaagcuuccaagacuucagcaagagugacauuaaacugggagaagccaguggucuuaagaggguuuguagaaagcucaguaacuagagaggguuaacugaguuguugcaaggggcaagucuuuccugggcucuagucuucauucugccugcaguguuuaguuuauuaauauggauaacuuagaaaccaggcugaagugacagccucguaacaguaacaaaaccaaaucaggcugaggccagaguaauuauauagaaucugagcaaaugcauucaggcucagaaauuaugugaacccagguagggagaacgucugacuugagaguguuuagucagaagauguguguuucauacaaguacuguuaguaugcacuacuaacuagucauguugcagugguuuugagauuuagacaggagacagcucuugggacuuaaacucuggguugauagugugccuguugaauacagguuuccagagccuaaccuccagggauugacucaggaggcuaggcaggggccugaaaaugcgugugccugagaagcaccugaagugaucucagugacaguguuugcaccacaucugagagaggcagcuuuacaaaacagucuuuuguggcuucugcucuuauaggcacagagaucaagguuggcaguaagcaguuugaauuuacacuuuaaauaggaaggucaguaaagaaaaucaguuuuaaaaauuagauuuuaaagaaggguuaggaaguauaauugaucaugaagagagcuggccuguguaugugaauuucuuaaauauuuugaauagcuagaaacauuuuugaaauuauauauuagaggcaagugugauguuuuauggccauaacccucugaaggcugaggcaggaguguuacaaauuucacaguagccugggcaauuuaccaaggcccugccucugcaaacaaauacucccccaaaagaaaacauuuuaguuaggaaguuacagugcaguggucgauggagcacuuuaccugcaugugcaagguuuagguucaguucucagcacaucauacacaaaauuauauacguuggcucaagauagggugaucauacuucuugguuuacuugugugguucugguauaaaauaaugaaguuuaauagucccuucuauuuugaaaguaugcuguuuagaugaaaugcauaguuucuuuuagagguagguaguauucuguaaauaacugacuuggaaucugaaccacuuucauaaacaggagcaagagggguuucuuuagaaagauuucugcauuuuauucuuuaguuacuuagauguuacuugacauguucauuugaaauuuaaaugaugaauuuuauuacuaauuagauugaaaauuuauuguuaguagaauauagguaagaauuuuaauuuugugguuuucauucuuuagaaaaucauuuucuuaaaguagacaggguuugagaucauucucucucuuuuuguuuauaguugucuauucugugccacuguauuuucuguguuuuaguuugucuaaugauagauagacugagguaaaccucugguugucuuuaugguuuuauaauggaacuaggcuuguuuuaauauauguugaaaaauggcuuuguuuuaccuuaaugcauuguaauuugugaaaguuugauacuguuaaaguaaaaauggauauguaauuuauuugggaaugcuuagaaacuacuuagaaccuuugguaaucaugacuuuguuuaccuugacaacacuuacugaugugcaagaagugaguucauguuaaagaggcaacguuucaguuuguauggaugcuaaguucuaauugacuaguagagagugggaaguaaaaagcugcuuaucaugcaagcuuacuaaugugcuuacuaauuaucuuaauaaauaggagugaauagaauauuuaaguugcauguugaaaauuuuaauuugaaaaguagccuauaauuuuauuuucgaauaugguuacuuuuuuuuuucuccaaacaaugcuugcuguaguuguagauacagcugccuucuucuucuggcuagguaauauaagaagcuagagcuaugugugacuuuggugacuagccagccaugcaaauguauugcuuaaauaagccuucuuauuucuuagcuuucuucugaagaaaauaugugcuauuugccaacugcuuaguuuguauaaugucagaaguaaagauaauugcauguugaugugaugaucucugaaauaggaaggcgagggcuguuugagauaguuuuuccuacaccucaccauuguuuuguacuguucagaaaucucagaagaccucaacuuaggucuuuuuacuuuuuaauuuuucuccaaacugaggaguagcaaaguauauugcccuuuugguuguuuuuaauaaguuacauguuaaggcuugucaugagauacucauuuuaucauacagucauuugccauccuaacagucauguuguuuuaaucuuaaaaauaaauguaaguuuagaaugauuccauguuguuuugaggacaaugaaaagauucccucaucuccagcccugccaguuauccuuuauggacuagcagugacagugucucgccccccccccccccuguggacgcuccacuccacuguggcagcuuuaggacagaagcugucccaaggaaacacaggugaucuucacuguucacuuucuagcucagcucuguucuuuucucccucuagcaguaaugguaacagcaguagcuggagcagucuugguuuagaaggagauuuguaugaggacaauuuauccuuuccaacaucagacagguugguccaguuuagacacuuaacacugaugacucuuucaucacuaaugcaugaugucauuauuccuaagagagccaguauguaucaaccugcuuuccuccugaauuuugacaugauucugcucaauauauuuacaucuaaugaaaauuucaacuaucuaaaauaugacugacaucuaauugcaaaaugugugacuguuugcauggguugcucugcuugcuauuuuucauucuaccaaugauuucauuaaaaagagcuugcuuccuacaggauuucuguuuauuuuguuuuguuuuguuuuccuauguaguuuaauuucauauauaauaaaaguauaggaaaauuguuuuaaaacaauaaauggcauuaguagaagcaauaguacuucaucauucaugacauucugauauucagauaguauauuacuuaaaaccaggguagaauacuucaccugaaguggcuuggcuuucaaugucaugauaagguaggguuucuguagguaucaugugcaauucagacuuuaacaugaaauaaugugagaagcaaagcuuccuuuugguugccauuuucuccuuucuaaaugucauaugucauauuguaacauuucauuccuuacuacucuucugagaagugauuuuuaauucauuacuaauuaggcucucucuuuuguuuuuuaaaacuacucuuguuuucuuugaaaagugauggaucggaugauggagaugacgagcaggaggaugguguggaagguuagucacaguugcucuaagucuguuuguguaacucucugugguuuguauuuaugccucucacagauaggcuuugcauuguugcuaugaaaccucacaaaucacugcaaaaaacaaaaaguuugaggaaaaagcuucggauauauuucucuuuuuaaaacuuaaucuaaaauccuucucauguuauaaaauaaauuuaguguaauuacagcauauuuuuuauuacucuauuuauuacuuacuuucuguggcugugacaaaaugcuugccaaaugggaaggagguucaugcagggaggacauggcagugggacugguagcuagaggaaaccaggcaggagucccacagcagcggauggguugugguccucacagcucacccuagggaccuacuccugucaggcccugcagcaaugaccucacagucucccaaacagugccacuuagcuggggaugaggaguucacucaaacugaaacucauaguuuccuuuacauugauaacuuguagaauuaguauuuuugucaaacuucuaugagccaaaaagugagccuggaaaggaacuuuaaauguccccacaacucucuuccgcguguacuucuguacucacuacacuuacucagggaacagccuucucuagugagcagaguucuuacuaugccagcaccaggugucauugccugcaacgucuucaccguaguuugugacgucagcucuuagaguagcauguccaagcgagccuagagacuucauggaaccuaaauuauuaucguauuuauauaguuuuugaauguccuucucaggucuuacuuuuuaaaaauuauaaaaugauaauaauuuuuauaaaaaagcauauuuauauuaaaaauaauguuuaauauaauuauuuuugaacuagugaaaaauuauuauuuuuuuuuagaaguaggaaaacugagggcuggagauagccuaguguucuauguugggaguucuaccucguacccucacgccaauaauguagguacacugagacaauuauaaaauguugaagagaauuucuugagauauaacccucaguuuccagccaguuuaucuacacuguucuuguucagggaaguuacauaaccgaucuuuaaguuaaaauucucagauuuaaaauuauuguuauuuaguauuuuaaaaucacauuuauuuguuuuguaugugugccugagugugcauaaguguaaacacaugaaugccacacaugucaugcaucucacauggagucaguuuucugucuaccaugugggaccugagaugucaacucagguuuuucaagguuggaagcaagugccuuuaccagcugagccaucccacgguuagauuuauuuuuauuuuaugucacuggguauuuugccuauaucugugugcaguauccaacaaggccaaaagagggcgucugauugcucuggaacuggaguuacagacaguuaagagcuggcauguggaugcugggugucagauuuggcuccugcaagagcagccaguguucuuaacuagcaagucaucucuccagcccuuacuauacauuuuagaguuagugauaaucuacguaguauuugcuuuauuuuuguucauuaauguguugaucuuuaaaagucauauacuucuaauaacacucaugaauauaauuauuccaaagacuaucuaucuguauguauguauguaaguugugggucuuuaauagccuaguuauuacuuaacuaacuuugcugaggaauaauuaagagaagagguacaacuuaauaaaaauaaaauaauucauuaaaaaaaaauuaguaguaggccugaaaaugucuucuguuacuauguaaaaaccaggagguuaauuauauucaagugcaucauuccucagcucuugagaugaugggcaucucucauguaugaagucguagugaacuuuugaaauuuguuccauuagaagauagauugguuuagauugacagaaagccuccaaauuagggauuccuacaauagugaauaucugcuuuuuaaaccuuccuucuuuccuauuuauuaauuuauuuguuaguuagguggcauaagccuugaccucuguugaaguuucccaucaggccagguaaccagcagacccuaaccaaggaaacccuagcaguguagaaaagcauuaacuaacccagcuuccaaccccaggaacacugcagggcuuacuaagggccucacauacagugucuuguuccauaguauuuaagaccuccuuuagaacaaauaaacauauacagaccguuuacuaaguuaauuuuuuauguuuaacauacaaagugauuaaugauugcauguguugaucucugaauauuuaucauuacacuuucaucuuccuuauugcugucucccauuggccccauuccucaugcuuuccuuuggcugcugcuucucccuaccagacaguccuccuucccugccggacagcccuuccucugcucaugucaccuuacucuuccucucaggggucuuacuucucuuucauggcucacacaaacaugaauguauguaaguacacauacacaauuuuaaauauagacugcauaggaaagacaacauacacuuacuuuugauugauacuggcacaaagagcaaaaaagauaaauuccugaguauaacauggaucaaaauuuuuacauuaagaauagaaagcuaacacaaauucuaaaaaugauuaguaguggucuagagugccuuauauacuauaacagaaaaauguccaucaaccacaaagaaauucaccaacauuuccauuaucaguacauaccggcuuaaggacuggcagcaugcccuagauacuucuuguacucaguuaucuuugagugggaauauuaaacaugacacuaguucacaggacauuggucccaucauccagcuagaaugucuccuuuguauuaaaaacaucauucucauuaacaagaaaguaaaauugagaacaguuccucuuugucuuauacuuaaacucacuccaaauaguauuuuacauuugugccaucaguaaaugaucaaaaauauuccuuuguuuuagcauuauuuuguccuuaagaaaugcuuuauuugacauuaugguauaguuaaggaaagcauucacuggaaucuuaaaucaaaacuagaguuuugaaaguugauuggauaaacuuuacuuccuauuguuuaaauuuacuacuagauuugcagcaaaauggaaagacucugcuaauuaugaacauugacauggagccuggagcuguagacccgcaauuaaggauuauucuucaguggcucauugccucugaggcugaaguugcagaacuuuauuuucaggacucugcaaagaaggaguuuauauuaguaaguaucucccuucuagagugcuggugaggaagcaguaacaccacucacuaaucuuaaugacuuuguugguuuagcaaaaugcuuguugauugcagaauauuaguauguaggagucuuacaguuggguuuagauuugccacuuuccaguagguauaaccuugggcagaugaguuagugaaugucucaguuuccuuaauugcaugugggauuagagucauagagaacuuaccuugcauguuuguaaggauuaauuauaauacuguaaagaacaaguacuuaaucuaacauccuaacccuagaaauuagaugucaguaauaagcagcucaugaauucuuaagaaaagauacagcuauuauauuucugugauucauaauuguaccuaauuaauuaggucguucucaucuuuaugugaauagaaggcugauacaaugaaaaaucaauauaagguuagauacauuuuuuagugugcaccaagcauacuguuaguagguauuuucaauuuuuagcuuuaugaguguucuuccccaguuuuccauaugaaaaauuauaaccuuaccauaguauaaaacaguccacugacuaaacaauauagauuaaucaaaaaaggacaggaaaggaaaacccaagauacucuauuuucuaguucaaaauuuacaauaauauuguagaagaugucugugaaggaugugaauacucugaaguggaguuuauuagcuugagacuucuguuugaaggaggagaaauacucaaaugaauuaucaaguggaaauguggcuagggaaauuguuagaacugaggcuuaagauagaccucggucggcuacauggguugacagguggugguuagaggaggaggccuugcuaucguguaaccuagcccagggaucuuugccugauugagucacuuacaaugcucaguuguggauggcaagguuuuauuauauuuauggcucauuuuaacuauuggcucucagagauugugucuagcuaggacuccacaaggauauggggauauuugaaacaguugagacaaguacagcuuauguuugguaguaauaagaauaauauaaauacuuucuguuuuucuggaucauacauuaaaauuuaacauuuucauuauuaaauagaacaaacaguauuaccuuggggauaaauagaagauggcauacaauuguauuucaaaaaauauaaacauauuagguagcaaaagagaaacuagauuaaugacuuguauugaaagacuuugccaacaaagcaagaagacaguucacauaugagaggaaauguuuauaauuuuguauuuauaaaguucuuaguccuagcauauacaaaggacuucauuuuaaaaauaaaaaggcacauaauacaauuuuaaaauggacuuggaguuauuaguacauaucuuuggaaaauaaaaccacgaaaggguguucaacuuuacuagccauuaggaaaaugcaagucaaaaucaguacacacuucagcaccagcagggugacugucaaggugguaacagcaagugugggaggacaugagaugcugcguucuucauaaaguucuuagugagagucuaaaguggugaagcugugguggaaaacaccugauaguuccccaaagugccaaggacacauuaccaagucacccagcauuucacugcuugguguaacucgggggaacagacacuuccucagacaugccuauggcaacaacuuaugcuaggcaaguguuaggcuuggugguauaggucuguaauuccagcacaccagaagcagaggcaggaggauuacuguauguuugaggccacccuggucuaaauuaagcaaguucuggucauaguaagacccuaucuugaacaaaccagaacaaaacagugagaagucuccaucugucuuaucaccuaaugaauggagaaggagcuuuguugguuaguagaaaguagugaggcaccgaucccugcuuuacuacaagauaacuaugcuccgcccaagaccacgcauagagccuacaguuccauuucuaugaaauauccccaaagaggcaaagcucugaggccccaaguagaugagugccauacuggaaggugcuacggaggauggagaggggcuucugagucagagggcuuuuuuccuggugugaggaaagagcauccaguauugauugugugauacuuguuuucaguucagugaugcuacccauggcauaugaauuauaucucaaagcuguuuaaagaaaagaacacuuccaguaaaauaguuuuucaauauuuauuuuacaggccuuuuaaaacuuaagaauucuuacauaguugaguaaacaaacaaaaaaacgaauaagguccuguucugcuuugcagugguggaguugcuuaaaccccguuuacucuuuugcuugcuuuuuuuguugaaacauuacauuucuuaacuuagaaagccauguuucuguugagguggaguguuuccuagaguauaaaccacacuauaugcuguggaaaggaaaaucuacauccuuugauuaacuuugacauugucauuauuauuuuauguuucuaauugaggguguggcagguguuaguuagguaaagacuuuuccuguagacaguuacucuguguucccaugcauucuguccacugccaagauuuggguucuguuucuagcaauccugaagugucauucuguggagauguguuucugaagguuaagaaaggaaaauguuuaauuugggcaaagggcuggugguugaggggauaucucauaacugggaaagaauauuucaugguaaacagcaggauuuccagcuuugucuaaagauaaaaacaaaaauuuuguugccugaaaugauuuucuguuaaugugugcuaauguuucuguuaauccuucuuucuuagcuuucaaagcaguuacaagagaaaggauggaaagugggagauguccugcaggcugugcuuaaauacuacgaagugguggaaaagcccucaagggaggaaagaugcaagucgcuguuugauuggcuuuuagaaaaugcccagaacagacuccagaccaguaugcuugucuagaaaguaaagaaauugaugauuuacauguaggauaaaauucaaaugcagaauauuaacauuuuaauugaauugagaggaaaguaagaagcuuuuaaaaugcuuucugucauuacacuguauauaguucauacuuuuguaaucuuugucaagauauucucuuuacuuaaucuucuguacauguguauguguuaugacccugagauaauauucugugaaggacgaucuaaccccgccugaggcuggggcauugucugacagcauuuguuuggauccacauagugcugcugcugcugcuguugcugcaaacagggcugaggcggccugccuggcccaaguuaucacuuggcuccuuugaaaacagguggcgucuaaugauaagucaucugacaucaagaaagaaaacugaggcugauauuuuguuguuuauuuauuucugauaaguuuuauucuuuauguacuguucuuuaaaaccaguuuuauuucccuaguucagcuauugguacuuguagauuuccccagaccuuuaauuucuuagcagacuccugacugauuuagguuucugugaacaucauaaaugaguuccccuugccuuccaucaagugacguuauuugcuaauacugccaauuguucugaaaugagaaggagcggggugggggguggggggaagguuuugagagagagaaugugugugugugugugugugcgcgugcgugagaggauaaacuuuaaccuucccacuaguuuauucuuuuacuuuaguguuuucuuaguuagaaaaccacuauuaacauuaaauaaaacgucuaaauauugugcaguaagaauuuugucuuuuuuauuuauuccacaaaugaaaauucagguuguaaaauaaauugaaauuuuaaaaauuaauguagaaaugcauucagaggagccuaguaguaauuuucuguguuggauuuuugaagaagaagaaaaaaaaaaaacccuccucacuucaccaagaguaauuucuuuuagcuaaguguuucucaaccuuccuaacacugcaacccuuuaauacaguuccucauguuguggugacccccaaccaucacauuauuuugcugauauuucauaacuguaauuuugcuacuauuacuuggacauauugguguuuucugaugggggucauguagccccagaagagguugcaacccacaggucgagagcugccauuucagcacagaagcaccucucccccaguaaaaugugucuggacuguuucauaaagucucuucucaugaucuuuuuuggucucuacauucccuacuguguuuuuuagagauugcaggcugcucugagugaggugaccaggcugugucucugugucugagauuugugaagaugggagggucuccccuaaccgauucuggaaucuaaagcaggucguauugcuuggggcuggugauuuuucuucauuacauuuuucauuuuuccucaagcucugacuuuuuuagaagcuacagugaguagaagacacagcaccuaucaggggacuuagguuaauuugaauuaguaauuauggugaaguuauuuuuauagagaugucagauuugcuuugacuccagaaacaauuuaaguauuuugaaacuacauuauaaacuguaguuuuuccucaauugaacauagagacacggggccugccuuaaacauacauuuuuaaaaguuucuucaaguauuuuccagaguggggaaaugcagggaauaauacccaugugcacucuccugcgcuugcacgaggaaccagcacacugcacguauguaauuugcaugauauguauugcuuagauuaacaguaaaacugacuucuaauuucuuugaggugcaaaugacaauguugguuuucuaaaguugaaagugcccaggcguguuucagcugcugguguaguuauuugaggcgagcuuuaacucugcuccugguuccuuugcauucuggugaagccaagcagcgcucacucaguguucuucauucagugcaacagagacggaguggaccucacacugcguuggcucugugcagggacacgggaaacagaaguuucggcagggugcgcagcaguguagguugacuuucuguaaagaaagcguuugaguguagagcaguguugugggccggacacaggggaaggaggcggcuuuaaagcacuuugucuuuggagcaucucuauugagaugcgcuccaucuuaucacagauuucuugacauauuuauauuggaacuuguauacugucaugcauuuugcuccuaaugaaauacaauuuacucaaaacuguuaaaaaguugugaugugcagugagcugauucuugauucaccaguuuuaaagguauucugugauccacagacagacagaccuuugccggaaaaaccaacaaacaaaaaccccacagaagaaauggcaguagagaugagcuggcuccuugugguguaaaucuaacauuauaacagccuucagugaacucauguaguaccuuuguacuuucagaaaugcuucauuuaccccuaaagauauuuaaugugaauuaauucaguucauacuacuauaccucugcuuagcaaaggacuuauagugcugguaggaagcuguauacugagugcacuguguggaaagugaagaguuggcccaugugacagcuggcagcucugacagugguggugcaugcucuccguccuuguccagagccucauggcuaccugcuguccaccaguaguguuucuccacagcuacuugcagcagcuucuagucaguguauuauuuuguaauuuuucaaagaaaucuuuacacagaguuuaaagauguuggguccacacacggguagggaaaaugcucuccauuuaaaaucaugucugccagucagcagcacaugagaacugugggagugucuguugggauuggaagcggcguacucaagucaagugcgcuuggcucgucagcacaagcccuguaggcaccccuuguuuacugugcgccugcucugcacacacaggcgcggugcugcucacuccugccucucuauuuauuuauuuugaccauguguacauuccuuucauagaguuagaacugcgguucugcaggcuccuauugcagucuguuguaugguuuggauacuauuuaaugccagguuuauauguugcuggauuugcugccuucaguuacuugugcuguguuccaagcaaucugcauucuuguucacuuaaugaauauuaaguagaaguaacuuugaauaauuguggccauuuauuugaguuugcucauuuagugcacuaaggucuuauacuauauaacaguaacuccucuuuuugcucuugaguaauuuaauguucauuuaccaaacuuggaauuucaagaugcacuaaaguuuuauuuagcgguggcucaaaaaauguuucagaacuuacuuuuguaauaauuugcaguuaauuguucuuuugucuuuacucuuguucaagccugugaucuuuccucucccagccaagaauuauucaauaaauuuaaagaaaugucaag

SEQ ID NO: 7600 - RNA, 4323 nt, Mus musculus
ugggaaauuaaaaauuaaaugugcuuuuaauaacagacagagcuuuauguuucccugucguagaugcauuuauugaggauggaaaaaagugagaaucuguuaaaaacauagauagugcaggaacuugagacgguuugccaaggcccaggaacaaagaauuugaacacgucuuucccuuuguauuacaggaggacugaaugcacauaaaaugucuaauguggugagcacugcaccucagauagcgcccuacuggucaagucugaaguccuaacuagaaguuugcuaauuaacucuccagagagcccauuuuacugcagaaauuacgggucaauuaaggaagccaucagggugggcgagcuaaccucuuagacauuuagaacagcucuggcgauguuuauucccagggcagagcugccugugcuuucucaacgcagagcagccaguaguggaucuugguucaggagguuggaaggcuccuuuaaaggacagaauaaaggugacuugguccauagaugaacaccaaagacacuuucaugacuuagccgagccuuggaguguguuugcugugauguguuucccguugagauaguggugguuuuucacucaccucuuggaucuaacaaggcucauuuggucacaccuugucacugccccacuguguccucucuacucuaauguauuuugcugccuugggaccccagcucuaagaguuggcccaacacugccaguuauaaguagucaaauuguuuucuacaauaagaaaggacagaugucaccaguccuaccuaaauuuacuaugucuuucccagugacauuuuaguuauaaagaaagccauuccaugaaaaagagacauccaaucugguaacccuugacauugcauuuacaaacaaaaguggaaggcaagugucucaguggaagaguguuuauacugcaagugugaaacccugguucacucccaacagugcguaguacaaacaacaacaacaaccaaguggaaggugaagcugaaugagcgacagcuaccuagaguaggucaugggucuuuuaaucugcauauuagguuuucuguguucguguuaaauggcuaguuuaucgagaugaauauagcugucagucaagguccucacauauucccuuagagaaacugccccaagaagagacaucauauuccacauccuacuugcagucucacaucccagaguacagagacacaaaugugcuuuguggaucagucucuaggacuuugccucaagaauggcugauugagcacagugcaggggagcaaagggccgaucaggaagcccagucuugcuugcccugcuccccuuuagcucugcuucuccucucuguuaaccuuucuaacccaggaaugcagagcggcuccagcguggggguuuaguaccuuggcagaaugacacggcccaggucagcucauccaagaaacagugcaaauucacaguuuugugaagcauuguuggauggccuccaauuugcagugcuuuugcuucagucugccuacagcauguuuuuguugguuguuuuuggugguggugguggugguugguugguuuuuauuguuguuuguuuauuuguuuguuuuuucgagacaggguuucucuguguaguccuggcuguccuggaacucacuuuguagaccagacuggccucgaacucagaaauccgccugccucugccucccgagugcugggauuaaaggcguggccaccaugcccggcgguggugguuguuuaauccaucucaaugauaacuuucaggccaauauuucauccacguuuuauguauauucaaagcuuuucuguuaaugucauauucuguuuuacacacacacacacacacacacacacacaaaccccccacugaauuuuucucgauuuuuguagucacagcguauagcuagcacauaauaggucuuugacauaauguuuuugaauauuauuuucauacugucgcaaauaaaaacucaaaauaccuucaaagucuugugcuugcaaggacacaagccuucugugcaaacauuaucaggcaaaagcaacuguuuggucaaggauccucauauaaaaaucacauuucuucacaucggaaauauuugucaggaauucuuguuucugaaagugagacauaauuuucagcauuccugacaaaaucuugcuuguaaaucauacaccugcccuacagauucuguucuauacacuacuuauagucuucauagacaaacauauuaauuaugaacuaggaaaagaauaaaaaacaguaagaaagguggaauuuuuagacaguauuugcccaagaagacacagaugaaauuuguauaauuuugggccauuuacuguuaaugauuauuguauuacaaauauaggaagaucucugacuaucauuauccuuauaaaacauagugacuaaaaauuugcuauuacccaugggccuguuuuccuuuuugacucucugaagccauuuuacuauguccccaaauaaugauaaaaguaaucacagugcucuguaaguuaaauuucuugaauaaacaccagucaauuagauaauuaagugccucuucuaggcacuugguuaacuuuuccuacuucuuuguaacugggauacgcacuuagauacugaggauacugguaaaauaagacaggacucuugucuguaggcuuucaauuuguccucgaauugaucuuucuaaagucuguuuaaaaaauuaggagggauuuuaaacaagcaaaagcaguuucuucucuggagugauuuuggccaugucuccuuccaccccagcacccuccaaaacuaaccaaaucugagucaccacaaagcaacuccauuuuuauuuccgcaacucguguauauauuuuccugucagccacaguucuggcuguugcugaucaagagugggccucacuagcccugcacucugcugcuucugcugcuagaggggcugcguugaacacaggggucugguucguagaacaggaagaaaucucagguuuauuuggggaaggcacaaauucaugacacuuucagcagaauacaugaggugacauugcagacccacaggagaggauggaucagaaggcuccauuugaaguugguugaaguggguugguguuaccuuagguaucuugauggagguaggaagucauggcauuugacagggagcacagcuguuaucucagcauuaguaacaugcgaaucuaugacucccacaaggcucugauauguagaugaaccacagcaaacauuuguguuaugauacugacuucugaauauuuauugacagauaggcuauagguuuccuuuauugagaaugaagaaauaaacugucuuuaucuuuccugucaguaagguugggggagggggcuuuugcugguuuguauuuucacauuucaauaagcauauuuugaaaucacuauuucccaucauauacaauaucauauaaaauaggggacacauuucugugucccuuagcaaaagaaaggucucaacuugauagcuuuuaugcuuagcucaacuuuguaaauguuccacaaaagaagggggcagggaaggcugggcgcugcacccuucugcccagcacguucauuacgcuuuucaauaaaaauagaacuuauuucccgccuguuaccaucaugguaaaaacuuaacaauguaguuccuucucuuucuuauauugcaaaagauaguuuuaauuuagucuugccauauuuauauagcuaagaauuuacuacauuuugguagucuguuuugaaacuaaauacuuguaucugacagaugcagauaaagucugccuauuucuuacacagugggcucuguuugcuacagaaaagagugaaacuuuucccagcuuagcacauuugccauugaaauggaccugacagagcagagguucuaacuuuggcuccaauuacuuuuaauaaugauaagacgugaguucuguuuguuuacaugcuguuuacaauggcauaauuuuuaaaaauaaaucuauaugagaacugagauauuuauugcauacuauuuuaaagauguuuuaauguguuuucaccuuuggaauauauuguuacauuuccuuguacagauaauuuggguggcuuuguuaauguagcuaauaauuuuuaugacuacuaagugaccaguuucggugccuucucuugugggaugcaugacucuguauuuauuguaaggaagucacugauguguguauuuuuguacugagaguaaugguugauguucaugaugaugagagacgucuuucccaaagggcacugccuucagaucgaccuucucaaauaaaaagacugcauuggaaggug

SEQ ID NO: 7601 - RNA, 156834 nt, Mus musculus
gauggccggggccggcagccagcaccacccucagggcgucgcgggaggagcggucgcuggggccagcgcgguuucccccacugcugcaggaccgggagaggauucguccgacagugaagcggagcaggaggggccccagaagcugauccguaaaguguccaccucuggacagaugcggaccaagguaaggcucggccgggggccugcgagaggguugugggcagagggaacgcucugggagaucccuggaacugguauccggaggaggggcgcgggggcgcggccuggauggggcguggccucgcgcagggggccauucggugcucuagggauuccugcuguggguuuaagagauagcuaggguguguucuggaacgcuugucuagccgucagaacaagcgucuuggagcacgguuaaagccggguggcgaguucccaccuaggaaacuuaaagggaguuugguuguucacccaugcgcugcaugcuauggaagaccugcuggaagcuguauucugccagccaccaugcauucccacccacagcaagcugcuugcaccucucagucaguuucucugcugugcugugcccacaggcuggccuggcuucaguguugcagguucccucaaagugcagggcucggacauccaugguguuucaucacaaguuaaccucuuuaggguauuucagggugugguagugcuuuuguggcguuuugugcugaucagucucaaaguugagcuuucauuuaaugaugaaggcugaggcuacuggguuaagggacuuagauauucuaacguucuucuuaguuuagaagucuucaacaccuaggcuguuguuaguggaggaguuaaagcaagauuuugaguagggaacugauuaaauuaguggaugcucccucuaguaacagauuugcaaaagcaauucauucuacaguuaucauggcuauuagcugccuaaggcuuaugagagugagucuuacauggaaacaguuuggauuaguguuuguuugagcgcgugcugacuucuaaaauucaguagacuuauacaugacagugacuucaguuaccagagucaaagguugcuucagccguguuuauuuggacaucuuggaacuacuguuuaauggagauggauuuugaauuucauagcauuuguaauauuucugaauuuagauuuuugaaaacuaaagcuaaccaugcuuuuaacuugugaaaucuuagucuaaaaaaaaaaaaaaaaccaccaaaaaccaaccaaacaaaaaaccuuggccaguaggugguggugcacgccuuuaaucccagcacucaggaagcagaggcaggcggauuucugaguucgaggccagccuggucuacaaagugaguuccaggacagccagggcuauacagagaaacccugucuuggaaaaaacaaaaaacaaacaaacaaacaaaaucugaaaaggugaauuaaagagaaaaacggcagguuucaaaaauggcacaucauauacuuauaugcaauggucaaaauuccaugccuauuaauaucaauauuggcuaguaagauuuaugccauuugaaaaaaauuagggaugguauaaauugaacugaggaaguaagauugaacaaaaaaauugauagaaagcacuauuaauuugugggcuuagugaacuugaaagaucguauuguuuaauuuuuuggauaaagcauguuuaugaagacuacaauaaaucuaagaaaaaauuuuuuuuucuuuuugguuuucuguuugacuuuuugacaaacauuugccacgauuauggcuaauuaucaagcuuuggaauacugcuucugauauuuauaucagaauaucaggaaaucugcauuuuauacuggcucauauguuaguauuuauauaaauguuuuugugcacaaacaucugaugucagaguauuaagaugccaagacuagugggccucagccucacggcccaccuccugcaguccaggcuauaacacaugcuguggugcccaucacgguggcucuuagcucacacacugcucuugaggggagaaggugaggucuguggaggaggcaauuuaaguagagcuacuaaagguaacaguggguuccuagucuuugggaauuauccagguaagaagagaagcacccuuagaaaagugaagauauuuccucaucuucucccuagggguauaaggugagagaggcuugaggggaggcgcaggccccagauuuggcuaaggcuuaguugguuuugaggccacacuaacaguguuuucucagucauccugacgauacaucaauacccucuaaguaugguggguuaggauuacuaauaguguguuuaguucugcauucacacacuuauacauacuacaugcuuacauauagauguguaaaugugcuccugaugaauguguuguucauagaacuugaagauauuugagggcaggagcgacuaggucugggaggugcuugcugugcaaguggaggaccugagucacaucuccaggaccgguguguuuuuguugccucuauguugcagauccccaguacccaugugucuuuguugccuuuauguugcugugauaaaaauaccuggaccaggagagcuuauagaagauugguuuugggcuuuuacuuccagaagcauaagaggucauccugguggggaggcauggcagcaugaggcaggcauagcaguagaagcaggaagcugcggcaugaugaacugaaguccuggaacagagagagccaaccgagagcagugugaagcuuuaaacucccagacccugucacgcccccccucacuuccaaacccugccucgcccccccccgcccccccagugagguacuuccuccagaaaggaacuccuaauucuucccaaacaauggcacugacugaggaccaaguguuuacauuucauagacugggguaaugugugcauggaguggggguagggguggggccagggguggggccagucauucuuauucagaccccucuaccacauuugauaaaagacaggugcuggggaggcagacacaggaggauccccaugaguuguuggccaagccagucaaaguuucagguuuaaggauuaaccuuguccaaaaauuaaagagcaaagugacuaaagaagacagcugcugccuuuaaucccagcauucaggaggcagaggcaggcggauuucugaguuagaggccagccuggucuacaaagugaguuucaggacagacagggcuauacagagaaacccugucucggaaaaccaaaaaaaaaaaaaaaaagaagacagcugaccuugaccucaucgaaugcaugcgugcacaugugcacacacacagacacagacacagacacagacacacacacacacacacacacacaaauaucuuuccaugaaugacugcauaguuauuaaauacuugcaaugugaauauuuucauuggaaaaaagcccauugacuuuaguucccauuaaagauccccagggucaugccccuguuuggcaggcagugaacagugcagaacaguuugggcuggagaggcagcucacugguagacugcuuugcuaccaugcaugaagcucuggauuuaguucccaguacuguauagaaacaaggugcaguggcacucaccuggaauucuaauacucgggacguagaggcaggggauggugcuucaaggcuauccucauuuacaaagggugucccagggcagccugggcuacaucaaacccugucucaaaaccaaacuacaaaaggcgggaguuuaaguaauuaaccuuauuugaaauacuuuuuguaaauauuucaugauacucuaaauuauuugcauacuaaaauggacauugcauuacuugagacauuugaaaagugucuaggcauuuucuuaauugaaaacguuguacaagcuggcaauggguauuuuaauuauacuguucagaaggcugaggcaagaggaugguaaauuugacuauagccuggccuaucuuguaaggcccuaucucaaaacaacaauaagacauguagucagacauacugucuuaguuaggguuucauuucuauaaacagacaccaugaccaaggcaacagagggagaacauuuaacuggagcuggcuuacagguucagaaguucaguccauuaucaucaaggcaggagcauggcaguguccaggccggcaugguauaggaauaguugagaauuccacaucuuguuccaaagucaagcaggagaagacuagcauccaggcagcuaggaggagggucuauaagcccacccccacaguggcacacuucuuccaauaaggccaugccuucuucaacaaggccacaccuccuaauagugccacucccugggccaagcauauucaaacccacacauacuaacaguacaagagacuacagggaaaggauucuagccaugagagaaaucccaucuuccacugaucucuggcuuccuccuagaggcaaucauaagugauguuuucuugggaugcuuccagaaaaaucucuaugcacuuacaaguguuauauauguacaccauacacacacacacacacacacacacacacacacauauauauaaacauacacauauauguauacacauacacauauauauauuaaugcauuuauacauuuuuuuaagauaaccaaauaucaugguauauacccagcacuggggaaacugacccaggagaauugccuaaagaucaaggcuaaccugggugacauagugagacccucucucaaaaaauagacauuuagaaaauaucacugucuauuuuauauucauagauauuuauacauacacacacacacacacacacacacacacauauauauauucuguuuaaaaacugcuacuaggacuauucccuaauggucuucuguauauuauuuacuuccuuccuuuuagugacaguaggccauucagaugagcugugccaaauugcuuucagcaguucaaaauuggcaaaguauagaaaguuucauuugguugaacuaacacgguaugugaucauuuaauuaaucaguuuaguggaaggaaauuggucguuuuaggacaguacacuaaucucagcuuuuuuuguaguggauaugccaacuuuuaauguaaagaauaggaggugugugugugugugugugugugagagagagagagagagagagagagagagacagacagacagacagacagacaggaagaggugugcuggcacugccccagcucagggcuaagacugugcuuugaagggcauggaguuugacagugaucuccuguaucguagcgcccuccucaccuccaucuuugugaugucuuugguccauuuuguuugucuuccuagugucuagguacaucuuuuuuuccucuuuacucauucucuguuuuucacuuguaucucuucuccugucagcugaguagaacuucagguaguuacauuuagguugcagugugauaagcaagauaauuuuguauccaacuuaauuucccaaaggcaaaaaaaaaaaaaaaaaaaaaaaaacucugcaggcuugaaagagaugcuggcuuguaaaaggcaaaugggagcaguaagguuuccauucuuggcuugccucuucacccuucuguauguucccugugggguggcguccccuuuagacuuggugcuguagagcauuucauaugcauuuuguagguaucaauggucugaaaggacauugcuauaaacucuaaaugugaagaagacugugugugccuuuguuggccugugagugcaguaaucuuucuuuuuuuuuuuuuuuuuuuuuuuuuuuucuuuccauuuuuuauuagguauuuagcuuauuuacauuuccaaugcuauaccaaaagucccccccauacccacccacccccaccaguaaucuuucauuaugccucaauggcuggagauuguugcucugcuuucaagcuggcauggcuaacggucagucauacagugauacacaccgaugagaacugucuccaugacuuuuagccauugaauuaucucagccagcugggcggugguggugcacgccuuuaaucccagcacuugagaggcaggggcaggcagauuucucuguucgagacuagccuggucuacagagugagcuccaggacagccagggcuacucagagaaauccugucucagaaaaaaaccaaaaaccaaaaaccaaaaaccaaacaaaaaaccccaaccaaccaaccaaaacaaaaaacaaaaaaaccccaaaaacaaacaaacaaaaaaagaauuaucucggccaaggucagaaagcuuugugugucaaaaauaucuccugauuacguaauggauuucuuauuuuguuugacauuuaugaauauucauauauuaauucugaauggcuauaaguuguucucuaaauuuggcaaaaaugugcuaaacacagaacacagucagcugaugaguugcuuuuaauuuaucaugaaaguagcuuuacagugaggcaauuuggacuucuguuuuucuuugcuuuaugagauauaguuuaggcaauuaaaacauuauuaucugaugugguggugcacgacuuuaaucccaccacuugggaggcagaggcagguggaucucucugagguuguagccauccugcuuuauguuguaaguuucccggacauccaggguuacacugaaagaccuugucucaaaaaaacagaacaaaauaaaaaauccaccaaccccaaaacaaauaaauggacaaacaaacaaacaaaagcaacauucuaccaccauuuguuauuauuaauuuuuuaaucaugauuucuugguggaggagacaauagggcauuuagucacugacuuucaaauuguaaaagguauuaucuugggaggucaugggaguuucuaucuaguguuuaaaacagaaacaauaagccacaagguaucuuuaagaaucuucagccucuguucuguguggaaauauuggaaucaagauccaaauaagaugagaagggagaaggacccaaguuggaggccaagaggaacaucugcaaucaucuggggcagaacucugccuacuucccuaaagaucacagugccaaagaugacuacguuucaggcuauuaggagucccucagaauugcucaucucugagaaugaugggccaaggaggaagguagaagaggauuggagugauguuugucagagugcaaaauuucugucagacuuaucagguaaggucuggacuauagaauaaguucuguuguaagcuaccguggugcuaauucgacaauuucauacuguugugaauaugaaaaaaucauaucauaacauaacauacgcagggcuuuuggugcuggagauugaaccgaggaccuugagcaugguagguguccuauuagaguuacuauugcuaugaugaaacaccaugaucaaaagcaaguugaggauaaaggguuuaucugacuuaugcuuccacauccauaguccaucacugagggaagucaggacaggaacucagccagggcaggauccugagguaggagcggaugcagaagccauggagggaugcugcuuguuggcuuacucauccugcuuuccuauagaacccaggaccaccagcccaggaugguaccagauugaugggucucucccacaucaaucauuaauaaagaaaauacccuacaugccugucuacagccuuaggaggcauuuucucaguugggucucccuccucucagaugacucuagcuugugucaaguugauaacauuagccaucacacugggucaguccuugaccacugagggaggcucuuugacaaucugcccuugcuuucuuucaaguuucguuggcaguaggguuucccuaagucgcccaggcugaccuuuauuuuguaggccucuugucucagccuucagagcaggugggauuauacucaugagcucccgagaucaucuuaucauuuuuaguauauuuuauuacuuuuuuugagaauuucauacaguguauucugcucauauccuucccagauccauuacuuccaucuuugcaucaccucugccacagcugccucccccuccuccuucuccuccuccucccccuccuccuucuccuccuccucccccuccuccuuuuccuccuccuccccuccuccuccuccuucuucuccccuucaucuccccuccuccucucccucuucuuccuccucccccuccuccuccuccuccuccuccccuucaucuccccuccucccccuccuccucucccuccucuuccuccuccccuccuccuccucucccuccuccuccuccuccauccacccuaucuaguuugugcuguccauuuacuuaagugugauggaccauccacaggaauaugcuagaucuaccgggguccauacccuuaaaaugucuuucccuugcccagaaaccaucaacuaacaauaucagcucauaauuuuugucaguaauucugaaauaaagaaaaaggauaacaaacugggugguguugaccuuaguuccagcacuccagaggcagagggaggcagaucuuugaguucaaggccagucuggucuacagagugaguuccaggacagccagguauacacagugaacccccuucccucucaaaccaaggaaacaaaacaaagcaaccaacccaccccaucccaguaguuucucugccacugucaaaugguaucaagagugcucaagagagugugucuguacuccaguaaaacuucauuuaaagaacuggaauuugaacgucaugaaguuuucaggguuaaaaauacucuuuuuuuuauuuuuuuaaaucaaccuguuuaaauaugucacuuguggacuguguaaaaaucaagugcagacaggauguggccaaugagauggucuguggcucuuguuggccgaggcuggccucuaccauagaaucuugagcugguuugugguuaggcucucaaagcaacgcaaaguuaaagcguagcgaaauaucagcauauaaggcaccaaaugaagcuaaauuucaguccauuugaaaaaaaaacucaucuuuguagaacguuuuauuuuuagcuugguuugcgucuuugcuuccauuuuaaugugaacuaaauauagccuggaaacucugacccuugguacaguaauauauaguauaacauauaguauauguauauaguauaguaugacucuugguacaguaacauauaguauaacauauaguauauguauauaguauaguaugacucuugguacaguaauauauaguauaacagcuuucuuccauguuaacuacacgucagacaugacgguccauugucaaagauaagaggcauaaagaauuuacuaagccuuuauguauagcguaagaugcguugcuucagugugucuaaauuuagaauucuuuggcuuagucgaagguugcguguuugcuguuaggguggccgggagagaggacuaggaaaguuuggggcucccuuuggccuuggucugauacuagauuaguuggacuucucucauucaggaacuguuuauaagggaagguuuuaauuaaagagaguuuguuuuacaucuaagaauagacuuugacaaagaccauagcauguuaguacauuacagcugcccuugacaagugugguuucacucugugacucuuuggacauuugagaaauauuuauaauuggccauguggguuaagauggccaaugguuauuauugaucacagcuuuaacuuaacauucaauguacucuggucgucugcuuguuuguuuguuuuuuguuuuuuuggccauuuuacauagguggguuuuuuuaauuuuuauuuuuugagacagucuuacucuguagcccaggcaacuuggaacucaaacuuucagcaauccuccugccuuagucuccuaguccuuagcuuacaggaaucuugcucagccauugaugcuuuagaaaguauuuuaauuuucaguuuugcguaugagugugugucuauguuuggauauaugcauugagugcggaugcccucaagggucaaaagaaggugucaaaugcccuggagcugaaguuacaggcaguugagaacagccgacauugguaucaggaacugaacucaguuccuccgugggagcacugugcacucuuuuuuuuaaauuaauuaauuuauuuauuuuaauuagguauuuucuucauuuauauuucaaaugcuaucccaaaagucccccauauccucccccucccacucccccuacccauccacucccacuucuuggcccugguguuccccuguacugaggcagauaaaguuugcgagaccaaggggccucuuuucccaaugauggccgggacuaugcacucuuaacugcugucacugauuuuaaaggucuggaagugguaacagccccucucuccugcuuuugagcuaucagacaacuaugauauaauuuaacaucacugauucuuuaaagcugagcaucuuggcucaugccauaaguccuguucuugggaaauggagacaggggaauugccuuuaguucacuaccaguuugggaucuugucuuuugaaaaacaacagaaaguagucucauuugaaagauggauucaugggugucaauuuugcuacccgcugugugucauguguggugggggacaaggcuuaauauauucguugaauauuagacuacagcagaauuuuaaaguaguaugggaguuuguauuaauaauccaacuuaaaauguugagccugcucagggacagauugcugugcacuuuuuuuuuccuagauaaaauagucaggugguaaaaaacuggcccccaaaaccugucauuuuucauuccuuaaaaauaaauuuuacucauuuuuuuuccaaaaauauaucuuaauaggccaaauggaaaauuacuucauaugauucuuuuaagcuguaccaugaccuuuuaaaaauaccaccguaccuuacagaagugaaacuagguuuucuuugaaaaccuguuuaaaaaauuaggugucuagaaacaucuucuacuaaauuagugauucugaggguuaaaaaacagaacaagacaaaacaaaaccaugcaaugacuuucauuaauuuuaauaagaauucauaaaaauucuagcugaaguguuuaagucugaaaucuauaucucagaugcugacucaugguuaucaauaacaggauauucuugcaaugaaaggaaucacuugcagaaagguguuaggaaaucuaaaacacggugaaagauaugauuauagauuuagcauauuaauaauggcaggggugggaugaaagagaagggagggagggagaggggcgggggggggguggggagaggccaggaacucacgacaggcucucaaggguaaggaacagaaggcugaagcccugcuuugagguccggcccuaccauuaauuaauucagcaguuacauuuuagugucagacucacuuuuuuuuuuuuuuuuuuuuuuuuuuuugcacuugaaaauuuagguaauuuuauccagcuguuaaauaaggucauccgguuggucucagugguauaugccuauaagugcagcacgcaagaggaagagacaggugggucuuuauaaagucaaggucugccugguccacagucaggacuaugaagcucgauccuaucucagaaaagcaaagcggaacaaaaauaaaaauaaauguuugucaagaaagcacuagguagaaaaguacucucgucugucugaaauggccaaacaugguggugugugcuguagauucagcuacucaggaaacugaggcaggaggaugguuugaggccagggguuaggugggaagagcauaacagaccccgucuccuuauaaaaauaacccaaauaacccaaaaaacacgcacaucuguaaaacaaaaagccccagagugugaauuaagugcauacgugugugugugugugugugugugugugugugugugugagagagagagagagagagagagagagagaggugggguggggguggggcuagcccaggggaacuuagaaauagugaccauuuuuauuucagcuucuagaaugcugggauuacccgcacggccaucacauucguuuaagaacauuuucuguaccacacaucaccgcuuuuuaaaucuucgucgcaccucgguucacgcauucuaaaaauacagcagcuggaguaguguguaggugccggggauagcacaggaagccagacagacaauaugaaacgaaugcagaacaaauuccugagguuauaagcaugcaaagugcacgacgacgucugugaagagaaguacuccaggagugcugugcuaguggggccuugugggcagagcugaaggaggagguguucucucagagggcaguguuccagcuguguuguguggcccgccagaagagcccuccacaggauggggaggucagggggacugcugugcguagaaugccggaagcuggugagcagagucaacaguaagcuacccccgagugguccuuagcugagucuauaugcaucccuaacguucgccugacuguuggacauccuucugaauuuuaugucuuugcgcacacccagagagaggcugaaauaguuguacagaggagauccuagggcaguaaaaagcuagaccagaaacacaucaacauagaccuaucagaggugcagaguuucugucguuggugcuucuagcccagugguucucaacccgugggcaagccagucagcagcaauccuccguggccugugcaucagccccagcccugucagagucucugcccugacuucaguggcggacuaugguguggaaguauaagcugaaauaaacccuuuccuucccaaguugcuuuugaccauaguguuucaucacagaaaaagaaacccaaacuaaaacaggaggaucuuauaaggcuucuguaagcguggaguuucugcugcuuuguaauuuuaauauuucacguaucccguguuuauaaugcacucaacgccucagcuuugucaaccacuacgucagugguucuuucucaaccugugggucacaaccccuguacaggauacccugcauaucagauacuuacauuacaacugauaacgguagcaaaauuacaguuaugaaguagcaauggaaauaauuuuaugguucgggucaugaggaacuguauuaaaggguugcaauauugaagguugagaaccacugcucuggccaaucauaucugacucagagcaaggcaggugcuuuguaaaugugugccugugucauucugcccacuuucuccguuucucucccggguuuaauucuguguacuguucuuuuucuuauguucuacccacucugugucaggcuuuguuuugguaaaguauggacaggcgacugugaucuaagaagacuauguggaucaggcaacauguucagguagggcacaccaugugaucucccggacauucucacagcacugcugagggaugaagucgauguucucuucacauccaucacaacaaaaccagaggguaccaugaugacacccucuccuguaaggcccauagagaaacucagauuucaacugagugacagcugccacucaggggauccaagugagacacuauuaguucuggguaacauaggcacaaaggugcaaguaguucuuauuccuguggccuuuuugaggcagugucucaaaggccuugaaccccuaauccuucccauccccaccuuucaaaugauuucugaagacugaaugaauaucaggaauuuugaauuuaaacccuuucuuuaaacuggauucucuugcagaacucgggcugcguagccucuuguguuuuggguuuuuuuuuuuuuuuuguuguuguuguuuguuuguuuucauuuccacagaguugaaauguuuuggguugaacaguauguuagaaugcaagggaagucuggcaguucuugguggcuuuaaagaugggagggaaaugaugagacccucguauaacaaugcuugaaagcauguuuagacgguuucacaauggauacguuauugugagaacaguguugauaccaugagccccugaauaauucuuuuguuacuacaguguauguggguuuccccuucccuccuuccauuuaccuccaucucucccucccuccaucccuuccuccuuccuucccuuucuuacuucuaugagcuuauacaaaggaggaacagagcaaggagaaagaguggaggaugcaaagaaaagcggugaugucacaccucacacuacccagcaggccguggggccaggguuccuggagcaccgugugugggaguguugcugaguagcaggaaaaacuuagaggucagcggguggggugagcagacagguggcugagacacugcccuugacaacuuagcaccacuagagcauauaaucaagcccuagaugcaggugauuauguuuacaaggaaggagugcaguugauguuccaagcuaguaagugugaucuugaaaauaaaguuagaauuuaaaaucuagauggcaguagagaaaugaagccauaauugaagaaggauuuggagaucgugugaaggcuuuguuuaagugaaaccauuuuuuaaaaagucuuuaaaauuuuuauuuucaaaugugugugugugccuguguuugugugugugugugugugugugugugugugugugugugugugugcgugaaggcaugugcaggugccuugggugcugugaacugaacaugguuccucugcuuagagcaguaaugccccgaccccugaccucuucauccuggaaacacuuuuuuaaaagaaguaaagcugugugaaccaaggaggacuguccaucugggagugugugugugugugugugugugugugugugugugugugguggggaucagcuguggccaagaggcaaggcugagucuugcaggcagguugggguggccuuuccuaggagcccguccacuuggccucagcauuaagcagagggagaagagaugcuucuggaaguucuuugaucguuuggauuuucucaauaaaaugggaagcuaaguuaucagcugggaaucacgguggaaaagaugguggcgaucuggagagggaaaggcaaggagaguugaucaggagacgaaaucccugccuugggaaauggaagccaaggggcugaggaacgcaucaugcauacaagucugagggccuuauccaggaaggucaaacagacacugucagccugguauagacccugaucagcugcagggcugggguaaauagagagcuguaguaaacaggguugcaugcagauugucuaggcauggccagggaagaggggacagggagacuggagggggaucccacagcccagagucacagaguggguucuagaaguuauuuggacacgagugacugcgagaaauagagaagagacaguuuagagauggaauuaagccugagauugaaacuuuguucaaauuaggaaaggaagaagaaaaaugaaagucuguuaaaggaaacuacacagcuucaauuauuuuagagaugcauuaauaauagggggaaaucuccagauuaucuguaugaaguuugguguaccuucuucuguaaaauacaaagaauaguuuacuuagaaaacgaauaagaaaguuuccucaaacaaacaaauaaaucuauuuuggaauccaaaaacuacauacaaaccccugacaugcaugaaauaaaguggguucugguucuaaugauguguguguguguguccguccguccauguccauccuugaacucacuguacagcccaugcugguccugaacucauuuccucuugucucccaacgggugggauuauaagcauucaccaucacacccagcucugguuccaguucugaucaggcaagcuggauagcgcccgagggccccaguuccuccucagguaaacccuaguaggagguuguggguagacgagagaaagcccucugcucgugcccagcacccauuagaugccagcagccaaauguuaggagucuugagcugaauggcucuuuucccaguagggcacccaacuuucuuaagaagguugcaagugugcagggccauagugaaaucucacagccauaggcgaagaauucuugucuguuucugaagagccagaaacuggagauucugauuguaaaccugucuuguagauugggucucaucugagaagcagacagauuauauauauauauauauauauauauauauauauauauauauauauauuuaaucauagauguuaagauuccacaguaagaagaaaagaauguugaaggagauccagccugucuguagaaauaaacacaucuuccuugucaccauccauuucugucacagccauccgagcagucauggcuguucccuuaaaacaaaugucaaccuugccuguuggcucugcuccucccuucugugggguggcaaggggaguagguauaauggagggccagggggaaaugucacugagaacaugcuucucuacacuccuguguguaugagggaauccagaggcuggaccgaguaagcuaacacagauguguggcuuccuugagcagucggaggcugagggggauauuuccuggaagauacuuggaugagaaagacugggguccaaugugaguaagaguaauauaacagccaguggauucugguccucacugugguucaagauuaucuauccauaggcugacaaagccaagggaacucaguacaguauaaacacgugaugugcuaaacaugaaaguuuugaagcagugaaacuccgugccuacauaaguauuauuuguaugaccccuguuuuagucaggguuacuguugugauuaaacaucaugaccaaaagcaacucgggcaggaacggguuauuucaguuuacaguuccacaucacaguccaucacugaggggaggucaaggcaggaaaccaggcagagcgggauccuggggacaggagcugaugcagaggccauggaggggugcugccugcuggcuugcuccccauggcuugcucagccuacugucuuacagcacucaggaacaccagcccaggaguguaccuguccacagugggcugggaccucccccaucaaucacuaauuuaaaaaaugcccuguaggcaugccuacauccugaucucauggaggcauuuucucaauugggguuuccucuucuuagaugacauaaaaacuagucagcacuacccccacaaagaacaacgcaaguauguauugauggcuaucaaauagauaaaaugugguaauacauacagugggguaucacuuagacuuauacaggaaggaaauucugaccucuguguggaugagagcaugagaccaagugagauaacccagccaugaaggaagagcaagugaggucaaaaucauaggcacgggaagaauggugguugucaagcuuggggaggggaugguaguagguaguuguuuaaugguuuuacuuccagauugaagaguuaugugagggauggauggauggucaugauggccccgaacugcuuaguuacugaugguuaaguugguaauuuuauuauguguauuucccccauaauuaaaaguguaucuuauaaauuauaggaauauaaauaaauacaggaauggcugucuauaaacucauuagugaugcaaagguggaaaauaaacccaagaaaugcaugaguaccgaggguguugucaagcugacuuauaagccuugcauaauuacaucuauuagaauguugccugacuugggcuauucagaugcuguggauaugguggugguauaaggagagaaccagccuucuaacauuguccuaugaccuccacaugcacaugguggcaugugaaugccuuucccaaaugaaugguugcuuuuuuaaccuacuuuacuaaaaugacuuaaaacaucuuaagacaauaucuaauugcauacugcauaguggugaagaguuucuuagccaaucagauauuauagaacagcauaagaugguagggcaggggaugcucacaccuuuuaucccaggacuccaggcagaggcagguggaucucuaaggcuugccugauggcagaggcauguggaucucuaaggccuuccugauggcagaggcauguggauaucuaaggccugccugauggcagaggcauguggaucucuaaggcuugccugauggcagaggcauguggaucucuaaggccuuccugauggcagaggcagguggaucucuaaggccuuccugauggcagaggcagguggaucucuaaggccugccugauggcagaggcagguggaucucuaaggccugccugauggcagaggcagguggaucucuaaggccugccugauggcagaggcagguggaucuccgugagcuugaggccugccuggucuacugagugaguuucaggcuagccagggcaauauaguaagaccugugugaaaccaaccaaccaaccaaccaaaaaaaaaaccagauuauaaaacuauaaauuauaaaauaaaaauuauaaaaaucaggcuuagauauggaaaaaaagauuguguaacuggaaaaaaaaaaaagaaggaauguacuuacaaguguguauuuuaagugaaguauuacaaccaaguggcaacugggucaccaguuaguuaaaaauuuaaagugcaaugucagucccacaauacauaguuuuugguuggguuaguaaucagacuuguaauauauggaaucauuaaagccuggccuaauuauaaagagauaaauauuuguauacuucaggcagaaaauuuaaaaacaacacaaaaaagaaaacagaaaucaaaaguuuacuauauccuggcauauugaaauuuaucaugaaucaguucgcacggucaguaaauucccaucucuuccaaccuuuaacccaaaagguaucucucauuuuuuguuuaugauaaaaaugucuuguaacaaaaaauugguuagaugaauuauguacauacguauuauuuaaaaaccuacuauucaaucaaauguuucacagauugaagacguucaguagguagaggauugaaauaacaaacuuaucuuauaucaugucgauguagaagauaaaaaauuuguaacuucaaaagaagagauuccacgcuccuccucuuauauacgugucagagugcggacauggggaaaggucggaagggagaguaugcuuuguguguuuggguguauauuccuguguuuggaggccagaggucaaccucagcugucgcuccucaggagccauccaccuuguuuuucucauucucuuacugggaccugaggcucacugagugggcuggauagcuggccaguuccagggaguucagccucccagugcugggacuacuagugcaggcuaccauguugcuucugcugaaacugccuccccucccccuuccuuccccuccuccucucccucuccucucccuccacccccauccauguuauuacuauuguuauuugacaaggucucauuauguagcccuggccagcauggaacucacuauauaggccaggauggccucagacucacagagacccgucugcuucugaccuuggcuuuuuaugugggcucuggggauacagcucaagucugggugcuuauauuauaagcauccagucccaaaguauuuaucguuuauuucuuuacuucucuuugcucauucccauuaauuuuuuuggcaacauguuuguuuuuguaauaaaaacuuuggcuuuugaauuuggauacaguucauuauauugggaaaaaaaugcaaaaagaaaacuuguauuuuucaaucugcucaagaacacuaauugucuguauuaguaaaacauuuaguaauuagauuacacagugcuucauauuucuagagggagauuaaauauuuuuguuggaguaguaagaaauaauauugauugcucacuaaacgcuguauuacguuuuguuucuacaugaaagaacaauuaaauaagaguaauucagugcuuaaaaaauaaaaaaauaugguuuuuguuuauuuuuuugugcacaugagugugcuaccacaugcacggggaggacagagagcagcuugcaggauguggaguagacggauccccaggaucgaacuuggcuggucaagcuuggcggcacgugccuuggcccuuugagcuacucugcuggcccuaauugaguacuucacagucucuguaacaauaaggguaaagaagccugguuguucuuuacuauuaacgagaaaagaugguauugagcuauuuagagcugaagugagucuguauagccauucuuuuuuauuacuauaaguaaaggauuauaucuugguaauagaaccaauagcuucuaaaagagcauguuaaaauuuaccaguuauuucuagacacgauaaucuauaaguugaauuuaccugaagguuggccuaugcuuuagcuguuuuaguaucacuuugguaucaccucagaaggagagguagaggugucauuuaaagauguaaaaaauuggaggggucuccacagcuucagaggaaggcagggcucuugaucccgguagggcucugucuacuccuguggacagagcuggggacagcaugggaccuucugcucucugcaucacgguccuccuguguagaucacagggaugcagggcucaguggugcagguuugcuuaugugcuucaaaggucagcauuuccagauggacggugcucuaggcuccuccaucucugucaccauggacuggacuggcccagucucuuuggggaaaaaggcucuggggagagagauguuuccaggccacugauccucuggaggcagggcaaucugaucacagauuuugucuaacuggucaucuucagaauguccauaggagagaggauuuuguccagacaucucugcagagauacagccgacacuccacagguccacaggcguugcauauguagacuacagaagaauuccaggagcauggugcuggaguguaacaacugcaggugugagggccaucuguuagcugcagauucuggcuaagucaaagucagccagcuugacugucccacuacucagcacuagaauguucucuggcuucgguucucuguguacuaugcaauuuuuauaaaggagaucuggaccucuuugaaauaagugcauuagauccuucacgucucaaguugcaagccugcuggguaugcccuguccauauaugucuguuuguccugguuuguaugcucaaacacuagggucacuuugaucuuagguaguucuggaagaagcacagaccuccaucagccagacaaccuugugguacucaaagccuccagcuuccucaggaagggugugucaugaacuguacggauggcaaggucucuccagcuucucuucuguuguuguuguucuucuucuuauuauuaaaaucucucacugaaacuggagcucauugguugguuacauuggcuggccagccagcucuagggacccacuuacaucacuagccuccuccccuuggcauuauucuaccuguguuuuguuguuguuacuauuuuaacuauuaacguugggugucuugccugcaugugugucuguauaccaugugcaagcagugccuuuggaagccagaagagggcguuggauucccugggauugggguuacagaugauugugaggucacugagaauggaacccgagucuucuggaagggcagccagcgcucuucacugccggccugcucucccgucugugccuggcucuguacauggaucugaagccugcccuucauacuugaaaaccaagcacauuaccacuaagcugucuccuuggccccgucagguggccuuuaguacaguugccuguggauuuaguggaguuuucccaucuaaucaaaacauuacggggaugacuugacacagucgaucgaucgaucgaucauucaugucuuccccagcguuccagaccaccuucucaguaugguguauuuggaacuucagaaucaacucuccuauguguguguguguguguguuucugucaccuguggucauguuuaaagcaaugagaaaccugagucgucugacguguacaacauguuccugaggugcucugagggcugugcaaccaaccgcccuuucauuucucauuuuguaaacagacaucccgugcaucuucucucaggcacgauccagucuucaccauuucggccauauucuuccuguuucaaauggcccucagcguagugcuaacgugugucuuaugcuccuaaaagcaagaaagcuguggggugucuuaugcagaaaauguuuaggcuugaguuagaguacuuucagcacuaaguucaaugcucaugaaucauauauauauguguguguguuuguacauauguaucuguauguguacauauauauaugauauauauauacauacauauauacauauacuuccuggggaaaaaaagcaucuucaagcagaagcacauuccuucuaagguuuuagauuggauguuaaaaauaugaccaggcccuugcaaggacuguugcuguucuaagagaaaauauucccuucgaguucaguaugguuccuugagugacacagccaucguagagaacacagcgguggcaaauaacgugaaucaguugccuguaaaacuacuugaaagggaauguguuguaaaaaaaagugcuuguguugaaacucauuaguucaaaacccaucaaucagaaucgcacaucaaaaaaaaagucuuucuggaggaagaguaagucuggacauacuucguuauguuugaauguucuaguuuucuguacuuaaaaaagaauuuugaagauggaacacagaauugcucauuaagaugacccauuuuuccucaacauuaaauacacauuuggcuuugacguaaccuguuuaugucacagaguagaauauggcuguuagcccagaaagcccagaugacaagcauauauauauauguguguguauauauauguguguguguguguguauauauauacacauauauauauacauauauaucaucgugugugcuagcuccaacauuuuucauuaguccuuaaucaucaguuuuaauuauucauuguugcuacagucgaucuagcaaucaguaauacauuuuucauugagaugucaguuuaauguaaaugggacaacucugagaccagagauaaucuuggaggcagggaugcagcuuccucuugguuuuuuuuugccauacauuugaucucucucccgucagugugauccuucuggcauucacuguuugcuguguguauacaguaggcucucaagauggccuuuaaaaaucgagguugugcuugcuucugugaguuccaguugcguaauggcuguauugcaaggaaagcauuuguccugaggguaccguuugaguugaguuuuuguugguuuguuuuguuuugaguugaacuaaagcaggugugcugacgugaugcuguagaauauguccggggcaggagagugcuguggggaaggugacggguuuuauuugagaggggaacuggcuuugcaucccaagugucucccaagugacuugcaaacaaaacuuaucucuaaacuuaggauaauaacaaauuuccucaguuuccaggauuuaaacagcacagguauucagaugcaugucuggaacacagcgacacuugaaccggucaguuguuaaguuuauacugaaagaaaacagaggcugugccacagugaguucaauguuuaaaauaaacucagccucuaaaacaaacccuaaucguauaagcgggagaggaaauucugcccuuuauaaagaaauauaaacaugccgacugucguaagaccgcggccuccuguuaguucugcuuuggauguuuucugaguuugccagauugugaaaucucaguaugacggccuagacaggcugcugcauaugggguuuugauaaccaccaucuuagagaacacaguuauggcuuagccaggggauucuuaagcaaaggaaaaagaaucuuccucuaauaaaacauccuccccaggcagaggaaacacaagguggguggcuugaggaacgaaacuaaguuuguucuccauguuugagcgcaugcacucaccuggacacuggcgcaggcaugagucacaggacaaaccuagccaucuuuacagugugucuucugccagcaucuacucauucauuccugcucugaaauuagggaaguucaguuaugucccucagaaucaaucacgaaaaguaacuagcuuccacccuuuuccccuuugacuaaauuaaauaaagggaacacuugcaauuuuuuuacuuaccagugucacaguaaaaauauuaagguagcccuugaaaugauuuaauguuuuagaaguucaaaagaagcugcugucucucuacuguaguggaugaagugcauucgcgugguccccagaaccugugauccucagagguggcagagguacccauccggcuacccacaccaucccccgucaucccucuccccauaccuugagcuuacauuuauuuaguugcuagcauuacagagauuaauaaaacagauuggcauuucacuauguaguuauucuguuuauuuguuugaucuuuugaaacacagugucacuacgugggugggggcucaccucagacuuggagcugcccucccaaucugcuggaauuaacaugugcgccuccgugucuggcuuccugccgguguuucagcugaucacuggucagggcaucuguaaaagcagaagaucuguuuuuaaucagugcagaguuuuauuuuuguuaaguagaaugaaauauuuucaaguagacaccacucuugaaaugggcauagccugccugagccuuugucauugagcuggagaguuaugaugcaugggaacuggagcuguaugggugugugugugugugugugugugugugguguguuaggacagauagacuuucugccucuggucaaagucuuguaggaaagguguugcagguuguugccagggccaugugcaugccgaucaaguguucuaccauuggcuuacccuuggucucacuuucaccucuuauggauagaaauuguauaauagaaggcgaacuguuuaacgccugcaaaagccuuugaaaccaagaccaugagacuccuccuucacgguuguuaugcugaccaaaggaggagaguuagagugagcuucaaucuuacugucucuuuuguacuuuuuucugguuuaggucaaguuggugacauuuguuaugcgugaguauaaauuggcuaguaguguuugacaguguacuaaucccucugacuuggcaaaacccuuggaguaugaauuuugagcuggcagacuugugguagccccgcugcuucauagcuccucacugaucuaaagggaaagaacucaguaacuaaaauauuuacuucaucaccaaagcaugucuccuggggccaaggacaucaaugaauaggagcuguguguguaaaagugcuauaaaucccagguucagcuucgccagugucacuguguuccaugauuaaccuauaaagaaaacaccuucauucucuuaauuugcagaucuucccuuugaaaggggaccucuagcucauaacagauauguccccuagucaguauugcugcuaccagcauguuuagccuacuuaaauguuauuuauuaaugucuacuguuagcuguaaccacaaauugaaaucugagucuagcgcagauggggacucuuuuaagccucaugcugugacggaugcucaucuguugaucaugguuaccauggcgagcacuggcugcuaccuguuucagccgcuuccuccuacucuuuccuauuuuuggccucucuucauuucacacaguccucaccuccacuccgccaccauuaccucauuccacccuugauuucugugcuuugaaccaaaacuuccuauuuuuuuugaaggaacuaaaucucuugagcaauuuuauacaauccuaauucucauacacuaauaguuuuuccgcccaaagaggccacuugaaaugcagcuccacugugcacggucacuggcaacccucugagcgugucgggcggggaauuccaggucaguguucauaucaugccaaaagcccuuuguaaauaaaguucucaaaaguuaguguauaauuaaaaaacaaaacaaaacaaaaccaaucaaggcaucaagacagggacuuaaaauaaauuacaaaauguuccuugaccgggaccagggagaugccugagugggcaaagugcuagcugugcugagcuuggauucuccagcacccacaggugggacaaaaagccaaaaugaggaauagcuguuccccgccaguguugggggauggagacaggcagauucugggagguuugcugguuauuuggcagagaugaaaugagaaguuccaagaucagugagagacccuugcccuaaaauaaaaugcaggcacgcucguauguacacacacacacacacacacacacacacacacacacacacacacacuggcuggcuggcuggcugugcugccccccccccccaaguuaaagcacuauucuuguuugcugccuguguaacagccucuaguacuggaugguucagcuaaggcuggagagauggcuuagcagaggagaguacuuacuccucuuccggaggaccuggguucaauucccagcacccacauggcuucuuuaacuccagauccaggggaucugaugcccucuucuggccucucagggcacuguaugcacgugguacacagauaggcaugcugcuaaaacaugcacaguauaaaagaacauaaaagacagcgcaauuuuugguuggacuaagcaaugagagaccuaccuuuaaguuuuguguguggaugcuuugcuguguuguuagucucaggacaccuugcaugccugccuuugacucggugacugguugaagggaaucagccuguaacacagggcugggaaggaaagaaacagcacuguuagcaaucauguuuuguaagaaagcaguagaauuauuuuauacuucccauuuucccagacaucuuacaacucgugaaguucagccuaaucacucguuauauuuggcuccgggacuacagagcucuaacguuaaaauuuugguucuuuuacuuuuuuaaaaaaaaauaucauguggcucuucccagaauauguuagcaacagauuauugauuuuguuaagagaaaaaaaaagugugcuguugagauuuuucuuagcugcagauuugauagcacaguucaccgcaggagaccugcuuacagcucacugguggaauuugauauagaccaagcuuuuaugauaccaagaaagaaauaauuguuuucguuuguguauuuuaacacauuugugauguuauaaauuguagcuaagacuuuucuguuccauuaaaauaaaagcuuucaaagcucuucucuacaaaguuuuguaggguauuaaauuacauguguaaauguggguuuuuguuuguuuguuuguuuguuuuaaagaaagugaaaaauguccacuuuuuuuuuuugcuugcuugcuuauccagucuucuccgcagucuuguuuagcagcaauucuuggugcuaugcacucacugauaaguggauauuagcccagaaacuuagaauacccaagauacaauuugcaaaacacaagaaaaucaagaaaaaugaagaccaaaguguggauacuucauuccuccuuagaauagggaacaaaauacccauggaaggaguuacagagacaaaguuuggaacuaagccgaaaggauggaccauccagagacuaucccaccuggggauccaucccauaaucagccaccaaacccagacacuauugcauaugccagaaagauuuugcugaaaggacccugauauagcuaucuugagugaggcuaugccagugccuggcaaauacagaaguggaugcucacagucaucuauaggauguaacacagggcccccaauggaggagcuagagaaaguacccaaggagcugaaggggucuacaacccuauagguagaacaacaauaugaacuaaccaguacccccagagcucgugucucuagcugcauauguagcagaagauggccuaguuggccaucacugggaagagaggccccuuggucuugcaaacuuuauaugccccaguacaggggaaagccagggccaagaagugggagugaguggguagggagcagggcagggggaggguauagcgaacuuucaggauagcauuugaaauguaaauaaagaaaauaucuaauaagaacaaaacaaaacaaacaaacaaaaacccccgucuauagcaguccuuccaccagacuguuaauacauucugcagccuagccuuugagaaaacagauaguauguagaagacucaaggcggcuuuaauauuuugcccguaucaugaauuuaacauuuguaaaacuggugccgguuuuuuuccaaguguggguuagaucucaggcagaguuuaauacuggaaaggacagcauugcaaacuucagagcagaagguacgucaucagagaaagcaucaggacccgcuuugguauugaucaucacuggugacacuuggcuaagcugcaagccaacaagggcuauaguccucugccugagaaaccagaagaugcuuaguaaugagcucauccagcaggugacaggugcaguguucagaacacugcucauggaaagcagagaugaaguuggaaagcaacugccuguggcccccgucuugaccuuauucucuguugagugggaauguucgggagauugaggucagcccgcugagcgacaagguucagggaacucauuucuguucugucucacgacaguaugggcugcugagcauccucauuaaauguagucuucuucuauuucauccacguagaauuaggauaaaaauacccaguuauaaugugggcugcaaagggaccuugggguuauuggaggagaauuuuaaggucugauuuuaguauagcucccucuauggguaaauguaaucuuauuccugugaaaaaaggguuuuuuuugggggggggaaugauauagaaaauucaagugaauuucauaauuaaaaaagcaugacuaucuuguuaaaguugcuucuauucuuuuauuuucuucagcuaaaaugacuuuuugcaauguucauaugauuccacuuuaaaguaucaaaaauaagcuauggcaucagugacguuuggaugcagggcuggguucucaggaaacccuugagaggcauagaugaguguaggucugaggcuaccccuggacagucaguauaauaggguuacagcagcacucagggguccgaggcugcugcugauuccgagggugggcccacaacugccauaggugccucacuauauagggauucucuacacucuguguuacggauucuggucacugcacucagacacacuguccaauaguuaggacacagcuuuuccuucauuuacaucuuucaagccuguaccuuugauugacaggaccuaaggaagccuuggaaaugcagcaugcacauuucuuuucuuuuuuuuuuuuccaacucacacauugugagggaaaaggaagacacagggcaugcguguggacaccgauuuccaauuguccucaaccaagacaguaaagcagaaauucaaaaaguccuaggauguguuucccggaaacaacuacaauuaauauuauguauccuguuccagauauguguggcccuucucuuaaagauggauagaugauagauauagaugauagguagauagacagauaaauagauaauagauguuagauaaauaggcaauaaauugauagaugauagauagauagauuucagaaaggagaggguuguagcugcuuugccaguggcuucuccucauuggcaccaccaccucccuugaccccagaucagaaaggugaacuauuucuuccaccacagcucauaccuugcuucuaccuuucaacuuugugugacgauuuuccucuuugccguuugaucacguucaucuugguuuuugucccuaaaugcucacuugaaaaaugauuuauuguaucugacaccauuuuguguuauuuugugucacauuccccaccccccccaauuuguguguauuuugagcuauuuugacuugcucccuccuucuuccccuccccucaagauaagguuucucuguguagcuguggcuaucccgaaacucacucuguagaucaggcuggcccugaacucagagaucugccugcaucuuccuccugggacuaacggcaugcagcaacacaccuggcuuuugacuuaguucuugauuacuugcugaguagcacuuucaagaagguuaugugagcacucacgaugcagaggaucucugagucccaggcuagccuggucuacagaguuaguuucagcuguauaggggcuauacagagaaacuuuguccugaaaaaacaaaacaaaacaaacccucacccccuaaaaaaccccaaaacaaacaagaaggguauguggauauuuuguuuuuacuuccuauggacugaaaaugucuaccagucauuauuauguaugaaugaacgagaggucuggggcugugcugagugguagaccaguugucuagcaugccugcugacuugaguuuaaucucuaggaaaacacauacacacacacacacacacacacacacacacacacgcacacacgcacacacacacacacgcacgcacaugaguacgugaauaacauggcugauuauaauauuuuugauuccucuuucucuuucuucauuugaaaaccuguucauguaugugugugcaugugacauguauccuguggaccugugccaugacaccugugcggaggucagaggacagcuuggagaauuccguucuguuuccccuuguauggucuagggaucucaggcugguuggcagguguccacugagccaugucuucuagucuccucauucuccguuccauuuuuuuuucucucugagguuugcucuauugucuguuggauuuuuucuuuuuuauuguugagaauugcuggguuggccuaauuuuccauauuguguuugguaauuuaaugucuguuuuacccaaauagaaaaauuaagugcugccucaugcuauacuucagguucuuccauccuuacuguacccacuacuucagacuuguugauaugguugggucuacagaacaacucacggcuucgggucagauggauggguuuaggggagguguuaaaaggccugguuuuggguuggccagauucuguucuuagaaagugcugucuuuccuauccuaaaggcuggugagugcuuguggggacggggcucugccuucugggaguuccagagacaugacccccaccuuccccacaucuccggcauuuacacugugauuucagaaacccacacaugggcaguauuuaaauaaaauaugucaagugagggucaugguuggcauaaugaaacagagagcgguuuucauuucagagagcgaucuccagaaaucuucccgugagagcgacauucucuacaaguuacugagggcaagcacuucagggugaaggagaagccgggucugcaguguuaguuagagcaggcucuuccccaguuaguuuuuuuauuuguucguccgaggaagccagaagaugguguuggaucuccuggaaccagaguuacagacuauugugagccuugugggugcuaggaacuaaucccagguucgcuacaaaaacucuaaccacugagccaucucuccagccccaccagcucucuucucuugagagagaguuacuguguuucugaagcagaggcuuuuuuaaacuucacaguaaacuaaacuugccugugucugagacuguacaugauuggcucccauugcuugucuuagagcaaaauuaaugucugcaaaauaauguuagcauccaaagcgucaauugauauuuuguaaauuugggcuagggucuuacuauauagccuuuaauccgaagcucuaguguaugccaccacacauggcucuuaauaauuucaaauaaucauuuuuaucuagguggaccacucuacuucguucagagaaggcagccaauauuugaugcccauuauuaaggacagcaauucaagucucuauucucucucucuacaucucucucucuacgucucucucucuauauauaaauuuauuaaaaggaaauuucagcauaaaccuugaagaggugcuaaaagaaagacuaagacauacccaaguguggauaugggcuucucaggggagugucaccaaauucccagacucuuuauccuuacaguuuacauuugcuuucgcacuaaagccuccacacuguccucauuugcuuuaaagcauccccagggcccggcacaggacuuccugaaucuugugagcaaaagugugggcaugaauagucagccaguucucgagcuuugggaauauggagagcuaaaaucguuuaugccaggggcucuuacugcugaaagccuuguucuauuucaguuuuaggaaaugaguucuagaaauuucuaccucagcuacagcaacaguaguaguuucaggaacauaugugguacuucagggcuccguacaaacaaaaacugcucagaucaugugaauuuuaaagauuaaugaauucaaaaaaggauguuuauuuuaaugaugacauucaguaaauaugcugccaguugucagcacuuaggaacgguugagcaaaauagaaaacaaaaauaaacaagcaaauaucaaaaugaaagaaacaaaacaaacuacuaaggagagaaugagaucuugccugaaggaacuugcaaauuaaauccagaguugaucugcccagagugaucugcccuguugugacagaaggaagguggugacaccaggaaguggcaauaagaugggagaggacagggccacaccuuuccuuuagugcccugcaggcgggccacccuuccuuucuguuuuauucgucugugauacucagauggagaaaccacacuggguugugcaguaaugcagggguccagauucacagagccacuucacagggccgugggggagccagggaaccagggagggaggcaggaugaacugcuugcugggugcuugcuggggaugggaguuaaccuagccuggcaucaccaggagggcaccuagcccuuucugugcucugaccugggguucugcauaucuuccagcaccuaccagccggcugccccugcaaccccagcuugucccacugcccacacccucuuauuugcugcucuccuuuccuugauuuuucuucuugaacaccuucuucaaagagccuggauugcuagaacagucuccaaaggcuuaagagaaauaccgacacaaaacaaguuccaucccucuuaaaagagagaaaaauacccuauagccagcuauuuuuccuccuuuagacccuuucaagacaaauaaaaguggaucugauacuacguccccuaagcccccaugaaggggcugcaaagaugucucagugguuaagaguacuuaauguucuugcagaggacccaaguucaguucucagcauuccuggggcagugcaaacagugcagguaacucaguuccagggcacccaaugcucuccucugugaauuccuccuucaggaauguguauacauaaacgcucacaggcucacacaauacucaaaaucaauaagcaggcaaaccaaaacaaccuuuaaaaccagugccgagaagugugagggagccaggaggaguguugagcaucccaggaggaggaagugaauggauccaaccaacacagacugaaguggggucauggcuacagauggagauggcucauaaaccuuaaucccaauguagauaugauucucaguaauaaaagagcucccauuuaucgguguccaugugagcacauucaguauguggcaugaaggugugugcacacauguguucuuuauguguugacagauacuugaggcauaaaauggauguaagagacaauuugucugggcuguguuuauucacagguaucucuuggauguucuuugcuggcuguucauccucuuguugugcaaacauaaauaguacagucugcucuuucuuagcuccugcaucauaggaaaugaucccaucugcuauucagugcuguguguaaaagugcuugugagguuuuagcugagguguaaauauuuaaaacaaugagauucuuuuuguggggguugggauggguggagggaaguuauucauaauagcuugauucauccuaagagguucacgauuaaaaauugacacuaaggguaauuuacauaaauauaggcugucguuaacaaaaaaguguguuuuggguguuuagggaugcauguagugucuguguguguuugucugcuaaugugugggugcacauguagagcccagagguucuuaucuagagucuuucucaguugcccuccacuuucuuuuaagacagaauuucuuauagaaacuggagcuugcauaauggcuauuuugucugagcagagaguucugggggugugucucucucucccccuagucccccacagcagggucagagaugagcccugucacgcucggcuuuugccugggcacuggggauccaaacucagacccuuagucuuguucagcaaacguggggcugccuccccaaccacacuaagaacauauucugucacacuuaagcuucagcacaguaagagacuaaauacuguuuuucaaacugaacaaauauuaaaauaaucccaguagcugaggacaugacaacgauguguggaucauaauaaaucucauauuuauaaaauguugucaaacacaucucggggacuuucccccaauucucgcuuaaccccaccccugacccacgguccucuuaccuuugaacauuuuccuaaacuccaggauggccacagcauggugaaaauacagagauacacagaugcuagggguaagugcggugguggugguggucuggacuuuauggcaguaggcggcugggaaccucugauguuauuccgguucagcacacacagaccuagucuugucauguuacaaggaguaacccaacgaacaugguaggauuacagcagcgggcacuuucuguuuaugugacauuggaucaucuugugguuaaaaaacaaaguaaaugcauccaacauuguuuuuuuuuccuuuggagaccaggugucauggagcucgggcuggccuucggugcacuaucacauacaggcaaccaucagcuuaagcgccugauauucugucucuaguuucugggugcugaggucaaaggucuguuccacuaugcuccauucuagaaccaagacuuuuaaggagucagaaucugagaccccauccugugcuuggcacuugaagcugaacuuuuaagcuuaaauaauggaccuuuaaaaucuacuuugauucuuacauuauuuaggcauuccuaaagucuauaucugagggcuccuuuugcccugucauuuuucauacugcuuaaaaacccuucuaauuauacuuauuaucaaugauauuacuuauuauauacacaucuaaaucuguggugucuacauuuuuaucaucucaccgccuagauuuuaaguuuccuauaagaacaauaagaacaggcucuuuguaggcauguuugccuuagucuuggugccuaaaaacauuucccaaguuauaaacauauuuaaaaaguguuuauugaugaacgaugugggcaggccugccuugccaucucuuacuuugcaguaucauacuauauaaugauuaucguaaauaaucauuuauuuuuuuacaauuuuaaaaauuauuuuauuuuauguguauguguguuuugucugcauguauguuuguguaccuugugaguucagugccugcggaggccagcagaggauauuggauccccuagaacuauaguuacagauaguuggagguuaccauguguuacucucuuaaaugcugaaauacucuguaauuaauuguagauuaaauaccgcaaaagaaaauagacuuaaguagaugacauaggcugugaagauauccaauagaaacccagcuuggugcugcaugccuguaaccucaucugcuuaggaggccaaagcagaaggauaaagauuucaaggccaccagggcaauuuagugagagcuggucccgaaguaagaaaaugaagaaacagagugggacaggagcuuacuggucaaccuuggugaacguccauuaggcuuggauuuuuuuuucaauaagccucauauacacaauuauguaucuguaaauaauuuggaguccccguagaaaagggaaaaaaugaaaaaaaaaacacaaaauaguuuugaaaaagcauuagcuguaaaucaguuaucuugauauuuggggaauaaaggaaguagggggucaagaauugaaggucacuauugguuauauagugaauucaagaccagacuggaaaacacgagaucuuaucuucaaauaaaaggaagaguggccacaguuuuuuccccaaauuuuauaauuauaaauguguaucuucaaggaauucagucaaggaggaaacaacaugaagacccaucagcaucugacuguuggaaaccaguaaggauacauuccuaagugcagccaggggaauaaaucacccguagaacaaagauaagaaaguaagccagacaaauguuaagguggacauuuguugguagaggcugccaaaucaggacuauauccccagcaaaaaaucuccugugaauggccugcaaguuggcucaggagcuaggacaccuguggacagccugacacccugagaucggucugugggaccuacaaaguagaagcagaggcuacugaaaguuagugaucagcuaaccaccaugggacugcuguggcuguggcuauggcuauccccccucccccaguccccaaacacacacaaccaacagauaaguauaguuacauuucugaagacugaaugaaaacuuucaaacagauaaaaccugagaaauccaaugcacagaccuuaaagaaaaaaauaccaaggguggcucuccaggcaaaggaauggcuacugucccaccugagaucuagaaauacagacaggauugcagaauaguagagagagucaggcugugguuaaauacaaacuaucagcucugauuuucaaaauuaaaggguaaucugccuuuaaagugagauucaccagugcagugugggauuuacaaggcaguggaaguaaaaucugagauaacaauagaacaaaggaguggguggggcgugguggaggaaauggauguuuaccacuguguccacgcaaauaaaguacuuuuugaguguucacugugguaaacugaagagacggaugagguaaaccauagagaaaucacuuaaaaaaaaaagaaaagaaaagaaaagaaacccaaaaccucuaaaaacagagcaaguaagcuagccagaaguaugaccgguaagccaggaacagaaaggacauuugucccagugucauuucuguugcugggauaaaauaucccagcaagaguaauuuuuuauuaaucguuuuauucauuuacaguucaaaugauaucaucccccuuccugauuacccuuccagaaaucccccaucccaacccccccauuccucuuccccuuugccucucugaggaugcuccuccacccacucacccauugccaccucacugcucuagcauuccccuacacuggggcaucaagccuccauaggaccaacagccuccccucccauugaugucagacaagaccauccucugcuacauguguaucuagacccauggcucccuccauguguacucuuuaguugguauuuagucccugggagcucugggugguccaguuaguugauauuuuucuuccuaugggguugcaguuccuuucagcuccuucaguccuuccccuagcucuuccauuggaguccaugggcuuagccagaugguuggcucugaguaucugcaucuguauuggucaggcguuggcagagccucucaggggacagccauaccaggcuccugucagcaagugcuucuuggcaccagcaauagugucuaggucuggugucugcagaugggauggauuccuaggugggguggucucugguuggccuuuccuucagaauuccagauuccagcuuguccguucugaaaagugaaggcaggagcuugaaguagcuaguuacauccagucacgagcagacagagugaacacaugugugcuugcuuacugcucagcucaccugcucuacucguuuauaguccggggcccuacccacaucacgccugggugagucuucacaccucagugaacccaaccaaggaaaagcccugucggcauccaugggaugguucacccagacuuucuuccuaggugauucuagauggugucaaguugacagaacuaaccaucacagggcuagugagaugguuuccauggauaaaggugccauggauagauugaauagacuccugcaaguugcuccaugaccuccaagaugcaccaugugcaugaccuguauacacacacacacacacacacacacaaaguaaaugaauguaaaaaacaaaauuaaaaaaucccucuaauugucaaaauauugaauccuaaaaucuauguaaaaggaagaaggaacggacgagacagaccaacacuauugguagccauagugauuguuaaugauuaaaacauucccuuucaauggccuguuaagcuggaaaaauaagugcaauucaauuauugcugucuuaugagaaauccgugucaaauuuaucaaugcuucuauguuaaauauaaaacaacaagaaguuacaacauacaaaugcuaaucaaagacaaguagaggccgccuggagagauggcucagugguuaagagcccugguggucuuccaaaggaccugcacccacgucagguggcucauaaccaccguaacuccaauacuaggugguccaacaaccgcuuucaggcuucaaggcaucaggaaugcauguagugcacauaggagacucgaagucaaaccacuaucucauauaaaguaaaaauaaaucuuuuaacaauauucagaaaaguuauuaucaggaauaaugagaaauuaauuaagaauauagugguuccaguuacacaggcagaugaaacaaccuuaaaguauguaaaggaaaacaaauuagaagcugucaaguuuccaguuauacuucuaaauuuccauaccccuucccaguagacaaucgcaacaacauuaagaccgaacaccaucuuucaagaacuuggacuaauugauauuugcagcagagcacucagcccaauggcaggauacucuuuguaaguguauugcccagcagagcauauauucugguaauaaacugguuccaguguauuuagugucccguuuuugcuuuuuuuuuuuuuaaugauguggugacaauugccacagacuuaauggcuuagcaaaaaacauauacguuaucuuucaggucuggaggucuaaagucccaacugggucucauuaggcuaaauucgcauaucagaaagcagaauucuucuggagacugugggugaggcaggauccuucuggaggcuguaggugaagacugucugucuucuggcuuuuuccuaccaaaggucucucaagcuuugguugcuguucuagguuagccaguucagcagcgccgaugguuuucucacuucaccaucuguucuuucuguuuuacuuuccauccugcuuguagagacccuggugauuacgcugggcccccugguaauccaggauucagcggcccucugaagguuaguugacgagcgaacuuuaagucuacagaaacuuuauugcccugugucacgcaagggaucagguauucccagguuccagggaucuggccucuuuaggccaucagucucuugcccuuucugugguuaaucaggcauauccucugacuuuauggcacuugaaauaggggugguggugggggaggagucagaaauagggcuuuaaaaaaaaaaucaaacaaaugcuuggaaauaaaaaaaaaguaauccaugggccaaagaagaaaucacaauuucaguguauuguuuggaauaguagaggaagugccuggagaagcugagaagaaaaggagguuugggaagggggcacacugcuuucuggaacugcaagcaguguuggcacuggggaggggaaaagucucgaucccaagaauuuaaggauuuggagcaaaugauuguuuuuccugguccaaccugggaaaauagcagugcaaucucuguaacaaguaacagcuagccggccauugguuuggucacuuccagugucguuauaaaaaucagaaaaguugguauugacauggaaaguugagcugcucuaccugauaucaggaacagagcucuggagccuaaauuauaaacaagcucucccuuuucugcauuugagggagggagggagggagggagggagggagacagggagacagacagacaugaugggcaaugugugugauauguaugcaugugaugguguggguaagagaaaaacugugugauauguguguguuggcauggguaugggaacauacacacgcuggaccacauggaccuguggaagccagauauccacagggaugucuuucuugcugucugccuuaucuuuugaaacagagucucucccugaaccuacggcucccucauugucuacacugguuggccagugagccuaucccugagcugggcuuugaagccuuagucacccuuccuggcuucuccauggaugccagggauauaaacacaggucuucaugcuugugcagcaugcacuuggcugacugagccaucucuccagcuccuuggucuuaaucuaaucuaaguucauuugcauuuccugucacucccaaggccgaagguuggccacugccugugugacaucaacagaccuccaucucugggcagcagcuuaaauaagccaccguugcugucacuguuauaaaaauggaguuuagcagucgaucucccaguggcacgcuccuucauguuuguguguacacaggggagaguggaccgugcaaccuuucuucagcggguguggaggcugcuuucgggccugucacucccucugauuguuaacauuacaaaagucagcaggucauuuaaaacugcacuguauaggauugaagggcaacagacugcccugcccuuagacuacccccuggugaugaaggaucugcugguauuacuggaucccccuaaggccgagagucugagagucuggaaggaacaguugugguugguauuacaguuggcuuccuugggcaguagcuuucauuaaacguugugugauaccaacuaaucagauuagguuauagccucugauggacugauagacuauccagcuagguggauguugaaggaaauauguacauggccagaaaucaguauggucaguggaauguguuguugagcgagauggugguccauggguuuccucugcucuaagacaucuuguugcuauggcaggauuguggggucacacacacacacacacacacacacacacacacacugggaaguacauagugguuuugggggugcaauaagauaaauauacuuaaugucaauaaaaauauaguaaguagaaugauugugauguauauauauauauauaugcacacauguaauauaaugcauauaauuauauguauauauauuauaauguacuuugcauguauguuuccagggcuggcauaugguauuggaaaaccaguuuugcucuucccugaggaggcuauuucuccuguucuuagcauuucuuaguugucuguagaccuuuguguaugguugaggccucaugagauuucucuuucccguguuaguaugucugacacaguuccaacugaaauaucuacaacacaaccccugcaccuaaggcuuagaaauuauuuuggaagaagagaggagaaagauugcaagagccguaagaauagauguuuguugugaaauuacgucuccuagaauugucagagaaacuucacccacgaagucucaccaaacaugacugccuaaacaagaccugaacacuuucaacccgaguaauuucucagaguauuuacagggagcaacuaugaagacugugaccauguccgucugugggacagaggacaguggcuugaugcguacuguaaagcagugaauacccaaaguuggucguuuaguaacucaggcuucugcaugcagaaacaucugucugagccucccuacaccauagugaaggaugggagaaucuauugaaacuugcucuuuaugcuugauguguugagaguaauaaaggacuuuuuuuccuucacccagaaucuaucuucuaucagcauacacgaaacaguugacagaccaaucugcugagguccugaugcuaaagccucagguggaaugaugucagccuuaggaugccugcucaguguuuuuauucagcgccaugcugggggguccuaguuaaugcagugaguuggaaaggagagacauacgguuugaaaagaaagaaaacagcuucacucgaaggcaaccuaacuauguagaaggcaugaaggagauuccgaagcaguuaauagaagcaguaagggggcugagcgcacaaggguggacucucuaacgauacuuccuacgacacugagagaaacguguguuggauauuaugaaacauaaguaaaagcaaagauuugggugugagguuggcagguuucagacuguugagacugcuauccugagagagaucuacagggucagcaugaaccccucagaaugccaauggcguccucugcaaaaauacaaaaaugucuucuaaaagucauguuaauucucaaggaauccccgauaggcaaccaucaugaaaaggagaacuauguuguaucucucacacuuucaaagcuggagccaugaaaacagcgagguacuuacauauaucaacugcugugaaggaaggcgggaaacguguguguuggucaggggauguccugcaaggaugccuucuuagucaguguucuauugcugugaggagacaccaugaccacagcaacucuuauaaaggaagacauuuaacugggacuggcuuacaguucagagagucaguccauugucaucacggcaggcgggaagguugguagugugcaggaagacauggugcuggaaaaguugcugagagcucuacaucuucaucugcaggacccauguaaaauccucuagguagacuggagacagguggagcccagggcuugcuagccagacagucuauugaaagcauccaucucuaggcccagugaacaauccugucucccaagauaagguggagagugacugaagaaagugccagauuccuaccuacccuugcccuuugugcuugggcacacccacaaauguguguacaaauacacacaacauguacagaaaaguagauaaugcugcaaaagauaaacaucaguugucaugacacacacgaaggggaacuucaaauuacaaccauaauggacugagugugguugcucauaccuuuaaucccaguacuagagaggugaaggauuuauaggacuuugaggcuaccauggucuaucuacacagcaucuuccaagacaacaagggcugcauaaccaagcaaaaugaaucaugcucuuauaugcauuuagcugcuucuuauaacgagaaaagaaaaaaggggggguguuguaauggaugcaaauaaggugaaagggaugugagagcauuggaguuggugcacagauguuggacugugaaguaggcucagcaacucugcuggguccuccaaaauuaucacccagcugugcugcuucugggucaguauucagaacaguugaauucagagucucgaagugacguuuguauaguagaguucauaauggcugaaagguagaagaagccccaguguugacaaaggaagaaaugauacuuggucaucuuaaaucaaggaaacugacucacacagaggaggguguuaugcuaagugaaacaggucuggaaacagauaaacaccuaagugagcuaccuggaguggucacucacguuuguagggucaggaaguggcagcuaggguuaggggaggggaaaggaagagcuguccaauggcuggcaagcugcagauuagcgaaaugaaaaaucuuggagacagguuguacaauagccuaaugcuuuucagcuuuuuacuuaaaauuggucaagguggcaaauuuucuguuaccuguguuuuacaacaauuaaaaagaagcucacggaagacucgugaaggcucuaauacagugcucagugagguuggaaaggaagcccaccuguaacuccaguuucaggagauuuggcacccucaucaggccuccaagacaccugcaugcauguguuuuacacacacacacacacacacacacacacacacacacacacacacacacacaccaaauaaaaggaaaauaacucuuuagccuagugccugggaacagcuggcaaacaguucuacauugcauacguuuguggacuugaaguggcuuucagauguacacuuugacuccagauugucagauuuuuccuuaagguguacguuuucaugugggcuugggaggaaauacugaguguuagcauagguuuguauacaauaugagaaaguucaaagauguugguccuauuacccguguagucuugcuucacauagguuuguguguauauaauacaaacauauguauguauguauguauguauacauguauucacuuuuuagucuuaaauguacagaugugauaaugaacggagaacucccaguuggcggguauuaagagccgaguguauaguucuguacauuuuacagcuuauucugaaaagaguuaaaauuucauacugucaaguaucuuugaagagaggagccuagggugugguuauuuuacacagucuccgguaaacaaggagguggacagaucccugacuccauaucuugcaggauacuucuggaacagagcuaacauucauuuaaagaaaaucuaugcuaaguccuuggaaagcaaauaggaacuaugaugucauuaguuucccugcaaauaggaacuaugaugucuuuaguuucccuggcuagaagcagacuugaaauuugucaggaaacucggugaaggagggagggugggggaccacggaccucagagccugagagggacuucacaguuuguucuuguugccagugaauaacagggcuucagaaauggcacaguuguucacuuaacugggaauccuuguuggaaggagagucaguaauggacauagugguuguguucuuagugacauucauccacuuuuaacuuaaguuagacacugauaauuagucauuuuuuuuauauuccucaacuuucuguuucuuucccuuggagaaaaaaacaauucuuuuuugagcaugugugugugugugugugugugugugugugugugugugaauuaaaaguguuacuauugcuauguguuggugugaaucuauauauauauuuuacauuucuacaucuauaaaaccacuagcuuacaauuuucauaauugacacagcuuaauuaagguugugacuugacauuuuggugauugucaggccauuucuucauuuggcgauauuccaguaugauaucuuucugagugagauaaaucuaugccuaaagccagaagaaaagaaacacaccugcaaaugucaucguuauuuugaaauuacguuuauuucuguguuuugcuuuuuucauaauaggauuuucugguuuugugaguaguuaaguuucuauuugcguaaacuuggcacuuugagaucacaaguaaaccuuuuuuucagaagucagagucucuucagauccugcugugguuugaauauggaacguuccccucagguucucacauuugguuacuggguuuucaccuggugucauuggaggggaaggugguggaaccugaggagguggggcuacucuggaggaaguaggucucuguggugggccuugaggacucauagccuggcucuacuuccugucuccuuucugcuuccugacuguccgggcuguguggccaguaugucaagcuuccacacccgccuuccuugcuaggauggauguauugcuuaaucugugagcuaaaaaaaaccauuucccagccuaugcuguuucuuaucagguguuugaucacagcauuagaaaguaacuaauauguaucuuauugaugaagugaacugcucggucucuccgguccugccagcucuuucucuucucgguuauagagauacaauguacugcauagccuucaaggcucugugggauuuacacacuggacaagcuugcugucuuccugggagaggauguuccuaauaggauuuuuaaggugggagccuauuggagauggaguugaaggaauuaucugggaaaggaagaaugccaaaccuacugaggcucaauggcuugagccucugguaagagggagccguguacugugggcuuccauguuugaagauaacauuuccucuuacacugacuuuucucucaaauggguuuaagcuugaaagaacuugucgucaggaugcaugccaguaaagaaggagaagaaagcaggaaguggaaagcaugcuguuagacaaggaaaacaaacaaacaaaacccugcucagugggaagcugccucugcucagagcacuguagcaacccugaagccacucucugcugcugucuagcucccagcacggagaaagccagugcaggcuggcugugugaagccacggagcgccucccccauccuccucucuggaagcguucaggaucuucucugcuccucagggaucuguaacuucacagcagaauucacaguguggguuuauuuucauccacugugugggcuucuccccauucagggcucaguucugggaaaucaucuugaguuauuucuuccuucuguuuguucuccuuauucugugugguauuaccauuguuuggacguuggcccuccuggauuugucauugcguguuccuucccagucucuccccaacuccccauuuucuagcauguuucccuuuucauugugcuuccuaggagaguucuugacuuuauuuugcaaccuuucuauuguauuuucacuucccuuuggguaaauauacaaacauuugugugugugcacacagggcuuccugcgaugguuaucauacuucagcaucuaugugggcuugguuuuaaugcucccuaaaggaugcaaaggaaaaaaaaaguggucugcagaagaucaaauguauguuauaaaaugugaauguuauagaauguuaacccaggcacucccuuuuaugagcuuuugaccaucucuucauuacucauaucuaucacgggguguuaaugaaugguaugugaguaguggcuguuuagggaacagugacaaaagaguggccauuuuaaguucaguuaaaaaugcuuuuuuucccccccagaguauuuucaacuuguggucaguugacucaauggauauggaacccacagacacacacccacacacacacacagacacuacacacuauacacacacuacacacacagagacauacacacagacacacacacuacagacacacuacacacacacauuauacacacacagagagacacacacuucacacacagacacacaugcuacacacagaaacacacagacacauacacacuacacacacagacacacacacagacgcauagagaaauaaacacagacacacacacagacgcauagagaaguaaacacagacagacacacuaaacacaccacacacacacacacacacacacacacacacacacuuacuuguagaaccaccaccccugaagcuggaccuacacacacacacacacacacacacacacacacacacuuacuuguagaaccaccaccccugaagcuggaccucugaagcuguuugaggugcagguguuucauucuauaaccugacuaggcuuuuccuugacaaccccugacaucuccgcccuuggcuuugucaggucccaaagggcuuuccaauagcaaauugcaauccuggcuaccgucaucuugaagguuuguuauauagcaaguccaggguacuggcuuauucacacuuacacagcacuacuccucugccucuaguuacuucugagucuuuuauucuagacucucuccauucagcucucuccagaauaagcccccagccuuguucugcugugggagacagacauuuggggcaaagcagagcugaagaaaagaggaguggggagggcgggugcuggugagggaggaggaagacagagguucguucuuucuuuauauauauacauauacauauauguauauauauauauuauuagauauuuucuucauuuacauuucaaaugcuaucccaaaacuccccuauccccuaaaucagacuuucaccuaguuccuugcuccggcacgagagguaccuggugcugugagguauugaguccuucggggaucgucuguucuagugggcuggcuuucagcuguccacacugccacuguguggcugcacuaagucaguccucauucuuguaucugcuucaccacuuguaagugguucaacuuugaucucugauuuuguugaaccucauaaucuucugccuuucccagaaaccucucuacuggaacuuugaaggaaugagagcgugucgagagcuaagaaaccuguguaaaaccaguaguuuuaaauauggauuuuggaaaaauuaaaaacauacuauuaguuuaauaucguaaacucauaaucgugaguaguuaagcuuuguuugcugaugugugguuacaguggagcuguguuuuaagacaguuuuuaggguacugaggccuuuccagucuuccuugccuauauguuuuagcauggcacucuucccuucccgauuuacguguaguauuucaucagaaccuugccuuuguaaaagcgaugaaagcaugaagccguggugggccgggauggcuguugucucugccuguggguugccuuugucaccuauucaaggcugagcucuucaucuuuucauucccccacccccuuucaguucauagaauuuauaaguaaccauagcuuuguauggaaccauuacauagacuuguaaguaaccaggaggucccuggcucuuucuuagccauuucuagcucgaccccacugugucucuuuuuccuuuaugaaggcuucuuagugacccccguguaauguuuccagucugcucauacguuucuagcaucuccauacuuuuauuuggacccucuuauguccgggguaugguguaucggccaggauucuagggcagccuaaaggaugggccaguggacuugguugaugaccugaaacagcggagaguggcugagugugguuuaguaguugauauguaagugcuaaggcugagagcagcuucgcuguuuguuaaucagcccuaguuagcaaggguaaagcuugauguuuuguuuauuaagcaaguauuuauuuuugggggagguggggucaacuaugugccaaccaacuguuugugacugaauguagaaaucacccaaacaugaagaccccuaccuaacucuguugugugggaaaguaggcccagccauuagcugugagcuguccaucacagagcuuugggccaaagcaaaccuuuauuuccuuguaacuguuuuccuugcuuucuuucugaccccuuugauuuugccccuaaccuuuccgaucucccuguaacucaucauggccucagaccuucgccuccauuggucccugcccuucccucuuguguauucaugcuguguggucccauccuguccuguccccgacguacauauuguucacugaucaguuauacucuucauauaugcauacuguccccaagccaagacuagccucuucagcucauuaauuuaaacucuucacauucuugaucuacaguccuguagaauguacaguuagggaaaguuucucagaguuggaugugguggcuucccacuuugaauugaagcacucagaaggcggagacaggaaaauugcuacaguuugaggcuagcuugagccacauagugacuuccaggccagccugagauggguaaaacacucucucagaaaaccaaaagccaaaacagaagagacaguuucuuacaagaacaauuccgaaugaagguggaccgaaaccugccgggucauuugaugaguggagagcuuucccaucgcuggccaagcgugucuguuuaauugaguaaggcagaaaauucagauucggugucaccacccaccauccccgguggacacuccuggcuaaggaucaucuccauucuacagagagaccugguggguggggcuugacacagcuuucuggacgagagcuucagaaagauuggcuuggugccugaagagcagugguauggacugugagucagagccuaacagugacaggaaaaagguggaagaggaaagaucacagccaagugaaagaagaggagcgggaaagaaugaagagcaguggggguggcggagggcagggaaggaaaagaccauucuuaaaggcaagguuaaaaauguggcaguggaaaaaugcaaccuauucuagacuuuggaagaggaaucuguaggagagggagacacgccggaugcugagaaaaggacuguaaugggaugcuauugaaauggguuucguucugccgaaguucggucugagguccccaaaugccgcagacagaacaaacaguaugugauagcaacacccacauggccuagaagagcuuugcagccccuaacaugauaccauuucccgcucucccauccgguaucugggauggcaccuaaugcuagguaagggcccagcuccacaucuugaagaugcccaagaugugucuugagguccagcugggaaggaaugagccuggcuuaccucaaguuacauggaaaguuaauaagagucauuggcucucuugacuugauccauagucucuggaggcuucagagacacuggauccuguaaaugcuugcuguagugacuccugccugccugccugccugccugcaugcaugcaugcaugccagaaagaagucugcaggggacacagcugggcuuucuuaaucacaccagucugauuuccacgggccaggagagggccugcuggcgagucuuuuaugccaaggccagugaaaccuucccaguaugauggagcugagcccaucagaggcagagguugggcgcuaugcagcauucucagugacgguuaggagaacccacuggaacccuaggaguuaauagcaggcgacuaccaaaacuacaaaaggcccuaauuuaauuggcuaaugaagugcagggagcaggauucuuagcagaagggccaagagaagaggccuccuguguguggaguggguggcaggugggggugaggcgaaguaagucucaaguuuuaagucuaaauuuuucccucucuugaaagcuaaaauguuuuguuuuuguuuuuguuuuuugagacaggguuucucuguguagcccuggcuguucuggaacucacucuguagaccaggauggccuugaacucagaaauccgccugccucugccucccgagugcugggauuaaaggugugcgccacuacucccggcgcuaaaauguuuuuaauagacuagaggacuucugauuuuuuuaaauuguugugguuguuuuuaaauuacuuacuuugaauucauauguaugcaugaaugcuugccugccaguguauguaucaugugugugccaggucaucagaucuucuggaacuggagauacagguaguuguaagccacugaugugcgugcuaggaacugcggccaggucuccuggaugugccuaacuccuagggcauccaauugaaguaaucuuuauuuacucugccuuccaaggggaauguacagagggauuuccugacuuugcacaggagggagggagggugggggaagagaaagagggggacauaaaugagaauuuaaguccuuagugugcuagugaccuguaagagucuaguguuugccaugaauggagccacagagcuugaaacugaagaugggugagcucugccugggugacauuuagaggaguaggcacggaaaccacgguuuuaagugaggcaacaaggagggaggagccguggggaagggcacccugguccguggaagguaguuaaggagagauggcaccauagaaagaugguaugcuuuguauggcuagcagcaguagugcccugagugggacuggaagcugaccuggagggaagcaacagugcugggucucagaaaguaagucagacguguugaucagaaagcaaggcguaucuugguaaagaaguguguggauuuuuuuguauuuacguucauggguccuuugagaacagugguggcuuuuguguggugguaauguuuaagugagaccuguucacuuaaggacaggcuaugaggacaggcuauagauaguaucuuagcuaggguuucuauugcucugaagagacaccaugaccacagcaagucuuaugaagaaaacauuuaauugggggcuggcuuacaguuucagagguuuaguucaugaucaucacugagagaagcauggcagcaugcaugcagacauggugcuggagagggagcuaagaauccuauaucuugaucugcagcagaagggacugugugccauacugggcauagcuugagcacaggagaccucaaaacccgcccccacauugccacauuuccucuaacaaggccacaucaccuucaacaaggcucuuaauaaugacacucccucuggaccaugcauucgaauagaugagucucugggggccauuccuguuuauaccagcacaguggggagugggggagcaagagaaguuuuuuuuuuuuuuucuaggauuugcauguagaccuugaaugugguggcccugugcuucugacacuucuugcuucuaggggaacaucuggucuaccucuccuggacagccugagacaaaaagccauuagcaucccucuuugggcuuauaggcacggaggacuagguauuuugguugucaugaugaccacaugcuuucuugccgauccuugguuauugccaaccuuuaguaaaauuguguuugagcucccucccccaauugcgcccccccgccccccaguuuauuacaagucgagugguacaaggaaggauacaguggaauacagucagccacaaacagcccugccguuuguagcccacagauggaucggugucuuauuuaugcaaaaucagcugggcacggagagcaaaugcugcaggacugcgcggugugcggaucuaagggucgaucucagaagaacaauggcuaccagagccuggggugucucagaggggacacggggugggaggaggguugaucaagugguuaaacaguuagaggagagucagaaauccuggcacgccauugcguagucaggugacacggagaaggacugcgugcuuccuagcuugccgagcuggagggagagcauacguucucacugugaagguguuuguggugcuagguggcuuaguccgacuuaaacuuuacacauguguacauguauugaaacaccuuauaaaagguauacuuuuuuauguaucaauuccaaaugaaauuucaauaaaaaauuaagaguagacucauuccagacauguggguccaaccggagagggagcguggccuguuugaggguuagugucggugguguguggcgagcuugcgcucugguguccucaggagacccuucccuggcuucuggucacaggggaguuuccucacuagaccagaaacaaugaagcuacacacauugcggcaucuuuuggcaggcgacauuuugauggcauuuuaaggcacagagggcaaggaagaugaaagguuguuugcaaguuccaggacuugugugcuuagggagaugaugguguugcugacaagcgagguccccgggcagaagagcaaaauggcugcaggaggauuguccacagaagguaccugccuaguuacaggaagcuuggaauuagaguugagaccuucugaagccugcgcuuucugcuagccugagaccuacaguacaugggauaaaaagugcuuguugagucuaaggugggccagcagugccaggugguggugugcagacagugaaaauuaugaguaaagccaggaacuuauuuugggaguugugcaugcauagauauuuagaggagaugauuggagcugucguggagggaguucacuuagauuugcacacaggcuauaauuggaaauggccaaugaagaguauucccuuaaaguggagaggacagcgagcagucacagcacacuugugcugugaggugacaggugacagacaggacagcggagcaucugccuuuccuaggcuugcugggauagaagggagcauuggcuugcaacauggggcagugucaagguuuuuacuuuauuuuggauaauacuuacgaagaggaaggaaaguggauggagagggaaugauugucgaagacccaagaaaggguucugcgcugucaggacagcagugugugcucaggaugcagagaccaaggaaacacacuuaggacucagcagcaccuccaugugcuagugguggugguuguugauauuauccguaagaagagaagguccagguucagagucaucgauucgcucaaggucuccacagccagcuggggucagaauucugcaccucuguccguuaacaaaaugacugcguggcuguaaagcuggagaugaggccacuguagagaaguagcacaggggcuaaguuuccucuggacagugauggaguaguaggcaaagguccccaagugggaguggcagaagacggcuguccgcguuaggauuucuauugcuguaaagaaacggcgugaccacaggccagcuaaggaggaaaguguuuauucgcuugaugcuuuaacaucgugguccaauggcucccaaccuuccuaaugcugcaacccuguaauacagcuccccauguggugagccccagccauaacaugauucucauugcuguuaugaauuguagauauguuuuccgacggucuuaggugaccccugugagagggucauucaagcauccaaaggagacucagcucauggguugagaaccaugucuuaguccaucgcugaagaaaaagucaggacaggaacuaauucaaggcaggaaccuggaggcaggagcugacacagaggccauggaggggggccgcuuacugacuuucuccccauggcuugcucagccugcuuucuuauagaacccaggaccacaguccagggaggccacuacccacaguaggcuggaccuuucccaucaaucacuaauuaagaaaaugcccuacaggcuugcuuauagccagaucuuauggaagcuuuuccucaauugagauuuuccucuugggagacucucaugacaagcugacauaaaacguaccaguccaccagggauggauccagguaagggaacauguugcugucaacaaucuacacucuguggugggggccuggguggguuuacugcagcuuaauccaguaauuugcucagacuuccaucucugauucuuccucugucccaucuuaaauacagaggacaaucaaaugcguuucuauugugggaugugugccguguguguguguguguguguguguguguguguguguguguguguguguuugaaauuacauuacuuaaaaacaaaacaaacuggcuuaucuuuuuuggguauaaauauugcccgugcaaaucaucucugagugaauuuucuggcaccguguguguauuuguguguaaauuaguccaugugacucugaauucagagagcuggcagaugucuaaaugaguaucccugugucaucaggaccuagauauucucuuggggaagaacuagaaaccuugagaauauugaaauacaugacuaaaauuccagaaaucacacacacacacacacacacacacacacacacacacacacacacacacacacacacaaagaggacuggcucuuccugacauccauaugaaugguagcaugugacucccggugcuguguguggucuguccaucgucuccguugcacuucauucuuuucuguccuguucuuggccaccccagugaccccaaaccccuccguagcccugaacuagaccugggagcauggugagugccagguuuacugagggccaggaaaggugcggagucaucuguuuagcacaugaguuacuaguuaaaaaguugacaguguucaguaguuaauuuuaggccccaucaacaugcccccaucaaaacagcuuuaucaugguggccacaugggaaagcgguuacaucaaaaugucaugugugggaaaaaggauuauucuuagaaauaaguaggggcguuugauaaagaagaauuuaauucagaauuagaaggagaguuuuucuuuuuaaaaacaggcccguguguaguacugacaaaccuggaacuugcuauguagaccaggcuggccucgaacucagagaucugccugccucugcuucccaagugcugggauuaaaggugugcgucaccacacccagccgagguuuuaucaccuuuaugacaguucccucacgcuauccauaaagcgcagacaaggauuuacauaacagaaaaaaggucaccaucuucccaaggcaggacugagcauuaguguaacaccacugccaccuaguggugaucucuugcagcucguuguaaaguaggaaagaggauguuuauaagagauauggacacuuuguaccuucucaaugcaguuuuaucucucuaauuagaaauuuaugcucaugaaccucuauggagaagauacauacuaagagcagaaugaacaucuuagggguuaaauaaguauucacagaauauaauuacuuuccaucugauuuuaccuuuaugccuuuucuuaagaaaagaaaauuauaaaccaguguaaguaaaauaauauauuagaaauuacugggcauuuuguauaaaggguaauuagacuauauuauacagucacuaucguuuugcuuuagaacauauuaauuugcauuuaagcacagauaucuuaacaguuuccaguguugcauacaaaaugauggggguucuuuggaucuacguagagguggguggaguccccuagaugcugggaggcucucuucauccugcuuucuugagcuuccucguguuucaguauuggguagguguaccccacuccucagcccaguguugguucagccuaagguauacuaugcuuguguuuugcaaguugaacuuuuuccuuaaauagagaugcagucauaggaauucccauagccaggaagcccuguggagcagcugcagggccccacuugcuuugccucccugcgucaccugugugagccgcauuuggagggacccacuguuauaaguggccaggcuacagcucccugacaucacagacauuccaaagaaccagaaugagacgguguacauugauguguguguaaaaguaagcaguuauuucaaaugaauuaaaaauguuuuuaggcucccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggagugggcggguaggggaguggggguggguggguaugggggacuuuugguauagcauuggaaauguaaaugagcuaaauaccuaauaaaaauggaaaaaaaagaaagcauacacacacacacacacgaagagagagagaauaaaaaauguuuuuauaugcauaaagcaagacuauuuugaacaugaauuuuauucuguaaauucauguugucugccucuggcuuuugaacucgguuacacagagcuguaggaauccuagcugauauccugggcaggaaaccugagcuggcccuuaugugggucagagugucuggccauuuaccguugggaaagcgccucagauuguucugauacacaaaacgguuugagcacacugcaccaaaauguagggcuuaaaaagcagggagaugcuugugauacuguaaaugaugauguaccuuauccucccccacucuaguuucauuaaguauuguuuccagaaacuucuuugaaugcuuucucuccuaugagcugggacacaguuaccccucacgguucacacugcgguccuuccucuucagcuuuguugcuauuugauuuuaaaaaguuaacucagcauuggaaggaaagaaguguucuggguuggaucuggcuagugccaccacuggcuuuggguggcagugcugggcucuuacuguguguccaaguggacaucuuugucugcugggugugggaagcaggcuuugggauugucgcgcccgcucucgaccagcaagaacgacgugaccaccaguccuucuaacagcaguuuauucaguccugauucuucuuguuuauaucucccuuguuuuuauaucucccccgagcccugggccucucacucuuuuauacucucaggucccauccacgcacagcaggccacgccaccucaccaggcacgcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacaauucccccuuuuuucuuuuuuggcagagagaaugucuguagauagccccccgcagccaugccccuuacccguccuugggugacaaacagcauugguuugaucccugucuuagguuggugacauguccagggagucuuaucacugacuaccucucaaucaugccaagccacuccuggggagauuguguuuugcuuguggcaggugcaucaaaaggccaggauauuaauuaaccuauggccagaucuuaauugcugcaagcaagccucaugggugaagguagaggucugauccccagugugcaagcauaggggcccuacacaaaaccaucccuuaggcucaucacccagagaggucuuggccagcucccgugucguuuuuccuaggggaagggaacuaggacacugaaccuucaugcaaucagacgugccuuccacaggaugccaacagcaagcuauccucugugcagugcuuagccucgcaccccacggcauaacgcagcauaauuucuuuuagagcggcaaaccgaaucugaggagauugucccgccuccacugcagcaaaagccuacgcuaccauggcaaaagugcgggccgcacacucugcaccuaacacaugugccaaacacaaaaaacacacacacuauaacaagcauacaucccagggcucucauccccacucaucuucccugaagcaagggauagauagccagaggggcuaucucuuuaaggggaauucagggaucaaaaagcguggaaaauuuugaaugucaugucgagcugguaucggcuucuggaauaccgaaaggaucucucaucucggcuccauccuuugugcuugugggaucauccaccacauccacaggggcaacuggaucaggagccucauucuugcagugucucaccaaucucuccagcacccaaagagguuccuucucguccuguggaaacacacaaacagacccucucacccacaucaacaccugauccugucgaucccaggggggauggacacaauaccucguggugaugagaccauaaccucaaucaccuguguguccaucuggggagucaauaugagagucaaguuuucacuagcuuccccucuguuaggcaaugauuuccacgcccuuauaggaaucugauucaccugcucaaacaccugcacuggauauccugucuguuguugugcaaaucuaccuugaucaagcagcauaucucuaucccaugcaaauuuagcuugaucagugaaaauaggacaucccagcaaggagaaucuauccucuuuccagaccuccggacagaaggucugcccauagauggcugccgaggaggcauagggagggggagcagaagcuaauucgccuuccuccuccgccucagcucuuuuauuuuguccuuucuguccaccugauaacacugugucuccuuucuuuuuccuuuuucuuuuuaagcccuucuccucuuccgacauauuuucuuguugcucuauaaggauuuucugaccugucuugacugccucuacacacaguuucaaacaguaacagaguccauauaucagaacaaacaagaccaaaacuaucagaccuacccacaaagggucaaugggagaaaaaagcauaacuacacagcgaggaucuauugaucacuacacugagguuaucauaguuccuuaacuuguccccaaaccgggaaccuuaacuugucccaaagccgagaaccuuuuguuaccuugugccuacuuccuggcaacuuuauauuccccucuauuuuauccgagguccuucccaaacuccuggguuacuuugugccuacuuccuggcaacuuuaugcucaccucuauuuuauccgagguccuucccaaacuccuggggucgcaaguuucacucaccgugaacuuacccugccggcaaccacugacugcugaaaguucugaacucggcgggggagucgguuccccauacgggccaccaauugucgcgcccgcucucgaccagcaagaacgacgugaccaccaguccuucuaacagcaguuuauucaguccugauucuucuuguuuauaucucccuuguuuuuauaucucccccgagcccugggccucucacucuuuuauacucucaggucccauccacgcacagcaggccacgccaccucaccaggcacgcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacagcugggaaauccugugucggucuggguuguaguuggguaucacuugguaagugggcaaguggccuucaaaaggaagaagggaagacuuguagcaagugggcauguucaguuaugaagcucaguugcccgucugcauuucugggguggggacccaggcuggugguggagagaggcuaagagccccacugacucugcuucucacagggaaagaaacacugggugaagagacacaguuguuuccuaugaauguguuuugucaaaaaauauuuaacacuaaaauuuuuuaaaauauuagugugugugugugugugugugugugugugugauauuuggucaggagcuuacuuugguuagaagaaggcauuggaucuccuggaauuugguuacaggugguugugagccuuuauguagaggcuaggaaccaacgcaggucuucagcaagagcagucaguauacuuaaccgcugcgccgucucucuagccccagacauacauuuugaaaugcucaacgcuaggugagaguaaaugcacacgaugaauagcaugaauaaagaaaaggacccagaauuaacugaauuaacuauaccuuuuacucacccggguuggccaccaacuugugaucuuccugcucccgccuccugaugauagacgugagaugucagacugacccacugggucuuacuauguguagauuccuuuaccugucuggcuuauagacucaagccuacuagaugaagucagauuuuuaaaauauuuuaaguccucuuguacuagugaacaagaagauaggaacaacuuaguauuuaauggaacugaaaguaauauacauacacuuauuuuaauaaggaggcuagagucugucugucagucuaucauuuauuauauuauacuaggaaauugaaccucggguuucagccaguacuagacaagugcucuacaacugaaucauguucucaacuugaauuuaccuuuuuuuaaaaaagcaggacauuuguggcgggggagagaaggccgaaaggugcaagguuaaguaggcuuggaaucuaagggaagggaagggcagauccagagggagaggaagggagagccaggcuggaagcagcuucccagagagugaugaaagagcuuggcaggagggacagagugggagcgaaugcuuuacccuccagggccugugcuugugaggggaaaacaguguuguauaaccacacacaagugacgagaaaggaaauuaaaaaaaaaaaaaagcacaccacgauacacuaagguccaaacuuacaaugaagacagacuucuuuuuuaaaaacucuuucuuauuuuuauucauguguauguaugcaggugaggugucuaugugaauguuuuccacauguauguaaguguccucagaggccaggagaggguaauguauaaguguugguuacauaagagggauagaaaaucuacuauccuuuuaauuucacuuucuacaaguagugguugcuguucacauugacagaugaaauagucaccacacauguuuuacagugauaucuccucuccgugcuacccgguagaauuugaguguaaaaugucgcccucucccguucccugccucugacuuauguguuuuaacccugguuucuagccacuguuuugggagauuguggaaauuuggggaguagagggucuggcugguguggaugaguuaccagaggugaguauuucagaguuguagccugacauccugccuccccacuucuccuuuucagggagacagggucucacuguguagcacuggcuggcguuggacucgcggagaucuaccugucucugccuccugcaugcugggaacacaggcaucaccaccucuccuggcucagacccugcuucuugcucaguucucuguuuucugcugugcugagauaggaacaggcuguaaaguccugcugagauuggucuugcugccauggagggagguacuguagcugcauggcaugacuuuaccugccaugacgaacuguauccucagcugagcccaaaaccaaccucuccucccuucuaggucuucuucagcagugacugagugacuuacacucuucauagguauagcucuucuauaugucacccaacgaugauauuaaugcuaaggagacagauggcuucccuucucgaugagccgguagugcagaaaaacaggacggcuccuaauuuuggcauaaacuucagguuauucaacagucagcugcuuacacuggccacagaggcauuuguuuacgaaaaagacaggcuggcuacaaaguaggcacgcuggcucccguccucggaguguagccagcucuccugcccagguugugcccgaacaguuccuaagacagucuacaguuuucccacccacagccuuuccgcaguguuauuugaaugccagucuucgcuccugggaaggccaagcgcugugauugguucuggcuccacggaggcagaugccagugagcuucuugugaaccccccaccuccgcacugacuuccuuaguggcuuuaccaguuugcaccccaccagcaaugaaugaguguuccccgauccucaccugcguggguugcccuuuguuuauugaucuuggccauucugacccggggaagaugaaaucucaaaguagcuuccauuugcauuucccugccgucuaaggaucucaacggguucucaacaauuuguguuucaucuuuucagaguucuguuuagauaaggauuuauuuuucauuauuccacauguggguaguuaguuugauuagcacuguuucuugaagacgcugucuuuuuuccaauguguuuuuggauucuuuggaaaaaucaggugccuguagguagauggaguuaagucugggucuucaguuuuguuuccgugaagaacgugucuauuuuaaugccaguaucaugcuguuuuaacuauuagagcucuguacuguagucugggaugauggugccuccagcgguauaguucccuccugugggagcaggcuucaagucuaaucaggaagugguuaguuaucccgcggcacgggaugacgcggcacgggauacuucugcuuggcagguuagaacugcaacaugcccggggcccaucucugggugagaucauuggugccuucucuucagaaaaggcggcuuaguuaggaugucagugccguuuagaguaagagcugcuaucacacaugguaugaggaugagcuagagaaacagagguggggaggugauuccgugcccgggucaggaagccuuuccaggcagccaucguguagcaucagaggugagagcauccgauuucaagauagacaaauuaaaggaggagagucacagcaaaaggagccuggaaccacagggaagaggccagagagugucacacccagucuuuccugaugccugucgggguguggacuugguagugcaggcagcaaaggcagaaaauagucaggguuucauuuuagaaaauaaucuuacugacccugggaaggaugaagugggucauuuguguuuccaugaaauagugcucguauaagaaaaaauagaucuguuugugacuucuuagucuuuaaaaacaaaaccgaaaacuuucaauuucguaucguauuuaguuuuucauggucuuaaacagaacuuuacaaaaauuccaauauaugcacugcuccaauuugaauuucucaaugauuuauucuuaggacaaauuagaugcuuacagugucuuaacacugccuauccccgcggauucuaggacucuaccacaagugacuugagagccuucagcagggugcugcuccccgaguacccuuccucugucuccccuugguagcaacagaaggacugaccggccugucuccuuaaagugucuggaagugagacuguaacagagggaugaggcuguucuggagaauuuaaaacaguuucagggugaaagguagauaauuuguaugcgaaagaaacaguaacuaauccagggucacagccauccugcccgagccugcccuugaguggccuccacaguggcccugucuggucugaaaggcaggccuaugagagaugcugggaggugaguguuuaggcuuggacgagagagagagagagagagagagagagagagagagagagagagagagagagagcgcucuugucugucauugugguuuuguucucucuccuauuaccaguuuuaaaauagauauggacgccgccccuuuucaagaauauucagcuaagggaguuauuauuccaauggcuuuuuggacuauuaguugcauuuaaaaauauuuuuauuuugguaaaaaaaaaaucacagaacauaaaauuugccaccauaacacucccauguauacauuccagaggaguuuaguguaguuacacugccuagcaauaugacauuauuuaguuauuuggcaguuuuauacacacagcuugguuccuuucucuuccccauccuuucuuaucuucuucccggcucucccuccucccuacggguccucuucaugacuuuugauuuuccugugugacucauguucaaucagccaucuauguggcuguuagauuugauuaaucacuggagccugguuaucaguagauaugcaacuggaaggcauuaauucucuccuugcccugauuuguucauaaaugguuaagcaguaggguaggauccuccacccccgggauucuccucucuaucuuugcacaaagcagucuuuuugcuuguauacuaauacuucauucucuucucagagaguuuuaaaaaauucaccuuuuauguauguugaaauaagcuaaacaaaaucgauuuucuucacuagaaugacaacaauaauuuccauuguuauuucuaaaugagccaggaagcauuuauuuuuguacauuuugcuuucaaaucaagacaagguuguaucuucuaucaugaacaaaggagaaagugcaaguccuuuggcuuuguggauguccucugacugggugaacuguggagcagaacauguguccacugaaagcguaugaaacaugcccgcaacucagugguuggccgagcuucccaucuuaggcauaaaugcugagucaacauuucuuuaaagacugacaaacccuaaaucacccacuggagacuucauaaguguagucauugaugcucucuucccuuaugccuuaucacuguucuguugcugugaagagacaccaucgaccacagcgacuguuacgaaagaaagcauuuaguuagggcugacuuacaguccauuaucaucauaucaucaugguagaggucauagugucacaugggcaugaggcuggagaaguagcugagagcuacaaccugacccacaagcagagagagagagagagagagagagagagagagagagagagagagagagagagagagagagagagagagagagagagagagagagagaaggcaggacagcucaggcuugacaugggcuuuugaaaccucaaagccauccccacauccccagagacacacuuccuucaacaaggccauaccuucccauccuucuaauccuuucaaauagugccacuacuugaugaguaagcauucaaaugcaauggccuacagggccauucuuauucaaaucaccacacuacuguagugaauaauaucuuucuucccacauucccucuuaaccuuuuuauggugcuauccuuuuacgagucauacuuacauuucuaaaaccccaagccaugaaacagaauagaucacagcuggaaacuguuguucagcaauuguaagcuauuaaaguauaaguaagaucuuccauugucucaaacuaaaauuagauuacccagaagguuccacauggccaauuacuauuuaaaauaagccaggacaaauaggaaaugcagaaugaaauguuauguguuuuuguuuguuuguuuguuauuguuuuauuuuguauguaugugcaugcaguucagaaguagguggaggagagcuguuugcucucaaaguuuccgugggagagauggcagagcagguagguucuugaugaggcgauaguucuuugcauuuggguuuuguagguucuugaugaggcgauaguucuuugcauuuggguuuuagguuuuuagcagaaauuacauaugucaguugacugaagggaaaggcuaagagauggaagaagauacaguaggugggagaguuugagggggaugugugccuuguggugucaugugaccugucacaucacaugaccuguuacaaccugugaccuguuacagcuugucauguugcuuccuuaagcgagagucucuucauguuuucuguucagguccugagagagcuuuugagaugagccaccuugcuggugcaacacaaggaagguccacaucagaauguaggcugaguaaccccagugugcggucaccacuuccucugagcuuggcaugcuggcuucugagagcaaagcagaucuguuacugggaggucuugacuuccgagggcagucucgguuuucaccuguacauuguaguguguuagcguuuccacugccccccucauaggaauguaagcgugggacugagccccgcccccagaccccacucucccuacagccagccacagucuggccuguuuucugccguuagcugccugagaugaagucuccuggcuuugcugaggucgagcaugucccguagcugcuucagacauuuaacuagggguuugcacuuacaguaagaggcagguccccucucgaggcugccagaucccgucucccaucuccugaaccuucaugccuugauccuuucugucugccccagcuguuauuuguccugacagcgggugccgaacacuuacuuaccuuuuccaagaagcucuuagaauucaugucuggaaaaauacugucugaacuuaauagcauaaugauaucaucauaauaacacuugcugccgcucacggagacuuucuguagccuagauacugugcuaaguguucuccgcauguuacuguuuuaugagccuagaagaaacaagcuuguaaaauugguauuguuguggccuuuuauuuuggauagaaaauguggccauaaagaaguuagugugucacggagccuggcuugaaaucuggcugguuuuagacccguuucucagguacugaaguuucagaagcauuuuguuaccguuaaauugcauugauuucccagcggacacuuagagcacacugcaaugaggaugccugacugaaaaucaaaggaaacauuaacaugaccucauuacuuugccgaacaagaaaguuuucuuggguuuuccggcucauugagaguguaaggcguucuuauaaagcuugcagauaaacccccgacauuggacaagguuucaccucagccaugcagaaagacuuccuuagcacgugggagcuaaguucuagguauuuaaguuuccugccccucaccccccccucagucgguggggcaauguagaccuuugguucucugcauuguuuuugccuuggaggcccauuguagcguuauuauucucggacugaauucagaauacaugugagccacucauucuggaccgcuucccagugggucucuugaagacucuugcgaugugucuccucaggacagucuuuuuuuuuuuuuuuuuucuagaccacuaucuaguuuuuauuauuuuuccuuagauauuuucuuuauuuacauuucaaauguuauccccuuuccuggucuccccuccaaaaacccccuaucccauccucccuuccccugcucaccaacccacccacuccugcuucccuguccugucauucuccuacacuggggcaucgagccuuuucaagaccaagggccgcuccucccauugauguccaacaaggccacccucugcuacauaugcagcuggagccaugggucucuccauguguucucuuugguugguuuagucccugggagcucugggggcucugucaggacagguugguucauauuguuguuccucuaugggcugcaagcuccuucagcuccuucaguccuucucuagccccuccauuggggaccuugugcucaguccaguagacaggauggucuuauaucaugucauuccaccuuccucuuccucuucuucuuccaauuacagugauacauuaaauuuccauuacauaaaauaaacccugggucuuuauauuuuaauauagaucauaaauuagauuggggaacguguuuagugggguaugauuacaguggggaaacagagaacaagaauacagugcagucucaaacugguggucuuugagauggaucucacugagaucaaggcuugaagggaccuggaccuaguggugugcuguuguaauaccagaauggggaaggcagagacagaaugggguucguuggucagccaggcuagucuguauggugcaccccaggccagugagaugggggaaggcuccugaaggaugacacccacaaauaucauuuggcuucuacaugcauguacauacaugcacauacaugugcacacaucaacauauaaacauguaucaggacggcugugaacauccuucccugguccaaagaauugaagggagugcaaggguuaaccagauggcucucugaaggacaagcaggacaggcccgacaguagcuauacccacgccuauaccaugcuuucccaagaaaaagcaaaagggugauugugaauggagggguccaagacagagccggagacugggugcaugugguuagagaaguucaagcgcuuugcugcagacaguggaagugaaauggcauuucacaaagcacccagcaaaauccaguccagagucacagaggcccgccuaccucuucuagacacauccuccacugcccuguuggaaacacuuccaugcauuugucacagaaugcucucuggagaguccccaaauauccgugcugucuuaugccugugugaaucugcugugacaaaaucccuggggagagcaguugaaagaaggaaaggucuucuuuugguucacaaguuuuagaaguuuuggccaguggucaccugggcccauugcuuguguccuguggugagauggagcauuguggaaaggaacaccuggcugagccaagagacacagaggcugagagagguuggggacaaaauguauccauuugcuaucccaccuucucccaaugaaugaccuaauuuucccagguaggcuccauucuucugucuccuaauggcucaggaauagauaaaugaauuagucuaguucagcccuaaugacugaugucugucacugccgcacuggugaccaaaccuucagugugugagccuuucagggacaugacagaucccagccuuucuaccuuugcauaccccaaacaugcugaucuuguuuaaaggcccugugugaggcuuccucagggagggcauccuugauucgcacuugggguugccgguucguucuucucugggcuaccacaaguaugcuuuguaucuguguuggcugugagaacaucuaacaagcaucugcccguuauuuccuggcaauguacccuuuguccaaaugaguaugcggucauuaaagacucgucugaguucaucaguugccuguacuauuucucgccucagaggucauuugccuuaauaaucaacuuacgacguaucaccucuaacauccucacuguauguaagcugugugaaagucacucucuugcagaugccggguuguguaccugugccuuuaaaacugucuacagauucuuuuguuaaaucaauuaaguuuuuucuuugacaguuucauugaugaaugcuggcuagucucaccccuguguucuuuaucuccuucuuagcuaagcccucucucccagcaagugucucccucacauucauuucuuuuguguuuuguuuuguuuugugacacugcccaguggacuccccaugggguacacagccgaagacagugacucuuggucuuccagaagcugucaauagccaauucuaccuguaaauaaauuuugagaacuaugucaaaaucacuuuuuuaaaaauggacauuuucuugauuggcuugugaugugaacaaaauauucucucuugucauuuguaagauguaagccccggggugcagaaugcuaaugaguuugggucauugauucugaacggaauccgguuuggggucgaaucuucaucuugucguuauguuucuguuuugucuccagacuaguauuaaggaaggacaacugcugaagcaaaccagcucuuuccaaagguggaagaagagauacuucaagcuucgcggccgcacacuuuauuaugcgaaagacuccaagguaacuccagaagccugcucucaagcacugcaugucaugacuauucuaaaacuuccgugguacaagcugcaguuuucuuggauccucacuauagccuaacuguccucauaauggauuauaaauguggucaucuugcaccccaccacaaggaggagcuaucacuucagcccuagucuugagagauaaucuuauaggaaccuagucuaauauuguuugauccccucuuuuucuucuagauaauuaaaauaaguuauaaacaacuuaaauaaauucaaaaccuuggguuuuuucuuuuucuccuuuuaauuuuuuucugaguauaagagagcaaggguugcuauagcuguuauuaauuuacguucuggggucagauauaagcucacaacccaacucaugcacaguucacagugugcuuguggucgccaugugcugcugcgagaaagcuuuagaccaugcgugccaagcacuuugagaauccuuucauuaugguagcaguuaagaguauaaaccacauuguaauacaauugaggcaaaauaauuuuuauguaagaguugaugaaacaauaauauaguuaggaggaaagauacauauuaaaacuaauauuuuaauguugccugaaaaguagacauugggaugccaaagaaccaaucauuucuaguuuuaaaaaaauguauguuccugguauaaucaguagagucauuaguagaagcugaaaaccaaccagucaagaaaccuaauuguuaaucuguggaacaguaguagagggaauagcugaauacuuaauguuaaagucauaacaaaauaaucuuauuuuaaaagucugauguugacuguuguccccgguccggcuccaucgugucuuugcacauucaccuuuagaaacaucaacuucuugguugccugugacuugggccguauguccaguuaaguggcccucagauagucagccccaugugugagaugacggguggguuuucugcugagaagauaguuggugacuuuccauagcgcugccuucuuaauccgggucuccauguugaagagucuaucaugcagugaaguuagcuuugggagagugggagcuaucagaaaaaggggagagauguuucucugcagccuugggggugaacucccgcucccccugugcugcaaguucacuggcuugaaaguuaagugaugccuaacucacuaaaaaugggaaagaugauaucuauuuacucggauuuacuaaucacuaauuuaauuaauuuuaagaaaugucguuuccccugccuggaucuuucgccacugacacuuuuugaucaaagcaaugcuuaagaguuugaacgaucgaggccagccuggucuccagagugaguuccaggacagccaggacuacacagagaaacccugucucgaaaaacaaaaaagcaaaaaaacaaaacaaaacaaaaaaccaaaaaacaaaaaacaaaaccccaaaacaacaacaacaacaaaagaguuugaacgaaacagacagggagacaggaucuguuuucggagcacagacaccauccuauuuagacaccguuuaguaguccaggacaaugagggccaaagcauucagugcaccaugaagucuacacucaguuaaccugugggccacaaacuugugggugugggugugagcgugugugucccucagugucagcuccauccccauggcagcuaggccuucagaggacaccagucauuuguguggaagcugcauagcuucauagggcauguuucauggccucacucguucuucuugagacaaagucgucgugcaaugucccgaaguuaacucucauuuuugauucccaguuccccuuuuguagucccuggcugagagugagaacccccugaggagcugggagcuggccuucagcauaacguguuuguguucuugucugucaacaguccuugauauuugaugaaguugaccucucagaugccaguguugcggaagcaagcacaaaaaaugccaacaacagcuuuacgguagguacgguucugucccuguucgaggcuuuuucuaagcacgugcaaaugugcaguccgguccuuaccgacacaaucaauucugauaaauacgcuuuacauccugggacacaaugaacucugauaaauauguuuuacauucuaacaccaaauauaugaucagcuauuggcucaguaaacuugcauuuaaaugucuuucaaauauauauuuuuggauauguguauuuaaaauauauucauacauaacacacacacacacacacaaacacacacacacacagagacacacacacaguagcucauaucuauaauccgaacaugugggaggccaagguagcagccugggcuacacagugagacuguguuuuaaacagacagacagacagacaagauuuguuuuucuuuucgcucuuuauuuaucuuguggguuuucauucacuuaacucuaauguucucagguacuugaaaccuuugcuguuuaucugcggucuuaaagagaaacacuuucuccccuuacccacacuucagcugcuguagcaggcaguugcccgagucuucccuuucuccccacuuaggcaauucaucaggggacucuugaagagggcccuucuguuccagccucuuuucuagugacaaauugcauugauucaaggacuagcuuacucaccaucaccugcaaauuccaucucccacucagucauacgaucuuguauagucccucucaguguucugaugcuggccuuccacacccugcccggcagccugcaugcuguguagccucugccgugaggcaugcugggccucugcuuuuccugcucccccuggcugugccugaugaaauccuuccucuugccccauucuucugugucuuucauuuacaaaaccaaaauauaaauugacuuccuguuauaucaccaguauuuaugauaagcagugaaaucuuaaaaauugguauguuguguauaaauguaugcauguauauauguauauauacauauuugcauauguaaaucucccucuagacuuuccuuaguucagggagccgcuguggcucuucaugcagugacacacuuuuuagcuccccugugaugcauugcuuuugcuaagucauaacaccuacccauacuuccagcccucacaccggggaaaucuccgccaccgacaccagugucuggugcuuaggugcacggagcacgggacagccagguaagcaaacagaaagggagugugacagaggugagcacuggcaaggagaugagccaggagaggaagcugcuggguucagauucugucuuauugauuuaugggcaugugggauaauucauaguguaaacagugcuuugacgcgccuucuccccagggugaguugaguuugagaagaggaaagccaagaauagaauccugggaaaauguuaaaauguaagguuugaccagaagacugagcaagagcuuucuaagugcagcaguagcaucgcccaggcggcgaugucauaagaacccagcgucagacaguuucaagauggaaguugcuaaaugucaggugcuguggagagggcagguccggcagggauugagaggugacucgaauuugugaacuuggggcuuguguggucacguggcugugggugguuuucagggcagggugguggugugcgugcauuaggcuguuaauuugaaguggggcagcuggcuucuucccggagcuuggccguuaggagccggggaguguuugggugcugagagcauugugguuaugcugcuucuucucacugugcuuuaaaaccggacuuggaguguguuuauguggcgaucagaaggagcuguuagaugcggcaggauugcugagggagcugaugggucuaagaggcagugcguggccugagcacagaaccggggugggggcaggcaggggcagcaagcguguguauuucaagcccagauaguaccauuuucucggugaagccgaagauaggguuguguggcugugagugggaguccuggaaggcuuagaauagcuucugcggagagauggcauggaaagagagcaucgggggccuguaaacuauguccacuaaagacuggcuuuaguaauguuuguacucugugcuuauagaauagucauucaauuaauagagagcaagcaaauggauugauccagagcagugguuuacaaggccuuuggggcagaggggagaaggaaaugcagggugcuugaagccucagcugcuuauaguuucuccuucucccuacacuuuguguucaaggcuaaaagacuagaaggcagagauagcuuggcuauuauccaagcaggcuccaguaaacgggaggacuauaauccuauagcuucucgucaccaucuggcuuauaugugccguucagucuacccuuccugagaccguugcguggcgguagcuuucucccuuaggcuguugaaaucccaccacuucuccaguucuucuguuucuuucauuuacaaaauauaaauugacuucccauuagaucauuggcauuuaugauaagcagaaaaauucagaaauggagaguauaucuacaucgacuugcauauguaaaucuuccauauuuacccccaagguugaaauguugcuuaauauccaaguuaggguaggcuaagccgagauagaaaguaccuugccaguccuaccaguggaacuagccauuuggcuuccucuaggagcaaacagaggauuuauuuauuuauaccacagagagcuagaguuaaucugaaggaaggaaccaaaauuuacagugcaaugguuagaaugauuucagguauggucugggacucagaacaguuacagacagaagaacuagaaaggccuggguuuggaaggauuaugccaaucacuucugcagcucugccuugcccucagcugcucuuguuuaucccuguuaugaacagaacuugccccgagccugcccuuuauauagguaagucuguguuuuuaucgugaccucccugagggcagggacuaugucuauguuaaagaacuuuuacucgugaguguuuguugguuuugauuaaaguuucuaucagcuugagaagacauaguggcuuggauauuucaucaaccaacuguucuuucugaaguuccuuuggcuagugauguagaugcugaaaaggaagguagauggcuuagugcuguacuauaauagaaacuugguagaacuuuccacagcauaaaauggagcaaaaggcauguuuucaagugguaauugacaacccuccugcuuaaauauuuaaauauccugucuuccuagaucaucuugacugcuccugacaccgcuauuuuagcugguucaugucagagguuaauggcguaacaugaugggauugcagcuaaagacucugggaggggccaaacucugcccuuccugaagucccugagggucauauauugacaagaaauggugguacacggacaaucuauaaauagcugguggaaaauagaaaacuuaugcuuugcuugaaaaggaaugcucaacucugcaaagauggcuucuauagugaguaucccacagagcaguguccugcuagcuuacccuugaaacagcucagcgucacuucuguggucgggaucuaugagugccaugaggcacauggacaccaagacuacagccaggggauugugggugugguuuaagaccuguguauccugugggucgugucuuacacagucuccaauccacaccuuccuuuccuacucugggcaguaaggauguuuuuccauugucuauaucaucaugggcauuauaucaguuuucugcuucugucuauuggccugucaugacuacaguagcuuuaaaaaaaugcccgucgaucugacagucccuggguuuugaagcacggcuggauuccucuuccccaagucucacaguugacaaauuaaauaauuuguagaugaaguuuuaaagaucuacuccuuguuuuuaauuacacugacuuacuugcguagggguggguaggugugcgugcacacucacaggcauguggaucucagaggacagcacuuagucauugguucucuccuuccaucguaaguucuggggauugaacccaggucaccagguuugaaaggcaagcgccuuuccccacugcaccaucacacgagccccaccaccaauuuauaauggucuuaaauuggguuucuuuuguuagagguuuaugagugguuuuuaaggcaggcaaccacuaaacccuacaaauacugagagccucuuccugugacuucagguggugguacugccaccagggacuaggaagggacacucgcagauauccuuacuuuuaaaugacuaagcaagguugguguucauuaaguuauucuuguuuaaauucugcuguggugggcagagcuucuguauauaaagucaaacagccuggguuuggcuucuagcuccacccuguuaggugacccaagccacaugaguuaaucccuuuaaauccacauuuucucaaguagacugagagccacggcaauggaguggcugcuuucuagggcccugaaugucaaauuaaugugauaacguaucaagagccuaggacagcaaagagcacaugccguuuaguggaugguaguggcuuuugcucccaaugaggcauccaucuuucccugaguugccacuauggggccaauuuaugaacguuugggaacuuuaaaggcuauuuagaugaauucuaucuugagaaaacauuccauccugccugucuuugagagguauaaggaagaucuaugucgacuuuucguucuauguucauaagaaugguugagaaaagcaaccaauuagcagugagauggcagucagagauuacuaggguaauaccauuuacuaacgaagggcuuugaggugauuuaaacacuacccaagucacagcucucggagcuguucagaugaguccuuuaaacuuuaaugaagauuaagauaaacuucagauaaaugccucauuucaagaagcuguguugguauuuaaaucuucugagacaacccaggucucuaaucccaguugauggcugagguagaagacugucacguucuuaaugaaaucucuccggagaagcccucagacagagagguauguuuccaaaucgaguggaaguuggugcgucagcagcuuuuagccuaccagagaaugaggagcccugggcaguacagcccuuuguucuggcuuagggcgucagcucacauggugccugcaugugauccagcaagacacccagguggagaugcacuaagaguguaacuucacacacagcucaguggaaaaugcuaaggacagcugaauuaaccccaaugcugagguaccggccuagggucucccguccucaauaaucacagagagguggccccuucuccccuuccuucccccauuuuuuauuucacauuuuauugugagacaaggcccuacuaaguucagauuuacuagccuugcaaguguccugcaccaccccuggacugugagccuagacugagcagaagaagaaagcccagugaguguuagccucuccuuucucuguccccugcucuacaaagaugggggguugaggagcaugguaccugauccugugccuacagagcugacugggauggaguuguuuucucaaccugugagcccagauaaguuccuucucccccucacuugcuucuccugagguguuuggucacaguaccuggaaagacgccacuauuggauuugauugugauucugacaggaggguguaaaguguuuacauucaaagaaaccaucaagcaaggagaacauacuguugugggccuugcaacccaggaauucuguauccaugccaucuuuggcagagcagcguggguuuaaugggaaggggaaguguccugggaguuuguuucugaagugguugcuuuguuuauucuggcuuccucucaguugacaaaguucagcugucucucuuugaaaagggacaucacauccuuugaacccaagaaggugucaguuugcuuucauccaguaauauuucaguauuuaauccugaaggaaaagaccaaaacuggcauuuuuccacgugaucuguggaagaaugucaugucauguaaaagguaucuggauaauagcccaaaugaaggauuccuuagcuaaacaagucaccuacccuaguuaauaauauggauucuuguucuauaugcuuuauaccugacauguccaaugaagcaguacuacuauagucucuacuguauagacaagaaacagagaagccagccucuaaaucauggaacccauguguuggguaugucaccucagacuauacucuuggccacucuacugacuuccuuauuuggucauuuaaauauauguggcauugauagugauccucuuguuggucucccguguucaguugucuuuuccgcaucaacucagugagaaucuuaggcuacacuacccaaugaacaggacacacaugcuggucagaguacaaaucuagaauauuacaguacauucggagggcuagaucuuaaagagaaacguagaagacgguggccgauauuccuaagcugccugggagucuugggguuggauggcauuaaggacuuuauuuuuuaaauuuaaaaaaugggauguaaauugaauaaguaauaaaaaagaagaagaaagaagaggaggaggagagaaggaggaagaggagaagaaagaaggaggaggaggaagaggaagaagaagaagaagaagaagaagaagaagaagaagaagaagaagaagaagaagaagaaaagaagaagaagaagaagaagaagaagaagaagaagaaaagaagaagaagaagaagaagaagaagaaaaagaaagaaaggaaggaaggaaggaaggaaggaaggaaggaagagaaagaaugaauagggaauaugggcaacaugggcccagcagguuacaggucuugucacacaaaauuggcaaguugaauuuagucuucagagcccguguaaaaggugggaggauagaacugucucuacagugguguccucuaacuuccauacauacacccaaugaugaugaugacgacgacgacaauguugauguuucagaauauuugaggaauuauuauauaggagaggcagugaucgguuugggugguugcauccacagaggguugacuucaacucaacauaaaaagaacuuucuaacuagaauuaucuaauagaacaggcccguugugagguaaagaccuugcccauuguuagaacuccacagucaucuucuuccuugucagcagaaaggggcuuucagagacuccaggacaggcccggguccagagcugagaugaacuucucaagguuggacgaugaagagcuguguaaauguggggcucuuguugguuugggauagucaaggcagcauggacugaaaugacuguugaaguggccucaccucuuaccacaggcuauguccugaucccgcgcagcaagaacacagugagcuuccuucaagaaggcuuugaggagucagugaccuggugucugugugggggcaauaagaugcugacggaaacaaauucccuucuggcuucaaauacugugacuucgcugacuccccaacccuggugcuuggcacagaggggaaagcuagugcauauuugacaacugaaugcacaaaugaauaauauuuauaaacuuacuuauuuuuuuuggguaagcaguagccuuucauguuuuagcauagguacagaauuucuccaucucccucuaugauguuuggguuuuuguaauaucucuguaaauaucgaaucuucaugaauuuuuauauuacauacaguuacucagauuguuuuuaaaccaggaugccucacagaugugauucauuacaguggucucagcuuugauuacauaaauauuagaauccuaauaguaagccagccuaauuaucuuagaucuauuuugauuaaaauauuuuaugguacuuuaaaaugguuccguguuaacauacaacuuagaagcugaggcaggagaguagccaugaguuugaggcuaguuuaggcuacagcaggucaaucuuccuuuucuccugaaaaaagaagaacuuuuuaucgcugggccuguugccaggguuauaugaggcugguguccuaagugcacuuuagucagaggcauuuugugaagaccaguagggcauuucuguccagaugaaguuucucauaccuugguggacuguuuugagggcugaccucccuagcguuucugucauauugcagcgcccggugaaggguagccugccacacagccuucucugccuugggacaaaugauaaaucuauuuccuguggguguuucauguucaaggcccuucauacguuucagauccaugguugugagcugaugacauugcacucaccaccgcccacaauuggcccuuguaaguguauggaguuaaacauuaagaaccaucuuuuccccguagaacuacacgggagcugguaaggguuucugucucagcagccacaaccucuguagccaccgagcucugcagaggcguccagaacauccaggcagcgugaaggacugcgcaggaucauaggcugaugcauucuccgaggaaggcaacaugguuuacuugaacuucagcgugugugucuagaugaagggcuuaguuaaagacacuuuggcccccauauucguguaggugagcucugauuuccgauaucuguuugcaguccagaaggaagggcucuguaaaggacaguaucuugccucaugccagugccuggacgaggggccuaagacgggcaaaugaguuacuggccauagcgacagucuuaaaaguagaaugcuaaguaucuggauaugucuaaaggaggcccgcuaggugauagcuaccagauugaagcagcaagacucugaacugcagaggccuuguguccuguggcacgugcccugaagaacagagcacaugucagaccacagauuauagcuucacuggacaacuuaaagguaucaaccuuuagguuuuaaacauguaucuuaagaauuauguuuuauguugaauguuaaaaauuaaaacagugcuaaggaaggccuguuauuuuacaagaucucagcaguuggagguauuuauuauacagcagcugaccaugccuuggguucugcaggguccgguguaugaagcaugcugaguagcaaguauggaguugcuuuucguuuuuauaucucaccccauugccucaguaagccugggagagcuucucccucccguaagcagguuagagggacugagagguucagacaacuuacucgggguaaauuuuuauagccacccaauagcauaaugaauaguuaaacugugaguguuuuccaugagaauggauugcauauuagaauuuucagggucauaggauggcaauaacuuggucugcuuuuuagaaaugauuuccuguguaugaacauuuccuggcacgugugugugugcacaccgcaugcaugccugguacccauggggaccagaagaggguguccagucccuuggaacuguagugacugauuguugugagcugccacaccgguacuuggaauugaaccuuugcaagaacagccgaugcaccucagugcugagcgcugucuccagcuccaaggagcaccacaguucacgggauguguucugaucuguucauucauggugaagcuucaucauccauuaaagcacaaagaacacagaugugcaacagugaaccaguuagcaaugauuagaacacgugcuuauugaugagcgucaauucauaugcuggcugcuaggccaauuaucuuuauuagacaacuggggagucgccacuuuacuuggugucuuagggaguaauccaguuuucugauaaagucgcuaaguuagauguugccaggaagagguucuccuuggaaaaguuguugccuucuucauuuuugugucuuggacucaguuuguacuuggccaagaccacaucuugauucaugaugacagagauggguuugcagaugggcagcagacagccuggucugcaauggaccagugagguugaaagcccauggaugguagagagguugagugauggccagcuggggacuuuccauucucgcugguuucagcaguuaagaccugcuggugggugaacuaagcggguuggacagucccgaaacgcaggcugcauuagccaaucaggguugagaggggaggguccaccagcccugucagaagcuuccauacacugccagggaacacuaggccaaaggcguguuuuuguuuugaggggaaaacagacuaguaacagaacuuuuaagagcuucgaagauuuuauaaagagagacauccuugccuaucagaugucugaaacagucgucccugaaaaauuggagcuucucugggaaucuuaggcuggcagacaggcugcugaagccuggugccagccagaggagggacuuaucucuaaggaagagauuucacacacacuucugacaacuugucagaccacccugcaagagagacaagaaccaaagcaauaagggugagaccacacuguggccaagacugcuuaguucugucucugucuuaucuuugguuuaaccuaggucacguuuugagaccccagagauggacuucaggagcccuagaacuccuuugcuucuucccaguguggcucugucuucuuuuugcucuucagauagacaggcuggccaguaagccccggacuccccauuuccccuucccagugccuguuuuccaucucagcuucuaugugagcaccggggauagauuuuccgcccccuaugcuugcuugccaaguucucuccugacugaagcuucuuuccaguuauguucugguuucuaugcaaaccuuauuaauuuucuuugucagagucccaucaauaagucaauguuucauggugacugggcaguugcggagccauguuuguugggacaauugugcuaucugcagagcaguugugacuucuuggagccuuuguaucuuuucauauuacuguauuuacaagcuguuugugauggguagaguuauuuccacuagcaaggacugaagguguuacucucaaagugauuguagggaaaucucuggaagagucuaacuugggaguuaauguaaacaggacacccgugucaaaggaaagaacgugaagaaauggcuucagucuugcuccaagccuucacggcuucagccuguguggaaucaugauggauagugaaccauucuauguauguuugccgagggaugcauuacgugggcaucggcuucacauuuucauagcaaaagacuggaaagaacucagguaugucaaucagagaugauugacuuaugaagacaacccagguaugucaaucagagacaauagacuuaugaaaaagucaccacagaauguagugcguccacagcuggagcagcuguguaugugacaaaacaggcugaauccugcacuugacucagggagaaaacucagauagagagcaguuaagauuucauaauauuacagcgugcuuguguaugcaugcauuuuuguguauuuaaacuucaagagagcacauaguucucauauauagauagacggucuccagagagauacacaaagaagcugaccgguguuuaucuuuaggaaggcaaguugguaucuggggcgggccuaagcagcagacauuuccauucuaaaagucuuuugaauuuucucucaagaauccuguauuaccaaccuucucuggcagcuucccgucugaugcacuugacaggaguaagcaguuagcuugagacgcaucuugggcaguacugcuaggagccuggcugucuaccacaggaaggaaggaaagaguggacaggagaccugugcagaaagacuucagggcugugucccaagugugugugugugugggggggggcggggggcagagaggaggaagcuaacgaacagcuggguuuggaguguaaauugugcuucaaucaaggguggguaauagauauaaaagcagguuugcuggaaaugaaaacuggauggugugaauuugaaguaguuguaagaucuccugggaacaucaaguaggcaauuggauagguguguucaacucuauuaaagugauuuggggguguuguuuccauggcuuauuuuaaguuuauagcaaagucaaguauccuuaaguuugagcacagacuaauggaaaauuaaaguuuuaggagugucccauuuuguagugagcaauacaaagaaaaauaaugauccuguuuugaaauuucccauugcauauguguagaaagccauuuacaguuacaaacccaagagcuugugccaggggaccgaagcuaaugcauucaucguuccgaucucgggcacagucugaaaauacuaagugaauggccacacuuuuaaggugcccauuaacuaauaccacuaauuuacagugggugugucugcaagaagccacauaaguaauuccuggaacauugugacccucggcauugcaguuagugcagaagauuccauuucucacacacuguaaaacccccaacgccacgccauaugagauuguguaccuuguaaguguuuuguucccugaggguaccugguuugcagugaccucuuuguucauucgugagugaagcugugauuaugaucauugugguuaauuuuugccagggguuuucuuauguuuucauuguucaucuuuaaagagcacacguaucuauagggcugagaagccacugcacagaggcuguaguuacuaucauugugcacgguacauauguaaaggugccucugugcgugugugugugugugugugugugugugcgugugcgugugcguuugcacauaugcaugcauguguguacaucagaggacaucauugauuggcugccaauccucagcuuguacacaccagguuguuuuuugaagcagucucucacuaaccuggagauuaucagguugggcugucuggccagaaagucuggggaauuggcccguuuccaccuuacaggucugaguuauaagugcauagcaccaugccuggcuuugggaucugcagaauaaagcucaagucauccuacuugcaagaccagcacuuucccaccugaauggucuccccaguaccccaccauuauuauuucugaauaagaaaaggagagcgauauguacgaugagccugugcguccagacugagcagcacagucacccccauucuuuugugucugguggcuacaaagguagggagaauuuaguucaaacccaacacauggccuucggugaccucuaaaccuuuguuuagcgcuuuagagucaugcaaggaaaacagauugcuacuuucuugauuaugccaguacaaugaggauauauuccuggccugguacaauuauuccauaaauagcuacucaugguaugcagacucacaaaauucuacacacuaacaccaucugagccuguggcucugucccaugccguuaauucugacacuaagcuccuccuccucucuagcguacgccgagacccuaaggaaucuuccaggcacagcagccugucugcaucucacgccuuucccacuguuaaagaaaauuguaguuuuaugcuauuuuuaaaguuuaaauaaaaaaaccuaguuuuuaguacuugauauuuuguggaaauauuaggggaggaagagagaggaagaaggagagaggagacugugagggaauguauauuaguauuacgagagcaccaauccaugucuauuuuuuuuuuuuuuuagggaaauuggcaauagaauuugauauacguuaaagcacuuaaaaaaauaacucuagccaggcaguguuggcgcacgccuuuaaucccagcacuugggaugcagaggcagagugaguuccaggauagccagggcuacacagaaaacccugucucaaaaaaaacaaaauaaaauaaauaaaauaaaauaaaugacuguaguuguagauggaaguuagauuaacauggaaagugauacugccgugacuccuuagucuugaaauaggguugaguucaguuuuguuguguucuggggaugcugaggguuaaacugaaggcuuucaggguaaacacacugggccacugagaaacaccccuagcuccaagaagacuuuguaauuugugaagggagacaagcugacuuucucuuaagaaaagccuugauguuuaugaauuauggaaguugaauuugauagccuuuaucaaucaauaccaccuucccauuacagccagugcucaaacuccuuaauucauuagcuucuguggacacacaguuacaccgacaaggaagaugacauaauuguguaaaauguguuuggucuugggaagaacguaggaggccagacacuuggucuggguugagggccaagcaucgcuuaggauauuagugucugugaggagcugagacacucaagucucuuaccuuaucucucaaagaguuuagguugggcuuugaaauauaccagugcuuucucaguuugcuuucugucgaugugauaaaccccaugaccaaaagcaaguuguggaggaaagagcuuauuuggcuuacacuuccgggucacaguucagcacugagggaaguuauggugggcacacaagcgaggacagaggauggauccauagagcaaugccgcugacugacucacuucaaaggcucguguucagcagccuggcuuguacagccuagggauaguagcagcccacagugagguggacccuccugcaucugucagucaucaagaaaaugccucacagacauagucgcacgcaggccagucugauggaggcaguucuuuauuggagggucccucuugucacguguauaagguuaauguuggagauuagccaucaccguccuuugaaaggggacaaauuuaaaccacaggcaaaugacucugugguagcugccucuugaccucacccauccuuuguuccucauuuccccucaguagcuucauccauucucuuuccccguuucauucgaggugaagagacacaucucaccucauggcaccucaccccgcacucuucaguagacaucccuaggauuacagagcgaggcugccccgcuuauguccagcuuucaaggcaaacacagcuuaagcagaagccgugaagagaacugaaggcagcuguucaguggaccauugcauagagaaggaauagcaaaucgcuucguuuuucuugcuauaacacugcugcugcuauguuuaugucuaugugagaauuaacaaauuguggacagaucacuuagugucuguuuuuuuuuuuaaucagaagauucuuuuuuaaaaauuuuucuuucuuucuuuuuuuauuagauauuuucuuuauuuagugucuguuuuuaaagucaguaugcuguauacaaugaacucauacuuaauguaugagacagugggggaucagugaggcggugccuucugcccagggcaggagucagauaugccuaugaagaaggagagaggcguacucuuggcaaggauggccccuuguuauuuauugaccuagaacaauugcaucuguacuuugaaaguuuccaucagaaguuacucuucaguaccuguucuucugucuuucuugguccuugccaccagggaguagugucugacuuguugcugcuacggaaggcucccacaucagaguuacuguguguagggaaugacuggauuuguaguuugauuguugaaacaaauauuccaucgagaaggugcuuagcuucuccaugccagauagaucagcaggcguagcgcagacguccuugugaucguaacaagccugccccuuuauucucagcgccuguugggggcuguuuugacuuuugagaugaccagucuuuaugacaggauuucccccacccccaccguagacuuguaaguuguuauuuuagucaguucagugaaagugacugaccagugaggagcaaaagcguaggaggacuuugaagaggccguguguguguguguguguguguguguguguguguguguguguguuugucuuggugcacaaguauaaucguggcucguuacugacauuccacagggaguucuagaguccuguucacacagugugcuuccuaaauagaacauuucuuaguauuuuauaugcagauuaauaaugaagugugugugugugugucugugugugcgcucgugcgcaugugugcaucaaccuuaauuguaucaguggucuacaguguuuuuauaaaccauuccacuucaucuugcauauguugaaacuuguguuucagaacuucauggaacuucauuuuucuccuugaccauucaaaggaaauucuguacuguucacacagauaaaaugagugugugugcaucacaucaauuucuaaggacgccuucuuuuuguuaguaguauuaguuuguuuguuuguuuuucaugacagaguuucuguguagcccugguuauccugaaacucacuguguagaccaggcuggccuugaacucacagagauccaucuguuucugccucccaaucaaauacugggcucaagggugugcagcaaccccaucugacuggcauauguuuucuuuuuaaaauuuuuuuuuguuuauuauauuuugcaugccucugugcaccacgugcuaacagcaccguguacuaauagaggcuuggagaggauugcggagcucccuggagcuggagucacagauggcugugacccaucaugugggugccaggaauugaaucuagguuucuuggaagagcaagaagugcucugacugagccacgaguccagcaccacaagaccucuccuuacccugaaauucucuccccuuaaauuuuacugucagucgaaaguacucaggcacuuuccauggucagcgugcccugaaugaacucacugugacaugaugucacucacuguucaguuccauugugugcuguacuacagugucaugccauuucuuccaucaaaauguaagcaaccuuggagaagauauauguuaaaucuauuacucccucagaagaaauugaguagauaauugccagcugagaaaacagauggggcuucaacagugcgaugaucaguuaagagaaauacugaccccaaaccagaccacuuaggaaguucaguguaagacucacaaaaugcagaccccucggggaccaguauuaauagacauuccccaacuggccagguugaaaauagggacuucagguguuuuuauuucuaucuaucaaauucugguagauuucagucuauuucaaacaauacaggaguccagaguuuauauaggacaaccaaugaaucauuagaaaucaugaucuuguauaucagguguuauacaugaaaagcuauuuuggaauagugaccucgaaaggaguaauguuguaggcaaauggcuaauguaguuuggagucagaaggaugcccaaagagggaccaaaccccacaagggucaaaaguaccuauuugauauaauugggacccgacaguuuagaguuaggcacuuaaaugaccuuucaugguuaauaaccaggugaguggcgaaauugucugccuaguugugccaaaggacguccugaauuacagccaaaauuaucaucaccuccccucauaccucucgaaggugcuucugagagugguggugaggcugggcuggguauguauugaugaaugugugcaccugugcccuugcaugccuaugugcuuggguaguggagguccccagucuccugaaaacugggagcaucucugcuccuaaaauagucacguaagauacacgaucacagugcaguuuggcacauuuaaguugucaaagugaauuauuucacuccauaaaaaaagaaugaggaaaaaaagcaacauacauaauuaaagaacugcaucuagauuucauaagggacgauggaagaacuauauuaagagugagcaguagauaacuacagggagggcggccaagcuaguguuaggaaggcacacugccguuagaucugauuagucaaaccauaguaaauguggacaacaaaguuauagcucagguacagcuccugcucaccccacucuccuggagagacuucucaccaugugugaacuugucuugcagcaagguggugccagauuaaaacccagcuaguccugaacagaguggaugcagcugguuagaaugucaggucagaaagaagauuucuuaacagaaaagauuguuggacaugaagugguccaagaauguaagagaauuuccuuuaucucagagccagauauuugaauuagagcugucugucuucuauaacauaacugugaucaauaguaacaauggcauacuaaaaucaccgcagcuggagagggacucugacucgcugaauauuuuguaagcguuauucagucaccgcuguugcuuuagguaagguugcguguacugaacuaggagaaucuccacccccacuuaauauguugguuauuuucuuuguccaguaggccguugacaugauucugaugguguuuguuagcuaggcagugaguuuuauagguagguaccuccaauucuuuuauuauuaaaacucuuaugacuuucaucuuggaccacaaauacaagaaauaauagauaugaaaucuguaaauggcagugcaggucucugucacugguaagagauggauagcuguuagcgaacccuagccuggacugugucaucgauugaacucuaagcaccgcugaguuacugcucugucccugguuagcagcagaaagagugaggcucagaagcauggcuacagccccagacacaaaagaagaugcuggugugauucaggcuagguugccaugacuccagacaguucccucugauucacuucuccuuagaaacgccuuuccuuugggagcucaaacaguguuguauagaaugaaaauuaccgguagacauugguucuccaacuugucucuacuuucgaaucaccuggguuuuuuuuuuuuuuuguuugcuugcuuguuuuguuuuuuaagaauugguaccuaccucuaccuucauuggaugagagagcaguuacuuguaagcugacauuugaaaagcaagcaaaccagaagauugugagauauagaagagcuugagggauccuacuuagguccaccauuuauuugagcagucuuuuaaaaaucuguauuuuauucuguaaaauuugauacagcauauguugaucaaauucaucucccaucuuucucuccaguuccucccagauauaccucccaccucucugcacccucccaacuuuuugcugucauugucucccccuucuccucuccccuccccguccuccucuuucuccucuuccuucuccucucuuccuuucuccauugaguccaguccauguugcuuauuugcauauggcuauggagccaaccgcugcaauggucgaccuaccaggggucacacacuugaggaaaacugacucugccuuccccaggaucugcuugguuagacgugagaacucaggagcccucccugcacaugcugaacuauucacggcuucaucuugugcaggucucccacuggugcugccgugagcacaugaguacagucccuggguuacaucugaagacgacacucugcuucagucugcccacccaucuuuccucuucccccauuuuccccgagucugucuguagcuaucucuguggggugcauggggugguggggaugggagggguauggacaguccuauuuguagcugagccuuccucagaccuucauucucugugauuggaacaguuguggcuuucugcauuaaccacaggccauugcugaaaggaaacuuuucugaugaggucugaggucuucacuaauguagggcuugagagacugcgauuuuagagggcaguuugacauuguauccauuuagcagaauaacagugguggguucaccccaggggccuaucaacucuccagccauggauucuuggcuagguguauagcaccugcuggcaucuccuccuguggagcgugcuuuaaagccaaucagaaagugguagguuccccuccauaacacuggggccgccugugcaccuguggauauaucuugccacaccagucaguauuucaguucacaggguucacagcuggguaagaauguuguugacgguucacccacuccaagcaccccugcauagugcuugccaguacuaugaaagcuagcuaacaggaugauuucugaucagaaccaacuugauuucucaauguccugugaugaaaguagauggugugccuucagcaauaggggucuuaacauagaguucuuguggucagccaagaacucacaaagaauucaauuggccuacaaucucuugauaguguuugauugugugucugguuuugguuuuguuuuuguuuuuuuuuagcuugaguaccaugguguuacagucucauaggauuuuauacuuaaugcuuuaucagaccaauucauucauauucucucucucuuucucucuuucuuucucucucucucucucucucucucucucucucucucucucucucucucucucucuccucacuuuuuagcccagucugaauagggaacuuacuaucuugcccaagaaggccucaaauucaaaacauuuuuuucugccucagccuucccuauuucugggauuacagagucucccuccccacccaggcugagauauucuugagucuuagaagugaguaauggugugguuggauucaugauuuugccaguaacucacuguuaaccaugccuacuaaaggggauuuugucuacuuuccuaggcaccguuuaagaaaucaaguuagaugccacugcuugguaccacacguuuuccacacauguaaauccaggguuucccuuccucccuuacagacucuucugaccaaccugauuugcccccuccccugcacacauaccuaguaaaugacccaugagcauaugugugugucuugguggcugcugucguuugaagaacacuaguucagaugugcaugcaaacacugaguguguaucggggugacaggaagagaguuacagauagagaaucgggagcacuguaggcuggguaagcuucagauccuuugaggaagguguagcacagccucugguuccagaaacuucccagacuugccuggacagauguaggaagaaagccccaucuccccucaagugugaaaggaguucuggccucccguuaggccugggcugccugugauccuaaugaagugcgagucagguauauuuucagcuaagaaacaaauaauuuucugaauuugcccucccucaaacuuuugccuugcaaaauuuggaaagacaugaggcuggagugacggagaauaaccagucuguuagucagccaugggcaguggggaggagauauaauggauggaagcuggcugaugguggccccuagaggggaaggaccaggcuugggagcuucagguuugcuggccgagccaagcuuggcguagcccagacagugcgggcuuuuuaguaccacggcugcaaagcuagccauuuuuguuccgcaucauuuaugaagagcugauuuuuuucuuucacacugacuucuuagaguguggcuuuaugauaaguagauucucaacugugauuaaucacaagacccgugcaucagaauaaccguagcguuuuugucuuugaagaacuuaaaauguuuggucugaaguaugugaugcucuuugcuuucucguuauggcucgucuuuaaugucuuuaauauagucuugauugaaaaguggaaguugcaaguauauauucuucacuccauuagcauguaaggugcgccgaugacuaagcuaugcagccuugcuggaaucguuuagaacggaagcaccugucuaguucugagaucucgacgagcguuuagaagucaucgccugccuuuuacauucaugaugguuuuaaaaggucuuuaguuuugccuguuguccuaugcuuuuuacccagaauuccacaaagaucaaaaucaaagcaugagaugacaccuaaaaggaacccuaacacauagcuaaagucagauaaaggcuagaggcaguccuuauucggauagcaucagcgagccagggaagcagggagguuucuggaugccgugccagccuccagagccaggagugucuuaugauuuaaugguaccucucugccacauuugaugaacugcccuagaaaaacauuuugaagcaauaaagcauccauuuggcuccccaguaaugagagaggcauugcucuuugcauuaacuauuuauucaggaagagaagugaccaacugcuaauaagcuuuacccaaagaaggucguuuaaagcaagaaaaugcgaaagcgaggcugucuucgauuucaugugcaauuaacaaagacgcaaagcagagcaguuggugcccccagugccacguggccccacacuggucuauuuaagugcacaugccugucagcaguaguaggagcuuucgggcuucaggaagauggugaggucuaauaacaagugaggacaccauggcuggugaguggcucagaugggcucacgucucuugcuuguaaccauagacuugcuuagaugagcgguggcuaaguccccuaguuuccucuuuagagaaugguccccuuucauuuuucauauagauuuguaaucuuuguaaucaucacucaugauaucugcugcuuguauuguaaaaugcuucuaguaauacuuacuaguugaucaagugguuggacuuggggaauuuuuauauuugcuguacaaauguaucucuaacauauuauuugaaaauaauuuucuugcucuuguaccauaaguauauaaaguauauaaagcaccacccuugcagugggugcuaaggucacaguaacuuaaaggcagcgugcaugauacuauauuuauaagcacaaugucugaaccuuauuuugaaauacccuuggugcuauaacagcaggaguuuuccauuccaccuacuuuaaaguccuuaauauaauuaauuugcuuuuuuuccagugucaugaaaaaaaaugaagucacaauuauuuuuuuuucuucaagcuaaacaaaggauuuuuaugcuaaggugcgcucugacuaaagagcagcacuguaaauuucugcccagugagagggauaagccuucagaugaaucugaauuacauaggaaguaguacgauagcaaguuagugaugaaauuuaagccuguuuuucuuuucauuuuucaguuuaaaacucuuuucccuauugaaaccgauguuucauuucaaauuacuucagagcauauuuaaaaccaggcuccgagacgcacuccgugcaguaagacugccgguuuacuugugggagucaucgucagaaagggcuaaaagccugauuccuagcagcagcuucagagaccagcagagacuuccgagggccauccuuuccuggaggucacacagaacaaaacucaucugucuuccagagguuucucuuuccuucaucaaggacauaaagacuuagagcauggaacugucuuguaagaggcugggcucuuaaaaccccucugguugguuacugaugaucauuagaucgaaccgucccuuucagaucaucacuccguucagaagacugaugcuaugugcugagaacaggaaagagauggaggucuggaucagcucucugaagucagugcagagcagagaacccuaugagguaaggcgccaccuacugguuuccuauccuaagaguagccaaagagcuaaagcuagcccgugaagaaauuaguacuggcaagcccguuagaaccuguuuagaguagauuuuguuuuuccuugaagugcuucgguguucacaguaacagguugacaguuugguagcauucacaauuugcaaauaguugugagucuguaaccucacucuccuguuugccucugacugaacguugucuucguagguggcccaguucaauguggaacauuucucagggaugcacaacugguacgccugcucccacgcccggcccaccuucuguaacgugugcagagagagucucucuggagugaccucccacggccuguccugugaagguacuguagcggucugcauuuguguucugccaacaguacauagauaccuuaucucgggcacugugccacugugaaggaggcagcugggugggagcgaggccugggagacuuguuuaaauuaagaugcaaguuuuggcccggcgugguggcgcacgccuuuaaacccagcacucgggaggcagaggcaggcugauuucugaguucgaggccagccuggucuacaaaaugaguuccaggacagccagggcuauacagagaaacccugucucgaaaaaacaaaaaaaagaaaaaaaagaaaaaaaaagaugcaaguuuuguuguagcucaguguuggacucuacacacauggggcugauuugcggaagugcuguugcucagcaucaaaauucaguguucucuugaaggaacuaacuaccucugucuacuacaauccccuugggcuugggacauucuaguucucauuguucuaauugaccguggcggccaguguauacgcguccgccgaauuccuaaugguuauuuauauugcauuauuugaaauauuuuccuucacuuacgguucauuuaaaugggcaucaucuugucauuuccuuuucuuuuguguccagcccuggggauugagcucagagcuucgugcacgucaggcaagcaucuccuggugcuaaucacaucuuccuggcauugggugugugagguucuuuaccguucuccaaaaacaagguccaggcuagcguuggcuuucuuuugcugccuuuuuuuuuucugcuggaauuuuuagugauaagauguuauuacugaauuugggaccugugaggaccaaaugcaagccugccaguagccagcaaggaaaagcgcaugacuucuccaguggggaagaauggagcauguuggguacaauuuuuggaacuguguguaggacgaguauuagcuucuucucaaacgcggucacaucguaauugugcgcacacacaauuaguguuuacguuaaaguagugaucgaaucccacucacuccuaauggauuccaaauaaaaccugaaauuucccuugucagcuguuuacugacuccacacggagucuggggcuaagcuccguggucucacacucuuccucagcugcccggucaggcugggacugggcuuaacgcacagaagcagaagucagauagacucacuguaaaaaauuaaaacaacacuuuucauagucuccuaauuuaauugaucccaaggaguaacuauccuucauaguuauuuaaauaguauccgaacaaaacaaguuuaagcgguaacuuuuuaaaaaaaaucaauaaugucaaauauauaaauaaggaugcuugucuuaacuacuguuuaagauuuaggaagguucagcaugguacaaacugaauguuggaauaaaagccauuaccuuaccgcaguauuugugaaguuuuuguggguuuauguaaugacauuauaggccaggggaugcaauguuucagcccucccuggagagacucaguugccaccugacaaaauauaggugaagaggagucaccugcauuggugaccauagcaacagucaggcuugucauugcuuguuaugcagggcgugagucucaaggcccauugcacaaagcacuuuauuauuacaaagcuccgugcuuguuuuaaaugaucuguuucauauuuuuaauuuuguuuuuuauuauauuauuuacauuucaaaugcugucccacuucccgguccccccuucauaagcuuucuaccccauucccccuucucuuugcugcuuccccacccacagacuuacagccaaccauuagacugagcccagggacucuaauggaagaguuaggggaaggacugaaggagcuaaaggggaacaacagugucaacuaacuggaccccccagagcucccagggacuaagccaccaaccaaagaacuguuucauuuuugauggcaagcuuuugaaguacugaggggguuauauaauuuuuacuaucuucuauauucuugcauggaacucccuauauuucaggcuggccugccucuaacuucugagugcugggguuaaagugauaagccacaggcccugcugucuuugugaccauuucccaagcugccugauuguuuucuuaaacgccucuggaucauccuucccagaugacaguuucaaacuguuaauauaaaugcacagcaguacaaaugccugaaauauuuaccucagugaauuuucucagauuaaacacauccaaaguggggacgcuucaccuagagugacaagugggauuauagguucucuggcuacugauuauuuugugugugugugcgggugucugugcuuuuuguucuucugaagaacuaauucuuuuguguuuauuuagauucucuucucagcagcaaucuauuauguuacauuauaacugcuucauaaauacaaagacauuaaauuuuaagauuuuaguuaugacugcuggagcuuaaaccaaaaacaaacaaacaaacaaaaaaaaaaccugccucuuuccucaccccuuuuaaaaaugccauguuguaacuucuucuucuucuucuucuucuuuuuuuuuuuuuuuuuuuuuuuuuugguuuuucgagacaggguauguagcccuggcuguccuggaacucacuuuguagaccaggcugaccucgaacucagaaaucagccugccucugccucccgagugcuggguuuaaaggugugcgccaccacaccuggcucuaugcuguaacuucuuuaacuuuuuuaugauuauuauuaucuuuuuaguguguaaguucaaggcucauaaaagaugugcagugagggcaacaaacaacugcaaauggaccacgcuggccuccaucgggaaggacaucauagaggacgaggaugguguaagcuguggcucugccccucucgugcccccaccccccaccccgugcgcaacuguccuauaagucuuucugugacuuucucuucagcuagauuucugcugaagugagccucugcccuuucuaugcgcaccuuuaggauucaggaaggcuagaugguccauaaaugugaacauaaugacuggaggucucucaggacacacaggauugagucuguagaggaagaaacccauuccucaucauuuucagaguaaaggugccggccuucuccgcuucgggcugaccauuacuucuuccuguccgcagguugccaugccucaccaguggcucgaaggcaacuugccugugagugccaagugugcagucugugacaaaaccuguggcagugugcuucgccugcaagauuggaaaugccuuugguguaagacaaugguaagggugagaguuagucugcacuuugaaauuagcaucuuuccuuaaccggcucgucugugugguccggaggcaaagcaaaucauuuccagcagagaggauccugguugcacacacaucccuuuguggcauaaugguacacauucagguauuugaaguauauuuucucuagcauggcaguggcgugugcauauguacauguguguguguauacagaugugugugugugugugugugugcgcgcgcacacgcgugugugugcauguuuucauuuauuucucuccguggucuaaauggcucauucauagagguugcauguguucagaaggaucccuaucucauacagguuuucuauauuaauucuaucacauuguagccacaauuuucagcaacccauucugcccccggcccugccccacgagacuuaagccaugugguacccucagaaggcucugcuccaaggugcuauuacguuaucauugauauccgaaauauuauuuugcugcagcccugggucuguccucugacacaaggccaaacccaguaggcuaugcacugcugcaauuggaguuauauaaauaaauaguuuuaaaaauuugcauaugaaccaaggaauaguuuccuuucugugagauguuagaagaacagggucuuugaccgagugaggacagccagggugaggaggcgucugugugcagugugcugugugcagacagugccggggcaggccguggggugcacucagcuuaucugugcugacccgcugcagcagggacugccuuccccugggcuagguuuguuuggcaguguuucgagucuuaggguauuuuaaguuuggaaauuaacccccacccccaacacacacacacacacacacacacacacacacagacacacacacacacuuuaaauguguaagacccaucgcuuuuguuaagugugaggcagaucggcagaaagcacacaagaugugguucugauauauugacuguaucaauaaugagacugacuuguaaaugccacagcauuuuaguccagucugauagguggccugcgcuuccguccgcuuuuaaaucuagcuugacucuuuguccuggugcuguggccuguuccauccuucugucuuaagaacugcuacauguggacugcuuucuuuuuuauuucaucuugucuuugguaggcuucuguugcugugauaaggacaccaugaccaugguaaaagggggugggcuucacuuggcuuuuauugcucaucacgguccaucacagauggaagccaggaugagaguguaaggcagggagccuagaugugagaacugaagcagauuccauagagaagagcaacacuggccugcuuagccuguuuucuuacacaguccaggacuaucagcccaggagugacaccuccuacugugguugcccagccccccaucaaccaacaaucaagaaaaacgcccuaaaggccagucuuacgaaggcauuuuucuaauugagguucccucuucuaagaugccccuagccugugacaaguucucagaaagcuaaccagcccaacuucaucauguguagacuauagcaggugucugugcaccucaguaaacccauuccuuuuuuuuuguaugaauuuuuuaaaauauuuuuuauuacauauuuuccucaauuacauuuccaaugcuaucccaaaagucccccauacccucccccccacuucccuacccacccauucccauuuuuuuggcccuggcguuccccuguacuggggcauauacaguuugcguguccagugggccugucuuuccagugauggccgacuaggccaucuuuugauacauaugcagcuagagucaagagcuccgggguacugguuaguucauaauguuguuccgccuauaggguugcagaucccuuuagcuccuuggguacuuucucuagcuccuccauugggagcccugugauccauccaauagcugacugugagcauccacuucuguguuugcuaggccccggcauagucucauaagagacagcuacaucuggguccuuucgauaaaaucuugcuaguguaugcaauggugucagcguuuggaagcugauuaugggguggaucccuggauauggcagucucuagaugguccauccuuucgucucagcuccaaacuuugucucuguaacuccuuccauggguguuuuguucccaauuuuaaggaggggcauaguguccacacuucagucuucauucuucuugaguuucguguguuuagcaaauuguaucuuauaucuuggguauccuagguuuugggcuaauauccacuuaucagcgaguacauauugugugaguucuuuugugauuggguuaccucacucaggaugaugcccuccauguccauccauuugccuaggaauuucauaaauucauucuuuuuaauagcugaguaguacucuauuguguaaauauaccacauuuucuguauccauuccucuguugaggggcaucuggguucuuuccagcuucuggcuauuauaaauaaggcugcuaugaacauaguggagcauguguccuucuuaccgguugggacauaaggaacacuacacacaaacaacauuuaaaaaaacccacagauuuauuauuuucauucucuguguaugaguauuuguucuggauguaugucugugcacugugugugugccuggugcccauggaggccagaagacagcugugccagauucccuggaaguggagugacaggaagguucuaaguccccuucccugugcugggaaccgggcagcuccugcucucagccacuccccgucucuccagcuccugguacaaccuacauuuuaaaucuuccuuucaccugccauuucuuuugggggcuccgugcuccucccgauuccugcugccucugucagcugugcauuuauugcugcuucucuccucuggggcuuagcuguucauuucugacuuuucgaaagcacaucgauaugugcugaaugguuucauagaggcuuugugcagguugucuuccucugcagugugugugugugugugugugugugugcauuuagaaaaauaguauagaauggcauugcuguuauaggugaugcauguuggcuuucuggaaugucuuuuuuucucuguucuucccuggcaaacuuaacugugaccuuaauuauuuccacccuaucccaugucaguuacacaugcuggccucucucgccguucccugagacggcugucuuggccucauacauccuauaugcuuucgcugacggugugcuugcuuugcaugagucauuguacaugaggaugcccaaugcuugcuacugucaucuaaagggccaacagaagccggaaggucuaccacccuggugguucgacguguacuguaaugaacagagucuguccauguuagcccugcucuccccaggcaggguugcgcggaucucuuucugugcugcuccacgauucucacacauguuuaauuuugaaaccgucucaccaagcaaugguuuaaucucagcacucaggaggcagaggaagguggauaucugaguuccaugccagccuggucuacagauggaguucgaggauagccugggccacacggagaaacccugucuuggcaaacaaaacagaacacccucagaacuaccuguucauguuaauuuuucuagaaaacauuuuuuuguuaaugauuaugucauaguugagaauuguccccagauaggucaucgggagaaugaaagucuucaucacauuuuaguuauccuccugaaagguuuggcuuagucaaugcauguaugucuuaaaggaccaauuaaauaaagccauauucagucaguguccguggaacgucugcuugacuagcugacauguuuaaaaggcucuguagaugggcacacaagcuauucugagaagccacgcuccaccauggugagguaacccuguguuuccucgcucagaaugucucuaguuggcuugagucuucugcuucuuucuugcagggcaguggucuagcugaggaaggagucaugcaugugcuuguaucagcacacauaaauacauaagcuaagauaaauuagacuaggagguuguaggaucacugcagaaagagcuugcacauggcagauuuuauuuauuuuuauuaaauuuuaugaccaugacauugagauacugucccuccauccuuccucuuucuucccuccccacucucccucucuuccuccuccauaucaucucuuccggcuucccuccacuaagcaugcacucacuacauaacacuuacuuuagauaaccauaggaguagacugcucugggcagagucacucacauacagugcaagcuuauuucccagaaggguaaauacaccuucagugguuuccuaaacacugaacauuuugugaugauguugauccugaacagacaggucugucggggucauuuaucacguguugguuuguuguuuuuacaguucuugaagguuucuuuguuuauugucaggugcacacugccugcaaagauguguaccaucccgucuguccccuuggccaguguaaagucuccaucauaccuccgauugcacuaaauagcacagacucugaugguacguagcaguaguaaguauguguauuucuagcguauuuacuguugauugaauuucauaugauacauuguaauugauuauucuggucaguuuuuauaaaugcuggacgguauauuugguugcuuaauuaguugauucuugugaugcugggcauaaaugauccugaagagcuaagcauacguccaaccacagagcuacauccccagcucaaaugaauauuuugaaaggaaaguuguagugcagccauuaacacuuuggccagaucauuguacacaagacuugcagguuauugguuuuuguuuuuuuucacaucccaacaaaugaagggggaccgucauuuuguacugaacuccugaaagguuaacgugucuguguucucucaccauaauugaaacugcccauuagcaugggcuccuauuaagauuugcucuccugucauuuaauugcaggaaucuguauuccucuaaaugcauuugcuauuucuagaaucuggccagggcuuaacuguaagugcagaggagacuuugugacaucaccgguuuuagaaugggacacucguuacuuccuccucugcacgccacguuacaaauggcuucugcaaugugucguuuuagucuucuguugugcuuccugcacaggcguguaacagcugugcagauggcugcgaagcucaggggauguguucuugacagcucuccccacccccaauagauccuucauucauuuuaacguauuuucuuagaccuauacaaagaacaauuagaauauuguaaaauaccaaguaugggcaugagucguuugagaacuguaaacccuuagcuuuccuuuccuuaucaagauugguaagguuggugguuauugucugugaugugguuccucacugcaaaguauaugcuaaaacaugaguuuuagauugcuaggaugcagauacugaaccguuuagccaggggacuagguuacggugaugcgccagcauuaaggaaggaagguuccuugcuuucacccauuuuucuuccuuuucugaauaccuauuaauaauugaagagagaagaagugcauauuaaucuugucccgggcuuguuuuugcagguuucugucgagcaaccuuuucguucugugucagcccccucuugguguucgucaacucuaagaguggagauaaucagggagugaaguuccuucgucgcuuuaaacaguugcucaacccagcucagguguuugauuuaaugaacggagggccuuauuuaggguaauucauuuaugauaaauccuacucgaguaaaauucaguucuaagcaugagagagaugugccuggcucugcugcucaugaaauuaauguccaagcuaggugguaguggcgcacaauuuuaaucccaguacuugggaggcagagacaauuggaacucugccuuuggagguccaggacagcuagggccacacugagaaacccugucuccgaaaaccaaacuaaaccaacaaaccuagaaaaauuacacuuuccguuagacaucuuuguugcucucaugcgucccuacauuugagcuuugucgacuuuagguucaguauuguucuuuuugaauggugcuggugauugacucuauagaagagcaggcccuccucauuaaguuauggcucuagcuuaacuuucucuuuaucuguuguuguuuguuuguuuuguuuuuuugcuuuuugagacaggacugugaggcccuggcugaagucugugagaacuaggcuggccugggacuuacaggggauagcuugucucucccuccugagugcugggauuaaagauaugcuccuuaauuagagauuuuaacacaaaacuuccugauguuauucagcuuucugauaucaauuccaaacuuguuagccuaacuuucaaauucuaaaauguguacaaaaguauuuuaaguguaugucacauaaacuugcauagauguaaaauacaaauaucagagacuuaucuucauagaaaauacacacacagugcaugaccuaacuaaagggggucuguuuaguacuucagcccggaagggucuugggcugaccuugauaaaugcuaagggaauuuuguugaccguucugugaugcuguauaacuuaaagucuaaacaugacugugaacugccugacauuuucacugugaggauacaccuuagguccuucacccccuuucggugacugugugugaugguauauguauacauuuucuguggggguggcggaugucuucucauggaggacuccuguauucucucagucucugagugucucuccuugugugauuucuggagguuauugguggaggaccuaagguuuacuaaaggucaguggguauggacagaaugacauuaaggggagacauuagucaaaggaagaaggcaugugacugggaggaggggaggaugcugagagcuaggcauuggugagggcuggcaggugucuuuaggagcagccaagugucccccauguuguauuuauaaaaagagagaaggaauauguuuugguggaugugugguaaggugugggguaaaaggggugucccugggggcccaugccgaggcaucccuucccccugagggaccagccacauggagguauaguauagaauaaaguuuauucaguguauggagaggggaguuaagagagaugggggagggagaggaggaguagagaaguagaggccagccaugagcauguguggggggggggggagaggacagagaggaagcaggaaagcaagagcaaggugggggcucgcagccccuuuuauagugagucaggcacuccuggcuguuaccagguaacuggggcggagcuuagacagaaugcugacaucccacacugcuucucccuuguuuguaaguucucagaaagugacuugcccuauaauggaaaagccacaggccacugccugcuuggccuuggguucuuguuccuggcuccccuccacuuuugcucuuuuugguuuucauucccucuuucuuccaauuuauccccauuucugcgcauaacuauuuuucauucaaauguuuucuugaguuaacuauggcacucaagucaauuuuuacauaggaacuuacauucaauaugaauguagguaagugaauauaaaguaaacaguaacuggagaaagugcuuuuuauggacuuaacacuaaaaaugaauguuuuacuuucagcuugagauuguuucaaaaguuugacaacuuucggauccuugucuguggaggagauggaaguguaggcuggguuuugucagagauugauaaacugaacuugcauaaacagguaaguaugcacuggaguguuugagaugggguauuguuauguggcuuaagcuagucuugaaucccuuguuccccagcuucccugaaaaugucaccauugcauuuuuuugcagugccagcuuggggugcuacccuuggguaccggcaaugaccuugcucgaguucuuggcuggggagguucauaugaugaugacacccaacucccucagauacuagagaagcuggaacgagccaguaccaaaaugcuggacagguaaaagaauuuuuucuucugaaaaugucaaccugagauuauuugauccuuucaguuuuaguaacuguuaguccaagauuccuggucuuguucauuaaucuuugagauccugaauagaauuugcauaaaguagacacucaauaaaaggugcauuugaaugauaggauggauggauggaagauggauggauagauggaugauggauggauggauggauggauggaugauggauggauggauggauggauggcaaaagucugaagaaaugguuccagugauuuccuuauuuaaauguagaugacugugaagucacuaauuuuuguuuuguugugguuuggggauaggguuucccuaugucacucagacugaccucaaacuugagaucuccugucuaauugucucugagugccaguauuauaggagugcaccaccaugccugggaauaccaauuacuuuuaaucacugcucaaaucagaaagcuaauaguuaacuuuguagcgggagcuucugauaauggauugaugagacccgucaucuaagaaaagcggugucauuuucauuuugcuggagggacuccuccugagcuaauuccccugguaauuagaugguaaagcgguaagggaguccugcccaggccagggauguagcucaauggcaaaagagcuugcccugguggggcaggaagaaagagacagagagacagacagacagacagacagacagacacaaacacacacacacagaguaugaauccugucccagagaaagagggaauuauuagggacacucaugcagauggaggaccugucacugucuacacuguccucaguccccuccccucgccucuccucaccugcagcaaccccauuuugaaaggucauggauaaagcugagaucacaguguuuguagcgaaggcauuuagaauuuggguuaagggaacaagaagauuuaguaagccauaauuacccccacccccaagaguaugagucaaauaucaaaauaucauuacagacuugagcucgcaugaaucaaaacaacuuugauaggauuagccaucuguggaacucuuccugaaaacaaaaucacaucagggagccaccagucaaaaauguaauuauccccagaugagcgcuaaccucagcgugauaaccuugucugucacgcuguaacgaaacgcgugauuccucuacugacaacguauugcaaaauagaccuggauggcagaaccuuagccuguauguauccaaaauggcauguaggggacacucauuuaguagggccauaaugcuuuaugaucugggcugguaguagauucagaaucucuccaagguuaagaaggaaaggaaggaaggaaggaaggaaggaaggaaggaaggaaggaaggaaggaaagauaggugagagggaaaauaggaauggguggguaggggagugggggggggggagggugugggggacuuuugggauagcauuggaaauguaauugaggaaaauacguaauuaaaaaaaaaaaagaaaggggugaagcugagggaguggcucagugcaccugcugugcaagccucaguuugguuccccagagcccauucggagcugagcugcggugcaagccucaguuugguuccccagagcccauucggagcugaacgcagcaccagcagcagcaugucuguaauacagugcugcuucuggcaaaaaugggaggaggagcaggagaguccccagaaguucccaggcuagcucuccuggcauauaagcugcaaacaaggagauccagucucaaauaagguggaaaaugaggaccaacacaccguuguccccagaucucugucuacacgcaugcagugaguagcacaugcgugcuugaacaugcacgcacacuuccuauauacacauacagaaacagaaaggaaaagacacuggcgauggauacauuaaccagcucagguguccugguuacuccucgggauuuauguacguuaagacagcaguugcuguuuuaaucguaaacacguaguaucuggccguuuuuaucuuaguaaagcagaggggaaggaaggguuugaaugaaauaaaaucagcuuugagggugggggagaacacagguggaaauaauuuucuaaaugggucagagcuuugcuucgcaaacagcauggaguauuugcugugugugugugugugugugugugucugucugucugucugucugucucugugugugucucugugugugucugugucugugucucugugugugugugugugugucuguguauuuaaucgugugaguguuccuccguuuguccuguugagcauguggagcucuuucgagacucacuucucuccuugaaccuuguaguucuuggggaucuaauuuaggucaccaggcuuaguggcaaguaaguaccuuuauucuugagccaucuuaccagccccuauaugcuuccuucugagacagauuuaaagggauguucugaugcggccuagggaaaugcuuucuagaaauucacucccccaaguggcuagcugagaaauagcaccccuguggucagacgcaccauccacugguauaugccaaaggcagcagaaagaagaugguggucuucaucagaaucauguuguugucuuuguggcuuuacuguuugugaaagacaggugauccuagcaucauaaaauggggaugaaaguuaauuuaauaguuuguguuauuuaugcuuuucaaauaccugaucuuuauagcgauacuaugacuugguucauaacagcaucguuaugacuauuuuacaaagaucaggcacgggcuucuggagacagggggaguagaaagaacucuggcugcucgccugacguucugugguacuguacucauuuuauguugccaccacuacaguccccacccagcaagcaguagggcugguauauuucauuuagaguagaaagacauagggugaccagcauuuccugcuguggccuggcauuggaauguuuggauguuucuaacuggagagaaaaugauagaauguggaagucauaaacuauuaugaauccaauguuuuaugggauuaucacaauuugucucugucccauacuccguuuaagauaaaauaaaacuauaugccauaaauguugcauguauguauguauguaugaauauauguauauauauguguguguguguguguguguguguguguguguguauguaugugacacagggauaguuuauuaagauuuaaaguuuuaauuuagagauuuaaguuuuagaccaaaggauuuucuucucucagguggaguauaaugaccuaugagcucaaauugccagcaaagucgucucuacuuccugaaccuguggcagcaacugaagaauuuuacguaagacuaaucuuguaucuacugaccacuugaaaugggguaucucgggcacagggggagauggcagugguggcauguguguuuugcccuaggucacugaccuuccuggaccuuuaccccuuugucuaugacauggguccuggugcccugaggauuuaauggugcagauguguauacagcaucagacaugcaaggucccguucucaugacccgggaggccagcagauagcagcccuuguugagggcucacucaucgucugcauccaucaugagcuugaucauuaggugucugcccagcucugauaagccccucccacucaugguccagccccucccacucaugguccagcacuccuggcuggaggaugauauaguuucucucuucccuuugccugcucucugaagggacagagacccacauuaagcccaucgauccugagcaagcaaaggaagaaacaccgcucacuuccuucuaucucugcugcugaccacaagugucuaaaaauuuucagucguguuuaaaccucagagcgguggaaacuuaaaacaaucuggcuuccaggagauuagcucugacucauuaaagcccuuugaucuaccgccgcauguuuuucucacuagggaaauucaccucuuuagagcugaaaucuuuguuuugccauugggaaaauuauuaucuugucaaagcuaagacaggggcauucuuagagaagauaaguguauuuuucagauaggaaaauauuuuaaaaaguucugaaacaugaaaaaguaguagagugguaugaaauggaaaacaaaugaugcacagccccauagccuaagcuacucaacuggggagguuuaaggguuuacugcuuaauuuccagcaaaacgcucacuuuuauaauucuaucugaauauccuauagagccuguuuuucuggaggauuaaaugugguaucuauaaauucuguccuuggacauaaauauuaucuucuuccucagaaagagauguauuuucuuuucuuugauuauccuuaauaaaaaaauacgagcuucaaguaggauuaauuaaauuacaguaauuaauaaauuaaucaugacauuaaugaaugcauuccuuuauagcauuaggggcuguaccacauauuacccaccccgcagcaaagagagauaagcugaucucugaagaaaauugucgcauuuuucaaagauacuuuguccugauccuuaaagacggagauucuuguauuuaaaccaagagauuaggcaggcagcgcgauguugcagaacucgggagacccguagcuacucuggggugaaauugcuuuuacagguguggucugaacucgaaggaggugagguagacauugaaaauuagccacugguggacuugaccauaaauuuaaagugagauuucuuugggaagaugccagucagaaugacaucguggaggagaauauuuaccagccgggugggaauaaaucgauguucggggugacaagaagauuuauagcaaagcgaagaaaaacuggagacugaccggcuugaacggacccaucguuucuauuggaaaaucccgaguuuauagcauggaaugcauaugaagaaaacauuugacagagacucuguucaugaggcuguuaaauagugugcauauuuuuauauaucaugaagguguauucuuuugacaggauguuaagauuugaguccaggagaagagaagcuacaggacacugggcaauguagugugucucacugucuuaagacagcaguucucaaccuguggguugugacuccauugggucaggcauccugcagaucggauauucacauuaugauucauaacaauagcaaaauuacaguuaugauguggcagcaaaguaacuuugucguuggggaucguuuagcacaagaggcuguguuaaaguuccuaauguugcaacauuaaagguugagaaccacugcccuaagauaguuacauaauuuuacgguugugugccugaucguuuggcuauacaguugcauuuuuaaaaggcuuuugugauugagguguaguauauagacagaaaaagaugcauaucuuagauguucagcuugggaguuuuuuuguuuuuuuauaaauuagacaaaccuauguaacagacacccagaucccaagacagcauugcgugccugauaagccccucucccacccuugcaagcacuuccacacauuucucauggaugacaacucucacuaacagccuagauucugguuuaggaagaugggaaagguagaauauaaaaucgagaucauucugcaugcuuguuugcuuuggcuccgcugaggcauaauugggacucaucccuucccaguguccucuaguguuuccauggaacaaauacauugcauuggacacugugugaacaucccaccuagcccaugucuuuuggggaacacauguccauuucuuuggguguguacguagaacuugaguuucccgguccucugguguuggccuguguucaggucuaacagacauuguccaguagcuuccuaggaccugucagcuuuuagguaggagagguuuauaucccaccauccgugccaguuggcagguuccacucgcugcuguuugcauuuuagccauuuugcgugugguuucuuucaguuugcauucugcacaugugugaggaagcucaggguuaaucacuggguuaaucuaccuguaucuccaguguucuuccccuguucuguauguguuguucuggcuuuuaguguacuuauuuaaaauaauacuucuuuuagucauacuguauuuauauauaauucacuuacauauauuuuuuaaaaaaacacaauggaucauuaauugaauuuucuaaagauauaaagauuaccagguucuaaaacugggagucagggaaauuuuuauuuugcaugacacccacacacaugcacaugcacauacacauacacauacacacacacacacacauacacacacauacauacacacauacacauacacauacacacaaacauacacacauguacacauacacacacacacagacacauacacacacacauacacacacaugcacauacacacaaacauacacacauguacacauacacacacacacagacauacagacacacgcacacacacuagcuuuucauggcagccuuugcccuguuuuccaaaugucacaaaugguacauuucugaagcaaucaugacuggguuguauagacaccaacagcaaucauauagcgcagggguuucuuuuccagaugacaauuuaugaagacuccguugcaaaccaucuuacgaaaaucgucaacucugaugagcaugcgguggucauaucgucugccaagugaguuguggggcuggaguggagaaggugcuuaguuacgugagagcgugcuuaguuaugugagagcgugcuuaguuacgugagagcgugcuuaguuacgugagagcgcacgaggaaagguauuuccugaugacaccauuucuggugguucuucuuagacaauaauucgaccuggaguuuucgucacauuggcgucugcauggagucuauucagagucuaugcugcuuauuuugaaacauuucuguuauaaaaguaugaaaagugcguagaauuuaaauguccauuugcaaauuaucaaugguuaauuacaacacagaaauccuaucucguuaaaauuuauuauuuccuguacccauguuuuuuuuuuuuuuuuuaauuuagcaacuguuuacaucaccaaaaggaaaauagugagauucuccaaaaugacaucucuuggaguguuuaaaauccauaauuauaauuuaucucaaacucauuagauuuuacuuaauuccaaacacggagccaaagcgucaugauguuauccuaaauguggaacuucaaguuuacuuuugaagcaucuuauacuugcaucgugagaagguuacaggacccuaaggcagaacacuucugauugucccacagauugagcaucuagcacucuccuaauuugugccucagcccugugcacacaaggugcagagauagagccaggcuguucccucugccucucugcaucucagagaugugggggaaacugagguaggaagccauggcugccccuuuccuuucuacagggauggacugaagggcuccaucccucagagucaauagcccaagcacagcaguggucagcgcucuggcaugcgcacaguuucacaaacccaggaggaaauuaggugaaaccauuacaguaauggcaacguggaccuuuagguacacaagcuggugagaauggcagugucugcucucaggagugggauuucacagaggaucuucuguagagcaagaaaaagugguuaugacagacugacaucauccaugaagaaauucuguauuauguauagaaggauuagauaggaagcccaugaaggagucuaauaaaugauaagcuaggcucucuuaauucucuuaaaaauuggaaauuaaggggcuggagugauagcucagcauuaaagagccugcugcucuugcagaagacucuaguuagcuuuccagcucccacaacucagcucacaacaauuaauaacuccagucccaggagauccgauacgugucuccucagacacuagaugaaugugguacacacacauacaugacaugcaagcacacacagauacacauauuuuuuuuaaucuuaaagaaaaauagagaacagaaacuggaaugugaaaagucagccaguuccaagaggauugggccuguagcucaauggcugaguguucacuuagcacucgugagucgcggguucuaucucugcaucaggaagcaggcugagggcuagauggcccacagagcuaaccccuaagcaacagguaaaacacagaugguuagggauaaugcuccugaaugaccaguucgaaggccuggaguguaagcagggugcaugcauguacccugugccugucacagaguuugauuuuguaguauggauguauagagaaaauaccauuccucacccaccagagaaaguugugaauuuaauagaaaaaaaaacacuaguggaacuuauuucuccuuuaaauuuuuacuguaucagugauagaaauguuuuacuuucaagauauuucuaucaacauacacuuuuugccaaaaccaaucuauucauaugccauuaugcuggcuaaauuuuuaaacaacuguuugagagguagaugucuuucacguuauuuuucucuccaguccauuucuuuugcaaagacuccaaauguaauuaaaagaaacaaacaagucagccaucgauugcugacacuaaugagaccuaaauugaauuaggcuuguauauuauugcauugguuaucuuaaggggggggggauggauggguuaacagagaauauaacugaauucaagugucugauugguugguaccaauacacacaaccucuuuguucuucagguagcagugagcuaccaagauguccauuugcugacaccuuguagauccaacagauccugaagcuagugacgagcuugugccugcucaccaugaagaaaagugucucaacugugggggaugcuacaggauuuuuaagggaucugaaaauauucuucuuacggaauauuuaagcauuugaggaugguucagcacagccuuacuauaaguacggaaagcaaggcuugcuuguguaucuguuuuucaccuaacagucguaaagaugucuaagauacguuaacacagauggaagguccaucuucuguaagaaugaucucaggaacucgagguugggcuccuugcgcuuacuuuuaacuucauuuguacaucagagcacacagacuauaaaggcgccuucucucuuccucaaaggauacucugugaaaccgugaaggacuucguugccaaaguggagaaggcacaggacagaacacuggaaaauacaguaguagccgaagccguggccaguaaaguaagagggacacaacacacaucaagggcaugcgaguuguucacugacauuaugagcaccgagcugugcuguaaagauugccuugguguacucuugccaaaauacccaaagagaaaacaaaacaaaacaaacaaacaaacaaacaaaaaaccaacguuuuuauuuagguaugaggauuuacaaaaaugccuucuaguuuaugguuagccuuuaauaugcacaaaacagcauugcuggaaguauucagcaagccauuuuuuuucuuuuaauuuagauaccuuucucugugauuggcaucuuaaaagggacauguggucagccugccaggggaggaugcuagggggcccaugauccuguugggugaggccuggcuuuccaugucaagcaagcguugguggcccaguucccucccagcacgggucucuccauucucuagacucaaguccuugucuccuucuaaguucuauuuccuucgugacguuuuuuucauaccuuuacagauuuuucccuccuuuaugagcuuucugaugcuaagguaagaauagcauauagacuuuacaaggcagcgucuuuacuuuuaaaguccaugaaggggucucuguacguaaggcucgggaaggguuccugccccugaggcccuggcugaacuaggggaugaaguggaagaaaaagaaaguggaaauaaauuuuuccuuuaaauuuuuauuuagucuaugacaguuuuauucaccuagacacugcuuggucacaucuucacccacuggggaauggggaaaucugcccaugcccacaguccucccucccccagaagucaucagcuguccauaaccccuuagccuaggggugggaaccccuccccuccccacugcuggaauauuuagcugcugaucuuaugcaggucuuguauauucauugcagccgcugcgaguccacgugugcagcagcccugccgugucuggaggccaccauaccucaccucuccucccuguccuccagcccuuacguguuuucugccccuucuuccaccagguuccuucccugagacuugggcgugggggaggcguguuaaugugauguucacauugcggcgcugaccauucagaguccccauuugcagauguugugauucuuuccauaagacuaaggacucuaccaaagugcucuuagaagugaggagaccucuggccaagucccagaauacagaaauaacacuuaaaagccagcagccuuguuacauaccuuugcugaagacacugaaaucaaugcuugaggaguuucacucguuuccuucucuguggagaguuucaggaggccauggacuuagccacgccucugucucagaaguucuucaucugugacuuugcuuggcuuuucaucauguggcgauggaagccauuggcgguagcauuaacaguuuugaucccaaauguuuccuuuccuggagaaaagcaagaaaagcagaaagaaacaagaccucugugcuuggucauucuguuccccucucccuccccuccucauuccugugcauuuuccuuugagaucuuucuuggacccaguaguccugagggagcacuguucgguucuuugcaauauagagcugcagcucagccaugccugcaacuccugauguuaaacgggugccuaagucaaucacuuuacaggaaguccugguguuuuuguauauuguguaucuaucaauuuaguauugguugcauucuaaggaggaaaagcggcucauagguuguaaacauuggaaccugugguggcugaagagguggcucggguauuaugagcucuuacugcucuggcagaggacccagguuugguuucaagcacccacaugguggcucacauagcacugguugcgggugaccugagacccucuuguggcuucuagcccaccaggcacacaacaugguauacaugcaugcauccaggcaaaacucccauguacauaaagauuguucuaagaagacuuucaauccugagauagcauuuggugcuucugaagugugagucaguagguagacacaagagcuguguuuucagucauuaaugccauaggucuguaucagucagcuaauagcaagcaguucugugcuuaagaccuaacucgcuuagagaucguuuucugucuucaguaaguuuaaaauguauuuaaaacaaaaaucuacagaauaaaagacuauagcuacuuaaauguugauguuuuuauucccaaugguuaaagauuuaucuugcauaaaaauacaucugccagucuaauagguuuuaauuucuuccccauuacccuugcggaugcuuguuugcuugcuugucaccacccuugauauuuuguuucuuuucuuagugcucaguccuaaacgagaagcuugagcaguugcuacaagccuugcacgcggacucucaggccagucgaguccccccaggaaucggcccugccauccccgaagaggacaccguggaguccgccagugacgaguccuugggugaaagcaaggaccagcuggugaaugacauugggaaacccuccucccagaaagccgugaagccccgggagauaaugcugcgggccaacagucuaaagaaagcggugaggcaagucauugaagaagcugaaaaagguacacucucacaaaauuagcuuccaaggggccgcaacaucccgcugcaagcauagccggggccuggccagggccgcagcauccccaccgcaggcauagccagggugcgugcgugcgugccugcauagugcucggauuuguuucccauuuacagacaaggcucacggcacgguagaagacaauaaguucacuaacaggaaauuuguaccuagacgugucuaaguucaguagugaagaucugcgucguaaugaugcaaucugcguacaccaagauuucagaaguaaaugagguuguaauauuuccaucccaacuuaaguagaagaauaguuauagaacaagucuaaaaaucucaaccuuuuuacuuuauugccaucuccuuauuggcaucucuuuauuucuuauaccugcugauaguaaaauaauaauaauaauaauaauuuuuuaaaaauuccuucuuguauguaucaaaacucauacugaacaaugagcucuugguugcaaaagaggauuuauauuuugcaccugauagugaugauuucuuaauaucauuaacauuuuuaaaagcauauaaaucuuugaauuugaaaagauuugcuuuuuauuuuugcuucugugcacgcaugagugucugugcgugggagggugugcgucagucagaacaggugccccgggagguacuggauccuccaggaaggagugagcugcccauugcagaugcugagaaccaaccaugcgcaugagcagucggugcucucagccacugagccaugucugcagccccuagauuuaaacuucgguauggguguacauguuucuuaguauuuuagugccagaugaaaaaugguuuaaauguggcuaauguugggaauccccuuccagguguguaacuugucaucaggcuuuguauuuugauuuaaauucauguauaauuuuauucuaguaaauaugaaaccguaacaaauuaauuuuuagacugcaguauccacagacaucacucccaauuuggucacuaaauaauguuguuuuguaaauguacaauuucuuuugguaguugguuuaguuuuucuuuccauagcauaucuuaauaugaauucauuuuauuuccacuuacgcaagucuguuucccuucuuacuacuuaaaguuauggaugagccagcagugcagcccucugagccagucaguccgucuugugacuaugauacagaaacagaugaagcuaaagaggacgacgcgaaagagucgcuaucaggugagaagucgaugaugacgucaucaggaaagcucaguuacaacuggcuuugcauuuauuuaauuuuaaguaugaaacgaacuguugaauuucuauuuuucuaaaggccuuugggcagucuguguuauucaugaacacuaaaauaauaauggcaacguaugaguuagguugacaaguauucuuauaucucuugugagaucuaagagauaucuagagaccaacaauaaacuaaguguuaugggaugauugagugucuuagaagaaauagccagguuuccccacuuuagcauggguugcucucagauuucuugggaaacugcgagaaagcugcuggccuuugcugcaucaagcuuggccuuugacggauucagcagagcuuuauauucugcugauugaccaaugcuuguugcgaagcuaagcuuuaaaaccaaaagccuucuaacuacaacucugucucuaccaaauuacuuucugccuagaagugauuguugcuugaagauuaguaacugucucccugccuauugacuuugaguaggaaaugaauuuguccuuuuagcauuucacauaauguaagugaaaguuuccaguuacuguuggaugagacaggcagaaguuaaaauauuaauguuaugauauaguaugaaaauaauuauaauguacucaggaaaagucagcauaguauaucagaacuguuucuuaaaauucauuaacauuuuguuuccaaacuuggacugauuucugaagcuuuucuguaguuuuccuaaguaaagaugaagaugauaguagccuauuuuaauugguuuguagugaagauuggccgguuuacuacacaaaagcgccccaguggugccugcugcucucugucauuguuguuguuguuauuguuguugcuuugagaaaauuuguuugaucguacuaaaaacucuuaagaaaaaauaaaaauuaaguucagugacguuuagauagucaacauauauaucuacaggcaaauuauuauauucacuuuccagauggucauugaaucuucaggacauucaguucuaauacauucucucuagugucuggcuauaacuguuagaagacuauucuuuaucauaaauuuacauuuucuuccuugaaauucaacccaugauggagaauauuaguggguuuuuuugugucauaacguaugcaguaagaacaucuggcauuuguaugguguuuuuaugauuggcuuaagaguuaauuucccagaugacauuuuacuaauuccaaguugaaucuguguucuggggccauaucuucccuucuucccuauggcaguccuuaaaugaugcuguaaagaucccuugcuacgucugaugccuccuucauaucuggugucucuuaacuucuuccaagagucugcaacuuggugauuuugaauuguucauuuuucuggccgcauucauuuggccagugucgaucuuuaaaaguuuugaacaaaccccagauguuuucuguaaggcagugacauaaauacucacgccacucauucagcacaucaugacguugcccaagcuacugcauuucuucucaaguuuaauugcacuagcuuucccucaucuuuguaacuguucuuuuuuauuuuuauuuuuuuuaaauuuggaccaucacauuucuaccuguuagguuggggauuuaguucagugguagagcgcuugcuagcaagcgcaaggcccuagguucgauccucagcucuggaaaaaacaaaaagaaaaacaaaaagaaaaccaaaaagacauuuccaccuguuaaauucuugugucaucuccaguguauuugaucugugaaguugguaaucaggcuugggauauaaacuacuggccauaguaggguuagcgauggcaucuauacauuuguucucuuccauacgugugcacucuuguccauggccuccagucagccauuaguccaccuuaccauacucucauagacucaacacuuccauuaauuagagaggaaauggaaagggcacuaaauauagagauaaaccuagacuuaggaaagccuuuaaucuugccacauuugaugccaauuuugccuguaauccaacuuauugaaaaucauuggcaaucgaaguguuccuucuauuaucuuuauugaaucaucuguauugugucauuauuaaauuauaccauugaugucuaagaugugagaaaugcaguauauuaauguguucagguggugccuuacuuaggaagacacuaauuugauucccugcaguggaguauugaucuuaggcaguacugcacuuucugcuuuauaucagagguaaacaucaaaaguugcugcguauuagaaauuagcuucaggagucccaucugucacacacaggaguggcucuucuguuccuuuugugcaucuggacuguuuuugaucagagaaaauacaugcaagaguaacguaguuaaguuuguaauuagucuaagggagagugaggauaauuaaguuucagaguacuuuuaaauugaauuuaauuucuaaugucuuuuuaauaccaaucacuggccucuagaugaguucaaggugcuguuuuuuuuuucuccauuaucuugccuuuuguuagauacaauuaaaucuuuucgauauuuucuugaauaucuuaacuauguggagcuuuuacaaaaacguaacaaaaccauuuggagcuuaucaccauucaaauaaaugauguggguuuuauuuaaagauuaaaugacauccucgauuuuaauuuuuaaaauuuuuuuauaauuaauauauuuugaccauauucuuuucccuccuccaauuucucagauccucucuaauucccuacuaacccaacuucauggucucucucccuuccuccccacaauaaaaacaucccgcccuccuucucccccaaccaaaacaaacaaacacauaaaacaaacuaaauacuauacacaaaagcacguggaguucuguuuuauguuggcguagagucugcuuugaagugugguugauauacccagagacacuccauuggagaaaacugauuuucucuguuccagaagguaucaguuguaaauagcuucuugguuagaggcaugauuuuguaucuccauuuccuucuucauccuggcauuuugucugaucugaacucaugcaagccuuguacaugaugccuccucggugaguucauguguguaucugcccugucgugucuggaauacaggguuuggagcuuguccaccaccucuggcucuuagaguguuucuaccuccucuccugcaugguccccugagcuuucugaggaggaauuugauaaagacaucucuucuagggcucccuccccguucauugucuaguugugggucuucguuaauuaccaccuacggcaaggagaagcuuauccgaugaggguugauugaugcccagagcugagucuagccaggugucccaucaauugaagauuauguuaacuucugccucauguguguucauguguucugcugggagucgcaucacuuaaauaugaugguuaaccuaguauucaugacuaguggguaauguggguaguuugcagcauaacaguuacuaggcuuuaaacuuucuacuugucaaguguggguugaucaccuucaaauuaagcauauugcugacuuaaugacaguagauaucuguccuuugguagcaucuauucaaaaccagagaucaguauaucucccuuggaagauauccuccacaugucucaagagaaggaaaguaaacugacugucgagguaaauagaauuaacaacuucaguuccacucacugauuuaaggaggcauugcuuguugcggugugucucgaguuuagaggggguuguuuaauuuuauacugguuucauuugucauuuuuaaucuggauuuuugucaacagccaaaaccacaucucagucuccugaugcccaggcaagcuguggccauccccaaacugacucugucgcugguccagccauggccaccaccaaagaaaaccucccugugcucaacacuagaaucaucugcccagguaguguaguugugugacgugguccgugcuuuaagacaccugugaaaaugaguaacuucaacuuaucuuauucaugaacuacagaaagguguccuuagugauaaauguuccuuuaagagaauaguuuuuuuuuuuuuuugccaaacuuaguuguagaaauccaggucuuuagauuauuccaugucuaauuguguaggacguauucaaacucacauuuaauuuuaagccuuguccuaagaaauguuaguuuguugguucuaggucagagcccaggagugugugccugaauuggagcugaccuucuauccugugaucuccaaggauccccacagauaucuccuugugguuuuaagccacuacuuucucuguaggcuguuuuagcuaguauuuguuucagccuggaugaaaugaguuugccuuggauuaggcugauacaaguagacaccaaagaguuuaggugggagcuggagggaaacacaugugucucagagcuuccuaaaucuacagagguuuuaaaauuccuuucauuaucauucagaacgcgcuggaauccauuuagacccuucuggugaauuucucuguaacuaugggcuuuaauuaagacacugguuggagaguuuguucuucucuuugaauagugacaggucagccaggcagauggucagggaaaugggguacccagaagucacaugagacaguaagauccagucagcauccaaaggacacccauacacagaggaaugugcacucuucucaagaguaugugggacacucucuaggauagagcauaagccaguuaggucacaaaacauucucaguaagaccgagcggaucuccagcucacuguucggugcucagcacaacggacugcgagggaugagguguacgcagcucauaaacguggaaguaaaauuagagaaaauaauggaaagacuaaaaacgaagcagagaaaaaaauuaaaaaaaaauuaaaaagcagagaaaauacuuugcuaugagaacauaaacgcaccauccuacgacguagcugaugcagcugaacccugccuggcguggaguggagggcuaaaggccgccugugaaaaguuccauucaccucaugugaaccaccuggcgccugccccccucccucccccacccccacccccgugguagacaggagcuaacuaaugggagcugacgaggaagcaaggaauacaugugagagcacuaauaaauaugagaauuaaaaaagcaauagagaaagugaacaagagagagagaagauucaaaucaccgaagucaggcaugggagaagucuugaggcaucgugguggagcuuacagaaauguaaacggauggaaaugagcugugugaugaccaaucacaacucagaggaaagaggcaaaugcacaaagacauaugaacuacgaaucacgcucaagaaggaaaagacauaaaaacccaggagacagaggcagguggaucucugugaguuugaggccagccugaucuacauagcaagcuccaggacagccagggcuacacaauaaaugucuuaauaaaccaggaaagaagggaaguauaacucugugucuucgaagauuucucuugugucuagcacucagaguggggcuuccccuucuaaggggaguggggaggacuuacaugagcagguacugggaggagaggaaggguaauauuggguuauaaagugaauaaauaaauaagcuuaguaaaaaaugaaaaccucaaaaacugcaugcaugugugcacaugugcucauaugugcacauaaucgagcuaagccaccaaaggucauaagugaguacacucagguuacagaguagaucaguauguaaaaacugcauauuuaucauuauauuucuauauaccgcaacugagcauucuguccaugcaauuaagaaaaaaguuccacuugaaauugcaucaccaauaacaaaauacucaggaaugaauuuaacccagaaagagaaaugcuggaagcuacaaauuguagaacugcuaaaugguaagugagaaaauaucacagauauuccuuuucauguuuuucucuuuauuacaacaugcagacauuuggaaauauuaaaacacuucacguuuccaagcaucauccucugagcuuuggcuacugaguggucacugaaaaccaggcgcugggagcaagcuguuugagaagggcagguugaguggaccaggccugagucugcuuccucuuaacaugugaugcuaauguuucuggcagguuugagagcaggacuugcugccuccauugcugggaguucuaucaucaacaaaauguugcuggcgaacaucgauccuuucggggcaacaccguuuauugacccagaucuagacucacuguaaggaacacuuuuguagcuauuugacuucuguuuuuguuuguugguuuguguuucuguuuuguucaaauccuaaaacuuugcaugugucccaaaguguaugagucuaucugcaaaaaaaggggugguguggaugcucagaaauggaucauggucugucccugagaugggucccuuucucaccugcucagcagccacucccuggugcagagaucugugccucgcccugaggggugaccuuagugcugguuuguacuuguauucaugccauccccagccuuucucucuucagucugcuaacccugccaucuuuccucaccccauuacacaguuuccuuauuucuagcuucuaacccacauugacugcaucucuuuuuuagacuccccaaaacacuuuuggaagcuugagauauauuuacuauuguuuucauuuuaaaauuugcacacacacacacacacacacacacacacacacacgcauguacauaccaugacuuguaugucugguauggucagagguugacuuacaggagucaguucuuucugucaaccauguguccugggaauugaacucuggucaucaaguuugguggcacacaccuuuaccucugguauaaggagagaauugacucuugcagauuaucuucugauguucauacauaugccuggcacacauggcaucugugcagaacccauccacuccauaaagugauaguggaaaauaaaaggaaaaugagugugaacaauauuuauagcaaugcacugaauucagaaguugcuuucuuacaguuuguccacuauuaaggguugaaauggaagagagucucucaugaaagagagagggcacugcaccugacuggaaagcccucauguagauagcggcaucugucuggguagucagacccuggcauagaagagaaggcguaaggcugccaaauuuaguagaaaacauaaaacaaugacugucuuugcucuacuuuugccucagaccaaaaauuauugcacuugugcccagaggaugucugcuggguauggcuucuccuucccaggccuccuggaagaauggcuaccuaaggguaguaagacuaaucguguaaauaaacuguacuguaaugacucugaaauugacuuuugugugcuuuuccuuauuaucauagagauggauacucugaaaaaugugucaugaacaacuacuuugggauuggauuagaugcaaaaauuucauuagaauuuaauaauaagagagaggagcacccugaaaaaugcagguaauuucaauaauacccauaauguuguuauaugaaggcaauuuuacuuuaauuucauuuauuaucucuuuugauuuaagaaguaaauacauaacuuuuccugacguugcacaacaauauuuauuuuuuucagaagucgaacuaaaaacuugaugugguacggaguccuugggacccgggagcuacuacagagaucguacaagaaucuggagcagaggguucaacuugaggucaguuaaucuugaaacaaaggcauuugaguuuuuccuccauagauaauuuguggagcuaaguugaccuaauuuccccuuaauuagcgauuaaauauauuguaaagguagugucaacccugccuagaaacagcagauguaaccuggccauuccugucuguuccuggagcuggggccaccaggguggagccaugcaaauacuguaguaggacagugucuuuaauaauggauuuucuacacucaaauguuccaguucugcaaugcccaauguuuuuauaacauccuugaaaaauaguguuugcagcucauacauuuuaauuuaaauauauauuuauuuugauccaauuauuucuaacaagucaguuaaaaaauaagauuuugacaauuuuuuuucuaauuuaaguagaaacuucaggauaacaaaaguuacugaaucucuugcgauagcaggaaaaagaugauugggagucuuugaaguauaucaauaacaguaaauuuauuuucuuuuaucuuuuguccagggcauaucuuuucuaucuuccuuuugugaucagguauuuuuauuuaaagcauaucacuaauacagaggaauuuauaacucucaagucuuaaauacuccgguaaucuaacuaaacugaguacuguugucuuggcauuauccuaacaguggguuguaggcuaacugucagcuaaauguccuaacgauaagcccaaugcuccuuggcacccuaggaauaucacuaggugaucagcugcuuugauucaugguugcuuguaaaauuaaacuacagauggcuaggugaaaggcuaccagucuguccaccacagucccaccacaagucaguguaaggugcccuuguaugaauuguaugcguuccuucauuuugaucccuggccccagguggccacacuccuuaagaacaguuaguuguaauuauugcuguuacccuuaguucguaacacaguagcugacacugucucaaggcagaaguggguaccagggaaaugauaauuugauauggaagaugccccaaugacugacauguugcugcauggcuccaggaaccgacuugauuggggcaugagggaaugaagaaaugacagaaagauacauggacagaaagcugggauugggggucaggcucugagcugcaggagcugagcaccucaggaauucagcaacauuuuggcuugcacggggaggugggauuuaugguauacaggagacaggcuuagcuaaccuugguaggagcugucucuguaagggugcagcuucaggcaggaagugucuagggacagaaagccauggugaauguuuucugcauaggcugucuacacuagcccuuggucccuugcagaaggcuuugccacaccuccaagccugaggcuacaggauccuugacaugguugugucucugucgacaacacacagucacucaggauuuuacucacucagugcuuccucuguuccuuacagaugaaucugaucauaaauuggggguuggaggggacagacucaaaaaauaaauuuagagccaggugugguggcacauguuuguaaucccagcucuucugguuuggaagcagggcagcugcccacauucaggccuggaguuucaggccagccaaggcuguauugaaugacccuuucuuuaauaaacaaagcaagcaaacaaaacaacucuaaaaccauuuaauacuuauaaccugucuuacuuagguuuuuacugcugugagcagacaccaugaccaaggcaagucuuauaaaggacaacauuuaauugggucuggcuuacagguucagagguuccauucuuuaccaaggcgggagcauggcagcauacaggcagacaugaugcaggcagagcugagaguucuacaccuucaucugaaggcugcuaguggaagacuguuuucuagguagcuaggaugaggguuguaagaccacgcccacagggacacaccuacuccaacaaggccacaccuccuaauagugccacucccugugccaugcauauacaaaccaugacauaaccuaaacagcuuauaggcuugccaaccucaugcauguuccgaaugcucucuuagcccauaguagaugcccugacccaaaggcugcuguauaaugaagugucuacucucacauguaguuuauagaguacuggauacaaaagugaaagcagaaagacugcuugucagccuggguggcugaauggccucuguuacuggaagccuucuuuguugcugauccaaauuuuaaagaagacaucuuaccuagagcucuuuccuuuguuuuuaaaagacccugaugguguggauccuuugacagugugcugauacgaugggucacuuuaauaaaguuuuuaauacauuaaguaagcuguguagauauaauggaugguauaaacaucaguuaaguauuuuuguuagacuaacauauuucauuauuaccaaucaaauaaaaauggaaccuguaucuaauucaugcaguguuccaaaguggggccaaacaaaugagagcucugugaggugacuccguggguaaaggugccugcugcugagcccgaugaccagaguucagucccuggggcucacaugguuggaggggagaacugacuacagcaagucguccuccggccugcccaugugugcauacaugcaugcucucaugcacacuuaaaugaacaauuauuguggagcaaguggaaccaugcuaucagacagaugaacuggccaggucaaagcagauuuaaaaauccugauaagucuuauaacugagaacaauaggcauuagaaucagcaccuggauagucgugguaaggcagacaugcagccuggcaccucugcauuucuccucccuugagcaguauaucaucagugcucugacacccgaguggcauggcagaaaagcagacugacaaaugauaauaaaaacgaaaugauaucugaaauaccuagacuuugaugcagucugcaugccuguagaccauguagucgcaguacuggugaugccugucuuguugcaugcacuuguaacagaaaguaaugcuaaguccauagguuaguuaguggaugucaaacgauagguuuuuuuuuuuuuuuuuuuuuuuuuuuuuguaaucagcaacuuuccauucuuugaauguagacacugaccccugauuuugaaaccuaaagcugagacuguguacauacagguacaaacaggcuagaugagucuggccuggucgcucguaccugugaucauggcacuggagauguggcgguagcaggauccugaacccuggucagccuguguuacguauccuuaccuaaaaauaaaguagaugcuaugugauggaaaaaagaagcuaaaaacaguaaaguagaauaaaggaaaacaugcugauacauguuaaaaagugaaauggaaagucucagaauucucugccuuuuuucgguaaggaaaaguagaucacucuuuaagagugaguguggaaggcugggugacagcuuuucaccguggugaugcugugugugguggggaauccaaggcggagcagagucugcaccaggccuguuuggguucaccuuucauucauuauuuuacccagauaagguuuccccuccgguauggaaggauauggauuuccugcguggcauuugaauuggugccagccaaguguggcuucucugugugcuaguggaugggagagugcuuggugcgaauucacggagcgagacagaagucacagugcaaacugagaagugugggcccauacacacuggguuugccguguggccuugggaagcucaucuaagccucgcuaucggaacagcaggagagguuuaugacccucuucccaugacggaacuccgggggaaagcacaacguguaucuccaccuuugcaguagaaggacauugcgugguguaaaugggaggucucacugaauuaaaguaugcuugcauugacagugacuugucuauaauaagcaggacuuacaugggucgagcaguguuccuuucuaacugaaauagugaucauacagucuugugcguuuuaaguagagagcgaaugucagcaaaaauaaauaacuggaaaaugcauauuuguauauauucucucaugacauccuaccccuuagcugccauguccaccucagcaucuauguuuuauauaagaauaaauagaauaaaacaaaauaaaguaaaauuaaaauacaauugaggagugacaaaaaugccaguuuugcuuacacuaaggaaaagucauucauuuguaaauauaaaagaaguaauuuuaccuuguuuuguguuuuuaaaacaagaucccacucuguugccuaaacuaucugggaacuugcagcaauccuccugucucugccccacaaguauggauugcagaugugugccaacacaguuuguauaaguuugcuuuuuaaaauaaaaauaaaaauccagagaggggcugaagaggugguucagccuuuaagagcacuggcugcuuuuagagaauuaaaauucaacuccuggcacucagaugggcuaaugaccaucugucucuccaguuccagggacuccaucgcccucuucuggcgucuuuaggcacuguguuccuugaugcuauguguaauuacuguagcagccacagagccccuuucccaucucagugguaauuuucauuuaggugaauuagaaggugggaguguacagugcuauccaguaugcauagcuucccuugccuuugcauguagcuacaugaacaguacagcuuugauuaaaaaugguguguguguaugugugugugugugugugugugugugugcuugcauaugugcaaguguaccaaggcacacgugugggugucagaggacaacuuggagauuuuguucuuuucauauacauguggguuccacucaaguugucagguuugguggcaagccccucacccuuuguaaugugagaguguguuuacaagaaagcaagcaccauggucaccuuccugucuccauagcucugaaguaacaguguugcccuuuuugaccucuaagagucucauguagcccaggcugcccuugaacuuaauaaguagcugaggauguucaugagucucugcucuuccugcauccaugucaaagugcugggacuauaggcauucuaaccuccaagcucuuugccuugcagugugaugggcaguauauaccucuuccuagucuacaaggcauagcgguguugaacaucccuagcuacgccggaggcaccaacuucuggggcggaaccaaagaggaugauguaaguagcauagugggguuuguguguguguccucagugguaauuacauucccagaaugccuagcuuuaaaagugugccucacgaaacuaauugcaggucaguguuuacaugauaaauguguuacaguauuuggaaggugugagguagaauccuaacaucuuauuucaauguuuccucucauggcuacagucuuaaguuucccagaguucugccauuaaagguguguaccaccacccuuggcaggguuugggacuauuucuguuuucuuaguacauuucccuguguuaggaaagaaagccacagucacauuugugcgguacgcuaccguugcucuaaaaggaaugagaaggagaaugcaguuauugaaguggguguaugguaaaaaacgguguccaugucagacuccugaagaaucauacccugauuucaguuugaggcuuaaaugaacauguaagguauagugcuugugauguggguagauaccuaguucuacugaaguauagcccacucuuugccagucaaauauucagaaguugugaaaucaguagaguaagauaaaguugacauuccuggacauccacuaggcacucauucaaagggcuuuauguucauuguuuaacauccaugugaccugauuuacuuuccuacuucuccucuuuacccuccuccuucuccuccuccuuuucuucuucauuuuucuccucccccccccccacccccaucugguaugugagcuaggaauaagaacuaaggucucugcacagacuaguaguagaacccugcaaaaacgcugaccuacaucuucagccccaaaccuuacuuuucugauuuuacccuugaaaagaaagagacagaguuuccauggugaagcaacuuggauccaggcgguuugguaacagaguuuagaagaaguuauaucaaguuguggccuuguauuuccaggacaacuuuuaaugaggguauuccuuuagagugagcauuuuuccagucauaauuauuuguuacauacagugagugagaaguagcaacaauacauggccaugacuaaauuuaaauccuuggcaucaguugugugaacaugcacuuaacauaaaagcaucauauguaugucugaggaauuuuuguucccuaagauuucuguuuccauacucaagaaugcccggaaagguuguuauauuaaauuaugaggcaagggcuggagagauggcucagcaguuucaggcacuuccugcucuuacagagaacccagguucaauucccagcacccagcagcagcuuguacuaccugcagcucaggcugucuguccuaguuugcuuucuauuacugugauaaacuccacaccaucagcaacguggggaggaaaggguguguucaucccccauguccugaucucaguagagcauguucagccccuauguccugaucacaguugaccauggagggaaaucaaggcaggaacugaagcagaggccacguggaaugugcugcuggcugacuugucuccccguggcuuacucaaucugcuuuccucacacaaucuaggacuaccucccacagugggcaagccccucacacaucaaccaguaaucaagaaaauacccgagucacaugacuacaagccaguuugauggaggcaauucuucgauuggggcucccucuucccaagugaccuuuagucugugucaagaugauagaagcugauacagucuuuuggucucuucaggcaccuggucucaccugcacauauuuacaugcagauacauucacauguguauaauuaaaaacaaaaacaaaucauuuaagaagguaauaacacaaauguguguugcuuugaauacuuaaaaaaaggggugucuguaaaacaugccaagugcauaggaucaugauuugcauguuuuuuaccaccaacuuuugggccuuuguagauuccuaaaaacauuaucuuaccaauuuuaugugaaauauuuaacaguucauaucaaggugaaucauuuagaaacauguuggucuagagugcuguaugagacauuugaauaucauauucauguggauguugagaccuguuuugaaauuaugcuuauuuugaguagcccuugaauauuuccuugggcuauuauuacuuacugauguuucccauuuugcuuuuuauguuuuuauggcaggcuuuaugggccuaguauuucacucuaccuaaacaguugguggaaauguguauaauacaguuuucccuuguagauauuugcugcgccauccuuugaugacaagauucuagaaguugucgcaguguuugacagugugcagauggcaguaucaagggucauuaaauugcagcaucaccggauagcacagguuggugucucaggucaaagcucgccuuauuucacagguaaggaccauagaaggaagcucugucagauugccuacacugcugggcuucuuuaaacacauaucaauguaaaagucaugacuggcuuucugucaugucucacugugucacugcaacgguaaagcaugacauucuguucuagaguggagucaacccaaacccagauaaugcaggcugcaugaauucucagguugaucuguggucucaaguaauguguuggcuucauuucagugccguacgguaaaaaucacgauauuuggcgacgagggagucccagugcagguggauggugaagcauggguccagccuccagggaucaucaagauugugcacaaaaacagagcucagaugcuaaccagagacagaguacguaacuuucauuugauugguuuaacugugugaguguugggggaggugugggacguauauguaagugcggugccgauacaagccagaagaugacacuggaucccccggagcucgagguccaagugguugugagcccccuaaggugugugcugucauccucugcaaauguauuaaaacugaugagccaucucucuguccuccagaauuuuaucaaaucauuucaaaaguuggaaaugaugaaaaauagaaaacauugaaagcaauguaaauuaucucuuaaaugcacuguguaucauguuugaagcauguagcucacuggaguuuuaaguaugaacaguuauucgguuuuaaguugaguacucuuguuuuguuuugcaacuuugaaguuugcugagcaguugagcagcaaguacauagaacuccuguuccuguauauuucuuucuuucuaccaccccccagcacacagaaauucccaucgcucauauguuguacacacauguaguguggaacagcuuuuacaacugguggucuauuaauauauuguuaacugccaggcgugguggcauccaccuuuaacuccaacacuugggaggcagagacaggucaaccucuguuaguucaaggcacccuggucuacauauugaguuccaggcagccagggcuauacaguaaaacuguuucaagcauacucacaugcauacauacauacauacauacauauagaaaaauacacgugggcacacucacauaugcacacacacucauacauucucacacauucccacacaugcccucccacucacccccacagccccucccccaacacacacucaguuucacacucccagauggcauugcucucucugcuguugaccuguguucugucuucuuucucccuuucucaucuuaucccuggcaaccauuguucuuucuaaccgccuccauaguuuagucuuccacaaauauuuuuaguuaaggucagcccuuaacuaauaaggcugacagaauucauaccaucuaguaaaagagugaagugaaauaaaauuaugaucaaucacucauuggauaaauaaagacugaagcauaagcacuauuuaugaacaucagugguggaaucaucuuuauuggucacuuuucucucuuugaugccaugcagugaaagacuugaaauaccccuuucaucaauuuagugaguucuuagaauagagcaaagcacucggaguuccagacucuugugcgugggugggugcgugugcuugcgcgugugcgugugcguguguguguauguguguguguguuuaguuauguuagucuccaaugucuaacauaacuguuccuugccaucuugguuuuaaauaggccuuugaaagcacccugaagucuugggaagacaagcagaagugugacucugggaagccaguucuucgaaccaaccuguacauccaucccgccccugaccuggcaacagaggaagugucacagaugcggcucugcucccaggcugcggaggaacucaucacuagguaaagggcuucugcuggagaauuuggcugggagaacucuggucuuggccaguuguguugucuucuuuaaaguuguuuuaaggguaguaauaagggauguguuggcuuauuucauuagcugcuuccugcgggccuaggcuauaucuugcccucucuaucagaccuuccacacaugcugucuguagucuacauguuaugcagcuucgaaaacaaugaugaauguccugacacacacucucauuaguauauccgcacuacccacuuguugcccuggaacugcucacugugugugagauguuggaagaagucugaacaugaacuguucccacacgucaugagacagaacaaacaguuguaguuucuggcaauguacuccaaagauuuagagacaacacauacuuguccuucuagacagaaaggggagagaucuuuuaaaacugaguuugaugaauguaaaagauauaaaagucggccagguggugaugacacgugccuuuaucucagcacuugggaggcagaggccaaccuggccuacagagcgaguucuagggcagccaaggugacacagagagguguccugccucagaaaacagaacagaaaacaaacaggauauaaaacgcacuacgauagaacuaaauuacagaauggaagggaggcugggacaagauuguugacccucaccugucagcucgcacgugggaauagauucucagccugccacgcggcacauagauucagucucugcaagccuccaucugaagacuugagaaaguaucaucauaggcuguggacguuaaauguucuaauguauauaauaaaacaguuagcauggaggugcugaauaugugaggcgugcccugguguguugcauuuaaaguuucagagaaugacagaucaguuucuggagugcaacugauagagcaucggcguuguauguucaaguccugggcucaaccgcaauaccagagcaaacccacaaagaaguggaugucucggugacgugaaagcuacacuuucccguaaugcucucugcaagccaggggacacucuucagaaggcgagucuucagugauggcccaaagugucuauuuugucucauucuucccuuuaggauuugugacgcagccacgauucacugucuccuggagcaggagcuggcacaugcagugaaugccugcucacacgcccugaacaaagccaacccacgcuucccggaggugaggauugaaugguaaauucucaucccacagauucuuuuggcguuucagcuacuggagagcacuggagagacccgcccugcgaaagacagcagugucugucuguugcuaugauucaaacauugucaacaaaagcaacucgaggaaggaagauuuccuucgaguuucauuuuuuauuuggcugacuuguguccauuacaguccaucaugaagucagcuuauaacucaggcaggaaccagagcagaaggcaggaaggaauguugcucugccuugcacuucaggcucaccuucaggggccguguaccucccaggaccaugccacucagguggcacugcccacagcaaucaggaaaaugcuccaccagacuugccugcaggccagucugauggagacauuuucucaguugagguuuauucuucccagaagacucuaguuugugucaaguugauaaucuaaugaucacagguuguuaaugaguuucuacaagaagcuuauagcagaucuguggccaugauuuuguuuaccuuuuccugccauccaucuguccguccauccaucuagccauccauuuauccauccaucuagccauccauuuauccauccauccaucuauaaucucucugcucuuaaauuuucugcauuucuuucuauuuuacuugcaaucauuugucaccuugacaucuuucaagucuuucuacugcuuuuauuaaauuucuuuuuuccuuuucuuaccccccucuuucucucuuuucuuuucuuuuucuuuucuuuuccuuuccuucuucccucccucccucccucccucccucccucccucccucccucccucccucccucccucccuuccuuccuuuuggggauggaagguagccacagagcacauguggagaucagaagacaguuugcaagagugaauucucccuuuccaccaugugguuucuagggguuaaacugagccaucaggcuggguggcaagcaccuucccugcugacucauuaccuuuccugcugacucauuccacaggccagaauuuucaucucucuuccuuucuuccuucuuccucuugauuuacccucucccccugacucuaaaaaaaaagacaaaccuagaaaugaucauaugaacuugguuggagauguucagucaguucuugguuuggcuuugauacccuacuucacuuuuugcuaaauuguugauguuucuguaguuuuuaauguaugugucaauaaauggaguggguauaauuauaacucuuagaaugugaacuacugugcaauaggagucuagaaaaagcugauaccuuuauuuuauucuuuuaauuauucaauugaaauuacccaaacuaguguucuauuaaauguuacugugcacgauuaaagcuaaaaaaucaauguauuuggaagcauugagcgaaaauagauagaauugcaguugaagcaccguggaggggugagccccucucuguccaguagaaagcucugugucuaaccuuugacucucccauggcugcacuaccuuaauugucugcuauugaccaguagugguaaaaagucacuaacauauaccuuuuugugugauuuuacuuacuuauauuuuauguguauguauguguuuuauuuuaguguauuaguauguaguaugugccugaauguaugucuuacaccauauguuugugguauccuuggaagccagaagaggguagcagaucuccugggacugggguuauagaugauugugagcugccugcuguuugaaauggaaccuggauccucuggaugggcaggcagugccuguaacugcugagacccuccuccagcccuguaacacacaucuuaugcauuacauauaagcacggcagcacagaacuaugugggaaacugcucaggcagagaccaccaauacaugaauccccacaagagccacagagaugcuuacagcagugaaguccguucuucauuuccccucagugugauuuccuagugcacuguacauuuguguacacuuugcccagcugaaauugacgcuauuuuugugaguacaugaguacguuuuucaaagggguuuauucuguuuuuaacucuguauguacaucucuguguuuaugugucuguauugggauauaggcgggugacugcagguaccaccccugaaggccagaagagggccuuagauuccauggagguggaguucagcaguugugagccaccugacguugugcucggaacugaacucagguccuguaagaacagcaagugcucuucacugaugagugucuccccgcccccacguuuugauuguuuaaucugugccuguauuguacuauucaugaccuguuuaacuuucucuuaaucuuguucgauaucucuuagcuaugcaauucgucuucaagauucuucaaauugucaaaaaucuacaaaaauaugcauagcugaaccuccgauguucaaacccaugauaugcaaagaucgccuguguaauuggauaauaaucuuccuucgaaacauaaauuucuuugauuuaacuuuuauagcaauauauuuauugguucuagcauauauguacuuguagauaggagaugugauccugaguaaauauauuuuaguugauucuugugauucugugaucuauuaauuaacagagauaaccuuauuaacaaaccuguguacaaaaucuugaaugcguuauggaauuuuggugguacuuuugaaaaucacuuacacugagaggacaguuuaaagaauguauuggugaggggguuuucguuuaauguggaaaugucuaucuuuguuauucucuucuagagccuuacgagagacacugccaccgagauagccaucaacgucaaggcgcucuauaaugagacagaggcuuugcuaguuggcagggucccuuugguaagaagaaaaaaaugaaugauggcuguucuaguuugcuucuuugccugugauacacuguggccaaaagcaaauuagagaggaaagggguuguuucaucuuacaacgcccaggucauccaucacugagggaagucagggccgagucccagaggcaggaagugaacagagaccacugagaaacucugcuuucuggccugcuuaugugcucaagcacagcaguccagaaccagcugccugugugcagcacugcccaccaggggccgggcccuccuucauuaguuagcaauuaagaaaaugcccuacagacaugccaugggaaauuccucaacugagguuccuuuuucccaugugacaauggguuugugucaaguugacaccugaagcucacacugagagucguccacgugguggaguaagauugccuugcuucauuagugagugugcacugagccaaccuccgaccuccauucuuggaccuuccuuucggucagacuuuugccugcaggaaagcaaugcuaaucucuagagcuauccuuaaggccaccaucuucucaaacuaucccucucucggccuugagagaugugagcuauauagguauaguagccuuuccucagcuacucacauuuguacaaacuuaggagaagucacagucccauucccccagugaauacugaaaauauuauugguauggucuucuagauuugcucuauaaacauucuauuucaagagcuguuucuauuuuaacucaguuugguccuggaaaucaaguguaagaaagugugaaucuggcuaaagcccacaggccugaaacauaaauacagcccuuucuguaaaaacaccugaauuguuuuuaaguguucugucacugaaucuugugaccaccuggaauuaggcauguagaaggccuaauacauuagcugucuuucccuuccuuguauaucuuugaaugacuccaaagcauuucuugucauagaagucucaucuguuugggcagauauaaaccaacauaaauuauguaaguuauuaccgauguaguaugugaaguggugggcugggaacuggagcgugauguccugcuggguucugugguccagcaggaugcgccacuggagucuccuuucugcuuaagaugcccagaggcucugugggguccauuucucuucaccaccucccagggaacugaaacacagcuuccuggaccacacaggguggccgucuccacuccugugacacagagcuaguagcuaguauugguuacuuguugguaggaucgguggaggccccgccuuggcuauugcugguacuauuauuguuaaucagaaucuucuguuauugcuuuuacaaaauaagccuaccagaaauccugugggcugugauuaagguuccaguuuucaaauugagaugugcgguuugcacgucacuugaaagacuuuuaaggucauuuaugauaagaaagaaauagaagcauaacuuuguccuuuacacccaaaguaucucucuugcucugauguauuguauuuagugauuauauuauauuaaaacauaagaaauuucuccuuccauauuuacuccucugugaucuucaaacauagacguuugguuugaaauauguccugguaaauuuuacccaaagucuuaacaauaauacgauaauaauuuauuauauuugagagcaucaaaguuuauuugucauuuuacuuccagagcaauugugaaauaccauguaaucaauuuugucagauauacauucuuauauuaaaagaaagugguaaauugucauacaauacgguggaaaaaucuuauuuuuauuaacuacugggagauagauacuuucaauauuacaaggaaucuacaacaaaaagaugcuuauuauaauagacaauaaugauaaccucagauuuucuuaaauucugugaacaucaguaucaguacugugggguuuuaaaauagucuagaaagggauugaguaggugaaagauuucucagaaauacucuaguuacauugugcuaagaggaaacuaaggugccugaagucaguuacucuuccuaaauuuguauagcuaguaaccacgacacgacuaaaaucucauugacugccuuccaauucugcacauuguaguaucucccucaaauauguuacagugaacaaauggccauuauauucuccuuaaagcagccacauccaguugcaaauuacuagcccuuuggcucucuccucauuuucauuuuuccuuaaacuuuuucuuuugauuugccaggauguauguguguguguguguguuuguguguguguauuugugugauguacuuuuuauaugauggguguuugauuaugauuagucuuuaaaacuuauuuguuuauggaacaaaucuauaagucagaagaauuuugacaaauacgacaguugacagauauguguuugcaagcagugaauggggcaguuaggaugggggaggggauggguaugagggccaagaagcacuaagcacaguaguuuuggaggggagauuauucagucgcuccaguuacauauaucgacucuggaauuaggaguuaggacagucaaccaguuuaucagaagggaaggugcuccagguggccuaguuguugugugaaguuggucaccgagucuugcuuuguuucccucucccccugcuggcgacuagcacuuggaaucuccucacgaagagcggguguccagugccuuacacucuguggagauggagcuucagaaguuaacggagauucccuggcuuuauuacauccuccgccccagugaggacgagguacgucacauccagccugucccuccgccccagugaggucgagguacgucacauccagccuauugaauguggacaguaggaccucagagucugaacuucccuuugaaaugagacaagucagggaagugaaguucgaaugcuucuuugaaauguuuugucauugagagaggaagggccuuuuugugaacgugggcauuuaguggaguaguacguguucaguaugcaagacccauuugugcuggcuaguuuuaugucagcgggacaccaguuagaauugguuaggaagagggaaccucgguuuaaaaauguaccuacuacauuaggcuauagggaagccuguaaggcguucuccuuauuagugauggaugggggaaaggcucagccccuugugggugaggccaccccugggcugguggucuggguucuauaagaaagcaggcugacccagauauagcugucucuugugagacuaugccggggccuagcaaacacagaaguggaugcucacagucagcuauuggauggauuacagggcccccaauggaggagcuagagaaaguacccaaggagcuaaagggaucuguaacccuauagguggaacaacauuaugaacuaaccaguaccccggagcucuggacucuagcugcauauguaucaaaagauggccuagucggccaucacuggaaagagaggcccauuggacuugcaaacuuuauaugccccaguacaggggaacgccagggccaaaaagugggaguggguguguaggggagugggggggaguguauuggggacuuuuuggauaguauuggaaauguaaaugaggaaaauaccuaauuuaaaaaaaaaaaagaaagaaagcaggcugaguuaagcccugaggagcaggccacuaggcagcuccccucuguggccucugcaucagcuccugccuccagguuucuaaccugacuucucagcgauggaagauaauauggaaauguaagcugagacuuaaauccuuuccucuuuguguuaaguuuggacuuggugucccaucgcagcaauacaaauccuaauuaggacaccauucuuaguuuauacuugcuaacagaguuuuguuuuuguuuuuguuuggcuugaauuuugcaggagccuccucuggauuguaccaaaagaaacaacaaaagcacagucuuucgcauagugccaaaguuuaaaaaggaaaaggcucagaaacagaaaacaaguucgcagccugguagguggucccacagugcgggggcggggauaacuugacgaaaaguuauuggugagggcaggggaauacucuaaaacuagguagggguaagcacuucccagcauuguaaguauacuaaauaucagcuaauuguauacuuuaaaaugguuaagauggcacauugaaccaggcaagccauaucauacucaauauguccggguaguggugagaauccaugguuauaaauggaaggagaagaggaggcgggcacuaaguuguuucuguucugaccaguugagucaauguguccauucaaaguagccuuuaucuucucaauagcugcuuuagacaucagugaauaacuucauuuucuucucagaguuaaaaaaaauaauaauccagauggcugugauaaggggagcauagacauuuucuuuuucccagcuugcuaaauauauguuuucacugaaguuucagaucccccuuuuuccuguuuuaaggacacaguuccacccuuugauaauaaacaccaaagccugugcuacuuacauucucagcaaaaccaagguuuucuguacccugcugcuuucccuagcuccaccccuuagagguuagcuuuaugcuaucuguaccuugggaguucuaugucuagaucugccuuucguaaugaaaucacuuuauaaauucuuagaagaauuucauacauucuuaggggaauuuuauaaauccuucugugguuuuuauaaacagugauauaaaaucuuaacaucuacaggaauaguuauugagccauguuuaaaaaccaaacauaaggggaaaaaaaguagguuuuugcauggaagauuugaaagaacaguuauccauacugaaaaguagcauaauccagcuaaucuugggcagcagccuggacgguuuuuuaaugacaauguagugaucuguggccauuuauuguugcaguuaucaguaagagucaguagaggaggcaacacuuagugucugcaagguuuuaagcauaucacugguaagaccaaggagcccagagcagauuuuaaggcuagaguuuguaguucauuucuaacuaaacacauucaccuguggucuuaaggaaagacaucggagcucauucugauuuuugcaucaugaaaccaccuggugacacaaaauuaaugcccugacacuuauugugugguuuugaugagaagcuggacuauggcugauggcgagggaggcaagggugcagguggcacccaucuuugauuagucauaauuguaucuaucgugggcacucuguaaccugcauggggaggggcgaggagcccccgucgaagcaucuucugucaccgucccuuugcuagcgcccccugcugucugucucgguuuucuggcugaccuuugcucuguaacgcaucgcgcauguagacauuaaggggguuuugcucuuaacuuugguaguucagaauuggggcacagaggaaguugcugcuuggcuggaucugcucaauuugggagaguacaaagaaaucuucauccgucaugacgucagaggggcugaacuuuugcaucuggaaagacgagaucuuaagguauuuuuuuuuuccuuugcgcuucucuuuggcuuuugacauuuuucuugcaaugcagaaucuuuccucccgugaguccucugucgugugcuuccagcuuggcuugcauuaugcaacugugcgcucaccccucacauuuguuuguaguccuugugugcuucugcagugaggaugucugcaguguuuuccugucaggacucucacaacagaagcacagcaccuugugaccucucucuguguccacuggcauggcuguuccuguccucacguuuucaagugggucacgucucuaccaccucauugugucgcagccgcacgaauggcagugacuguuguugguaaagacuaaaaaugaauggaauauaaaguuaacuaaaaauuaauguaaaauacaauaugagauuauagaugagacagcagugauaauuuagaguccucugauuuuacuguguuucuaagcugaacugugaagaucauauaaauaacuagacaguguaucaaagcuuccuucauggcacaguguuggugucuuuuuagucucaaaaggaaacgcuucauuuucuuaguaaauggagcuaaaaauaugccuagcugcuuucucugucauaggccagagcaugaaaaccuucacuggcgagcagcgauuccacguuagccuuuguguacagauucagcgguagaauagcguaagcuggguuauucugcccaggauuuaacgagaaugauaggagcuagagagauggcucgggcacuaaagcucugcuguacaagcccgggaacaugaggucagucacagcacacaugcaaacaacaacagcaacaaggcacgguggcaugcgucuuaaaccucagaacugggggugagcagagacaggaggauucccuagaguccucuggccagcucaucuagccaaugaucucuaaacugaaugagagacccugccucaaaacuuacagugcuggaggaagacacacaucagcuucuggcuuccacgcguacacacaggcagaaaaccauucguggugggugggaguuuucgauauauucucacagcaugcugccgcuuuacagcuccgcgaaguaacacugcgucacgaucccuuuccaguagaugguguucuagcaugcauagagguaggaccuuucagcgauuuguaacucuugugcuuucaucugcguaguuuaguggaaaucuuggcccuagugauggauaguguaaaauucauaucuuuauugcagaguuauacagcgcuuuagcagaucaaaaggagacuacugccccuaucugaacauuguuagcucugauaauaauaaaauaauagacagcuuauucuguuaguccuaacugaugcaacucaggauacacagugugagagcucauaaagcagagauugacuucaaagcuugaaaugaacgcauacccaugugcacacacaugacgcacacccagagcugucguggcuuauuauagcuaguguuugugugacuucuggcaaccuuggcagguugcacuauuuauugaagagccaguugcugaucaauggauuaugcuagauucucucagugucaucuuucuggacgcucacaucaugcauguucugaacuuaugugucuuaaaguacacauagaugcauccauguucauguucaugaguauauauacagauguauacucagcacauguguauauaugcauacacauauauugaauguaguaaauacuuuucaaauuaacauuugucugcauacgcacagacaccgcauuagucagagugaccugugggaggagaaagcgaguaugagaaggaaggagaaggcugaggacgacuuuacugaaccuccucauucgcuuuucauggcuugguuuugcucucuucguguuuuucaucccaguuauauucucucccuugccacuuuagaaaucuguauuggcauuuaacacuuuugguucugaaauaggguaugggugaugggaagaggccauuuuauuuuuuuuuuuacagaaggagccuccuggaacacaaagccacaaaacuggagagcugcuccccucuuucccgugugugagcuucggaagaggccgacccauagacuaguuccugcaugcuggggaaggguuaccuccugccgagucuccucccacacacccgcugcuucaacuccuguuuaugaauaugacagggauuaacagucuucucuaaccuugaccucauuagugaacuguaggauucuguuuccaaccggccgcugauacuugggcaucgcaaagggcauagaucuugcugugucccagagggacucucaccuucugccucucuccugcuuugucuccucaccagcucugcauuuugcugaacccuguuccuagccccucgggugcuggaagcggauaaacccagagucauauuuagcaucuuccccuuccugauccaccucgccauucuagccaaacucuuacguuguagauuccgcuccaucguugcucucggguucuucccaggaccuuccuucacgcugcaccccacaucccaccuuuccguggaagaucaucucguugucccucugacucuccaguuuagaacccaccacugugauguguugccaucuucaaacaaguucaugacuuuucugcucagggccuuccagaagcuucucguucuuaugagaacaguugcguccaucucugaagagacagacccaaaggcccugccuauuuacucacccucuugucccuggccucuuacuggaccauccacuuugguguccuggcuuuaaaacacuguuucugaccaugagaaugugugcucauggcuuaugucucacuaucccacacccaguuaacuccuucccacagcucagcccaagcaucccuuccuuaacaugggggauuaccaaacaagugaagauaacaaccugacagccuagcuugccuaugagaaacauuucuaacaugcuuuagcagaggaagaggcaggcagugauuuuuuuuuccccugcuggaacccaguagggaugcuggagaagauaagaugguaaaggcauagugggggguccccucccccagacacacucagaaaguuguauaugaguagcuagaaggauaacucaauaucuucaaaggaaucuuuggcaaaauuaugucuguucauccagagaaacaaaaagucaguaauaaggaauaugauaacuacuguaaggucuggagagauggagacugggcaggaaucuagacaaaucaaugauccccaggcucagagagggccccaucucaaaaauaagauggaagucaacuuaaaaagacacucuguguugaucuuugaccucuacaugcaugaacaaagcacauaucgaucaacacacauacaucgccacacacaaacacaucaaaaguaaguauacagugauaccaguauaugauaccugaugaacugagagcucuaucaaaugucaaagcaaaucuuuuaucauaaccuaacaauuagaagcugagaagauacugaauuuggucaaaguaaagagacuguagcuaccaagccgggauaacugugguacccucuagaaaauguuccucucauuguaccaaagcuguaauucugaggagaauaucaaaguaaagcuuguguucuggagaaagaaguguuuguauggccuaaaauaagauacuuaauauauuuuauaagcagaguauuauugcaacgucuaaagaauaagucugcuguucaaaugggaacucugaaauguagcauuuacauucuuuuugccaaaaaagauauuccauuuaaguguuugucuuuguaaguguaugcuauauguccaggugcccagggggccagcagaagucauaggguaccuggagcugcccugacagaaagauguaagccacuugacaugggugcugggaacugaacuugugucuuuugcaaaguggcaagccaacuuuagucacugagccaacucuccagucccauuaaaacacucauuuauauuguaaauuuaugcaacagauaaaaauuugggcuugcccucaaguuugguauuuaucacauauccaagaaaugugaaauagccuaagaacuaauuuuguucauccagguaguauuugagaacauuugguuuuuugggucaguuaaguuugauaaaaaauguuacccuagaauuaucucaagcuugaauugugcuggcuauagaaaaaaugguuuucuugaaggauuuagaaugguuauuauuacugcucuaaagaauaagagagaguguauaugcuguguccauguguguaauucaaaucaguuuggucugcuucauuuaugacuucaaaauaaauccagccccuacacuguagaacugugugaacuuucuuaggacauuucccuuuaguaauccuauaguuaacuucuugggggagugucuagcaagauaggggagaauuaaaauaagagaaucacuuagaagcacugagggcugagaccagcuagccuaggauguuuugcaacauaauuuaagcaacaagagagugagccucaaaaagugagaggagaaaaccaacucccaaaagcuggccucuggauuccaccuggucacuguggcaugugcaugccuagacucauucacguucacacagacacucacgcacacacuaauaaauaagauauucucaucaaaucuggacucaugaugcaaauacaaauaaauuuacaauuuaaauuacagguaguggacacugguaucuuccccugugaaaccucauuuuucuuuccccaaauccugcgucucauguagcccaggcuggucccaaacuugcuauguagccaaagaugaccuggaaauugguauccaccaaccccugacuaguaaauccuggaacuucaggcauguaccaccauggcuagcaggccucaagcuuaaguuuaauacagcacuagauagaaacaaagcuuaagagcuggguguggcagcacagaauuccaaagguugggaagcugagucaggaggaucacuaaguccaagaguaagcuggacaagguggcagaaucuugucuacaaaaggaaaagaaagagagaaagagagaaagagagaaaggaaggaaggaaggaaggaaggaaggaaggaaggaaggaaggaagaaggaaggaaggaaggaaggaaggaaggaaggaaagaaagaaagaaagaaagaaagaaagaaagaaagaaagaaagaaagaaagaaagaaagaaagaaagagaagaaagaagaaagaaagaaagauagauguguguguguguguacgugcgaguguacaugauaaaaaccugugccuuaaaagucugguuguccuccaucauuugccucagaucacaaaagagccaguauuuuuuauuugagagagagagagagagagagagagagagagagagagagagagagagagagagagagaggaagaaaccauauuaguuuugacucuugaacacuuucccuagcuguacacaauuugggaagauaucacauuuaagaagaguuugcauggggccugguaucguaacuuaguuuucuaccugucacuuccagagcugaucaauaugaacuguuaauaaaauguguauaugcuaauuaugugaauuacuaguugaaaugcuuauugguaaacuugucuuuuguuuuuuuuuucucccucucuuccuuucuauuacuuuuguuuuucuuucuauguuuccuuuuuuaauuaauuuuuuucucuuacuuuuucaggaccuggggauuccgaaagugggucauaugaagcgaauucuccagggaauuaaagagcuugaacggaacccucccaacuuggucugagggguggucacacuggugcuauuucugggaagagaaguccucacucaccacucaauacagaguccuuggaagccgcugccuguuguugugauuuacugcacagauaagcaccucugaagcaccucucccgacugauauuuugcugugggugaaaguuuugauuugagguauuagaaaauaauuuuugugccaaaaaaaaggccauuccacaaagccauguucucauugugcaaaccugacaugcuaaaaaaaaaugcucacaguaguggaagaaggauuagacaugauugccuugucuaaaaaguggacuuguuugcccaucauccagugagggucuuuagaucugggcccacaggagguuccuaugugugccugcaacuguguuaacaguaugcagcuggaacuucgcaggcuucccagugaaggcauuggcuccucucuagaagucacugguuaggagauaaagauagggguuguacuuuuaaguuuuucacccuaaguucucaguauccacuggucaaaaaauacggugaaaccaacccauagcucacuaugacugaugcaaaucugaugcacgauguuccuugccugaguugucuuucuuuuucuugcaugucauguauauuauuguaauauuucaauagcuuugauguuuauuauaaugaaauuuaauuuauuaccacccaacuacccaagcacuuuuugguugguuaagggcacuuuggaguaaauauuccauaccuaagagucugggaauguuugucugugccaugaucaacaaaugauauacaucuuaugcaaaccaaauucuuugccuguuccaaacuacaggugugcacauaaggagaauucuuggguguuuucauaagcuuacauguucugucaccuaugaaacuuauuccagcuuuccaaaugcaaauucccacauuuuguucccauuuuuuucauaucaguuuaauaaccauuuugaguuucugcuugcacuuguaagacuugacauccaggaauuuuucaaggucguggcugagaucccagccugaguucuggggacugaggugauuacugacaggacucaccaauagaaggaauuucauuuuguuucuuaagggcuuuuuguauuacuaacucacauuuugauagucuauccaguagauauuauuucccuuuuucuagaccauggcgugucagugucgcucaauagaaucaucaaguauuugaaagccaaagguauacaagucaaaaaaguaagaaaaagaaaagaaaagaaaaaaaaaaucucuguuuucuggucauuauaugccaaaaaucaacuguaauauuugaaaguuguguauauaagagaagcaagcagggcugcugacccagugaaggcgguuuugauaguguagccugccaggugcucaguagauaaacauacccacacaugugcacacacgugucaugcuuccuuaccugugugcacgcacuuacugacaugcauugucugggcauacagugucccugcuacuuucgagacaaucauuuccccaaugcuuaguguuucguuuuuacuuggguauuuacuaggggaaaaaaaauccccaaauugaaauaccuuaaaaauaaaugaaguucaguggcaaaguguuugcuuaggacaggcaaggggcuuggcuccacccauagcagagcaaaauccaaagggaucaacaggcaaaccuagugcguuccugaccauguaaguaugucucacauuuuacccagguugugcacaauggacacuuuccaaagauaaguccuaucaagacuuuugagcugaaaauaaacgaaucacu

SEQ ID NO: 7602 - RNA, 897 nt, Mus musculus
ucuuugcagaggcuacugaggcccuuggcuccuuuauuuuugcagcaaacaaggaggcuuucugcaugugcaguuccauuucauagaugaggcucaaggaggcucagccagaaggcgggaaacaggguaaacucuuggagaacucugaugcccgcaaagacacuuccuugggucggguugucagggugguagagaaagcggcggguaaauauuuggggcgguauccuggacuccggcgacacccgucacugcgguucuucagaggccagcgcguggcuagggcggugccgggaguaggggguggagggacaggggcguccccuaggucgucugggacuuacucagcagccccgccccgccccgccccugccgguggcuauaagacggaguagccggcggguggcgcggcucaggcgaguagcuagcgcucaggcucggcaaggagcaaggcagaggcaccggagcagacugcagugcaggcggcagccaccagggccaacaccucgcagcaucucugcuacgcgugucacugagcaacuucuccaugaagccgcccucagcgcagagcagucccgcggcggucgcggccgcaggugagugccuauuuggaggugucuucuccaccucugcgccccgggaucgaagccagggacugcguccacgcuaagcuacacucucagcuccggggccccugagagcuggagccugcaaguaggggcgagagaacagaggucgcuaaggucuucuuccacugcccacccuucuguccuccaucacccuggcaucccgucuccggaucgcucguccgaugcagguuuaguuugguuuuccacgcgggacaaggaaccggagucugacacguaacgggugccugcugacucagacuucccgccgcca

SEQ ID NO: 7603 - RNA, 56595 nt, Mus musculus
cuuuuuuuuuuuuuuaaaucagugucucaacacguaucccuggcuggacuggaauuccaucuauagagcagacuggccuccuauucagagaucuucugaagugcugggauaaaagaaguguaccaccaugccuggccccauuuuauacuuuuaaaacaccaaagaauccuauuuacuguggcaccaaagcauaucuggaaguugguuauugacagucacauuuucuauaaacuugaaaagauugagaugauuaaguuucuacuuucccaaaaaauauuuuucuaguauggauacaaaauaauaaaagauauaaacaagcaacucugcaugaaauaauuuauuguagcauugucuagguuggcauuauuuuacagugaucuuuuuuccucuucaauagcuaugaaucuaagaaauaaaggaaaaccacuuuaauuagaacugucuaaauaaaaucaucucucuggguuuauaucagguagauuuacagacauauugacacugagaaauggagugauuccaugauguagauauggcaaaaagggcuccccucaaauacuguccaacagcacuaugaguuaauaguuuaauuguaguuuaaggucucaucugagagaucuaaaacuucacugaagggcugugagggagguagugcuguguucuaguguguacucugccaaguccuccucccuugaagaaaaccucucagaguagcugcuugcuaagucuccaagcagcucaaccacgaaaacacaauuccuacccaaucgccuguaagacuagacuacauacacaacaaauuuaacuguuaaauuuacaugacuaagaggcaaaccagucuucacauucggaaucaucaacauaacacugguguauccuuauucaaccauaaaguaucacuuuuauggcuaugacaaaggaaauaaucauacaaguuaagguaaaaaggggacaaaucacauuaucgaccaaaaugagaaauauggcuauuucuuaacauucaguuaacccuucaaaauaaucaaauaaaccagaggucaaaacagauucugaaacuaggaccuaaagaaaauagugucagaaagcugucuauaccuuaaucagcaacugaagcauauaauacagaagcaacaacacucauaauucagaaguauaagacuguacaaguauaaacaaguaccuguaacagauguccauguaaauugaaggccagacacagcauaaaauaaguuuacacaauauuccauuuaaaacuucuauccagagccgggcgugguagcucacaccuuuaaucccagcacucgggaggcagaggcagguggauuucuguaggccagccuggucuauagugaguuccaggacagcuagagcuacacagagagacccugucucgaaaaaaccaaaccaaaccaaacaaaacaaaacaaaaaacaaacaaacaaaaaaccccuucuauccaaauauuuuauuuuacgccaguuuaaaauguacagugaaaaagaaaccugaugugaauucagcuuugagucuuaggagcaacuucccacaagauucaaauuucauucauuaagagcuuguggucagcugugugguucagcucagcacugagaccgagggcuucccucgcagcaggcaggaaagcaggugugagugggagcaggcuauggcaggucuuccuauacucuucauauugggagcuacaguucccaaagcugccauccaggagggccucagacaccuuuauuagagucuauugacacaaggagaaaagaccaauuguaaaaaaauaaaguagcucagcuaauaauuuuaaucaacagagacaacuuaucccacagagagacugcaguugcuucuuccuaucuacaguaaguaauuauuucaaauaaagaaggcuaaacucuagcucugagcugguuauggaggcccagcgcucaggagggugacgcaggauuccaauuucaagugcuguguaaaagggcacucaagugucucuccggaugagcuaggaagagguguuuacuucgugcuuugcuauuucaguuaacuauacaacagguaucacuuccacacccauaacuggccucaagucacacgcaauaauggauagaggcugagcgcuuugacccacuuaaaacuauguuguagagauauauguuuuguuagaucuugcaagaccuauaaaucaagcucugaagaaucuuaccuucacauuuuuauuuuuuauaguuucauccaaccuaguggcuguagcaauugcuuuuucuugccuugacuuguccagaaaauacaucauuuuagcaccugaaauuccaagacauuauaaggaugaguaacuccuaaggcuuacauuucaucugacuuauccugaccacucgcauguggcuacaguguuuagucacucaguggugggcuagagcuggcagcccccagcuuuaggcagccaacugugacauuucuuccuauucagaaacaucucauugaaccuuucagcuacacugagacgaauuaccauggcaaauaucagaagagaagguaagagccuuugcuguucuuacagaggauucagguuccguucccagcaccuauguagcagcucggaaucuguaacuccaguuccagggaaucugacccccucuucuggucuccacagacauugcacgcgugugcaucaacauacauacauguaaacacucauuucacauaacauuuuaaaaauacauuuuaaaacaaaacacguuaucaaaguuuuuccuucacaguuauuaaacacuuacugaaaaagccuaauuugacaauuucugugcuuagaaacaguauaauucaaaacauaaacucacagggcuagccucuaucgucaaucauuucagguagaaacacuuaaacagcauagcaccuuaaguaaggcaucuacagaacaaauuauugucaugaagguauacaugcucacagaaagaccucgccacacgcauagagaaggggauuuaaaauaaaacuaagcccgguuccagcaugucuuacagauauggccuagauucacagucccacuguagucuuauuaauguacauuaauuggcaguaauuuguugagaaugcuauauaauauuaacuuacaguuacaaaauggucuuuugacuuuguuuuauucuuauaugguagacauuuuccuuuuccuuagaauuacauuuaauauuucaaaaucaauuucucacaauuauuaaaaugcuuuuuauuauccugguuuucuaaaaauuacuacuuucaccuauuacuuuaauuuuuuuuauuauuuuuaagauaugugugugugucucuguguggggguuuaugcaugugaguagaaguagccagaggccggccggagguguucaauucucccuggagcuggagugaacagguggcugugagcugcugaggagaugcugagaaucuaacucagaucaucuggaagagcagcgcauauaugcucuuaacagccgugccaucucuccagccgguccucuguucuuaaagagaaauucuucucugcucuuucugccuagaaauguaauuuuuauuaauguaaguauuucuuccaaacaugucagaauggagacuucuccucuaacaacaaaauucagauuaaaaucccgcccccccccccgccccccgccccagugguacacccuucguuugucuucaacuccucuuccaucagcuuucaacaauguugccuuugauacuuuaggcccucguguaagcugccuaaaauccuuuccauaacaagacaggauacaaagaacuuuucaagacaaaaaguacauaaagcaaggcuaggaaugcagcccagcucauaggaugcuugccuaacuuagcgcagucuccagcacugcacacaacuggauguaguggcaccggcuacaaucucaguacucaggauguacaagcagugagacguucuaagaaguucuagguuaucuguggcuuaagauauuuaagacacugaaaugauauuaaacaauccauaaaaauacaaaacaaaacaaacccuaagagcaauaaaaauuugaggaaaaaaauuuacucauaauccaaagucaauguaaaguuuugguauaaacuuccuuucagacuuuuucccaggcauauuuuuacacaguugagauuuauuguuugcuaauuucuacauauguagucuaagaguuauuuguaaccagguaggaguaauccaccacuuaggucaaagcaggaagacuaagugcaaacucagcugcuuacuagguucaaagccaggcugggcuacacgagaccuuaucucaaaacaaaagaaacaaacaaaaaaaacgaaagcaauuucuagggcuggagagauggcucaguggguaagagcacccgacugcucuuccgaagguccugaguucaaaucccagcaaccacaugguggcucacaaccaucuguaacaagaucugacucccucuucuggagugucugaagacagcuacgguguacuuacauauaauaaauaaauaaaucuuuaaaaaaaaaaagauauaauuaaaaaaaaaaaaaaacgaaagcaaaaaaggcuguuacucacugguauuauaaauuguuugaauaaauacugcuuuaaaugaccacuuggcauuccauucuaccauugacuacugguucccauaucucugaacauauuuuaguucauucucuuucccccaaauuuacauacauuucaguagauaucuuugcacugaaagcuuucuuugcuuggaauaauuugguuugagccagggucuguguauauaacugacaaaggcuggccucaaacuuaucauccuccugcaucagcauguggagucccagagauuacaggugaaaauuacuaccccucaguaguaguuggauuaaguuacuuacaaaaguacaacuaaagaaucaaaagacauggguaaugugcaacuuuuaaaaaaauauauuuuuauuuguauuugugugugugugugugugugugugugagagagagagagagagcacagagagagagagagagagagagagagcacuggaaucccugguggaauuggaguuaaggaugguuguaagcuaccauguggggcucugaaaacuaaauugggguccucugcaagagcagcaguacucuuaacugcugagccaucucuccugccccuaauguguaccuuuuaauaaaauagaccaauugcuuuccuaagugacugugcgaaccauauccaagagugcucuguucuccauuuuaacaaggacucucugguugauuaaaaccuacgacuggaacugugcuauuuuccuuuuucuuuuggaaguuaauuagacugaguacuuuuccaaauacaaaccugcaaguagaugcugaagagagguagcauugugucugaggaaauccucauuaaagcugugcaaaucuuuguugacaaauaucuucuucauuucuugagcuagaacuuugcucacaaugucuggaagauuacugugauuagagacuacaaaaacaaaaacauugggauuuguuuuuaaucugaaccuggaggagguaccaacugaaagauuuuuauacuuaggauguuaagcuuaauguauguguaauauuaauauauauuuauauaauguugauauauacauauauauuaaaauuauuacuccuuuggaacauuaauagucuaguaaaaaaugcacuaauuauguaccucauuguuuaauuacagguauagcaccauuuaaguaucaggcaaacguuugguuuggcuagaucucugcaguuuccucccuguccagcuaaauggaagauggcuuauauuugcuucucauaguugcaugcacauaaauaucuuucuuauacuuaccagauuuagaaaacuuaaucaagcauucauguaaccaaggauuauuacuuucaauggcaaaggcucguuuaacagacugcaacauuagcaaaaacuucccugugccagaaaaacaaaaugcagugugaguauuuguguuaucuucacuuaaauucaauuuaagaacuuaauuuuaaaaaaacacaugagaagaauuuuaaacuaauuugcauuaucuaagacaauuuucugcuuucugaagaaaaauuuuaaaaauuguuucacauaaaugucuuaauuggguuucuuucuauugcugugauagaacucacgacuaaaugcaacguggggaggaaaggguuuauuucaucucauagcuggaaauucaucauccugggaagccgggguaagaucucaaagucaggaauccugaggcugaaauugaggcagaagccauggaggaccuuuacuuacuggguugcuccucaugguuugcucagccugcuuucuuauaccucaaggaaccaccagucuuugcccacagugagcuggacucuuccagaucaaucaagaaaaugccaaaaggccaaucuggugggagcauuucucaugugggacucccuccucccaaugacgucagucuaugcugacacacaauuguucacaauauucucacacuaaauuuuauuguaauauuuuaauauguaccccugcaaauuuuugagcaggaauaugaaagggaauugaaccuuuguggaaggcugaaauaaagcucuaaaaaccaaaaauggaucuaaaucacaaaacugguaucuaauagucaacauuauaacucacgccuaggccugugcagcucagugacaaaggagcacgggcccagccaugugaggccaggcuucagucccucuacugugaaaaacaaaacaaguaacagucauauaacaaaccucaauucaaagcaauguguuaccuuuucuaaaauauauuucaaaggccagcagguggguaucaaugcucucagcagcaaggguuuucagaggagugaggaacuugauggcuucuucuaauggauugucaaccuauuuagaagcagaaaggaaaacuucuguuuuugaaaagcaaguaacacaagccaaaucaaaucuacauauacagauauauaacuauguguacacuuucuuauauagccaaacaagcaugaaacauuuuaaaauuaucaccuauaaaccaauucaaaguacauggccaggggauggagagauagcucagcuguuaugaggacccagcucccagcaccaugguaggcagcucacaaccaccuguaacuccagcuccaggagauccaaaugcccuuuaccagccucuauaagccaccucauuccauacauacauaaauacauaaauaauaaaaugcaucuuuuucuuaaagguacaugacuaauaguuuucaaaauagaaauagcuacauuauuuuuauaacuauaaagucaggguaguuuuauacaaaucaaaaacuauuugaaauuauuccacagaauuuaugaaauuauacaccaaaaacugguaaugccuuauauauuacaaaugucaaaaaucauaacuggaaaaaauguaaugaaaaaucuuaaauauuuauuaauuuaugagugaaucaaaguuaaaaauuccucuaaaucugguccuaaaauaacuacuaacaucucgacaagaucuuggggaugagguacuguuuuuagacuagaucaucgucuuaguuuggguuuuacugcuggaaagagaccaaggcaacucuuacacauaaaacuuuuaacuggggcuggcuuauagcuucagaaguucaguccauuaucaucauggugguaagcauggcaguguccaggcagacacggugcuggaggagccaagauuucugcaucuuuaucaaaaggcagccaggagaagaaucucauuccacauuggguggagccuaagcauuagagccacaaggcccacccucucagugacacaauuccuucaacaaggccuccuaauagcgccauucccugggccaagcauauucaaaccaucacaaccauuuauagaguaagacagauuaaacccaugauuauagacuucauagacuauuauacugcugcuacaaauuccaaaaacugggugucuuuuuaaaaacuccuuucaguuuuauagauuauaagaccacacuggucaaagugucaggaagacugcauucccauucauggguucuaggaaagaauccaaauccacgcuuuuuuuucuacuucuacagguggcccaugcuccuuggccauggcccucucuuucuacuuuaaaagccagcaacaacacauuaagucauucucacagcacaucacccuaucccuguaugauuuucuccacuuaugacaggucgugucugaccaggcugcgauauauggacauuucagaccaaucucaacuguccccucuccuuuuuauugaaaagacucagcccaccucacauaauauauccugauuacagauacccccacccucucuccucccaguuccucuucaucuccacucuaucuagauccacucccuuucugucucucauuagaaaauaaacaggcuucuaagagauaauaauaaaauagaauauaguaagauuaaacagaaauaacacacuggaauuggacaaaacaaacagaaggaaaagagcacaaaaaacaaacccauucauucacucagucaggaagccauaauacauacaagcaaaaagccugcuucaauggcuggagucuuaagcuaaucucuucauuguaaaaucagcuuauuacaacuuuaaauuucacuugauguccuaauuucccuuugccauguacacacauucuaggaauuagaacauaccuuuaaaugagccccuacucuggccuauaauauuucgauauauaauuagcauuugucaaauuuuugcauauuuuggacauugcauauuaccacaguggcucuuauaugacuugaaauauugcaaguagcuucucuuuuauuuaagcauuuaaauauauuauggccagaacagaaucaaauagcauaaauuuuaccauaaaaaauaguuauagacucaacuuacccuuucuaguuuuucaggaauaaguucuuccuuaugaccacugguaacuucuucuucuucuucucuuuuuuucuuuugguuuuucuguuggcguucccuuucugugugcuuucucucuucuucuaccuuagccuuuuucugagcucuucuuugcuugcuaagcauuuucuucauuucuuuggcugacagguuuucuauaaacauucaaaugugcaaaacgugugacugucaguuuucauuuuuugucuuucuuauacaauacacuauauagcuuucuuucgggaagaaaugggaaaucuaaaaccuauguaaaagguuuuaguauguuugugacuagccaaaacauggcacacaaaaggcagucaauaaaaguugguugcauuaauaacuaaaaguaauuucaacuaagcucugccucugugauaauucugugucagcuugaaacaaucggcaaucacaagacugucuagcuucgguuggcuugugggaauaucugugggugacugucuuuccuggguuuguaucccacacugcuuacagaggacagagaaccaaguaccauguguaccaguguaugcacucgcucuguucuugacuguggcuaugaccagcuguuuuaaguuccugcugucuuugucuucccugcuauuauccuaagcuggaauugugaguuaaaauaagcccuuuauccauuagcugccuuugccagcauaguuuaugacaacaauaggaaacaaauacagucucccacacaauagaugacaggaaaaucacuuugucccccucaguuucaaguugcaaaacauguaccgacuaugcuuugggaugguccaagggugagagaggauguauguaaugaaacuggaacuuccuaucuacuaucuacugggccucuguguggacagugguacugacugacugauaagcaacaaaggcaaucuuacuuucaguaaaacagauaccagaaucuguaagaacguguauuuuuuucugagguacucaaagcuuuaaaaauuauauaauuaucuaauuauauaaagauuuaauuacauguaauuuauuagugugcuuguaggaguagugguagagaggagguugagaaugggggugcaugcccuccugcgugugugaaggucggaggaauggaauugguucuuuccuuuacagggguuucaggaaucaaacucaaaucaugaggcuuguaugguaagaguugaucugcugagucaucucaccagcccucaaaagccuuuuucucacuuaccauuuaaugaaaauaaauagcacacauuuauacucuuucuuaacugauguuauuaaaaacaaaaccacaaagacagggcuugaugcugugacuuauaccucuacggaggcugaggcagaaacaucaagacucugagggcagcugggcguuaagacuggggugggagggcgcaguaaguccucccaugcagcugacggagauguaacagcuaaagaacaucagccuccucagauaaagaggagcuuuacuucaaguuucucuggcuuuuuccuaauguaucaaugcugucuucacaugcaccugacaacaugucuuuuauugauauuucaguuauucaaacauuuggagugaggcaagacaauuugaucuaguagacaguauaugacugaucaggguagauaacauuuuuauuuccuuaaacauguguugauauacuuuucuauuuaauacguuaauaucugauaauauucucaaguuuaguauucuuuuuaaaucuuuucauuaccugaaucuaugucuuguuguuugcugucauugguuaaaggguuaucauguaauuucaaauauauuucaauugcugaucuagcagccuugaaauaaaaaguaugucuucugagagcaucuucuaaucucaagaggccaacauaagcacggagggucaucuuucucaugcaguauguauggaagucaaacugaucaucgguuaucucaagaaaaugcuuaaaaacaaaaccacaagauuaucccuuacauuuaugucaauaccuuuuaccuuuuaaaagaaaacuauauaaaaaagaaaaacuauaaaagcuuccagaacaauacagucaauuucacuugguugcguucaacuuauaguaucauuuuuuuuacagccacaaaacucuggacaucucaacuuaacagacuuuuuuuuauaauucauccuacuuccugauaauacaagagaaguaucagguuaucuuuaaacccuggaaauugguuauguugauguaguuuaccucucuacucaaauaaaaaacagcaagucagaccuaaacaacccugaaacucacugcaugcagguucacacuacauguuuacacaucagauucaucucauccucccugagcuccugugagggcaacacucacccuccuucccacggaguguaacacagcacaguaccuaccaacuggaagaaaagagcuucucaggcgcaagccuuugauuucuuugugccuuaauuauuuaaucuaagguaggaauaaaucuguagagcaguuucuuaaggugacugacaaagcaacacauuuuaaaguuuauucucauuaguaaagugcuauuacaaagacagcauuauaacuuuuucuuagugaagaagcucucauuaacauacacacauacaauaaauucuuuuaucuuaagucuuuguuauaacaaaaauaguaacuccuuccuaagaaguaaguucaacacuuucgucuaauuuccaaaggacucaccaccccaaccccaaagcuuaaguaguaauugcuuucaugaaaagaaaauucaccuccaaaaugcacacaaaacaauuuuaugauuuaguuuuuuuucuccccuacauguauuuguaccucugcugccccacuccacuuugguuucuccaaacucauacagaaaaaugacgugcuccauagucccucgggggaggagggguacugaggugacggucuaguaacuaugcagaggacacauuauaucaauuauuccuagccacuugauauuuuuagcuaucuugguaauuagaaacaugcuauauauacagaaucacacuaaauaccuaagaguuuaagaaaagaauucuauaaagaacaaaaguauaacacggaggacaagcaacaggaaaaaaauucauauuaguuacuuuuuagaaaaucauguuuuaaugacauacuugaauauuaaauuuucagagauaaauuaguaaguaaugacaucaauuuauuuuuuuaaaaaucaaaggcuaacauauuucauaaugguguuagugcuuuuucuuaauguaaaccaggcuuccauaagaguaacacacugaaauccagcacagcuggcuaagggaaagagcaaugcuccaucaugacacacgguaagaugaaaacaucuaaggcacugcacgacauucuuuaggcugagacacacaugagggagggaugacaagcuucacaagguauuucuggaaacagcaguagacauggauuuuaauucacacuucagaaggaaucuggaaccacaaacgcuuaauccaccucuucaucacuaacagcccacaggcugccucucuccaguugaugucuuccauaaacugggugaccaacuuagcccaguuuaccagaagucuucccaguuuuuccaguuaauacacugugucuaggaaccacucaaccacaggcaaaccuggguguuuauuuacuccauauagcuucugguuguuuaaaaaaauuuaaaagcuagauaaaaucagaaaaaguagacuacuacagcuauagcguuugauauuuugcuuuggaauaaacggggguacuacagaauacuacauacgcaauaaauaaacaaucuuauccccuuucucccacugccuggcagccacuguuggcagauggucaaauuaggcuugacugugaacuuugaagcuagcacugacuacauagcaagacccucucucaauaaaaaaaaaaaaaaaaaaagagagagagagagagagaaacaugggcuugauuuaagacuaguugucaagaaauuaggaaaagcuccaucaaaacuuuagaauaugacuuuauucaggaacugugugaugcccucuucuagccacuccccugucuagaaugucucugaauccuuggcugagacaguuaagaacuuaaaacagugaaaacaacaaaauguuuguuccuaaaaauugugaaauggggaggggacacaacugggaggaguggaggcagggaaacaguugggaugaaaugaacugcauggaagggaggguggauggguggguagauggauagauagauggauaggauaagauagauaggaaggaaaaacccuuuuccucuaaagaauuugugcuuauaaagccugugaaaacuuaaaaaagaugcaacaugucuuauucugccagaaacccucaagugaauaaacaguaagaaauaauauauuauaugcaauauauacugcccugaccugaauauaagccaguacacuaaaaagagaucccagucaguauuuagaaaaagaaaaauaauuuagaauguugcugugaacacaaguuuauagucaguauuuugaagacagcuguuuuguuuaaaaaaaacaacaacaacaacaacaaaaaaccuuaaacaucggauuggacugggccacaugaccuuuacagauaaucuuaaaauccacugagagggccgaaaugaagacagaaaagguauuauggaccauuccagaaugcuaaaauuucaacuccaauuucuaagaagccacaaaagcaugugaaaacugaaacugcuuuuaaucagaguucuugauugaaauuaucuauuuaaaacuucuauuuaaaagauaaaaugcaaaauuuuguguucaguauuuauuuccuuauuaaaauauaagaaagccggguguggcggcacacgccuuuuaaucccagcacuugggaggcagaggcaggcggauuucugaguucgaggccagccuggucuacaaagugaguuccaggacagccaggacuauacagagaaacccugucuccaaaaaaaaaaaaaagaagccagguauaaauuaacuuaugaaguaguuauaaaucaugucugaaagaugggugugguggugcaugccuuuaaccucagcacuccagaggcagaggcagugggauuucucaguuuaaggccaacauggucuacacauggucuacaugaaagucaggaauacaugcauagugagacccuaucuccaggaaaaaaaaaucaucuuugaauuuuauacuuuuguaugugcacaugugggcauacaggcauucuugaagaugcaggaggucagagaacaaccuuagaugucuguugucaggugccuuugauucacacaggguuucucacuggccagaaaugugaucauguuggucaggcuagcagaucccguagcuuuuguggauccaccugucucuacaauccauucugucacugcugggauuauagaaguacaucauucuaccauacuuuuuccauggauuaagaggauccaaacucaugaccuuacacuagcaagacaagugcugugguguguguguguguguauacacuuuuuucucuguggguucauguagagauauggaagacaggaucuuccucaacugucccccuccuuuaggucaucgggacaaggugacccugacccuggagcucacuauuucagcuaggaagccccagggguccgucugucucauccccucagaugugugccucuaugccugguguuugcuguuuguuuguuucuguauuagugcuggauauuucaacucagaccucaugcauguacaacagguaucuuaaccacugagccaucuccuuagcacccaagccuggaaaucuuuccaaugacauucauaauuuucuuucaauguauuaacuuuauuagaaaucagucaguaaguauuuaauguacuuauuuaaacuaaauacauuucuacauauaugcaaaauauacguauuguucaugaguaaagccuuuuuauuuuuaguauuaauauaaucauuacaaguaccaugagaaguggcacuuuucucauguuucagauucuucauagagugaaaugccaauagcaaacucugaauaaagauaguuauauuuuuaaauaaaaauaauaaugccacaugaccagaggguguugauuucuauauuuuaaucucugguaauuaauguaacucucuccuucaaauauacuuccuuccaauuaaauuauuuuucaaacuaaaagucauuuaagaauuucauucauguuacucagccaaagucacuauaaacuuaaugauacacaguuacagaagauauauuuaacauaaucuggcaauuuaugaaauacugaaaauucauaaagugacacaggaauuaauauuaagaaaagugggacuuaagucacaaagguuccaacuguaacgauccuacuaacauuuaaauuaaaccucuacagaaaaauaaguaggucccacugacaauggggcacaugaaauaaaugucuuuaagaggcaguuuaacuggaagacauuagggagcacugacacaaccuacuaauauucaguauuuuucccugcuagcuuuuguucuuuuuuuguguuaugauuuguguucacauuuguauaugauggcauguauguggaaaucagaggguaagcuggguucucacauuccacuucguuuuguuuuguugguucuuucccauuuaugcauuuuauguguauguguguucugccugcuuguaugccugugccgcaugugcauguaugguguucaugagguguggucagaagauggcaccagaugcccuggaauuagaguuaggaauaguuucaaaccaccaugugggugcugggaaccaaacaccaguccucugcugagccagaaaucucucuuuauuuaagggucucuuuugcugucuguguacuccaggcuagccuggucccacaaguuccacaggauuuuccugucuccaccucaucuccacuucccaacucaccgcaguuauccugggcuuacagacacaccaccauguucuggugcuagggaccccagggaucuguguuccagucuccaggcuuguacaacaagcacauuuauacgccaaccaucuccugucccuuuuuugcugugacauggucuuacuaugucacucagguugaccuugaauaccacuugcaacucaggcuagcuucaaacuuaugauccuccugauuuuggccugcaccaccagcccuaacucuguccuacaauuucaccauacaaacagguacccgauuuaaacuauaauguuuggauauuuaacauauaauccaagaggcuuaucguucucaaauaggaaaugacaaaucuuucuccuauaaauacaaauuuaaaggacaagaaaaaaaaaacaaagcaaacuuuggugauuuuuauaaagguucuguauaauucuaaguccaguucccauggaaagccacccccuaggacagagccuucuucuggguaaccucaggaguuucacaugggaagaaggccaaagugacugccacggcagacaucaggcucaccugacuacgacgccuguggguuuauacugcgucagcaggggaagaguggugccgagugccccacaacugagggcugcugaggacugccucaggggugcauuugcggcuccuuuccuccugugguccauguagaaggagagugcuucagagaugacaaagaacaggaaaacaaaaauucacacaaaggaaaagaaaagugcccucacuaaggcauaucacacacacaauucuaaaagcaaguaaugaaauaagccugugaacuggccauuugauguacaggguaccaaacugaaaaacaacacccugggaagacgaacuggagagaggcugacuguggaccagauccuggagcuuaaggggaaagaggcugccugccaccagcucugcguccucuuaggcugcugaugaaaaauuaaguaauggccggaucggggaagagaaacugugaauauaugucaaugauagcacaaacugcuuuuacuaaauuaauuguuuucuuuuucucuucagaaaacaccucaaaaguaucaagaaaguaaccauuuacuccauguuguacacaguacuaaauaucaaacgaagcugucagagucagucaggagaggcagacgauccaguguggccuuguucccgcuuuccuugucacucacagaagaaagcagaacccacacccuaacaacucacccucucuacuucauggcacuuuuucaaggcauccccauaucuccccaggcgcugauaggcagaaaugcacuccgucucaaaccacauacacugcauuucauucagauucuccauggcagauguuccuuccuaaaauggaaaugugcauuuaauaaauauaaagcagcaagcaauaaaacuacuccccaaguuacauuuauaaaaaaaacaaacaaacaaacaaaaaaaaaaaauuuaaauuuaaagccuuggguucaaauccugacaagaaaaagucacuuuuucuuuuccaacucugaccacaaguauuaucccaauaaauagcaaugggcauaagugacauuaaagcuugugauauuuuaaaaaauguauuaauuuauuuuguauguuuguauauguguauacauacaaggcacaacacuuuuggaggucagaggacaauuugaaggagucaaugcuuuucuuucaccuuugagucuuaaagaucuacuugcagguccuggcagcaagcaccuuccucacugagcccucucugcagcccuucacaguggucucacuuacucggcuccacgaguguucaugacucuuacagaacggacuccagauuacuaagacuauuuuuaagcaucaaagcucuuauuuuaacuacuuucacccucguuuucuuucugcuacuucacauuuucuugcugacucgaggucacuacugcaaaggccuacuacuguugccaugcuucucaguccacuuuuagguucccgcccugccgcugugggcuaagcuguuccucugcucaugccccugcaguuucauaacaagucucuuacuucucuaccgccccucugccgcauacuauuaaaagcaagcaacacuggacauggugcaugccuaucaguccagcaccuaggagacuaaggcaggaggauuuugaguuuaaaaccagccugaggcauaguaagacagaaagacagagacagagagacauacacagagcgagguaucccuggauuuguuacaaauauuuguuaguucagguaaguguaagaacuuuauaaaaaauauauauaacuuccuagcuucaauguagggcauuauauuuuugucauugguuggaauauuuacuuuaaacauuuguuugauuauuuaugaaaacauuuucagucuuuggucccguuuuagcccacuuucuauuaucaguucaauucuuggaauucauugaaagucuaaaacuucccuaugcuuaggaggugaaggcaagaacaugucaguguaaggcuaccaugagcuuauacagcaagagccugucucuuaaaauguauuaucuucagauuuaaaagaccuuagcucuccuuuauagaacuauauauauuucccauuuucugaugacucuaccuucacaaaaaauuuuuuucaugguaaagguuuaccauaaagaacuacuaaauaaggcuuuguaauucucuauaauucuaagcuguacauaaacuguaaaugugagcauuucacucacucacuuacaggcugaucuguuucucauucuccuaugccccugaagauacauacuaguugucuguuuaaauugcuggacugaaauuuaacuuacauuuuauaaauuaauuuuucauugguuauuuuauuuauuaauuucaaauguuauccuccuuccuaguuucuccuccacaaaccccuucuccccucuccccccucccucuaugagggugcuccuucacccgcccacccauucuugccucagugcccuagcacuucccuacccugggucauugggccuccacaggaccaaggggcuccccucccauugaugcccuacaaggccauccucugcuacauaugcagcuagagucaugggucccuccauggggaccuugguuggugguucaguccccgggagcuuggagggguguggcugguugauucuguugcucuuccuauggguuuacagacuauuucagcuccuucaguccuugucucuuucauuggggucccagugcuuaguccaaugucuggcuuugugcaucugcaucuguaaacuucuaaucccuggggccuucaccuuccagauaggguuuucucuaaaagccuaaugauguuuaugccuguuugcuuuagucucuucuaaccucgacaucugcgaugauguaggagaaaggacacugaaccacagcgcugcucaguaugaccagggauggucugcguguccucgccagcuucaaugucugcucuguacaacagcggacaccugaauaugugcuaugugaacagaagcaauguuacuauucuuuauuuauuuuccuccuaauauccauuaauaaccuucucccaauacugcuuguaccauuuaguuaugcuauugagucuaugacaucucagcuucagaaacacuacuuacuauaguuucggcuaugauuauauaauuuagcacaaaaaaaucccaugggcuuagaaucaaagauuuccaaugcagaguacuggcuccaaaugacaacuagcaagguaguuuguccaaggaaauuuuugacuucuacacauuuuaauuguaucauuuaauugacaauacacaaaaaguauugauuaaaugaaauaauguauauaaaguucuuagcuuaguacucagcauuaaaguuauuuuucuauuucccuuuauaaauaaguaaauuauuagcacugcugcaaauacuguauaucagggcaauucaucuaaaaaaagaaaagguuauuuuuauagcaaacaaguuuucuuuaaucaaguugagagugaaaaagugaaacagaacaguguguguguguaugcauguuuguguguguguguguguguguguguguguauaaaaaucaucaaaucgucugccaauaauuagucauguuagacuuuaaaauucagucuauuuuuaugagcacaaaaugccuagugcuuuaaucguacuuugcugguuacuagagaagacaaguguuagcuauucacgaccagccugggcuacgggagucugucucauagaguuaaauaacuaaaaaagaugauaaaguauaaagcggagaaaguuaggaaaacaguauauuaacaacauagaaauauaaauagauagauagaaaacauuggugguugaauaaaaauggcccgauaagcucauaguaagugguacuauuaggagguguggccuaguuggaaaaaguaugucacugugggugagcuuuugaggucuccuaugcucaagccagccuagcaucacucucucuuccugcuaucugcugaucuggauacaaaaggccaacaucaugucugccuguguccugccaugcuccccaccaugaugacaauguacuacaccucugaacuguaagccagcuccaauuaaaugcuuuccuuuaauaacagcugccgucaucauggugcuucuucacagcaauauaaauccuaagacaaaaaccuaaaaugaaugaaaaaaccuuuuccccucaucuaugcugucuugcuccuuuggaaaauaaagaaugcuuccccuucaagcaugaagacuacucuguagccugaacagacuucugcuguaucuuuccaaauaucuaagaguuugcuuucuauacuuagcucucugguccaucugaagcugguguguguacagucuaagcuauggaugccauuuaauauguuucaacacaaaugacuaucucugcaauuucaucuuuauuuuuaaaaguauaauagaagggauaauaaaggaggaaaauauaggacaaauauuuagcuaaacaguuagacaacuuaaauugaaaacugucacagaaaacacacaggaagaaaucugagcaauucugaagaugacuuaauagaaaaugaaagagauaucauacauuauagaggagacagauuugagauacgaucuuuuuuguuuuguuuuuuuccgagacaggguuucucuggguagccuuugcuggccucgaacucagaaauccacauggcucugcucccaagugcuaggauuaaaggcgugugcuaccccuggcuuaugaacuaaauuuuuaaaguuuauuuuaaggcauggugucauuauccaacccuagaucucacuaugaaaaccagcguggccuugaauucacaaagaucagccugcuucugccuccugcgugcugggauuaaagguaugcacuaccauacccaacacaaacugaauuuugcagccaggagcacaaaaacaucauggcaagaagccauaguuagaacacagauuaaugggauuuuaaaaauagguuauucuuaugaauuuaacgacaaacuuauaucagagaacuucgauuuuccuaacucaggcaaucacauacuuauaaguuauuuccuacccuugugaaccuggagcacauuuccucugcuucuuuuaucauauuugcucgaagcauguauuuggcacauuuggaauugaugaaccugucagccguguccaaagacugugccucauccauccacugugcggcuucuuugagauuacccauaugcugcaggaggaggaaaaccacuuaugagcaaguaaaaaggagugucacagaaauggaaaacaauguauaaaaauggguuccaguuugacaugauuguaucaguuuaccuaaaaacuaguuaauuaugauuuuacuaagaacugaaccaaauggcuaacacugauuacacaauaaagaauucuuuaggauuauuagaauauagaaaaaacugcaugagaauucuaggaguuacugcuacuucaagucuuuuuuaaaaugacccaguuccugcuacccaaaaaucaaggggggcuggagaaauggcucaguguaagagcuccgacugcucuuccagagguccugaguucaaaucccaacaaccacaugguggcucacaaccaucuguaauuaaaucagacgcccucuucuggggcaucugaagacagcuacaguguacuuacauauaauaaauaaauagauuuuuuuuuuuuaaaaaucaagauuaaaaacuuaccuuguaaauuuuugcuuucauguagaauaguucuauuagaguuggaguacuagcaauuacagcauuaauauauuccaaagccagaaaauacugcccaaguuuaucauaaugcugugccaggaaauacuggacccagauuagaguuguuggggguuccuucuccccguucucugcaaucaaacaaauauuaaacuguuauaggaagaaugcuaaguaaguguucucuccccaguucaaaaugaaaucaauugcuauuauuaagagcaaaagcuuagcaaaaaugaucagucucaacaggaagagguaugacugugacaucaaguucaaagguaaauaaagucguaguuuaagagacuucuaaccccuaacuacuuccaaauaaacagugcuagagagaaacuaucuaucuaauucuggccgaaaaaaaaugcagcgaaccagaaaaauaauaaagaaaaaguaacuuggagaagaaacuaccuaucacugcaugacuucagcagaagcaagaacugccauaucacacacugcccacauguacaaaacaugcuucucgcaaguagacaacagaagcagaugaagguguuccaaguuuacaaggguuaccuugucuaguugucucaauuagcauagugugaugguuuguauaugcuuggcucagggaguggcacuauuaggaagugugaccuuguuagaguaggugugucaccaugggcgggggcuuuaagaucuucauccuagcugccuggaagcuggucuucuagcaaccuuuggaugaagauguaagacacucagcuccuccugcaccaugccugccuggaugcugccaugcuccuuccugucuugaugauaauggacuaaaccucugaacuuggaagccaggcccaauuaaauguccuuuuaagaguugucuuggucguggugccuguucacagcaguuaaacccuaagacacauauauaagcuuuaacacagccagagcauccuggcucuggugaagaauauggugaagugaagaagaauauacaccaugagauuaaaaaaauaaauaaauaaaaaccccugauaugccagaaauccaaaauuagggcacaaagcccaaagucagcuaacaaaagcagccacauagcauacauuauuugagcucuauucugcuccccauccuguacuaaagaagccaucaaaauggccugcacagaauggcagauaugucuacagugaggcagagugaauuuaccuguguuaucucaacagaaguauauguagccaacuaaucaaaugacaagauaauaaugccaacacauuaaaacauaaaucagaaagcuguggugguuugaaugagaaugggucccaauacacucauauauuugaaugcuugaucuucaguugcuaaaacuauuugaaagaauuaggagguaugaccuuguuagaggaccuggcuuaaagguuucaaagcccaugccauucccaguuagcucucucugccuagugcucuuagcuacuacuccagcuccaugucuuucugccugucugccaugccuguuuaccauguuucuugucuuaauggucauggauuauaaccuucuggaaccuuaaacccauccauaaacccauauuaaauguuuguugucuuuguauuguuuuagaaguugccuuggucaugguguuuugucauggcaauagaaaaguaaguaggaaaaugcaaauaagaacaaaaaaaaaaucaaauauuuaucuuccacauaauucaggagaccaaaauauauaaaggaagguuucuuaaaauaaacucagaacugggguuguaagucaguggcauagauaaggcccuugguucaaccauaaccugcccugcccagcugauagguggggaauaaggucagaggaacuuuauaacgggcacauagccugauaagaaacccagcuuuagagauaaucagaacgccucaagccuucugauaugauguaaccucaaacacaaagcaccaucuaugaaguauucaaacaacugaagucuauuaaucucauugccaguguuacaugaaguagaaacagaaaaacacagugauaccaagagaaagaaaucagccaaaucccuaagaaagaaaacaaggagagucuacaaaacaaaugaacuuucaacaaaaagcauuuuaucuuaaaggaaggagagaucauaaaauauauuaaaaguacucaaaacccaucaaauguaaaccaugggccuuaacuagaucuagauuaaaauaacccaacuaagcaucaauuuuggacagcaggagaaaaauauaagugugggcagguauuggauaugagauuaauuuuguguguuuuaaagaaagaugcacacuaaggucuuuacagguaaaauaacaucuggacuuugccuuaaaauaccugaagguguuagauuggaguuaggagaaauagcucagcaguuuagaguacuggcugcucuuccaaaggacccagguccaagucccagcauccacauggcagcucacaacugucugaaacuccaguuucaaaggauuucauguuccuuucuggccuccauggagcaccucgcaugcaggcaaaacauucauauuuuuuuaaauucagaaaucaauaaacaagaaacuccaaacuccaaguggaaugugaaaaagacacaugaagaaccuaaagaaauugccccauaccuuaagcauucuacaggauuuucuaaauugucuuuguuuacauaugucuccacagaaaaucaaagggccaaaucaggcaugacuaaaauuaauaaaagaacagaagaacuuaaggauucagugaaaaagauucuaauucaauuuaauacucaaucuuggacaagccauucaaccucuuaaguugaccaaguuaacuaacuaaggcuaauuaacucccagccaaaaaaaaaaaagacuauggaaauuuuaaaugaaauaacacuaaaaauacuuucauucacuaauucaaaacuaguaaguagucauuuguguagcacacacauaauaaauguaaaauaguauuucugugauuaaaauuagauugaaaugagcaauaaaauuccaauuuagucuagguuaaacuuaccauaagggcuaaaauagccauucauuuuaagagaggcuucauaauuaguaacaaguuccuggauuauugaaaccuguuaaagaaacauauuuuuuaaauuuuaaaaacgcuucacugaaggcauuuuuauuuguggacuaaucugacuggaacaacaauuuacauuuuacuuuuauugauaugugugugucuauuuguguauaugagaucugugugcggaugcuuggaaagacugaaagaggcacccaacccccugaaacuggaguuaagacagauucacaggaacauguacaaacacuacauauacaaacaauacauacuuuucaaugacuauauuuuguuuacuauuguuaaccccaguaaagaacagaaaguagaaacugugccucuuuugaacauguaugcugggaaccaaacucagguccuuagaccaaacaaguguucuuaaucacuaaaccauuucuacagccccaaaacaauacauuucaaaaccacgaguuaacuaaacuagagguaucaaaauacuauuuucucuaaucucccaaucagaacauuuagaaaacugagaaaaaaaaugcauugcugucuuuacuuauguuuuuagagagaaaaaaaaagcaaaaacaacuccauaaauucucaucucaagaaaaagccugagguuuuucuaguuuguuugguugguuuuggugucauucccuugccccagcaccagaacugagaaucaaaccuaccuugggccuucaaagugaaccuagggucuucaaagcaucuacaugugaacuaggucccaauuccagaauccugacauucuuuaaggacaaauuaccacaguuaggggaguggggguggguggguaugggggacuuuugguauagcauuggaaauguaaaugagcuaaauaccuaauaaaaaauggaaaaaaaaauuaccacaguuacaugauaauuaaauugucuuuguuucccuguuuuggccuguaaacuuagaaaccacuauaaaaaugauuagauuugccgggcaugguggcgcacgccuuuuaaucccagcacuugggaggcagaggcagguggauuucugaggucgaggccagccuggucuacaaagugaguuccaggacagccagggcuauacagagaaacccugucucaaaaaaccaaaccaaacuaaaacaaaacaaaccaaaacaaaaguuuaaauuuuauaaaaugucacuacuuauaaaaaagugaaaugauccaaaguuuacaaguuuacacauuaaaaaugacagcuuggucaguagaaugcuugucacauuuaagcaugaagagcugaguucaaaccccagcacucacagagaagcuggcaagagcaucacagcuggcaucuguaaccaccaaguugcugagguggagacaggaggauucauggaacucacuggcaagcagucuagccaaaucaaugagcuucagguucaacuagagucccugucucaaaaauaaaaugauagcugggcggugguggcacacgccuuuaaucccaguacuugggggcagaggcaggaggauuucugaguucgaagccagucugaucuacagagaguuccaggacagucagggcuacacagagaaacccugucuugaaaaacaaaacaaaacaaaacaaaacaaaacaaaacaaaacaaaaaauaaaauggagagcaagugaggaaaagacauguacacacacucaugcuccuguaugcacaaacacacaggagcauguacacacaggagcauguacacacaggagcauguacacacauguucacaggaacauguacaaacuucauauacaaacaacaaacaaaacauaguuuuaaaugacgguacucuuuuguuuacuacgguuaccucuggcaagaacagaaaguagaaucugugcuuacuacaauuagagggcuuuucuucucauuuccuuaucuaaaugcugcuaaaccaaggucuaagacaguuuacuauuuuaugaaaauuggaacuuuaaaauauuuggauuuucaaaacaauuaaauuuguuuucuuuccccaugccucucuuauuaacuaauaaaaauguacuauuuacacauuuccugccagugaagaauagaccaugcaucauaaaauccugaguagguuuugguagauauggcugugaggaaccuucuacaugcaugccacuaagauagaauaauuuaauugucuucauuuugaauccaauuaaucugcaucauacaaagucacagaauagcauccaugaagccaugaaucauaucacugguuaaaaauuccacuguccaacccuuuaccaaaaaugggugagagggaagccaaaauaaaacacuucucauguuacuauacaccuguccaugacucuaguuccaggagaucugguuuccuuuugcaggccucuaagagcacuacguaugcauaguacacauacaugcaugcaagcaaaacauccagcgcacauaauaauaaaauaaaaugaaacaaaagcaaacaaaacacacagucaagcauaccuagugaaaaugugguauuaguacaaacuagcuaaaaugauucuuuaaagacaaagaguguuuaguuuaaauaacuuuguuuugguuuguuuuuaauagagucuagguauauaggacuaacaggucuggaacucacuacauagcccuggccucaaaaaucaaggcaaucuuuccuucucauccuucuaacugcugggauuacaagcaaguggcaauagucccacugaaccacuauuugaaagagccuuugaagcuggggagugugugugcauguaagccuaaucuagguccucaggaggguggcaagcuugagacccacauagacuacacaguaaaugcaugccuugaaagaggugucucucugaugugaaauccaaaaaguugacuucgugggaguagaauuauuuucacgagagguccagaggaguaaggaaggguagguugcuauaacagguacuggauacagacaggaagauguggcaguuacuggaacagaggagaagaguaagucuacugcucuaacacuuacuaaacuguguauuguagccucuggggucacgaauguggaagacucaaaguguuugguaauauuuaaagguuguugaaugugcaaugauaagaaagaaagaaagaaagaaagaaagaaagaaagaaagaaagaaagagagagagagagagagagggagggagggagggagggagggagggagggagggaggaaggaaggggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaagacagacauacggugaauacuagguaauuguuaccauacaacaagaacacuuugcacugcuaacuucaucacacuacacaacggcaacaaaugcuaucuaaaacaccuuggcucaaauucaagacaacuauacuauaaauuacaguauuuuuuauacauaaaaaauuucuguucuuauagcaacauuaugacuuaaaugcaaaaagucauucaauauuucgccuaccaucauccuucggccucuagggauggaauguuaguaugucuuuggagucuauuauaagaauaaauuuuaaauugcuauguaagcuacuggcaugauuuucccuaaaauaauaauaauaauaauaauccuccuccuccuccucuggcugcuuuuccaaaagucugaguucaguccaagcauugguucaggcagcucgcaacccucuaagccaguuucagggaucugauguucucuucuggcuucucugagaacuauguaugcacguguuucacagauagacauucaggcaaagcacccacauauauaaaaauaaacacaucuuaaaaaauaauucaaugaauuuuggcuugagauuaggacaaaauuuccaaauauuucugaaaagccauaaauaugcuucugccauuuugccuuuuacauuuauguagaacaguauucacaacauugacaaauauaaagccaaacuaccaaucaacugugaaacauggcagaagguaagcuaaggagauggcucaguaggcaacccccuucgccacucaauccuuaggacucacacacaagccaggccggggagccugugccugugaucuaaacgccccaugaugagaugggcggcagaagcaucacagugucucauuggccagccagcaugguauacacagcuagcaugguauacacagcuagcaugguauacacagcuagcaugguauacacagcuagcaaugacaacgauaagacacuucucaaacaagggaaagggcagagacuaacacaaaagcuacgcuccaaccuccauacgcaugccaugggauguacacacucacacacaucacaaacuaacaauaaguuuaaaagaauuguguucuauguccuccaguaugaaauauguacugaagauuuaauccuuuagguaaaaacagagaaacacacccaucauuagcaugcaaauuugcucucauuuuaaauaaacaauauaacuauauauggacaaagagguguuguuuuaaaauaaaugucaacauggcuuauuaucaguaaauguuugaucuacauacuuauuuuauauacuuauaaacacaaaggucaguaaaaacuucucaggcaaaagggggucacaagugaaaaaauucacggaucccugcuuuacagguccuaacaauuuacuauauuccuucuaaaacuacaagacaggaguuccacauucccuaacacacaugguucacuuagggagccagagauauuaauuacccuauccagucacuagauauuguauguauauacagaacugcacacuguacuucauauauaugauagaaaauauccguauuuucuaucaguaaaauaaauaaaagcuaacucucaauuuuaucacuauuuauuuuucagaaaaauguugaaaaucaaauaagcucacgaugcuggguauaguggcauaugcuuuuaauuucagcacugaacaaauaggagcagguagauuucugugucuuucagggcuacuuagugagauccuaucuuggauggauggauggauggauggauggauggauggauggaugggcaaacaaguaaacaaauucaugaucugaaaauuaauagaauuauuuuguuuucaaaggaacaguucggaagguggaauccagggaucauuaucaucaagacuggcccuagggauguacauuuuuaaaaaauauuuauuuguuuaauguauaugaauguauaucugcauguacuucugcauguuagaagaagguaucagaacucauuauagaaggucauaagccaccauguggcugggaauugaacucaugaccuggaagagcagacagugcucuuaacugcuaagccaucucuccaguccaagauguacauuuuaaaaaauauuuauuuugggggcuggugagauggcucaguggguaagagcacccgacugcucuucugaaggucaggaguucaaauccuagcaaccacaugguggcucacaaccauccgaaacaagaucugacucccucuucuggagugucuaaggacagcuacaguguacuuacauauaauaaaucuuuaaaaaaaauauuuauuuuauguaaaaguauuuugucugagccaggcauuguggccuaugcuuuaaucccagcacccaggaagcagaggcagguggaucucagaguuugaggccaaccugagcuauagagcuaauuccaggacagccagggcuuuguccugacaaagaaacccugccucaaaaccaaaacaacaacaacaaaaaaaaggggggaaggguuggcuguauguauguauguauguauguauguauguauguauguauguauguauguauguauuacagggaccagaaguagguauugguucccuugaaacuggaguuacagauaguuuuaugcuacuacauagguacugaaaccaaacccaggucuucuacaagaacagucaauacucuuaggcacugagccaucucuccaacccccagauguacauuuuuagacaauccauacagaaucaaaaaacagagaaauucgguucucucuguuuaacaagucuucuaguuaaaacauacacaagaguuugagaaccacugauacaacaaauuuaaagguagcagacaucuuuuaaguagcauaaccaucccacccaucuuucuuagaauacuugcaacuuaaaauaucuuucaggcuuagaaauuuaguguucaaauuguuuuaaguauguggaaauuauuuuuguuuucaauuaacuuacacugucaucuagugacugguuaaacacaguagcuagcauagauuuuuuaaaaaacaauuuuucauauuuauuuugugugugugugugugugugugcacacuaguauuccuuuccccagucaagaauaacauagcacacguggaggcuaucugaaaagccuccaagcgucuccucuuauuccaucacaugugucccaggaaucuaacucugguuauuaggguuguuggcaaaaaccauuaaccugcugaaccaucuugccagcccccaaacacggauuucaaauagaauuuaccauacgguucuggacuaaagcacacuuucugaaccaauuuuaaauaacuuaaguacaacuaacuaagggauguggugaacaggccuuuaaucccagcacucaggaggcagaggcaggucucugugaguucaaagucaauauggucuacacagucaguuccaggacagccagaacuacauaguaaagaaugcaucagaaaauuuuuuuaucaaaaagacaauuugggacuagcaagacagcucagugggucuggacuugccucacaaguucaaugucccaagucaaccccuugaaccuaugauaaaaagauaaucaacuuccaaaaguuguccuuugacuuucacaagggugucuuggcaugugcacaccuguacucauacuuuauacacacaaaaauaauuuaaaauuuaaauuuuucucauaggagcccacuucauuucacuauuucgauaucaaguagguaauauguaaaaaucagcccauucauuugucauagacugaaagcugccuuugugugugaggugugugcuguguggcauaugcaccugugugaaggugcacaugaacagagccagaacaaggcaucuggugucuuccuuugucacucugccguauuaccuuuagacagggucuuucccaguaaaccagcucaccuacugugcuagacugugggacacugagaauuugagaacugugggaaagcacagccauacuuagguuuuuaauuaggugcuggaauucaaacucagguccuucacuuuaauuccuaacugaugucacuccuggaagacaacagcaauuuuaggaaggagcuaugugggaggaaaggucucuggcaauguaugucuuucauagucuacugagauuccagcccuuuccuuccccuuuuccguuccugcuggccuacaacucugcuuccuuacacacucccuucaccaagauguucaguuuugccagagccaagaaaccacagaccaaaccuuaaaacugaacccaaauaagccuuuccuuaucugaagcuauuuaucacugguauuuucucagugauggaaaccaacacaauguuucaaacuuuucacaaacuuuaaaccuucuaauucuaaccauccucuccuguuaaguauuuucuccaagcaguuauauuugauuaggacuaaagaagcucuauuaaauuuauuauuauuaaauuaaaagaaacucuacuaaagcuucauuaaaauccagccugggaaaguaugugugccuguugcagagauaacuuccuaaagcauggccuuugaccuauggucuuuaugacuuaagcucaaacagaugagugacagagucagaauucccaacaagcuauaauuccacuaaaccagaaccugccuacaaauggaacuugagacgacuguuguucaguggggaccucaaggcuucaugagccaaucagauguucuaaucacugaucuuauuugcaacauuuuauuacucacaaguauuacuuuuaaaaauacgggugaaaccuaaauaaccugauagagguuugaugaaaaccucaauguccaacagugccuuuuaaaauguuugacuauaaaaaagaccagccacaagauuucagaccuuaguaaguaagaaacaaugcuuaggaauaaagucuaacuuucuuccuauuaguccuuuccccuuuucaguggggagggucuauguuccaugaguuaagucucagauccugagcuaaagugauccuccugcuuugucucccaagcaacaggaacugcaagugugugcuugcacccggcuuuccuaucagagucuaaguauccauuuaucuuucaaauugacagcucagacuuaggugcagaggcaguuucuuuaccauacuuacuguaugcagagguacacaaggggaggggagagagaaugaaugagugugugugugagugugaugucugugcauguacccuguuguuugaaaccugggacuaguuacuuaugcgaggccacuuggcacacgagccccaggaauccccaccuccccaguacuagacugugcgaccacguccaccuuugcacguacgcuacauagcaagcucuacagugcugaaugagcgagccucccaacgccuaacacuacugcaccuauuaggacucaaccuauuaacuaaaacuagcuguucccauuccacugaccuaaugguauuucacugugaaauucagcgauccaugccaacuuugauaugauuacaaacuggggaaaauuaaaaaaaaaaaaaaaccaaaacaacccuauacugugaaauauaugacuuaugaauagcuaaauauaaaguucuaauaauauguuuguuuuguuuuguuuuuuuuuuggggggggggggagcaggucucacuauguagcccagacagaccuggaauuaacugugaaagucgagcuagcuucauagucuugccaguucuucugccucagccuuucaaggacuaggauuacaaacgugguccaucacauccagcuguguaucacuuuucuuuuuuuugguuuuucgggacaggauuucuuucugcaguaguacuggcugacccaaagcuugcucuauagaccaggauggcccugaacucaagaaaucugccuaccucugccucccuagugcugggguuaaaggugugcucagccuaucucagucuuuugaaaauacuuuacuuuucucuacacuuuacagcaccaugcgcaauuccuuuguuaucacuuauaccauaugcauauacuuucgguauacuuauaccauaugcauauacuuucgguauacagaacugauaugucagguacaacuauuuaguauagaagauaaaaagggaaauggcacaauagagaaaauaauuaaaucauaacauaguuuauaaaaaucuugcuauaauaauagcaaaucugcauaaaaaccaaacuuaccuuuucuguaucacaauacaaggauuucaaaguagugaacagagguggacacccuuugcuaaaguuuggucucaggaacuuauccaugaguucucgaaacuucuuaccuagagauaaaagcaaacugugguugauugagucaacucuucaagaucugaacagaaagccccucagagcaaugacucugcaagcagacguaacccaagucagcgccaccuugucacauagaaagcaauguuccaggugacauguccccuaauguccauaaggaauucuucagaaacagggaaaugaaaugagucuuaagucuaauuuacugacuacuugacuauaaccacaacuagucuuccuagucuccccgaguauaaacuugguccgaauuccuaaagacaacugauaugguguuugcacauacucuaugucaguacuacagucaagaaauaaccgaauuaucuucugaaacacuaaagugguaucaccaauuucacugucuguucacuucccaggcauguaucaggccuccuacuacacccuuagcauuauucagguacugguaauacagcaaucauuauuacaaaaaucuaaaaauauuuaccacagagaacaucuucuagagacuaagaaugacacugaaagaauguuacagauuauacugaaaugaggcacuuagcuaugaaauaauaagcacccuauuuacaacaucaaagaaguacauucccuauuauugcuaccuguaacaaaaaugucuagaaucuuugguuguuuuaugagacagaagcgugcuguaucucaaucaggagaauagaaguuacuuuuacagacagacagacauaaaacucuagaagaaaaagaaaacuuaaaacacuaaugguaucuauuaauuucaaaaguacuauuagcauuacaaagauauccuaguauuaccuggggcgaaacucagcggcagccuccugggugaaacugcucuggggugcugcuugcugacuuccucauaaagcugaagccucucgucuagagaaccuaguaucgguaaaaaggugaggucauagcgucguaacuuuuauguaaaauagcaaugaacuuuaagacaaaaauugcauugucaguaucaaagcugcucacaauuuuguacaaaauuacauuuaaaacuguggugguaaaaauacuguaaucaggaaaucaucacccuggauauguauauguguguaggguggguguuguuuccugguuuguuugguuuuuguuuuuuuuuuuagacagggucuuacuacauaacccugauugacuaaaagcucccuacugaacugcucccaaauacaaauaauaggauuaaaugcacgugccacuucuuaaaaugauccuuugaaaucaaaucuccaggaaacccaucucuucucgacugcagacuacacaccacucaacuaaaccacuuacaucaagucagagagaggcugcauuucucuucuccuuaacuuccaaaccguaaaaaagaaaaucacuuuauaacauacugucuguaauauaccuuauauaaauccucuaaacuaauccucuaaacuaacggggccuccccuaaaagucuacaauaccuauuaagcuuaaguaacaguuuuaagaaauauaguuuaaaaaugaacuauauuucucaauuucuuugacacuuaaaaucuuuaaugaaauucuauaugaaacaaaacaaaacaaaaaccuuauuaaaagagauucuuuauagagguaacagagauggcucagucacuaacaguucuuguuucucuugcaaaguaccuggguuuaauucccaguacccacaugguaucuguaauuccaacccagaggaccuagcacccucuucuggcaucuuugagcaccagguacacacauauaugcugacauucaugcacauaaaauauaaaucaguuuaaaacaacaacaaaaaaagaauagauucuuuaaaguggaaacuauuucucccaaauaacacaacagaugugauaaguuccauccaagaaucauuuaauuuuuagugccauaaagaaaauccauacaagaauaacauacuauauccagaauaguaacugugugaaauuccugcguaauuuauagagauacuaucauguaucaaucagacuaccuauaguaauguuuuaaggaaaaaauaaacaaaucuauugaagcuauaagguuuuaaguauauuauaauucagauaaaaaaauguauuuuuaagaauaacccauagucccaggcaugguggcacauuccuuuaaucccaguacuaggaaggcaggagcagguggguaucucugauuucaaggcuagccuuggucuacacaggaguuccaauacagcuaagguuguacuggagauacuguuucugaacaaacaaacaaauaaucuuugguaaauugcaaacaaguuaucuucacaguaaaugagcuauuuguaucaaaauuauaaaagauuguauuuggcugagcguggugaugcaugccuuuaaucccagcacuugggaggcagaggcaggugaauuucugaguuugaggccagccuggucuacagagugaguuccaggacagcgagggcuauacagagaaacccugucucggggaaaaaaaaaaaaaaaaaaaaaaaaaagauuguauuugaagaggcaaucugguaagcuuugaauaauuugaagagguaauuuguguagacucaugacuucucccuauacuauguuuuagagugccaauaugguuagacuauuuuuuuuaagauuuauuuauuauauguaaguacacuguagcuaucuucagacacuccagaagagggcuucagauuucguuauggaugguugugagccaccaugugguugcugggauuugaacucgggaccuucggaagagcagucggcgcucuuaaccacugagccaucucgccagcccccugguuagacuuuuuaaaauggggaucucugccaaauuuuuuuugcauauucuguuaacaauuuagagacuucauagaacauuaaggaccuuuuucuaaaauauauaaugaagguuacuaaguauauuaagaaaaaaaaaagauaucucuguauugcauuccagguaaaacaagucuuacauauguagcuaaauuaguauuaagauauuacuacucuagcgcccuacuugaaguaacaaguuggaacuacagaaguuaccaugggagugggggaacaucugaaagaaucuaaaaacauagguaguauaaguagcuuuaaaagcaauaguuuggggccgggcgugguggugcacgccuuuagucccagcacucgggaggcagaggcagauggauuucugaguucuaggccagccuggucuacagagugaguuccaggacagccagggcuacacagagaaacccugucucagaaaaaccaaaaaaaaaaaaaaaaaaaaaaaaaaaaaaagcaauaguuaauacuaucaaauaucuuaagaugugaacuauggcacacucauuuuacuaaaacauuuaaggacuucauuaucaauugcuaugucaguaugguaguuaaccuucacugucaacuugaauggguuuggaaccaaauaaaacaaaccucugggagguuaaacagacaagggaaaauccagagaauaugaauagcaccaccccguggguuggaaaccaaggguaaaaagagagagagaaggggaaagcuagcugaguacuuauaaaucaccuguuuccugucacuagccaccuuacugucccacccccaugccuacaaugggccaaaauaagccuuucuuguuuuuaucuagugacuaagcauuuguuaauaacuaggcguuuaaagacaaaagccauagcuauuuuagauuuccaaccugaauacauguaauuuuuuuauaaaucuuuuuuuuuaauuuauuuauuauuauacagaaguacuuauguagcugucuucagaugcacuggacgucagaucuuguuacggguggcugugagccaccaugugguugcuaggauuugaacucagggcuuuuggaagagcagucagugcucuuacccacugagccaucucacgagcccauacauguaauuuuugccuuguuuuuuuuucaaacaauauucaauuaauauuuuaauuuuaauaauuuuccuaaaaagaucuauuuaaagaaaaaauuuaaaauguuguagcuauuucagacauacuuucuguacauaaauagcauuuuaaauugggccuggugguaugugccuauaauccuagaaccuggaauagaagaauagagcccaaggucaauccaguuauauaucaaguucaaagacaaccuaagcuacaacaccuugucucaaugaaauaaaaugaaauaaaauaaaauuauaucuaugauuuuaggaauaguaacugcuacuaucaacauuuaacucuacaaauguuaaauaaaauuagaaauaacaaucucaggaguucuuaaaauugucacagcuaucuaauuucaagauacauauuuuucauucucuacaaacugacuuggcuugaaagagaaugauuuuuauauugccuuucuauacuauagaaccucagugaguauucuuucacucaaucauauuuaaagucuaagauaacaaaucuuuagugauauaauaauauuaauuauaauaauauuaauuaugccauuuuccagaaaggaaaugcucauuuuccucauuucucuaguuagcuuuucucucucucugugugugugugugugugugugugugugugugugugugugcgugcguuucugcauguuuauauguguaagugcaggcauguacauggcaugguaucuauaagaggcgaggggacaaucucugugucaguccucaccuucuaccuuguuugagacagggucuacuguuuacugcugcauacaccagacuaucuggcccacaagcuuccagagagaacaaagguuaccaaguccagauuuacaugcguucuggauaucugaccucaggcccucacacuuucucagcaaacacuuuauacacagagaccucuuuugaggccuguauuuguuucugaaacagggucuuaaugcguagcucaggcugcccuugcgcuaguaagucucccaccuuagcuuccuaggaguacagacauguaucaccaugcuugauucuuguuuguuaaaauauuaaaugacccuuacucucacuggcaaguucagaguuuauuucuucaggauuccaauguauacugaagaagaucagcugagacauccagccucauggaaugaacuauuauugaauuccuggacuuucuaucaggagaacauugaacaaccauuguucaauaguuggaccacagccuggaaggcgcucuaauaaauccaauuuuacauaaauacauauucauucuaucagccugguuccucuagagacccugaguaauauaaacccuaauaugaauuaaaaacaaaaauuuaaaaugaguaaaggaaucuaaaagcaucuauuaguauuguuauuuaaguaugaacauuuuaguuaauuuucaugcccccauguuaucuguaaccuuacuacauggaaaaacaacuguuaaugcuaaaaucaucuauucuuaaagauuaguguaacuuucacuaugcuucagaagcuggcuaaggaaguggaggagaaucauuacauacgaaguugcaaugccuuuuccaagccuucauaauaacaccaauuuucagcauuccaaucaaucaaguuucugaauacuucacuggcuucuuuuagucuucccaauuucaacagcauuuccccuaaaauuaaguuuaaaauuaaaauuaaguuuacuuaaacaugacuuuucugacccaagagaauucucucagcauuauaguaaacagguauuuuaggcaaaccucaauucugugugcuucccuuagggcauguuauauauuaauuaguguauaguuugucuucagaaaugaaccacuuucauuucugacuccuucccauccccuaaauauacauacagauacuaacuucuuaguuaaaaaauaaaaaguaucuuuucauuauacauauucuucuguccuccuggcgauagcuaaagcaaacaguaaaauccaacuggcaaaucauccaaaugaaacaggccagccuuaguacuguaaaaucuaaaugugucucccuugaucaguuccuguauuaaguaacuguccauugucuugguuucuuuucuagaucauuaaaauugcuuaaguuaacuuagcacaauuaucuaacuaaacauuauuucacaacaagaaaccacauaagccaugcugacaagugcguugucuuuuagguucaaaccuuuuuacuaauuuacaaaacucacaaguagaucuggaaaauaaggcucuaaaagccucagacacaaugggaaguacauuuaaacuaagguaaagaggcuuuucuuaaauaaauguaccacacauuccuauuccccaaggaaccgauuucaaaggaaaaaaaaaggcuuuggaauaucugugauauuauuuaacauucaucauacuguggucgauggcauauaauuuauucauauuauuuuccauguuacauaaucaauuuccaaaauaaaauuaaacuagguauaauuacaucacacauagcaacuuugugaacuugggcaaguaguuaggccugauacaaaaugggcagacgugggcuggugagauggcucaguggguaagagcacccgacugcucuuccgaaggucaggaguucaaaucccagcaaccacauggugucucacaaccauccguaacgagaucugacucccucuucuggagugucugaggacagcuacaguguacuuacauauaauaaauaaauaaauaaauaaacaaaaugggcagacguaacuguugggugagagaaacaguaaacgugcccuaacucccgcacaacuguccugcuuaccccauauauaacuggcagcagcacauuuucacucccauaaacaucuguuauuugcuaccaccaugaagcaaauaguguaaguguauacugaacaaaaaagugcccauauacaccaauugagugaaaaucuacuaacacuuacaauuuuugaaagcuucuuaguaaguuaaugauuacaaaugacauaaauauuggaauauuaaaugggccuacaaaguccacugaaaaaaaaaaucacauagcccacuaccucuaagccauauugagaacuggcuauuuuauucaagauuagagcuccccaaaacuuuguuacuauccuaugagugaaugugguaaugaagcuauuuacaugauuuuuuuaaaugacacaaaugucacuguaucauacuuauuuuguaauaacuacauucuuucuuaaugcuaugagacaaagaaagccacggagaaacagcugccugagaauauuaagauuuaaucauaaaauagcaauaacacaccaagaaggaaaaauaauugccuuuuucuuuguuuccaucaauuacaggcaguaggauaagaaaacaaaauaauuauauuuuacugauaauuugaaaaaguauugucacuaauacugauacuaauauuaauuagguauauuaaauccuaauaauuauauuaauaccuaauauuaaguuagguauuagaaagcuggcuaggugcuuaagagcauggauugcucucauguacuggagagaauuuggguuuaguaccagcacucaaacugagccgcuuacaaccaccuauaacugcagcuucaggggagccaacgccucgcgcaucccugacagcugcacucaccuauuauacccacagagacagacagacagacacacacacacacacacacaccccuacacaguaaaaaauaauaaaaaacaaaccuuaaacaagcgaagaaaaaaacaacuagaggcuagagagaugggcucacugguuaagaacauagguccucuuggagaggaccugggacacagcaacuuacaaccugauuccagaggaucaaacacauucuucuagucucugaaggcaccaggcauguacaugguacacaaauauacaugcaaggcaaagcauucauacacauaaaauaacugaaaaccaaagugagaaaauguuacauaccagcaagaggacagcagcuccucaguuaaccuauguccucaccucaaaagaaugucauggugauuaaauuaauaaugguuuaguaaccaaacacuuagccagccaccaaauacacaggguuacuuaaguguuagaacaaaaauuaaagggccauuaaauaaaacaaaaaacaaaacaauaacaacaacuaaaucaacuuacccuuaauuucuuccaccaaaaguuuaucacauaucaacuucucauauguuucuauauguuccaaagauuccugaaauaaauuugccucucucaucacuugauucugauauaguaacaguucacuauauucauaagcuauuuuguugggaggaaccuagaagaaaacaaccaaaucaucuuauauaaaugaugcaacuacauaaguuaguuacagaucuuuaauuuuuuuacucaggauucauuugcagauuuaaugcagaagcaguuaaaaauaggucagcaaaugauuaauuccaucuuuaaaauaaaacagguuuauaaggcaaagugaagaggaacagauuucagauuuuuuuugggggggggggugcgucgagacaggguuucucuguauagcccuggcuauccuggaacucacucuguagaccaggcuggcccugaacucugaaaucugcaugccugucucccaagugcugggauuaaaggcaugggccaccauucccaauaaggaacagaucuuaaauccagauauaaaaguagaugacagacaucguaaggaaucuaccacaaauuauuaaagaaaaaauaggaccaauaauggaauuuagcaaaauuuuauacaaaguuucuucaagaaaauacugugagggccuggagagauggcucucaggguuaagagcacugacugcucuuccagagguucaaaucccagcaaccacaugauggcuuacaaccaucuguaaugagagcuucuggggugccuaaagauagcuacaguguacuuauaauuaauaaauaaauaaauaaacaagcaagcaagccggagccaguggggccaacagaaagaaagaaagaaagaaagaaagaaagaaagaaagaaagaaagagagagagagaaggacaggcagacacagagacagagaggacaggacagacagacaagacugugaagcagggcagaguggaguaaugucagcacacacaacuguaacgcaaugcucaaaagaagcagaugcaagggaguccagaguuuacggcagccuccgaggcaggaaggagggagggaaagccuccuuggacaccuauuucuaaauuacaugguaaggucuaaggagagccaaggagguuacucucuuccuggccuuucuacuacacauggggacaggaagaacugaggcgguaguauaaaaccguaggcaugcuccaacacauccauacagaaaaaggaaaaaauuguaagcugguuuuggaucagaucaacaaaaucacuaacuuaaccuggaaugacuaaagggaaaaacagauaguauuaaaaucagaaauuaaagaaacaucaccacaggccugagaugaugaugaugaagaaacaaaaaaaaagagaaaaagaaaaacaaagcaaagaagauuaagagaauaacagagaaaauuacaugagaagaaaacuaauauaaaaugaacuaaauaaaagcuuuuauaaaaacugacugaaggggcuggagagauggcucagugguuaagagcacugacugcucuucccaaagucuugaguucaauucccagcaaccacaugguggcucacaaccaucuguaaugagaucugauguccucuucuggugugucuaaagacagcuacagugugcucauauacauaaaauaaaucuuaaaaaaaaaacugacugaagauauaaaaaaaucugaauagcaauagaacauaauaaacaucccacaaagaccaggacuagauggcagcacaagcgcagucuaccaaauguuuacagaauuggugccaauccuucaguguuucaaaacagaacaggaggaaacacuucaaaacucauacggaagccaguauuaccaugauaccauaaaguaggcauacacaucaaaaacaaaccaaaccaacaaagccucuauagaccaauaucccuuugcccaggguuggugugugcaugugggugucuucuguugguggucauuuuguuuuguuuugagacagggucucacuauguaggccaagcuagucuggaacucacagagaucugcuugcuucugccuugcuggaauuaaaagcauaugccuccauacccugagauggucggucaacuugacacauucuaggaucaucugggaagagagucucaaugaaggacugucuaucgcauuacccugcgggccuuucugugggagcucaucucaacugaggugagagagaugacuccuuucccugggcuuggggaccugcacugucugagagaagaaaacaagccaacgacaucaaugccugcauucauucucuuggcucuugacuauggaugccacuggauauucaagaucuugcugccuugacuucccugauaugacugcaaccuggaauuaugagcuuaaaauaaaacccuuucuccccuaaguuacuuuguuuaggauguuuuaucagagcaacaggaaaggaaaaaaagacagcuaguaucccuaugcuacauuaauaaucaguaagacacaacugggccagggagauggcuaagcaggcagggagugcuuuacaaccuaaacucaguucccgggaacucuaugguagacggggagaaccaacuucuccaaguuaccuucuaaccuaacuccauaugcugcacaaauacaaaaaaaaauguuuuaaaagaaaagaaaaucaagagagguuaguaaagccuuuuauucgcaaauauacaaaucaauaaauaacuggcacaaggugucagcauaauacagagaaacgaaauucaucuaacagugcuggugaauguucauagcuacuucacaguggggacaccagaucuagcccauacuuaaucacagaacugucacacuuuuguaauuccaguuuuagauuuacacugaagacaaacacaaauguagucaaaucagcagcaaacaagguuauuuauaauagcacuguuuucaauagagacaaaguagacaaacucuucauuuauacaacagaacaagacacaguauuuaaaaaauggaucagcugggcaugguggcgcacgccuuuaaucccagcacucgggaggcagaggcaggcagauuucugaguucgaggccagccuggucuaucacuggaacccacguuaaaagccuaaagugguagaauugcaucagcugcaaucccaacacaauuacaaggagauauguggcacaaucagaacuguucagcaagccaccuagaaugcaaaacaccgcacacacacacacacaaaaaggccaagguggaaggcaagaacugaccucuggggguuuucuucugacuacacacacauagagccacccccucacaacacacauuuauacacacgaauaaaauagaaacuaucaggcuagaaacagugauacaugccuauaaccccaauaccaagaaagguaagcuuggaggaucuugaguucagggccagccaggacuacacuaugaaacccugacuuaaaaacaaaaacuaccauguaaauucuaaaaacauagacacaagucgguaucuuugguagauuuaugcacggcauacauaugaaaaguuaucucuguacuaauuucagauuagugcuuacaucuggaaaggugcagaaaaaacuuaagcuacuucuacauauuuuauuuuuuaaguaaaaccuuuaacaauuauagaaaauguuaacauauguaaaugaguuaacaugcuuuguauuuuuauaaaacagguuaaguauucuagauauuccaaauacauuaacauaaaacaaaaacacacauaccauuuccauauccacaacuaaaguaauauauaucacagaaauaauccucuagcuuccaaauucuuuauauuuuacuauuuuuuucuaguuagagcuaugugcccauaacacaaccuacgagacaagcccucuucccaagcuccacuacagucaucauauuuauuucuguaucuaucagaguauugagauuacugcucauaaaacuuaagaauuaguuuauuuuauacugggaauucuacacuuuaaacuuuccuauuuugaaauauuuuucaauuuuuuucaguuuccuaagaaaauuuuaaagguaaaacucaaaagguaaaacuauuuuagucugcaauauuaggaaaaaauguuaaaguucuuacuugcugcguuugucuaaauucuucuaauagcuuuagcgcuguaucauaaucuuucagcaaaugauaagcgauggcauauccaauccaggaagcacgcuguguugggcgcaacugaagaaguugguaucucgucuccuaaaaaagaauuuuuuuuucucuuuuuaaguucuuuauuuaucuaauauguuuauacuucaucugaauuuuaauacucuuuaauaacacaucaauaaguaucaguucuaaaauacgauaaaaauguguuucacauuucuaaucuaaauuaagucucugugccuuauaguccuugcuguaaggcuguuauaaaauuaggauagcuuuugauuauaucagauuuucaaaaaauauuauaugaaauuugcucguuuacauuguuguaaguggccucguauacaggauggaaacggaggaaacaguaugaggcucuaccaguggaaaugcccacugccaauaggaagcagcugaauuucuauaauauuauagacaaaauaucagaaauucucccauggauacccuagaaaaaccaaggcgagcagaaaacgcaacuucuccacagagacccuaccucccaagaguaagucagcucuuucucaguguuugcagcagacugagucuagaaaaugucuauaucucacuucgcugacugguccaugguaguaaguggugccaaaggaggccauccuuuucagguacucuuggccauccaugucuggcuccuuuucacagaacaucaaguuaacagcacuuuaucuuacuuucacgccugcuucucggucacccccuccuucauuaaauuuucucuggcaaauacaagacuaaaguaggcacaaguucaguuuccaggauccacacugggaaacucacaacugccuacaauguuaguuccauggaauccaaugcccucuuguagccuccauagguaccuaaacaccuauggacagacagacgcaauaccaugcacauaacuaaagagaaaaauggaucuucauggcaauccuuuccguauuauuuuacgcuuacuaacuuaauauaaaaaagcuaagcagucuucagauuucaguaacagcugaaugucaaauccauuuucaguuuagcaaaaauguuaaaacaaaugauauuagaauaauauuuuuacaccaaagacaaucauuuuuuuaaaaauugugugugugugcaugcaugagugaauguauaugugccacaguacacacgcggaagccugaagacaacuuucagaaaucuguuuucuccuuccacaguuuaagucccagggaugccaggcaagcaucuucacucauugagccaucucaauuuacccuuauuuaaugcucaaguaugaaacuuugcaacuauuaucauaggacaguccaaguggguauaacaucuugcuuuaggcuuacuucauucugaauucaugugcuauuaaaaauuuaaucuuuacaccaaguguuguggcacacaccuucaaucccauuacuuaaauaaauacccuguauuuauuuauuuauuuauuuuuaaagauuuauuuauuuuauguauaggaguacucuguagguguauucagacacaccagaucacauugcagauggucgugagccaccauguggauuuugggaauugaacucaggaccuuuggaagagcagucagugcucuuaaccgcugagccaucucuccagccccaauaccguguauuuaaaaaguacauuuaagacuacuuacucgauaaccuucaaggucucucaucugaaucugcaauagagagagaucccucaagauuugcaaauuaucuuuaucuaauuugagggcauuucgguagcauuuaauagcuucaucauacuucuuaucagaacguugcaggaggccguauacaugccaaccuaucaaguuaaggaaauaaagacauccacagacacuacgauauacuaugcaauagccucaaaaguauuuauuucaucuggaguuuguuucacaaugaucugggaucagagggaaagggcaauuagaaauaggcaaguauaaaaacagccaacccuugacuagucagcugggugaugggaucgaaaugauucaaauuucaauuucucccauuuuguacaugcuuggaaauuuccauaauauuuguagaaacuuuuagaaaauucuugacaaauuuuguaacauuuuucuacauucaauucccuugcuuuuguaaccaaacaaucucaaaauucacuuauauaaagauugucauuauuuucuaaaauaaguuuaguuauccaauucguuuaauucacuagugauauuaaaagacauaaaauuaagauuuauucucuuagcuuaucuuaugccaaacccccaaaacuaccauacuuacauggccuuucucuacacuauaggguaaagucugagauaagaaaauaaucauuuaguauucugagagaccccuaaguuaaauaugugaaaauauggagacuacacauggcaaacacuaaccaucugcuaaacgaauuaaaugccaaauauacaaggguacauguuauaagaccaaacacaaacaugggaaaugaaaaaauuucaacaauccuucuuuaaagguuuuuaaaauugguuuacauguugaaauacuagcaaaagaaaagaacuguaaagauucaguaaaguaaguguuaugucucuguuaauagaauucaagcuaaagaagcaguuuuuccugacacaaaauaaaaccugguuuccauuugcuaguucugcagugccagggguuauacccaggacgcccugcacacacugggcuacugagcuacagauccagcuaaacuuguuuuuaaaagguuucuucuaaauugaaaauuuccuguaaaacuucuaaaagaaaauucaagaaacacaaauauuuauauagauuaagaaacuaaaauucauuuucugaaguaggaaaauaucaguucauggauguuuaaggaaagagcugaucucuguuucucuaugaauauuuucuuuaaaguacuccaaaaaggauuaaggaacaaaauauugcuaauuacugauacugagauacauagacuucauuaaaauuccuaagauuucacuguuucacagauaaguuguaaaauuugaauuagaaaagacaaaaccacgaaacuauggcaaaaggauacagacaugacuccugacgucacugcgaaguccuuuacgaacaaauucauaugcuucuucucuuuuuccuaaacaguucaguauuaauccuuucauagccaaagucucugaaaucaaagauucgaguuacucuccuaggacuuuguuugugccugagauccuaaguacuaacuauucuuaccccagggcuuuuaucuuuuaucuucaucacaaagguacaaauauugucuugaagugucucccaccccacugaaaccaauuuuaaccaaucauaaccuaauuuauaccccacaaaaagauugacuaccuaaauauauacauugcaaucauuaucaucauauucaauaauaaacacauuuucuuuaaccuaaguccuauucuaaaaugccuuagacuggaauagaguucuacccuuucgaagacucuauauggagggauuuauauuauccucugaaaaauuuaacaaagcaggcaucccaguccuuuugaauuaaauuuacaguaauucuauacuuucucaaggccaguuccuuucuuugugugucuguauauauuuaugugugugagugcaggugaauacaucaggcacauauguggaaaucagaggacaaccucagacguuauuccucaauugcucagaagcacacugcccaccaagaauugccccaccccacugagaccaauucuaaccaaucauaaucuaauuuuuguuuauuuguuuauuuaagacagaguuucuuuguguagcccuggcuaucuuugaacucacucugcagaugaggcucaccuugauuaaagaaauacaccaccaugcaucauggcucauaaucuaauuuguaccucacagaaagagugacucuagcuacuuaauuaaaaaauauauguuguaaucauuaucaccauuuucaaaauugaacagauucucuguugucaacaaacguauuuuaauaauucuauguaagcuaauuaacacuaguuugcauuuggagagcauaacauuguacuacugaugagcaacccaagaaaauguuaggaaguuaaugaaagaugaagaugauuuauaauaaaguauuucucugaaaaauccacaaggacuuagauagcaguagugauuuucaaacugaucucuggaaacuguauaguuuucagaacacugucccauuuuacaaagaaauccugucuuuaaaaaaauaaaauaaaauaaaauaaaauaauaaaaacuuuagauagugauugguuagaauuugucucagugggguggggcaauacuuaguaggcugagcaauugcaaagacuugaauucacauauccagaacccauguaaaguuccauuuucuaaaacuucauaaaaugaaaacuugcauuuccuucaaaagauuaucucauaguuuuauaaaggugaacaguaucagccuauuuuccuaauuaaauggucuuaaaaguuguccaagucuaguguucuaagagaacuuaguuagcuauguuauguuauggaccauaauuuuccaagaccaaucugaucuucucaacgaacaaucccaacuaguaaauaugaugaaaaaaaauaaauguagacuuuauuaggaacaauuuuaaaaaaucuuaacaaccuaguuaugaauggaugguaacguauuuauauacagacgaggcaaauagaaggagccagcuauguggcuuagugaguaaucacuugacaccaagccugaaaaccggaguucaacccaugggacccacaugguagaagaaaaccaauuguucuuggaccuccucacauguacuguggaaugcaugcaaccaguacauauacucacacaugauaaacaaacauagaaauaauaaaaacaacaaagaauaaaauguguguuuuuaucuucgcacuauucuauacugcaaacaagauccuacuuuuauauacaagaaacugaaguaggaaauuagagucuagucagagggacagaugaaagaaaucuaaccuauaaacugagcauccccgugcagaagucccaaauucuaaaggaucuaagaguugaaacuagaguuucaagauuuuuugaauugguguguauaacugguaaucuaaacaauuauuccaaagucugagcucaucggguaucugaagcacuucugagagggauguuaacaugcacacuaccucauccaauugucucucaccgacuuccucauuaaaagucaaggcacugcacauacuagagcaugaaacuagcucaaccuaagauucacucgaaacauaaccaagaaaugcuaaacauucaugccgagaaugugaguccuccugcacuuucagaaguccugccuggcuuuagaauuguguucccccaaagcacagugcaacagaugggacaguaccuccauguucagcaaacuucggguuagaaagaaucaucuugcaaaacuugaggccauuuuuguacugcuucuguucauaacauuucuaaaaggaaacagcagguuauuuuauaaaauaaugaaccaaguuuuauuauaucuuaucaauucaagauccaaaguuuaaaaugugaugacaugcucuucugucuauauuaauuucagcauuaagugcgguuauauaugccuugacauguagcaucuccacuauuguaagagauagagacauaaaugaagaauaaacucaauaaaugcauaaucaucaaccaacacugacacagaauaaagacuuuuaaagccauaugacugugacuuaguuaccacugaccggcuuuccccagugccuuccuccacucacucucauccaccucugguaacuucuguucaacuuuucuuuguuacacaugagcccucgaaucucugaagucucugucuaugccuggcuuauuucacuuaacaugaugucuaauuucuuccaaguugcugaaaacauauuuucauucuuucuagcugauuaccauuccauuguaugugcugcacuguuuuauccauugaucagcugacagguauucggaucguucccauuuauuggcuuucaugcaugauguugaacaaugcuauaaugaacacuacagauggcucuucaacauacggaucucaacuccuuuggauauccccagcagugggauagcaggaucauaugguaauucuauagguauucucauuuuaguuugacuuuguuuguuuuuagaaacuccccccauacaguuuuuuaaguguguguguauguguguguacagaucagaaaacaauuuacagaguugguccucuuuuucuaccuuuccacgggcuucagggaaugaacucuggugcaagcacuuuaccugcuaagccaucucacuggccuaccacuguuuucuauauuggugguacugacuuccauuaccaaaaaccaugugcaaggguuccauuuucucgacaaucuugccaacaacacuucucuuuugucuuuuuaauaauguuuaguucuuauaaaaauuccuuuaaaguggugcuaucaucucgcuuuacuaauguggaaaguaaagcgagacacuagcacacagauacaagccuccuacccucugccuauccaauccuaucuacuacucacuuucaucugcuacccacugcuaucacucuguugucucugacauucuaguuauuuacuaucuaucuucagaaccauccugugaauucuaggagaaugaaugcuuuuuuaaagauuuauuuuauuuuuaugaguucacuguagcuguuuucagacacacaccagaagagggcauuggguucuauuacacaugguugugagccaccaugugcuugaugggaauugaacucaggaccucuggaagaguagucaaugcucuuaaccacugggccaucucuccagcccgagaaugaauucuuguuuaggcuucuuuacacuagacaaguaaucaagagcuguccaauaaaaucauccuccuagauucacagcaacacggcgccaagggcacagcuaauucuugcaggagauuuuggauguggaggugauaauuucaaagcauucauuaaaauauauuuaaaaugaauuuucuugauuggcucugggaagauuaccaaaugguuagaagauaaaaguaacagaaaaaauauugaaccauaugaauaaauuaaauagcuauguggccaaaccugguggcucguucccuauaaucaaucaaucaacgccaguccuuaggaaguuagaugaggcaaaaggcugccaugaguucuaggcuagccuagauuauacaaccuacugugggcuggagugaaacucugaaacuccucaaaguaagcaaaauaaaauaggaaauagggccaaggaaaugggucaguuaggaaagaugcuugcaccaagccugauuaccugaguuugacuaugggaggagacaacugacuccuggaagguguccucuaaucucugcacaaacgccauggugugcacacaugcacauaaauaaauguaguaaaaaaauuuuuuaaagguccagcuuugacuauugagguucacuugauaauuaacaaagacagugggcuauaagcagaagaaacuacugaggaagaguacaaguguucuuuaacuaauccugaucuuugucagcuaccaaaggagugaacacuucugacauuuauuugccacacacgcuucucuacuaacuguaccaaacugagauuugaaacauuaucaucccaaggcuagaugugguauccagaacuguaaucccaucacccuccaggcaaaagcagaugaguucaagguuauuuuuggccaaccugaaauauauggccaucucaaaaaaaaaaaaaaaaaaagaaagaaagaaaaagaaaaaaaaagaaaaaaaaaaaagaaaaaaaguaguccccuaguccacuuguaucauuguuaacauucucaaugcuacaugucaagcuucuguuggcuugagccaguacuaaguguaacauuuugucaggugauggcaacaaaguauuaagaucaguguuuccuuacucaacagcuaacgcuauucagccacgugcucucaauacaaauucacccugaaaucuaaaagcuugcccagcaaguagcacauucucaaauuaaaagggcagcuuagaacauaccgcuauuaacucauuuucuuuucuaaaucuuuaagagccccgcaacauacagagaagaagcgugucaccucucuccucccugaaaggauauaaccuggucaaggugccaagguggcagauaugcuggcacacuccccagagaaaacuucuugucugggcacaguggcaaaugccuugaaucccagcacucgagaggcaaaaaaaaaaaaagcagcucuaaaaucuaggcuagcuuugucugcauagagagauccaggccagccagggcuacagagugagcaugucuuaaguaaacuuuaaaaacguaaaaccgaaccucguuuagcugggcaugggucuaacaugaccaaggcaacuuguuauuaaucaucauuauuacuauucuuauucaggcuucaaagccacguaaagggucucaagcacaaagcccuucuccgcagcuuucaucacgaggacgaguuagaagcaaguuucuggcaaaucacuuccaaaaccgggcccgcacaaacaugcaaacucucccgcacagaggcaugggcucccgaggaucgcgggcuccauguucccguaccccgcaagcagcggugcuuggcccagccuggacccgaagcagcucggacuacuccgaggggaggacugcagggacccgcugagcccggcgccgggguuccggcgacucggccggggaacuuucuggaaagcucccgcaguggggagcuccagagucagggagggagcgccgcgggggaacggaaggagaagcggccggaggagagcccggcucggugggaaagaaagcgcgcaggggucgggcgggccaccgcucaccagcacgcgcuugaagagggcgcucuccuuggcgggcagcugcacgcagggcaucguggcggcgauggggaggccugcucgagcgaccagccaggacccgggccgcggguuaccucggcgggaugccacgggaagcggaacacagcgcacuccagugggcggcccgggagggaagcccgcgcgcgccaagauggcgaccagggcucgccccgcccccc

SEQ ID NO: 7604 - RNA, 682 nt, Mus musculus
ugggaagaaggccaaagugacugccacggcagacaucaggcucaccugacuacgacgccuguggguuuauacugcgucagcaggggaagaguggugccgagugccccacaacugagggcugcugaggacugccucaggggugcauuugcggcuccuuuccuccugugguccauguagaaggagagugcuucagagaugacaaagaacaggaaaacaaaaauucacacaaaggaaaagaaaagugcccucacuaaggcauaucacacacacaauucuaaaagcaaguaaugaaauaagccugugaacuggccauuugauguacaggguaccaaacugaaaaacaacacccugggaagacgaacuggagagaggcugacuguggaccagauccuggagcuuaaggggaaagaggcugccugccaccagcucugcguccucuuaggcugcugaugaaaaauuaaguaauggccggaucggggaagagaaacugugaauauaugucaaugauagcacaaacugcuuuuacuaaauuaauuguuuucuuuuucucuucagaaaacaccucaaaaguaucaagaaaguaaccauuuacuccauguuguacacaguacuaaauaucaaacgaagcugucagagucagucaggagaggcagacgauccaguguggccuuguucccgcuuu

SEQ ID NO: 7605 - RNA, 2518 nt, Mus musculus
aaagaacaucccucuauggccucugcaucagcuccugcucccugaccugcuugaguuccaguccugacuuccuuuggugaugaacagcaguauggaaguguaagccaaauaagcccuuuccuccccaacuugccucuuggucaugauguuugugcaggaauagaaacccugacuaagacaguuggaaauagcucuaggugccuacuuagauucuggcgucugaaugagauaguucaccauuuucuuuucuuuucucaggguacucacuacauagucuuaucugacccaggcucacuauguauacuaggcuggccuauaacccacagagagcugccugccucugccucccaacuaagugagggguuaaaaauguguguccauggggcuggagagauggcucagugguuaagagcacugauugcucuuccagagguccugaguucaauucccaggaaccacaugguggcucacaaccaucuguaaugggaucugaugcccucuucuggugugucugaagacagcuacaguguacucauauaaauaaauaaauaaauaaacaaauaaaacuuuaaaaaaaaucucugagcaucuccucucugauuuuugcucauccagguauuuucucaagaacaaucugcuaccauccucuauggagugcugacccaaccuugguccuacacagggagcaugugaccuuuccucuuucagucacaaauacacaaaaggagagcugauguugacaguacgccuuuuuguaagucuggggauguagcucaguaacagagcaccugccaagcuagcaggagcgaagccugggcauccauccucagcuguagccauuuuguucugugccugccagcuauuucacauuauugcuguaacaugccugccagucacugccacauaggagugacuuggcucaaggacaugcugaccaaacacccuauuuuguucuauuuguucuguauaagguuugcuaaucuuaagaaaccucacagagcuuuacauagaaaccaucaaaucaaaggucaaguguaucaguuaaugcuacucaguugauccuagcgguggcagagcuccuugcuacccaccccaauguucuggguuccugaaugaaagaugcauacacacagccuuuauauuaugugccugaaacagcucaauggcuggaccacuuccuaaccuccacauggccaauccauuccccuccaauauuccugagcuauuauaaguaauaacuauauuccaucuuugcugccuucuuggagcgugcuccccuggcuccugcauggcugcaaugcucucuguccgcaccucucagguguaguguuucuccucuccugucccagcauggaggaucauucucgucuuuccucagucccuuguccaggaauccuaaaaguccugccucugucuccgugcccagccacuggccgccagcaacuuuauuuaccaaucaaaaccaaccgggggcaggguucccucagugucuuacguguagacgugcagauucuugugcaauuuuggagacccagauuaacauaauacaagcaacauuagaccaaacccacaacagucaguaugaacugugaggccuaaaauggcuugagucagagcugaccacugggcaucccuuuccacaccuacguaugagcucucgaugguuuuuguggaugauacugaagaauguuauuaauaagccaaacauuuaugauuauacuccccuuggagcuggacuggaagaccacuccuggaaccacaguggucuguccaguacauccaagcaucuuuccugcacagauaggcuuaccacccgcauccuucaaaaggggaacuguuuccaaacagaaggagaacccagacaccacuggcacaucagauccacagugccauugccaucuguaaaagcuuugugcaaagaacugcaaacuaccacaggaccauacccucugaguguuagcuaguuagaaagcuguggauguuugaaugagaauggcccccaccaacucagauauuugaaugcuggguccucagugggcgggacuguuuggaaaggauuaggagguguggccugauccgggaggcuugugacugggggugggcuugagcauuucaaagcccacaccauucaguuagcucucucugccuugugcuuguagaucaagaagcaagcugucagccacugcucgcagcaccaucccugccacaguggucauggacucgaacccucuggaaccgugagccccagaucaaacguuuccuuuuauaagccgaagccuugcucacccgugggaauguggacaagccucacggcacugucggugguguuaacaugcugccccccugcuccucuggcucgaaaugugucuacucgcagauccuugggauccacuuucacaucuaccuagggcaaagaaaauagagcgugaguaauucacaaggccacagacacuuuagucugagauuuuucaaauaaacuaaacuauuuaaguaaaccaugaauuaaaaaaaaauuaaa

SEQ ID NO: 7606 - RNA, 423 nt, Mus musculus
acccugucucaaaaaaccaaaaaaaaaaaaaaaaaaaaaaaaaaaaaggaaaaaacuuuuaaaaguuauggcuugauuuauguaaguagcaaaagguuuucuaugugugagaaggagcagaaagagcauugacauuuucagcaaacauugcaaacauuuuucauuccuuccccaaauuauaaucaaaauaaaaagggaagugacugugugaagaaagagcuuaaaaguaagcaacuguaaguggacacagaauuugauuaguuauguuaaugaguaaaaauauaaaugucuaacauguaugagcaagaguuauugcuuaguaaacacauaugcauggugugaugcagggcggcaagguuauaagcccggcacuuggggaguaggacaggagaaucaagacaagccucaugauaccacgucuca

SEQ ID NO: 7607 - RNA, 43468 nt, Mus musculus
gcugccggaaaagaccuggcugccacgagugacgucacgcacaacuuggccgccggcgguagccaugaugaaaaccggaguaaacggagcuuaacgugacacuccuuagcgaagccagaacuaccucccgacggauccccaguaccuuacagugggcuccgagacaauauuucaaagcuuacaagccaugccggaucccccacgggcguacggcggggcgcgggacucacggccacgcccucggggcgggggcuuggcugcgucacggguaggggcggggccggagagcguuuccuccucuuucccagccggccccgcgccuaccugcccacccuucgccuccuuuuccgcggcugcaugcugcgcgaccgcugauuggcuacggaggacggaagcucaguugggguuucuuuagaaguuuucccuuccugggcggcggcggagcugguaaccaagguagaaacgcucaggcagaagcuuucuugacuccuagggauggcggcagcugcagcaggaccugcaucgucccagcggugcgugauuuucuucaccuuugcuguuugucuuucuauucuuuccuugauuagagagaccugcugaagucguuguuuucuuggcaggcuuuuccagagcuucucagaugcucugaucgacggggauccccaggcagcauuagaggugagugagcucacugggacuguugggucccuacagaccccuccucuucccggcauuaccuucgugggagcaaagcuacaauguaucuaagucccaaaauuaagauacuuaaucucuuugucuccuuaauaccuuugccauagaucuugcccuuccucuccacaagcucccgaugagggcaccucccucccauuuauuucuuggaaacauaguuacugucugugguugcacuuauaauggcauuuaugaucaaggaaaaggcgaaaauagggcuugauguaucaauuuuuuacuuuaacaguuauguuugcccuuauaugucagguacuguuaaguguccuuaauuaaauuuacuaaagaacauuuucccucugugccuuccacuuuacagaugacugugguuguucuuuauacaguuguuuauaaaaccgcgcuuuuuaucuaggcuggccuuaaacuuuggauccugcgaguucuugggauguaucaguaaauaaacccugccuacauuuuaguauuauaugauuugcuuuugggccauuucaggugaagucuagaacaaacuagcuuuguacggauguuucuuaggagcgcuggcuggacuccagagaguuaucggcacaugucaaguauggugguacaggccuguaauccugguacucaggcggugaaugcccuagggucagaaauucaaggucauccucagcuacuuugugaguugaggcuagccugggaugugugaaauucuucccgacacuucagagcucccccgcuggaaaaaaggaaacauuuuuauguuuugagccuuagagaaaucacuuuuguagagacuagcagacuaggauagcuacauuguuguuuuaauguuacaagcuccgcuuuguauucuuaggucuacagagugaucaugagguuugauagcgcgguauuagagagccugcugguguuggcgcacaccuuuaaucccagugcuugggcggcagaagcagguggaucucuugaguuugaggcccaccuggucuaccaugagaguuccaguauggccagaauuacacagagaaacccugucucaaaagaaacaaaacaacaaaaaucaaggcauuagugacuuugagauuagggcuacagacgcaaguaucuuuauauuuucugccaaaggaaauuaaaacccgaauugagaguagggggaaggacugaaaaaggagaaggaaaugaauaauuauuaaaagguuauugagugcuggcuacagaucuaggcugcccccaaagcccuaauaauuggcagaugcugccccuucuaauguguuccaugcaauucucuacagccccuuggcuaccucacauucuggacuuuacuaguuucuucuauuugaaugaaaauggguaccaaugaagcauggguacaaggguaagaaguuuauuuuaaacugccaaggcugucucugaggagagcagcaagaugcgggguggggggauguagggggguauacguguguguguguguguguguguguguguguguguguguguaagaucuucuggguuauauggaagccauaccugggccugugggcuggguuagggggugggggacuugugaguauggaauaaggaaguguggaggcuaccauugaccuugacacgccaaugagaaccacagagauauguuaauguaucccuuuugccagagaugaggggaaaacuuagcacauaggaacuauuucagacuggggaaagggauuucuuggcgggcuuggggguggggugggguuggggacgacgacugacauuguuucugguccugcuugguuuuacucuguucaugguacaguagccagcaugacaguuggaucaugucacucuccuacuagaacuuuccauguccuucccucgaaaugaagguccaaacaauuucuuuccaaugcccaucagggugccuggugcaguggauaucuuggaacucuuuuucuuuuuguagagcuacacuguuugaggugcaucugcuuuugcuccacauacacuugaccuuuaucucauuuuacucggcgaugccgaauucuuuagguuucgcccgaaaugguuccugcugaggggagcuaguuuuucugucuaaauuaggucugaaaauaaauagccucaagacagcaggggguuuuguguaucuugauuccuuucugcuguguucucaguauagcacuugggacuccuccugcaugauucuugcaacccucuucauuggcauaagcuacauuuuuacucaguagggaguugaaguacagaguaaaaagguuaacuugaucaaaacaaagaggcuuggaagcaacagguuucuaguuucaagggauuaaggucaucuggcagggagagaaccugggcuaugugauacaccaacuaggagcugacuuggaagccacuugguugagagcaguuugagauugguaaacaugugguggcaaucagugcugacauucuucucuaagcaaugcuucugugcuuagaccccagcuaggugaagguagggaaaagaagaggaaccagauugagauacgcacacacccacccacccacccaccuagagauucuuugaacauuaauuagcauuuuuaaaguaaauuugaaaauuuacuaaaaguuaguauuaauuaaaaacauuuuuuucuuuuuuuuuuuucuuuuuuugguuuuucgagacuggguuucucuguauaguucuggcuguccuggaacucacucuguagaccaggcgggccucgaacucagaaauccgccugccucugccucccgaguggagugcugggauuaaaggcgugcgccaccuuuuuauuuuuaaagcuuugcuggaguuugaacccaugcaaaguacauggucuaccgcugugccuccuccuccaauuaccgaggcaggguuucacgaaucccaagcuauccucaacucauguguaacccaggaugacguugaacuugugcuccaugcauuccgggaugccaggccugugucagggaucgaacccagggcuuccugugugccaggcaaacauuuuaccaagugagcuacagccccaacccaucuaaaaggucuucauuuucaugucuuacauuccccccucauuacuguucugguuagugucgugcuucuggcuguggguuuugcucgccuguuucuuuuucuuuguggcgguggaauugaugcuguucaagugcucuaccacggaagccacagaacucauuuucugcaagugucuuuuuggacuuguuuacaauauguuuggcuuaggucugcucuaauuccuagccuuuugcugcugugauucacguguuggcaccaaggguguugccucuugcuauuuccaccggcagccaugcuucucugcaggcagcaacuuuucguuuuuguuuuguuuuuuguuuuuucgagauaggguuucucuguauagcccuggcuguccuggaacucacucuguagaccaggcuggccucgaacucagaaauccgccugccucugccucccgagugcugggauuaaaggcgugcaccaccacacccggaggcaucagcuuuucaaaaacaaacagugcuacacuaaaagcaugucagcuaagauuaugaaucauuaucuuaaugauugguuuggggcuuuauuauaacucacuuauucauaaauccauuuguauguuuguaaauuccuuuagguuuggcucucauuguuuuugauuguuuguaugguugucuuagaaacgucucuuuuguuacauccuuaccaagucugcacgcuuuaggagacugaacuguucuuaacuaacaacugacuagugguucuaaagagcauuuacaaguggcuugaacuacugaagcucugacuugacuuuguaagcagaggaaugaauaaucuguggcucauccuauaaucucagcucucagggcugaaggaagagacugcaaguuugaggcuagcccaggcuguauaguagagccuacauacuacauacuacagacuacauacuacagacaugguaauuucuuucuuuuuuuuuuuuuuuuuuuaguuuuuuuucaaccuauuuuaaguuuaagacacagaaacccagguugaccuugaacucauuauguaggcaagggugauuuugaacuaaagauccuucugccucuucuuuucuaaugcugggauuauaaucuuuuuuuuuuucuuucuuuuuuucuuuguuuuuuccagauaggguuucucuguguagcccugacuguccuggaacucacuuuguagaccaggcuggccucgaacucagaaauccgccugccucugccucccgaguggagugcugggauuaaaggcguguaccaccacgcccgguuuugggauuauaaucuuaaacagucauguagcaccaugccuguuuuuaugugguguuggggauugaaaaaaaggaguuugucagagagcacaacuggacaaugugcagagagggagagccacuggagcacgagauccuccauggggugccuucauccaaccccuuucuggaaggcucaggauggggaaguagggggaaaaggaggcugcaagguuggccagaggugacagaugacuccaggguguuagugccuuccagacacaacaggacaaaucacaucacagcucauauuguagcagcauguucaagacauacagguucaagucagaugggcuccuaguacggagaagaggaaauggaggugagaucccacuccuaagcaagaaacuacuuguaauuuauaucugcugacaaagggaaaaucaguuuucuccaguggagucacuguauauugacuacacuccagggcaaacccaggagccaucagucaguuaacacaaagcgaacuccaugguuuuauuuguuuagagaccauaaaguuagaaggauagggagguggaagggucugggaggaguugugggaagguuaaaaauauccaaguacaugaaaaaauucuuaagaggaaaaaaaagagagaagggguuuuguuuccaguauggaagcacucugucuacugagccacauucauagcaaaaaaaaaaagucuauauuaaaaacauuuuucccucaaccugguuuauauguuauauaauguuucuaaaauacuuuuuugauuuugaugaucuugacaucaguauaaucuguaauaacuuuuuagucauaauucucucucuuuccucccuuccuccuuccucccucccucccucccucccuuuuucuuucuuucuuucuuucuuucuuucuuucuuucuuucuuucuuucuuucuuucuuucuuccuuccuccccuccccuccccuccccuccccuccccuccucuccucuccucuccucuuuucuuuucuuuucuuuucuuuucuuuucuuuucuuuucuuuucuuuucuuuucuuuucuuuucuuuuuucuuagaucuauguagcccuggcuuggaauucucuauauagaccaggcuggucucaagcucagagauccccugccuugcccuuaaaacugggauuaaagguguuugucauuuuucucagcuuuauuugcuauuuucaaaauuguuuuauaaauuaaauuagaagauuuacuuaaccuagagauuucaaaauuacuagaaagcaugagugcagguggaggagagacacuuagugacaugaguuggggguugcuacuguuuuguguaaguucuacuguggggcuuuuacagaccuggauuugaaucuagucuguacgguuuugucccuaaggaaguaaaagaaagaauuuacugugcccuuguucugguccauugguacucaaccuuccucauguuguguugaccuacccccugccccccccaaccaugaaauuauuuuuguuacuacuucauaacuguaguaauuuaguaacuguuaugaaucauaauguaaaaaucuguuuucagaggggcuuagacgacugaccccuguaaaaggguuguuugaaccccccaaaggggucacaacccacagguugagaaucacuguucuagccagaugaugcaacguauuuugagagacuauucagugauuauugugguuagaugugagcuggaugacgggcaacacagugcuggauagagauguuagggaguccugccaagagccuuugcaaggaccuagaguuuugcuugacaucagcuggagagcuuuguguagagacacaguaaagggcuuugauguuacuggucggacuagauacauuuagugccuuugaagugguggauuauagguguguuugguaggauucuuuguuuaaucuguuuacagacaaggaucucguguaacccaggcgcuggucuggaacuugcugcguagcagaggaugcccuugaacccucagugcugggauuacaggcuugugccaccacauccaaauuuguagguggcaaggguugaagcuuugugucugcuaagcaagcacucuacauauuaagcuaucuccuauccuggauuuaguucaguuuugauuuucugguauacauuggcuugggaaucauuagaauuaaagucaaguggugagugguuauuuaaauacaucuucuauaaauacucauguauggguucacugaaaggagacucggcuuuuuugucugcacuuggccuuggccuuauuaacgugugauuuguguguguguuguuaaugguccagcuccuguguuaauacugugacuacccagggcagugaagguuuuaucucuguuagcuuuuaucugggcuuugagcagaaugcuguaaucuguuucaguuuucuggaaucuauagggaaggcugggggccaugcauccacucauucuguugaccuccgugaacuguagaaguuagaugguuuuauaguuugucugucugucugguugguuugguuaggucucucuguaucacagcccugguguccuggaacucauuuuguagaccagguuggccucuaacucaagguccgccugccucugccuccugcgugcuggcauuaaaggcacgcaucaacaucagcuagcuuuauauuuucuagguaccucaaauucuacaugguauugcugccuucuccaaaugaggaggaauucugaguuggucuguguaucucagcuuagcuuuggggaauaaaugagaugauaauaguuacuaccuauugaacucuuaaagcagaccaaggauagcuaaugccuuuuuauguauuacguuuugugugugcuauggguucagggaggaggaacuaagauucucuuacaaugacaagccccaugcuuguuuccuuuuucucucuaauagguuauuugauuuuaaguuaaauuuuugauuagaauuugauggcuuuaaaccugauuuacugacauuccacguuuguguuuguaggagcugaccaaggccuuggaacagaauccggaugacgcacaguauuacugucagagagcuuauugucacauucuucuugggaaauaccgugguaacguuucuuacaaacuguuuugccauuuuguaguuuacuuauaaaauuuucccaagucagaauauccaaauggagucugugugugugugugugugugugugugugugugugugugagagagagagagagagagagagagaaagcaagccagaggacaagcccgggugcacucaggagugcuguccaccucuuugaaagacaggauggcucauuggcccagagcucaccauuuaugcuagacugcugaccagugaacccaggggauuauaaguuaccacgccuggaguucuuauaugggugcuagggaccguauuuaggucuuugugcaaaugaaggccuucuuccaugacugagucaucuccaucaccaucuuugaaaaucuuuaacaugguuuuucacaagagaaacauucugaguaacauugacauaaccguucccuuuucucccgugggcagaacauuuauagagauggcauucauagugacugcauucaccauuguccuuuuguuagaaaaucuuaauaauaauuaaaaaauaauguauuucuaaguugugugacuuuaaaauuuugaguaugggauaggcaagaaugugccuuugaguuaaauuacauaaauauuguuaaugagaagaacagauaagcuguaggacacagcuucauuuacugaugacagaugaacuuuaagaaaagaacuaaaggagacgggaaagagaccuccguagguaaaagcauugacauugcucuuuacaaaggaccugauuucuguucucagcacccaugguaggcugcucaugacugcugguaacucuagcuccaauagaucugauacccuuuucuggcuucucuggggccugcacucuguggauagacuggcagacacacaaucuuaaaaauacaauuuuuaaaaagaaggaagccagaucuaaucaaagauaugaaaguaauauuuaaauuuuaccuuggauuaguuuucccuaauuuaaaaccauuuggccuuucaccuauuuaaaagguuaaaaauaaaauacuaauucauuuguuuuacauuauuuauuuuauggugucucugugugccagcuuguaugugccacaguauauaucuauggagggcagaggaccaguugagugaguccauucucagucugccaggcgagucugggcauugaauugagguugucaaguuugacaucugagccacuguucugccccugauucacauuuuguggguagcacguguuggaucuguaaauaaauggcuaaacacucugaccuuuuucuguguagaugguauugccgauguaaagaagucucuugaacucaauccaaauaauuguacugcucuucugaggaaaggguauguaauguguuggguuuggacuauagccaguagguguugauuuguugaguaaauauauuauacaugauguaaucuuacaauacuaacuuauguuaguauguuaacucaagugugggauaacagaugucugauguuuaaagcagugaugauuaaaauaucuguaaaguaugggcggaacugacgaugcucucugucagcaaagccgguuagcugcauuuaauaauaagcaaaaacuuagucuacuuuauguguaguguuaagcacuguuuauuauaacugauaagcauggcuuuuuaacugagaacccaauucuuuugcaugauuguuuuggcuuagaacaaaugcauauauagauauauuuauacaguuaaacucagauuccuugugaaaugaguaugaaaauugaguuuuaaugacccuuacacuaaauguuacaguaucugaaaaaacuuaguuuauuagcauagacuugaaauaaauucuuucagcauaugaaagucaaauauuuuauuuagaaagaagucuguuuucuaugauuucauguguguauauuaauuuguaauguucucacacaggauaugugaauaccaugaaaaagacuacgcuucugccuuagaaacauuugcagagggacagaaauuagauaguaaguauuaguuacauuuucuuucuuuuuuaaauuuuuauuucauuuauaugaguacauuguuguugucuucagauacaccagaagagggcauuggaucccauuacagaugguugugagccaccauguaguugcugggaauugaacucaggaccucuggaagaauagucagugcuguuaaccucugagccaucucuccagcccuagaguuacauuuucauaacgauuauuccuucuggaucuuaaauaccauaguuagauuuuguuaaaaucucucugucccagaaacccaauucccccuuucuucuaacauuauuuuguggugauuuugaguuuacaauuugaauucacuuaagguuugauuaaaucgaacuuuccuuagcauuuaaauuacagauaaacuuucccauuagaaaccaaaauuagugucuggggaauguguuaccguuugugcacuuacugucaagcucucgagaggacaggaguuuggguccccagaaccuuuaaguaccaggucagcgugguaguuugcuucuaauuccagcuguggguggcugggacagaggguuuuuggggcaaguuggcuuccagaguagccaaaucaacaagcucuguguuugauugagggggaggggagggggagggggagggagagggagagggagagggcgagagugcuugccuuaaagaacagguuggaagaccauuggagaaagauugcugacuucaacucagaccugcaaacacacacacacacacacacacacacacacacacacacacacacacacacacacacgagaaaagaaagagccaaaaacuauauguauucauucaguguguuuacccagugaauucaucuccauauagaucucccaccccaugagcucuuguguaggaauguuuguugaguguugaguacaugcagcaaccagagguuaacuucagggggcauuacuuagcaacugucuuugguuuuugugauggagccuggcuugcucuauuaggcuaggcugccaggccagcaagcuucagguaucuacauaucuuugccuccccagugcugggauuccagcucacaccgcucuaccuggcuuuucacugugggucccaugugcugugggucccauggaggcccuucugcuugccgggcacacacuguaccaacugaguugucucuccagaguguggcuguguuuucuacugggaaagagaaauuuuaauucacuuucauguucaaaaauaaguuaguggggcaagagagauggcucagagguuaagaacucugguugcucuuccagaggucccagauuugauuccuagcacucacaugguagcucacaauuguguguagcccccauuccaggggaucccacagccucuccuggucuuugagggcaccagaugcaaacaagguauauagacauacauaccuguauacauaaaauaauaaaaaaauuuaaguguucauuuuaaguuauucagauugcuaggagauuuuacccuaguaaauuauuaauuuuuagaacauugugagauauagaagaaaaugagaacuuucuguuuuuuuagacagucauauauuuaacucauuauggagcugaggguggccuugacuuugugaccuuccugccauuaccccauggagugcuagguuacuggcagacaccaguauacugcguuuguaugggaguggguaacaaacccagggcuuccugcagacauauccaguuagauucuuaggcaaaaauaccuuugaaaguguuaggcuuucuccaaauguccauguuugagaagugugugugaacauuaucaugauuccaggaucuaguugcauagagagaugaugagggcuggagaacuacaagguagauuuuauauguaaguagaagaugauaggaaacuucauaauccuaauugaauuaguuugucuucgguggagcuuaccacaggccuuuaaaacagugauucuuaacugaaaacagcuuugcuuugugggggcuggggugugcuuuugccaguguucaaacacgugagucuauaggggccauaccuaaacauagcauaaugcagacuacauuuaguccaacuucaaaaaaaaguacuuauaguuuauagcagucucaacaauguuaaaaguccaaaguucaaagucucuucugagauucauccaaacacuuaaccuacaaaaucaaaaucagaaagcacaucacguaccuccaaccucauucaggauauguauuaccauuugaaaaugucauagugaggaaauacuggaccaaaaaacaccaaaaccaucuggguaaacucaacucugcaucuccaugucugauggcaaagcgcucuugagaucuccaacucccuucaucuuuguuuacuguaaucaacuucuucuccuuggcugguuccacucccugugagcagcuuuccccagcagauuucccauggcucuggcaucuugagcaucuuaggguccccaaggcaacuacagcguugcagcuucuuguuccagugucugggaugcacacacuaucuucugggcuucucaaaagggcuugaguccgaucuccagcucugcucucuguagcuagcacucuaggcucugguugaccccacuccacugcugcugcuauucuuggugaucaucccaugguacuggcucucuaaaacacgggggucuucccgugcagcuaggcuucaccagccucucauaggcucucuucauggugccaagccucaacugcuuugcgugaccccuucaagcuugguccgucaacuguaacugaggcuacaccuucaccaguggccuucccuugccucucacagugccgagccucagcagcucucuaugacccuuucauaccuucaaaaucaguaccaucucuuacacuuuaccaaguccagcugcagcuggaucacagcuucuuuguacucucagaaaacacuuuuagaagauuucaccucagugaugcuggucucuucuuaaucaccucuaauaucuuagcuccaguuaacuagcuucaauugucccaguagucccuucuguucuugacucuaaagccagagccacauggcugaagcugcagaguucugcugcuugcuggcgcuggaggauggcccccuuguucuauuacauuaucaccagcuuucugcuuuccaccuccuuuagugccuaagcucggcuguccuggagcuugcuuuguagauugaccuugaacucagagaucugcauggcucugucuccugaaugcugggaguaaaagcauauaccaccaugccuggauuuaagcuuuucuuuaccugggauuugcuuggucccaggcuggccuugaacucagagaugugcuugucucugucuccugggauuagagcugugugccaccauuccugggccuaagcuuuucaugucuacuguucaucaagcucuggaggaucccugugcccuccauuucuggauuauaguucauuccagauucaaaguccaaaugaaaucaauaaccagauaauaaugccuagauaacuauuccuugaacaucagcaaacacaaaaaaauaagcuuugcugggugggaucuugucccgaggucaccauucucuuagucuguuugucucuuugaacacaggauccagcuccacuuugcuucucggugccccuuuauucuuugaaccauacauuuuguacuuuuccuuucaaagcuugcuaugcuugauuaaaauguuguugaccagacuaaaucagagagaacaagucuauguugggcuuugucauauaagucucuuuaccauagccucagguagauuuuuucagacaaggacaaaaagcagccacauucuucaccaaaaugccacaaaaauggucucuaggccacauccugagauucuuuuccacugaaaccacuugggccaggucugcacaguucaaaucacccugagcagcacugucuuccauauuccuacuagaauagcucauuaaggcccacuuaaagaauuccacugcuuuccaaaguccccaaauccacaucucuccaaacaaaagcauggucaggccuagcacagcaauaccccagucccugaugccaacucuugucuugggguuuccacugcuauaaaagugacaccaugaccaaggcacgucuuauaagggacaacauuuaaauggggcuauguuauacauucagagguuuaguacauugucacuaaggugggagcauugcagcuucugggcaggcacggugcaggcagagcugagaguucuacaucuuguuccaaaggcaaacaggagaagacugguucuuauguggcuaggggcaggguaucaaacccaccccccagugacacacuuucuucaacaaggccacaccuccuaacaguaccacuuccugggccaagcauauucaaaccucaauaggccccaauauacaaauagaagcaaugacuuaguaagggugaauuuccuggcaacaguggugcuuaaauuuguuuacccacguuuaggcacaugaauucuuuaccuguuuauuaagaagacaggguauuugcucuuugcaaauuuaaagcaucucguuuucuaauucugcgaugugaggcauuccauaugcuguauucuuugcuuuguucguucuccccucuuguaugguaagagucuuuuauugguucggggaaucauaggguauuuaauauagcaauuuccucagaaggaaacagugcaucuaugccuagcauuuugaugauuaauuuuuauaaaucaggcaacuuaaaaagcuguauuuucagauuauuuaguaaacuuuugauugcuuaauaguuaacaccguuuucuaggcauaguaacuauguagauacucucaaucuucagagguaaauaauuuguugauucauucaacuugcugucuauaaauaugcacuucaccaugcauauucauuuucuuggauaccauauagcuuagagaugugacaguucacaaaguauaaaguauggagauagauaaagucacaggaaaugguagauaguugguagcuguguuagagcgagauaaagguaugagaauugauuugggaaucugcuucaagucugcuuuugccauaugagggagaguuccuuuacgaucaggguagauguaaggaaggagguugacuguaguuaaaacugguguaaucguuuucuaggaugagcaggucagugguaaaucuugguuacauuagagcauuaacagaaugguugcuguaaucuguguuugugcagguaauaucuauuuuauugacugcucagcucccagugccuggacuacuuggggcauaguagcuggccaguauuauuuguugaauuaauaugcuguguuguacacauuagggauuuuauucuaaguuuuucuuuguucuagguacagauaccaauuuugacaccuggauuaaaagaugccaagaaauucagaaugguaaguauguuggguaggcuuccacaguccuguuuuuuuuuuguuuguuuguuuugguuuuucaagacaagguuucucuguauagcccuggcuggccucgaacucagaaaucugccugccucugccucccgagugcugggauuaaaggcgugcaccaccaugcccggcaccacaguccuguuuuaaaauaaacauuucaagauuuuugguuaaaauauuuuucuuuaaucuuucuuucuugguucuggggaucaaaccuaugaccuuguccaugcagggcaggugguugcucuacuacuaaguugcaccccagccccaauaguagacuauuuccuccugacccucguuuucaaucuuacaucagaaggaagauuuggugguuucgcuuugccaguaauauuauguuauuaccaguuaaagauaaccaaggaaucaaaaaauuaacuucuggaugcaaaauggaaacaguuugcuucauuugaaauacauagcaaauuaucuuuuuuguugauguggcuuuaccaauaaacauacugguaucugaaaaugcuuucuuuuuuguuuucuaggaucagaaucugaagugguaaguccucucaucucucaugcuuuguuuagucauguuaaauuuaauuaaucaaauauauauuuaugcuagggcuugggaugagcucucaaauauuaaagaguuuuauuuaaauauuaguuaucugaaauaacuuuuuuuaaaaauaaaagcuacaaguuuauaaucauggggaauacuggacuguccuaaugaauuuaguauauaaucuaaggugccuggguuuuugagucaucaggacgguuaucucccgucuuuucuuuaccaguauccacagccauuagguuaaagaauugucauguggagcuuuuuuacaguaggcuuaaaguaaauuggaaaugcuucuguuugguucauuuaaaaaaaaaauuuuauuuauguguaugaguuuuguggucuguguguauaccuguacaucagaccccacuaaagaugguuaugagcugucacaugguuguugagauuugaacucaagacuucuagaagacuagccaaugcauuucaccacugagccaucucucuagccccauuuggguucuuuuuuuuuuuuuuuuuuuuuuuuugguuuuuugagacaggauuucucuguguagcccuggcuguucuggaacucacucuguagucaggcuggccucaaacucagaaauccgccugccucugccucaauuugguucauucuuaauguuuguuaacaguuaaggauuuucauguucaaagcauuguuacaguagcagugccaaggcugcagagcuggcucagugcauaaaagcauuugcugcucuuccagaggauucgguugccaguguuugcaucaagcagcucacaaccacaugugacucuaguaguuccagaguaucugauacccucugguauccuaggaugcuuguucucguguggugagcagacacuugugcaggcacacguacauagaaauagaaaaugaguaagucucuuaaaauaccaugaaauuauaaggcaaaguaacuuaaaauauuugaauuuaauuuuuugaaauuucuuuaauguauauuaguguuuuaucuguguguauaucugugugugguacccauggaagucagaagaggccaucccaucccugggacuggaguuggcauauguuuuugaucugccaugugggugcugggaauugaaccuggguccucuggaagagcaaccaguguugauaacugcugagccagcucuccagccccagggucaguuuggcuuuucaucagucuagacuuucauauguuagacuuaaauugugacauacuguuuuagugguuguugucacauacauagucaauaaagacaaucacagugacuugggaaauauguaguccugaccuacuuuauggauaauuaccuuuuugagaugcuuauucaucuuuuaagaagauuuccuaagccgggagugguggcacacuccuuuaaucccaucauucaggaggcagaaacagguggauuucugaguucgaggccagccuggucuacaaagugaguuccaggacagccagggcuauaaagagaaacccugucucaaaaaacaaaaaacaaaaaaagaaaagaagagaaaaagaaaagaaaagaaagauuuccugcaggucagaggcagaggcaaguggaucucugaguuugaggccagccuggucuacagagugaguuucagggcagcccgggcuacacagagaaauacuguuuggaaaaacuggggguuaaaaaccugcagcuaacagcuauuuuguuucagacagaguucuugggaguauuagucagugcauguauauaggcaaaguuuacaacagcuuucaaaacugaagcccuguucaaccaccugucuguccaugccugcccuucauuccuagauaacugagugguaaacgaggaacuaaguggagaggacuuuacagcugacuuccuaauuuaccuguuaaugguguuucuguucgggccuuagaauauuuggaauugaaucuaggugugugccugggccaggcuuuugcaagcacugcaagcuaagagaagcaguguagggaagaaagguuuguuuugguucauaugcuuaaggagaccagaucauagcagcuuacaucauggugaacaggagacaaaguggggcgcagacaggacguccaguauaccuuccaaaggcauucaguugcucagugacuucuuucuuccagaaagccccuaacucccagaauggcaccaucagcuauguuuaaccuuugugaucagaggauacuuagaaucuaagcuugcacacaacagaaugguauuuggcuaacaaaaccacaauuuguccaguaauaaagcauauauagcuuuaguggcauauacccuuuauuuuggucggucuaucugucugucugucugucuaucuaucuauuuaucuaccuaccuaccuaaugugccugaguauuuuuccuaaauguacauguauguacaucaugacaucaagugggcauugaaucuccuggaacuggaguuacagaugguugugagcugucagguuggugcuacaaaucaaaccuggauuuucuggagagcagccaguucucuuaacugcugaaccaugucuucagcccccauuuagucuauuguguccuguuuccagguuacauuguccuuguucuagucgggaucugugcuuguuuccuguaggcuaaugcuggagaggaguuccaaguuggcgucacaccucuagaauaguuuugcuuacuucuuugguugcuuguuuuuucauuagggacaaauuagaggccacccaugacucaggcaucuucuuuuuuuuuuuuuuuuaagauuuauuuauuuuauuuuauuuuauuuuuauuauauauaaguacacuguagcugucuucagacacuccagaagagggagucagaucucauuacggaugguuauaagccaccaugugguugcugggauuugaacuucggaccuucagaagagcagucgggugcucuuacacacugagccaucucaccagcccucgggcaucuucuuaucucuacauagccuugacuaguaguugauaguuucagcauaugguuuagguaagacccauuuugcugggugagagugguggcucacccuuguaauuccaguacuuucauuuccucaugguuaggguauguugcagagacgccuuaaauguguacagugguguucugaagcucacccuccacgugguccuuuaccgucucuagagcaguguuugaugguuauaauucagccuaagguuauacugucuuuuuuaaaauauuuauuuaguuaguuaguuauauauuuauuauauguaaguacacuguagcugacuucagacacacccgaagagggcaucaccagcccagguuauacugucuuaaagcugacuuucuguuguugccacggucuccuguagccugggcugcucuugucacugugcugcugccacacccguuggaaguggucuucaguucuugaguucugugucuuucagcuggauauacauacuacacaagucaguucuucuagucauauuagaaagguuuuguuguuugcugcagcaggcucucacugugugaguacagcuggugugguacuccuacuccuccugcuuggaaaagcaggcugccaggcgguaagauuacacacugcacuucuuccauauucuagaacuacaggccucagcuaauuaauaauacauggacuuuuuaaauauagcugcuaaacuaacauguaaaauauuuuuucuuucaacuugcccaaaccagucugcaucucagaggacccagucaaaaaucaaguaaguguuucuuucuuauaaagcagcccaugguaaaugugcuuaaagaggagaaaauucugguuucacagaaggcagauccuuaacugugauuuuaaguguuuucuaauuuaaaaauuguguuacaguccucaugaaaaauuuaacuuuaagucugucuacuaauuaguauuaacauuuuaaugaauucacaucaaugucaucucuaaacuugcuuagcuugguuccauaucauguugccuuuguguguauuauggagagcugcuuccugugaagucacuguuguccauguaaagaaguagugggcuacacagaauugaaacuugccaugcugcugcuggugugugugugugugcacucgagugcgagaaacaggugcugaggacuaagccagcaaaggccccaugcauccuaggcgagugccauguaggugaacuguaccgucagcccuuguucugccucuuauauuuggaucauauuaggaaugcucuacaugaguucagagcuaguauugcagucacauaaugaaugauagcaaggcuuugacuguggcuuagucagugaagugcuagcccugcaggggugagcaucugaguuuggauucgaucacccacauaaauauaaaauaaaaccaaccaaaccaaagacugggcauggcagcacaccuguaaucuuagugcugcguggauagagaaagaugacuccuggagcucacuggccaaacagcuugucuagccauuuaauaaacuccaggugaguaaacacauuucaaaaaguaauauaggaaacaauuaaagaagacauccagccacuggccgacaaacacauucacuaggccacauguauauaugcacacaacauacaaaguauucucuagccacauaaacaacuuguacucuuaagacuguaacuuuggagucuuacuaguugugaaggugugugcugggccuguugaaguguauuucucuaccaaagauggcuuuuauuguaaucuaagcaggggaguggcagcucaggacagauuaaguacuaugugaagcaggcacuugcccuuauccuuagacauagauuagugcgcggaagcagcuuugcccucugggagauuuuagucuagucuccuuugggagugagaacgaacgccuacauuuucagugcuuguuauuggaagacauguaaaauucaucucuuagauacauuggccuucccucagaacuugaauuaauccuuuaauacaguguauaguguguuggcaggcgcuguggcaaugcuccucauugcuucacuccuuauauuugcucccaccuugagugagcagaacuuggaguacugacauaggcugacccguguccacagugucagugcugccaauugguuugcaagcugacugcuucaucuuuccaagcuaccacucucaaacuguuuuuaaagaguuaaagaugacaguguugguggugcacauaacugguagcuguuaaauuuucaucuucuguauuagcuuaagcacagcaguaucaggaacuggaaagguuugacauugucuaccugugauaggaauuaguuauuuauauagcugcuuuguauauuuacuuccuaaagguggagcucuuguucuaauaagacuauuaauuugacaacuuuaagaaaaucagaaauuauauuaagauauuucuuugaauagguaugacugguaucaaaccgagucucacguaaucaucacccuuaugaucaagagcguucagaagaaugauguacgugugggauuuucagagagagagguaauuagucuuugaaccuuauauagaaguuaaauacuguuuguaaauuuaguguaugaauaauuuauaccaguuuacuagauauauuucauuucuucuugagauaaaauggaaaauacuaaaugaaauuggaagcauugcuuuucauuugaaauuuuugaaaaugugaacuaagaacauguuugcaguaggcugucucuagaggugcuugcacuuggucugagauaagguccugcuaucuagccauggccggccuugaaccuggugcaauccuccugcaucagauccugggguacauggcacugugcacuugcuuauugugcacagugagcuuuugcuaguguugcuggcuuacaucaucugugagguuugcagugcaaagcagaacugggcugacaguaagaucaaugcucaguaagaucaaugcuuugcuuaaacuuacugguauauguuacuuucaaaaaaguuagguuuacuaccaccaacuaccuaccaacaucacacacaacacacacacaaacaguuuaguuauaugggauuuauacaugucuucaaguuuauuaacuauaucaaaggaguaugauuuaauagcuuuuuccucccucaugauagauauuuccaagcaguauugugauagaauuaauauaauuuacauagaguaggcauuuuuaaaagcuguaugcuauauuuguucuuauguauuauguuuucuuguuuugaauacuaaguaucuguaauuagaucucuaauuaauacaaugcaacauucuuuucuaccacuugguucuauguaugagaauucaaaugagagaugccaugugaaaaaaagaaaauauucuuuugaaguucccaaaucugacauugcagagcuggugagauggcuggaggguaaaggccccguuugccaagccagacagucugaguuccaucccaggguuccacaugguggagggagaaagcagacuccugcaaccugucaucugacccacacacaaacacacaaacucucucucucucacacacacacacacacacacacacacacacacacacacacacacacacccucacacacacacacacacacacacucacauaucugcagcauugcugaaauuuguaauuauauuaaacacuucacuuuuuauauacauuuacaaaguaugauacuaacuuuguuuucauuaguugucugcuuuggugaaaauuccugcuggagaagacuacaguuugaagcugaggcugcuccacccuauaauaccagaacagaguacauucaaaguacuuucaacaaagguaagcaagcaggaagaauguaauauugaaaagguaaucucugcacaaggauacugguagauaaaaucauccauguauaguuggccugcagccccugcucucagaguguuagggaucaaacccagagcuucaugugcuaggcaaggacucuaccaggagucugcaucccaggcaguguugcuguuuuuaagacacacaccacugaguuaaagguaugaguaaauaagaacaaagggguuuuuuucuaaguuuuaaaauuacauuuacaucuguguguaugucuguguguguguuuguguguguguguguauguauguguguguguauguaucuguguguguauguauguauguauguauguauguauguauguaugugagugcugugauggauggguagaggucauaggacauuuugugggaacugggaacugguucucuucuaccauguggguccagggaaucaaacucagguuuguggugguuugaauaugcuuggucccuggaguggcacuauuaagaggcguggccuuguuggaggaaguguguuacugugggugugggcuuugagacccuccuagcugccuaguaaccagccgucuaguggucuucagauaaagauguagaacucucagcuccuccuucaccaugcuugccuggaugcugccaugcucccucccuaaugauaauggacugaaccuaugaaccuguaagccagccacaauuaaauguuguccuuauaagaguugccuuggucauggugucuguucaccgcaguaaaacccuaacuaagguuucuauuuaauguagauauaucaaucagccuaucuaguuaauuuuuuguguguguguguuuuugauacuccccugagcauguuuauguagggcugaagguugaaguggggugucuuuugacauagggucuuuagcuauauugcagcuccguguuuuacuuagauuggcaggccagugaaccccaggaauucgccuguuugugcugcccuagcucuggaguuaagaacaaaugacgcagcugcauuuucugugggugcuaggaagcugagcucauguccugauccgcacagagcaagcaccuuagacuucauuguuuuaaaaaucaugcauguguuuguacugggacuagugcccaugagugcaggugucucaggaggccagaggcauuggguccccuuggaacuggaguuuuaaagguggcugugagcuacccgccccauacggauucuggaauccuccgcaagagcaggcuguacuuuucucagccaucuuuccaguucuaaccagccucuucaugagauuugaugcucgugaacugucaguguggucugccucacauaguuuauacguacuguaagguagaaccugcauuuuguugauuuuauuaguccaacugaacuuuagguuauuuucuuuguuugagacaggaugucucuguguuuucucuuugcugucuugaaacucacucugaagaccaggcugaccuugaacucagagaucugccugccucugccucccaagggcugggacuaagcgugugccccacaauacccagcucuagguuauuguauuaagaggaaaugcugaauauauuugaauuauaguaugauuauauaauuuagauuccuguauaguuaaaaauaagaaugccaauggaauuaguuuuuaaaugucauuccaaaaaagaaggaaguaguauaauuuaguagagaauauagaaaaauuaaaaauaagaacuguaggguauggugacuccuaccuguaauuccagcauccagaaggauagagugagaggauugcugugaguuugaggcaagccugggcuacagagugauuuucaggucagcauggguuagagugagaaaaaaagaaaaaacaaaaacaaaauacaguauaaauaaagcaugugacuugcgcaacccaaaaugaaagauauaggcuaaaugcaucuugagaucuugauguaaaacuauguaauuguaaaacugugaaaugauaucauaaaugaguaaaugaaaaaggaauuguuuagguggacauuuugcaguauaaucuucucuauuccuggaauuagggucaugaccuuccucuguuggaguaggaagaacaaagcuuagaaguagaguuugcauugacuuaaggauugcccuuuaggaaaauauauggcuugucaggaacaaagcuggccagcuaugaggcagcuacaugacacugcacucugugggauggugcagagugagaagaggggugucugagaaguuaggguuuccauugcugugaagugacaccaugaccaaggcaacucuuauaaggacauuuaacugggcagguuuacagauucugagguuaaguccauuaucaucaaggugggaucauggccucuuccaggcaggguaugguacaggaggugcugagaguuuacaccuuguucuaaaggagaagccugauuaacaggcaguaggaggagggucucucaaggccaccagcacacugacauaguuccuccaacaaggccacacuuccuaauagugccacuuccugggccaagcauauucaaaccaccacauuccacucccuggcucccauaggcuuguucaaacacaugagucuaugggggcuacaccuagccauaguauaaugcaaauuauauuuaguccaacuucaaaaguucucauaaucuauagcagucucaacaauguuaaaaguacaaagugucuucugagauucauucaaacaauuaacugcaauuucuuauaaaaucaaaagcaaaacagcaaaagccgaucacaucaucacaggcuauacauuaccauuugaaaaugucauagugaggaaauacuggacccaagaaagacagaaaaccagccuggcaaacuccgaacucugaaucucaugucugaugccaaagcacucuucagauucccaacuccuuucuuucuccugggcugguuccacucccugugagcagcuuuccuccacagguaucccauggcgcuggcaucuuuaauaucuuggggucugcaaggcaacuucagcguuacagcuuauuucaguuccugauagccacacaugauuuucugggcuccuccaaaaggcuugggucacucacuucuccagcucuuucuguagcacuuuaggcucuuguugacuccacuccacugcugcugcuguucucgguaaucaucccaggguacugacaucucuaauguguuggggucuucugcugaaacuaggcuucgccaauagucucucauaggcuccuuucaugguaccaagccucaccuucuuugcaugauccccucuggccuguaccaucaacugcaacugaggcugcaugcucaccaguaguagucuucccugucucucacagugccaagccucaguuugggugggaucuugccccaaagucaccacucuuuuuuguuuauuuaucuccuugaacauaggacagcucuauucuauuucuuggugccccuuuguaguacuacuuaauuaauccuacucaaaucauaucaacccuggguggcagcagcacuccaugauaaccuucccaguguucuggguuuuugaaugaaagauacacacacacacacacacacacacacacaugcccuuauauuuuaauaugccuuuaacagcucaguagguaggccacuuccaaaccuccauguggcuaacaacccccuucccccaauauuccugaguuauuacuuccuaagaucuguauuacaucuuuguuacccuagacccaguuggaggcuccuugggccugcucuuccccagcucuucucuguccucuguacuucucaggugugaugucuccuccagcauggcagcugucccucugcuuccugggucucuugccugggaauccuaaaaguccuaccucugucccccugcccagccacuagccaccugcaacuuuauuuaccaaucaaaaccaacuggggacaggguucuaugugcagauauggggauucuugugcaauuugggggacccagauaacauaguacuaguggcauuagaccagaucugcaauagcccuuuauucuuuuaaccauacaguuuguacuuuuccuucggaagcucacuccuagucaucaaaagucucuuccuaagagugaacuuuaguaaccgcacagcagaaucuauaccagaccguuuugacacuuucuuugucaaagcaauuaaucuaaaucucuuuaccuuagccucaggcagacucuuugaacaaagccaaaaagcagccacauucuuuaucaaaauauuacaagagcagucuguaggccacauacuaaaacucuucucuucugaaaccccuugagccaguaggccuauacaguucaagucacccucagcagcacugucuuccauauuccuacuaggauggcccaucaaacccaacuaaaaucauuccauggcuuuccaaauccaaggucccaaaauccacauucuuccaaacaaaaacauggucaggccuaucacagcaaugcccagucccugguaccaacuucuuucucaguuagggcuuuacugcugugagcaggcaccauaaccaaggcaagccuuauaaaggacaacauuuaauuggggcuggcuuacagguucugagguucaguccauugucaucaaggcuggcagaguccagguagauuugaggaucugagaguucuacaccuuguuccaaaggcaaacaggagagaagaaccaggcagcuaggaggagggucucucaaagcccaacuccauagugacacacuuccuucaacgaggccauauaugccuccugauaguaccacucccugggccaagcauauuuaaaccaccacaagggauugaccauuuucaguugcugcacuauucacauagaguuaaauuuauuuaaugauagaauuuugagcaguaggccccaaaacuggagagauaagagaggcaggugaggaauggugugguuuuuguuggguguuuuuaaguuguuuugguuucuaagucaaaggcuccccucaagcuguccauucuccugccucggccuuuugaaugccaaaauuuagauauuguccuuucuuauuguccaucugugaacuccaccuacauccgccuccugccuccuguugcuagguacugaaccugggacccugugcaagcuuaccacuugggcaucuucccagcccaagagagcccuacugcauguccauuugaagucauuuauuaagaauugauuucuggggcuggugagauggcucaguggguaagagcacccgacugcucuuccgaagguccgaaguucaaaucccagcaaccacaugguggcucacaaccaucuguaacaugaucugaugcccucuucuggagugucugaagacagcuacaguguacuuacauauaauaaauaaauaaauuaauuaaaaaaaaaaaaaaaaaaaaaaagaauugauuucugugaggagaugaugaaugacuuaagaauuuguauuucacauaauguuuggcauauaaaugcaguuuguauuucagguuaugaauuuauuauuuuauuuuagguuuuuuuguuuuguuuuuguuuuuuguuuuguuuuguuuuguuuuuuugagacaggguuucucuguguaguccuggcuguccuggaauucacuuuauagaccaggcuggccucgaacucagaaauccgccugccucugccucccaagugcugggauuaaaggugugugccaucauaccuggcaacugaauaacuuuggcauaaauauacucauacuauuuuuaucugcuagauuugguaguucucccccuauauacacagugcucagcgaugcuuguggaggaaccugaauuggaauugauagagugaauguuuuggguuuuguuuguuuuauuuuugagacaggauuucucuguguagagcuugcuguccccaaacuaccuccauagaacaggcuggucucaaacucccagaaaucagcuugcuucugauuccugaguccugggauuaaaggcucaaggaagaaaacggucucaaaguuuacacuguaguaaauaauaacguggcacauaccuguuccaacccucaggcagggggaucucuguuaguuguuugugcuggcccaggauacaagagcgaugcuucuuagguuuuucuuuguucugaauggaauuuaagauucuaagguugugucuaaagcagggcuuuuauaaccauuuugcuugagaacauuuuauguggcccugggaauauauagauauauaauauaacucaaguguucaguaauaauaaauuuuaaagaaauuuuaaagaauuuauuuuuaaaugauuauucgguuauauguagaaccuugccauuuacuaaaaaugaaagaaaagcuaagauaggugaucuuugguuuuugcacaaagaauuaaacuugguuguuacuuggugcauagagcaucaaggagauuuuuuaaguguuguuugaccuuuguuuuuguaaccaucaguucacauaaacauaguagaaaaugacaagcacuucuagggccauuucagaaacuguuggaaauucuguccuaaucccaagccagaauucauugaaugauuuauucauguuuaugaaauucauguuagcaauuucacaauaaaaucccaggauagaauaguuugauacuccuaugccaagguuuggcaggaggaauauaguaaagucuuaguuuucuguaauuaagccacgcuuuugguuuugacuuuuuuuuuuaaagaucacaaaagguguguccagcaaaaugacugcaguuuauuaacauacaccaguuuuugaaucccagccaagggguuucaggcagcauucaguuaauguugcagcaugguagcguguugagagagcacgcacagggcagagagugcaugcuguguguucaggcuaaggcugccgugaugcuguucagugcgguauuggcuagggcugcccaaaugccagggcuccuuacacauuuggcuuagaauuagcuuguggugguguuacuguugccaaagcuuuggugguuccuggauucagcugcacagcuggauacagggucgagagaccuacagauaggagaccaguguucugacccucgggucaacauaucuuccauauguaaucauaaacugcuguguuuuucaaaaacaaauugaaauuuuuuuuuuuuguaauuauguuucuuuagggaacuaaauggugaaaucuuugaucauuuccuuuuucaaacagcagagggaggcaguguuauaugcaguagugcuaggaagaugggauucaguggguaaagagcuugcuacacugaggacccagauuucuagaaccugcaugaaaucaggugggugugguggcuguucgugcuucucagcauccaggagauaagcacaggagauccuuagagcaagguggcuugucagacuagcuaaaauguuguacucuacguucagugagagaccccaucucaggauagaaggugaaugaaugagggucacaucugauaucuuuguacacgaauucacacacaugcagguacacucauacaugcaaauaaauaaaauguagacaauaaucuuccaugguucuguaaagugcgcuggcauauguaaagcacuaagcacacagugcuacuuacccucauaauucagaguuuuauaugggcucuaaaaaaagcagagaaggcaaucccugcuaccacagaugacauuuuagcaugcuucccuuuaaacauccagaucuuuugagcagaacucaugccauagucaccguuggcauuuuaguauauguuccacugaauaaccagcucuuuuccaguguguauguuguacauuggaauguuguuugcagucuucaagcagagucauaugacauaggauuuugguggucaaucagacauacagugggagggaagaauauguugauagcuuggccuuguacaggaaauguugcccugacucaaucucaaccugcaguaaauauuagaauuaagcaguuagaagaggugagggaaaaccagcuuccuguaaauugcccucugaccugcacaugguugaauaaggguagauuccugaguccgcucacagguuccugagauacugcucuaacagccaaggaauuugacugcuuagaaugcucagaagguuucauccugaagagcugccagagagccucagguccugaggaaacccuucucccaccagucuguggcucuugcucagagaagggaauggauaccauggcugcuuaggaguagugcuggagcaauuguccucugagagaaaugaaugaauucucuuacacacagaguccucagaggugggcuggugguauuauaauacugagaacuggugagccagcacaaaacugguucuuacagauggcuuauagcuacuucucugauauaugaucaucucuuaaaagcauuuucuguguacuugagaguaauauuuaaauuaccaaaguuuuaagauaauuguguguugggggaugcaugcauacgcaugugagugaacgugugugaaggcaggucaacaucuggugucuuccccauuucccuuuuugagaccuggucucucccugaaccuggagcucagugauuggccggcaaaccugagggauccccuugcucgcaccccaacccaccccaucucuaucuucuucgcuuugggguugcaagcuuccgugcccagcuuuguacauggguacugagggucugaacccgguccuuaggccugcggggcaagcucuuuaccaacugagccaucuucucaaacacuuaaggaaguuucacuuaaacacaaauaaguuugcuuauugaugguuacaaugaaaacauuucugaaacugggcagauaauucuagaaguaucuaccagaguccucaagacuuaaauuuaaauuuaaauuuuaagagcauguaugaauugaaaauuaagaauaaaaaggaauucauacuucuccccaucuuuugaacuucuacgagguugccuuucaugguuuauggugugcaugcuacugucuuagugaguggauuaaguagaacuucaaguuggaucagcuugugcuaagagauaaaggccucuuuguucaaagugcacaaaugcccagguuacaguggcuuucaauaaauguaagugcuaguauauggugcucuucaggugaaacaaggaucuuuuuaauaagaguaaaauuuuuauaauucuucagaucuaacuuuguauaauguaggcaaacuaucaaagacacuuaauucuuaaaaacuuugauuaguuaugaaaauugcauuuuugcuguuuuauguaucuuagguugaguaauggguuuuuuuuuuuuuuuuuuuuuuuugcuguuucuuucagauugaaauuaaaaugaaaaagccagaggcggugagaugggaaaagcuagagggacaaggagaugagcccacaccgaaacaguucacagcagguuuguacccuggccuccugaaguucacggucauuguguagcugaaaucaaauaguaaugagcacucucccuacugcuucguuuaugaaguaaagaugcuuuggauauaauaaagucauucugauguccaacauuugaauacagacacgucguggccaggcccagaggaguugggacuguccgcucugucagcuuaugacucaagccagcaaaugucugugcugccugguguuccgcucucgcccauggugagacaguuugcauuacugaugcacccuucccugucucuucuuuauuccucucugcuuuuccaacugauuuuuccaucucugaucuccuagaaucucaggaguucacagaguagugcauuaggacuauuucuuacuaagacagagauggacacagaucaggaaaggagcacguagaagaggaaacagcuagaguugauccuauagcccuuuaugugcagaaguccguucugcgcauguguuaucagcagauaggcaucuuuuuacuaguggaauaauuaaccugcaggaccuucuuagaacugcaaccuaagauuguaucuuaguguaauugccucauuacugaauagggagaaauuucuuuuuguuguuuaauacucugauuugauggcugaaacaagccaacauugugucucagcuacuuucagauuuuugccccuaauauaguagaaaacacaugugcuugugacaauuuuuagaaagugaguuauuaacagguccuguauguaugugugugugucagaauuucaugaauguacaaaaguugcaaaaauauguguuucuuuacauagugauagaauuuuaauaauuuguagcaaaguuaggaaaaccaggggagacagcaaagaugauuucuaguugauauuuuaaaggguaaauauuuuauggccaucccuugggaaugacucucagagguuuggggcugagguuuagauagugaacagcuguguaauaaguacagugcucauauaauaggcggcccagguauuuaccuguuuggaucacuuaguggaucuguggaggcugagguuuauauagugaacagcuguguaauaaauacagugcucauaagaguaggcggcccagguaucuuaccuguucagaucacuuaguggauuuguggaguacuaaaauucagggcaaaaugggugugguucugguaacucuugcuguguccuguggggcucauucuccaucaguggagaugaucucugcagucacaguugagugguagagugagugggcagagauguagauugcucucaguacuucaccuaccgucuccagugauucaagucguucugagauuaaauaucaagggaguguguguguguguaugugugugugugugugugugugugugugugugugggcaguuuuucuaaacugaaucuuuuagaaauucaagaugcacucccuccuguccuguguguuucucgaagaauuaauaugcuugucagauccuguguauugcaagcuggaaacuguagauaagggcaaggcacuuaaccuaucuaggccggcuuucuuaucuguagaguagagauuaaaauuucauucccauucuuccugggagucagcauuagaauuaauuaaauccauguucccagcuccuuaacaaugucuuaggguuuuuguuuuccuuggcuaccaguaaaauguacaaagauagcguuuccaauagagggaagugacauuuaggauguuuaaagcaauaagugcacucuggaugaaacugcaccaggucuuccuggaauuuacuuugaugaagacuggauaaagaaaaaguugguuuauuuauagguaaaaaggcacaggaaaacagaauaaauguuuauuuaguaguuucucaacuauuuuuagaaaagggauguagaauuauuggagaaggagcauuuaguguuacuguguuccagugugacaggggaaccuggagucugccugccugccugccugccugccugccugccugccugccuucccucccucccucccucccuacuuuuucuuccuuccuuccuuccuuccuuccuuucucucucucucucucucucucucucuaguacuguaaacuauacugucucuuuuaguagcugcuggcuguuuaccacuugaaguaguguguauuaagaugugaaaugcauacccaauuuuauacacacacacacacacacacacacacacacacacacacacacauauauauggaucauaauguauuuuaguauuuucuaggagacuucauguugaaacacuguucuuucuuguaugguagguuuaaaaaauacauuaagggccuggugagauggcccagaaggugaagguucuuguugcugaugacauaaauuugauaccgaggaccauccccaguaaauacauaaauguaauuuaaauauuauauuauauuauaauuuuuaauuauuuugguguuuguuuguuuguuuguuuguuuguuuuugagacaugguuucucuguauaacccuggcuauucuggaacuguguagaccagacuggccuugaacucagaaaucugacugccucugccucugccuucugagugcugggauuaaaaguguguguuaccaccagcccagcuuuuuuuuuuuuuuuuuuuuucuuuucuuuucuucuuuguauaaguuuugacuguguguuugugugugugccugguguguguggaagucagaagaguguacuuacccuggaacuggaguuaggacaguugugagcuuccaugugggugcugggaacugaaccccgguccuuugcaauagcagcaggggcuguuaacuguugacaucucucugaucccuaauacaugaauucuuaaaaugaaguuaaaauguauuucauuucuuuuuaauaacaguacuaaaacuguuaaauuguguaucuggaucacguuucuggcucuuauauuuucauuagaugaucaacagcuguucuuagcccugcugggucauuuaguuugucuguuuuccaguuauuugagugccaagaucuucauuuccucagccuuacaacaucccuccaguugcugggccuguaacuucuguauguaaaugauacaaaaguuauguuguuaucuacucuuagguagauaaguuuauuaucagauacuguauuaagauguggguaaguaaguggauugguuuucaguagucaggagucacuuaaugcuuuguuuuuaauuuuccuuuuaaaaauuuuacgugcauugcuguuuuggcugccuucauaucuguaugaagguguuggauccccuggaacuagaguuaacagacaacugugagcuuccaugugggugcugggaauugaaccuggguccucuggaagaguagccacugcucucaaauacugagccaucucucuaguccuauggaguuacauaauauuuucuauugaaguaaucuaauguguguguguguguaggagauggagcauuggcucauuauguggcagauauuuccacuuugaaagauauaccuaagugucucauagaaaagcuacacuuccaauguuaaaaucuugagagauugacuagggagaagguucagugguuuggcccacuugcugucuuagaccauuuaagacccagauuugguaccuagcauucauaucaggcagcuuacaacccucuguuauuucauuuccagggaaucucacaccuucucuggcucagggcacuugcauguacaggaugcauauauaacacucaggcucaggcacaaauaaaaucuuuuuagaaagcuuuagacguuucaaaauuagguaagcuuuuugguaguaucuggaauugauauaagaaccucgaauaugggaggcauuccuucugccauuguccaacaccccaccuucucauggagcauccuaaaauguguaugugugugugcgcgcagacuggcauuuuuauaguuauuuguacugccuuuuaaaaagauuuacuuauuugaugugagugaguguuuugcuugcagguaugccugugcaccauaugugugccuggugucccggagcacagaaguggacuuugaaaccagaguuuugaaugguuguucacugcccuggaggugcuggaagcagaacccagauucuacgcaagaacaaauccucuuagccacagagccuugucuucuggcccuauucugccuuuugcaaaccuuugcuucuuuccuagagcaacacuguguccugggggucagagggcagaagcguggcgugggcuccauucccuccugacuuuucauggguccugggaauggagcucagguuguguugcccgucuuuccagcugucuuuuaacuuuaauuuuucucucuuuuccaccuauuuuacuuaucuucuguuacugguugguuuuuuuuuuuuuuuuuuuuuuucuugaggaaguucucauuuaauaaaaucugaacuuaaccauguagcucauccugguaucuaauuacaguagucuugcuucagcuucuugaguaacuuucuuuccauaagaaguucuaucuguugaucccagcuuccccugugauuauuaugcagaguauuuuuagucuagcuuuguauaucguaucaaaaacauacccuuuauugaauuauuuugcucagaggaaauccuagaucuugcagucugcuaacuuacucaguuuuuuuuuuuuuaaagauuuauuuauuuauuauauguaaguacauuguagcugucuucagacacuccagaagagggagucagaucucauuacggaugguugugagccaccaugugguugcugggauuugaacucuggaccuuuggaagagcagucgggugcucuaacccacugagccaucucaccagccccuuacucaguuuuugaaauguuacugauggguauagcagagagacacuuaaugcaaaguagaaauucagugaccuacacuacuugcuaagauguucuggguaccguggucacagcguuuauguauuucuugacauaaucaaacaugcugauuaaucagucacuucugucuuuucacuuugcagauguaaagaacauguauccguccucaucucacuauacccggaacugggauaaguugguuggcgaaaucaaagaagaagaaaagaacgagaagcuggagggcgacgcagcuuuaaacaaguuauuccagcagaucuacucagacgguuccgaugaagugaaacgugccaugaacaagucauuuguaagaaaauaugaaguuuucagauauuuuaaauauuuuaaaauuaugagugaauuuuagauaucuaaaguaagaauaaauagugaguuugagaccacauugugugacccggauagcugggagagugucugguagacuuuggucuaguguugauuucuucuucuuccagacuguagaguagugguugcagaaaugaaauaagaaacaagugcauuaggaguuggaugguuaagaaauacuaagauugggacauugaugggaacuuacuguuuaguucagcucgucacaguagcucaauggguucccacuucuuuaaaaugaagaacuuaggagagagauuuccagaaucauauugggcuaguagaaaaugucugucuaguauucaguggcuuaauuuaucaauuuauuaagaaaauuuugcuaguguagccuaaagaucaccaggucuccaguucugagguuuuagugauaacucaucacuguaaaacuguguaaauuguuuauuuacacuuaaagauguuaucugcaugcuaguuuugcauguauguguggaggugagaggggggaauugcaggcaguugcuagcugugcaugggugcugggaacuuaacgccucuguaguccaggcuggcuuugaauuugcuguggagccauggauggccuugagcucuugguccuccugccuccguuuuccaagcucccgugugcuacucuacccagcaauuauuuuucuugaaaauauaaucaugaacuugaccaggaaaaauauuaucuacucaaaucuuuccaggcaagaaacucuuccuuacuguugacuuuaaaaaugugugcuagagagaauagcuguaugucaggucaaagaugugauacaaaauccacauccauuuucauauagaaaauugauaguuaacugagugauauauauccauaaagcaagccaucugugugguaauauugaccuuaaaugcagcuugcuucugucucugagggaagacaaaacagacugcccuuuauuguccuccagccuaacugaaguagugaggaggagaugcuaaauugcguuguaaagcgagaagggaaaguugucaucagugaauaugaccagacuaucaacuaaagucacuucugugaguuuuaucacggagaguccucuuaggaguagcuuauuuuacagacuugucacauuucauuuagucauauuauuugaagccugcugugugccaggccaccaugauuaggacuacagugaagguacauccaguuucuuugcauggguucuacagcugugaguccaacugacuugugacuugaaagugucauguuuguaccgaguaccuauuauacagucuuucuugucauucaacaaauaacacuaugugacggcaaccugauauuuacauagcauuggauauuauggguacucuagaaaugaucuguaguauagugguaaggugugccuagguuauauacaauuuaugaaccauguuauaugagguuuguagcauccacagauaguauuguauaugaagaaagggguaugccuagacccucuguagauaccaagugauauuuauguugauaaaauauaguccaugccuuugauacuuuuuuaaaaagauuuauuuauuuauuuauuuuaugcauaugaguacaccaccauugcugucuucagacacaccagaagagggcacuagaccccauuacagaugguugugagccaccauguggcugcugggaauugaacucaggaccucuggaagagcagucggugcucuuaacugcugagccaucucuccagcccaguccaugccuuugaagaguucuuuuugucucuagucaauaaugagaauuagacuuacauaggcaaaauuuuaaguggguauagugguaaucuagcacuugggaugcugagacaggagaguugugaguuuaagauaaguccgggcuaaauagcaagacccuaucucaaaagcaaucaaguaaaggaaaggaagcgauccuuacauugcagaggugccauguauaguaaugguggucacauagaagauagguuguaugggaguccagccuaguaauuaaaagucugagggaacuugacuggcaaggugacucaacagguagggugcuugcugccaaaccugaucauccgaguucaaucuuggguccucuguggugggaggaaagagcugauuucuacuaguuguccucugaccccccacaugugugccauggcaugcccacgcccgugcacacauguacaucuacauacacuaacuagauguaaucuaaaaauaagucggagcccaccaagacgugcugaccuucguguuuggaaggugaguaaagauguaaaacugggauggagacuagcuccccuugcagaggaguucagggaguuugcagaugguguuggugagcuugagguuccaguucaaaaggguaaacaacuuccuguguuugucagaaugcagcaaauuaaaagauuguaguuucaggaauucacauuauacucugcuauguaugacccauguccaugaauuuuuaucacaacaaaugcauggaaauuuuauaucuuuagaagugugaaccuuagccuuugacagcugagcugucucucccuuccaaguuuuuaauaauacaguuaugcauugcuuaacacuuggccguguucugagaaauuuguugcuggaugauuuucacuacugggcagcaccauugagugugcuuauacaaaucuguguaguacagucggucacuugaugugcccugauuuguguguguugcuggggauucaauccaggcuugcacaugcaagacuugugcuuccaugcugaccuguaccuacagcuugacggauucagaguccauguuaccaagagguuuggugaauacaggacauuugaggcugcaaguguaaauagaauauucuuuuacaacagacuuuuuuuuuuaauaaguggagaaguaaucuaaauuacuuaguaauuaguaagugaagcuaaaauuccaguaaaagaaguuuagcugcaacuaauauuuguugcuacauauuguauugucaucaucugagccguuguuuuauacggcuagcaggccccugcguuugauuacaucagcagccccauagacacuagaguuaugugcuggauuaugaacaguaucaauggcuacaauaucacugggcagccagaaguauuaagcugugucaucuuaugacaucaguauuaaguacaauucauuauugaccaaaucauuuugaugcacuguagggcuccaugcacauaauaggguuguugguagguuguguguucacugcauuauaaguagauaaccaggucacauguaguugaccacaugucccucuguuguaugugccauaauuaaaaagaaauucagaguacauuagaauaugcuuggcaaagagggaacauuaaguguggguccuuaaaguucuauuuaacugguauuuuacugucuucagcaaaauaagaucaugucauuuggggguggauuuuauuuucacuuguaagucaauuuuccacacaaugcaucuacuaauagcagaauacaugguccuuauaugggagugcacacgaugugccuaccuacuuacucuagaauuguccuuugucagcugucuucaaacuugcuaaccucucuggaaugccuaagguuaaauaaaaauguugaauuuauauugaauuauuuuuaguagccuacauaugggagaguguguuugauccauuuuaagaaaaauacuguauuuugauacacaauacaggaauaaaccuuuuuuuguuuuuuguuuuuuuuucucuuuuaauugcagauggagucuggugguacagucuugaguaccaacuggucugauguagguaaaaggaaaguugaaaucaacccucccgaugauauggaauggaaacaguacuaaauaaaucaauuugcuaucacuguauugcguguguucgagagagcccauugugugcuuuaucauauucuugaguuuuaaacaguaucuuuugaaagauuaaaccuucuugccucucugugcuuuagaaaugauuuuuccugcaaguauucuaaagagugacaaucacaucuuaucauuucuguccuuaaggauuuugcacauccugaaacugaaugaaaugccaguuguuccuagauagauccgcucugucuaguuaugaaguggagaaaucuuuaauagcaucuuggguaauugccuuauuuuugaugcaguguucugucaauaauugauuagaccuggcaacuuuggugggucuaacguuuucagcuucaguguuguguuuacuuuucagagcugcuuuggaaugagagcugugcauuucucugugaaggcugcugcuuuauuuaccuuccucuuaaguuuuuccugggaacuuugagaaauugcugcagagaauucccucauuuaguuuuuaugagaaguauuuguaacugcagcaagauuuugguucuaccuucuaaauucucgaauaaagcauagauucucgaguuuaccagcacacagauguaacugucaauaaguaaucugaguuggagaccaagagaaugccaggccuccucugccaccauuacugugguuucaguacuuaaauggagagagaugcccuuaguuucagaguguauaguauagcagagagaaggcugacauucaggaaaacuuaggaauggcugaauguugggcuacagaauaguuuuaacaaaccaaaaaaaauuaccccaugaugaauucuuugcagucuauaauaaugcauauuccacuggcaacucacagauuugacaucauuuuaucagccuuuguauagccuaguggcgggucugugcucugguagguguuacugauaauuuuguggcaagacacucccuuguauccucagagcugauggugaagugaaggagaaacauguuggaaagcauuucagcugcagaaaguguaggagaguucauauuuacagugggcuggucccagacccuuugcuaauagcuuguggaagugcacuggagauuaggagaggcuggcuccgaaugaaucccugaugcccgccucaccuuccagugacuguuacgugcuggauaacuggcauuaccgguucacaccaccauguuuggcuuaaucuuuuuguuggugguguccaugcugaaguucuaacugaccuuuugcccacguaaagcugcaaacuacuguccuuguucuugagcacuaaagggaaaggcaagguugacuucuugcuagaguggaguucaggaauucuuuccuuugggaaacaagauaguggguuguggucuagauguuaaauuaucucagugucuuugauccuaaggggaagagaggcuugcuacagaagcaauaaaggcaggacaccuccaccaauguacaagaauuuccagcccacucacuuuauaauuuucagcaguuaagccuccccccacaagagauauccuuauuguauguguauguguguuugcaugaguguauguacaauauuuguguguguauacacccagugccgcagaagaggccgcaggaugcucuggaaauggaguugcagacucugugagccuccuccaugugggugcugauaaccacgccagauccucugcaagagcaacaagugcuuaaugacagccgucucuccagccccaguauuaagccuguuagauuguaauuccuuuaguaaauaauaucuagagucuuagaauuaaaagauugugaauauaaauaaaucguauuuuuacuguucaaccuuuaaga

SEQ ID NO: 7608 - RNA, 4543 nt, Mus musculus
cagcuccagcccagggaaaggaggcggaggcgccgagugagggugggucugcgcguccuccgagccagcccgagccggagcugcagcuuuucccgcacggggcucgcagagccugggacucacgcuccgaucugcacgccggggaagacucuuuagguuagccuuucggaauagcaguuggggauuggcgauaugaguccugcgaagcgcuggggcagcccuugccuuuuccccuugcagcuauuuagucucugcugggugcucucaguggcccagagcaagacaguccgauacagcacguucgaagaggaugccccuggcacagucaucggaacccuugcagaagaccugcacaugaaagugucuggagacacaagcuuccgccugaugaagcaauucaacagcucucugcuccggguacgcgagggcgacgggcagcugaccgucggggaugcgggccuggaccgugagcgucuguguggcccguccccacagugcgugcuggccuucgauguugucagcuucucgcaggaacaguuccgccuggugcacguggagguggaggugagggauguaaacgaccacgcgccccgcuuuccccgagcccagaucccgguggaggucucagagagcgcuccgguaggcacacgcaucccccuggaggugcccguggacgaggacgugggugccaacgggcugcagaguguacgccuagccgagccucacagccccuuccgcguggagcugcagacgcgcgcggacggugcccagugugcggaccuggugcugcuacaggaguuggaccgcgagagccaggccuccuacagccuggagcugguggcucaggauggcgggcgaccgccgcguuccgccacagcagcccucagcgugcgugugcuagaugccaaugaccacagcccggccuucccacagggugccguggcagagguggaauuggccgaggacgcaccugugggaucgcugcugcucgaccuggacgcugccgaucccgacgaaggucccaacggcgacguuguguucaccuucggcgcccgcaccccucccgaagcccgccaccucuuccggcucgacccgcgcucuggccgccucaccuuggcugggcagguggacuacgagcgccaggacaccuacgagcuggacgugcgggcucaagaccgagguccagggccccggacagccaccugcaagguuaucgugcgcauccgagacgucaacgacaacgcuccugaaauuucuaucacuccucuggccgccccgggggcuccagccaccucgcccuucgccgccgccgccgcugccgccgcacucggaggagcggacgcggccucgucgacuggguccgggacacaggaagccgguaucaccucgcuggugccagagggggcggcgcgcgagagucuaguggcgcuggucagcaccucggacagggacucgggcgccaacgggcaggugcgcugcgcccucuacgggcacgagcacuuuaggcugcagccggccuaugcuggcagcuaccugguggugaccgcugcaucucuggaccgggagcgcaucgcggaguacaaccugacgcugguggccgaagaccguggcacacccccucuucgcaccgucaggcccuacaccgugcgagugggggacgagaacgacaacgcaccgaucuucaccaagccagucuaugaggugucgguccgcgaaaacaacccuccaggcgccuaccuggccacaguggcagcccgcgacccugacgugggucgcaacggucaagucaccuaccgccugguagaggccgaagugggccgcucuggggaagccguguccacuuacgucucaguagacccggcuaccggagccaucuacgcucuccguaguuuugacuaugagacucugcgccagcuugacgugcguguccaggccagcgacggcgguuccccucagcuuuccagcaaugcucuggugcaagugcgggugcuggaccagaaugaucauucuccgauccuugugcauccggcgccggcuaauggcucccuagaaguagcggucccuggacguuccaccaaggacacagcuguggcgcgcauccaggcccgggaugcugacgaaggagccaacggggaacuggccuuugaucugcugcagcaggagccacgcgaggccuucuccauaggccgccacacgggggagaucaugcuuacuggagaccucucgcaggagccuccuggccgcguguucaaggcccugcuggucauauccgacggcggccgucccccucucaccaccacugcaaccgucaguuucgugguaacagccgggggcgggucagcugugccugccagcuccgggagcccagagcacucccggccacccggcucucgccucgcgccgucggggccuucgcugcagugggacacgccgcugaucgucaucaucguguuagccgggagcugcacgcugcugcuugcagccaucaucgccaucgccaccaccugcaaccgccgcaagaaggaggugcgcaaagggggggcccuccgggaagagcggcccggggcggcgggcggcggagccucggccccuggcuccccggaugaaaccgccaggggaacugggcccaggcccaacauguucgacgugcucaccuucccuggcagcggcaaagcgcccuuuggcagccccgcggccgacgcgcccccgcccgcggucgccgcggccgaagugccgggcucggagggcggcagcgccacuggggaaagcgccugucacuucgaggggcagcagcggcuccgaggcgcgcacgccgaggugaggccuuccuucggcugggcgccccccuccgugcucugcggacaggcugggagaagggaaaccggagggguaagggugggcucucacagggagauguuuaaccugucgcacuugcuuuuuuguguccuguccaacccucacaccuuccccccucccccauucccugcugcagccuuacggugccucuccaggcuucgggaaggagccugcugcgcccccuguugcagucuggaagggucauucauucaacaccaucucgggccgagaagcugagaaguucagugggaaagacagcggcaaaggagacagugauuucaaugacagugacucggacaucagcggggacgcuuugaaaaaagaccucaucaaccacaugcagagugguaaggaugcuucuccccaggccaguccggugguccacccucccuugccaacuucuugccugcucaaaaccucuguucccagucccucuccuucaucccucucuucaauacuccagucccagccggaccccauucccuuuaaaugcgaugcuagccguggaaggaggguauucuauucaucguuuuguguuguuguuguugcugcugcugcugcucucccagcaaaggagcuacacuuugcauuaugucaaguuaucuucauggaaagcaugugccauccucuccagcugcccugaccccguugacauugugcagccuuagaauacuaaccucaggaauuucuuuucuuccccccccccccaggacugugggcguguacugcugagugcaagauccuaggucauucugaucgcugcuggagcccauccugugccggacccaacguacaccccccuccucacccaccagcccagaugucaaccuucuguaagagcacgucccugccucgggauccucugcgcagggacaauuacuaucaggcccagcuccccaagacaguaggguugcagagcgucuaugagaaaguacugcauagagacuaugacaggacagucacuuuacucuccccuccccguccaggaaggcucccagaccugcaggagauuggaguaccccucuaugaauccccuccugguagcagauacguguccccgaagaagggaaucaaugaaaauguguaaucuuauccugcaugucuucacacacauauacaggucacccugacacgucccuaaguuauugaccgguuucaguguuguauauauaaauaugcaagaugugccuuaaaaugaaguuguuggaagcuauuuccaaucacauugguacuguuugguauuugcaaacaaaaaaaauguaguuaauguaauuuuuaugaaaugugugcaguauuuaauuuuucuuaucaugcuauuggcuuuaauuucauuuguggcuugcaauuuucuuaguguuuuuaaccuguacauuguguaauguaauguuuguauauacugaaauuuuguuauauuuuuauauauuaaaagcuaaguggaaguuacugccaaaggaauugucuguaagacaaaaaacaaaauguguuggaauugcucauugggauuuuaucuuucaccagaaacaaccuaauguuugagaaguuuuugccuugccaagucuaacaacuuguagaucuugagucugugguagauuucaaguuacuguuauuuaauuacauucgguucucuguaagcucugucacuuauaagcacaguaauaaaggauucgucauguauuugaagaaucug

SEQ ID NO: 7609 - RNA, 2430 nt, Mus musculus
cguuguucuucagcauauacccaacuguaaccaaacuggagccuaguuauauccuaguugggaagcacuguguuauauaauucuauuaauguuaaccuuuaaugcuucucagcuuuaacuguaagaacacacuaccuccucaucacucuggugacaugugaaggcuggaaaaccugauguucaggaaaaaauuuacaauaaacagacuaugaagacaguaaguauuguuuguuuguuugggauauugguuucuuguuuuuguuuauuaauggaaauuauguuuaccacauguagaaaacuuuaaucaaauuucaucacaauuaauuuuccccuuccuaugcaaaagugugucauuguuguuguuuuauuuuguuuuauauuguuuuucuaguuuucaaugguccugaugaguucuuggagguuaauuccuggaaugucagucauugccagccacuuacuugcacuacauuuuuuuuucuuccaugcuaaauuuuaucuugucuccaguaauaagucaauaguuuuguuauauaucugaguacaacaauauuuuuuuacaugaagugucuggcaugacuuacaaaguuugcacauguuggagcuuagcuggaagaucauauaaagaccuuaaagugggaaauauguacuauaugaaguaaaauuucaacuaauauuguacuaauucucugagaauguuggacaaacacaucauuuuauucugaucauauucacccauaauuccagcuccaaugaucccaaaaugcacuucaaccauaccccucaccuuaugugcuuguaaagaaaauaauaacucuaccuaguucaguauauuaaugguguaguaccauccacuguagcaaaguuaaccuaucagcauacauaacaauauuaaugacuaaguagcuuagguuccuacauagaaguaaguagaacuguuaucuuauucuuccaauguauaaaauugaguuggcuuauguugugccauucaaaugaucucuacuuaaaagguaaugucccuauauuuuauauugucuaguacuugccuauacaaugcauuuaucugcuaacaaacucaucaauucauuccuucagaaaaguauccauuggacugagcauaggggcugcaauggaggaguuacagaaagaaccaaguagcugaagggguuugcagcccuauaggaggaacagcaauaugaaccaaccaguaccccuagagaucccaagagacuaaaccaccaaccaaagaguacacauggagggacccauggcuccagacacauauauagcagaggauugccuucucggacaucagugagaggagaggcccuugguccugugaaggcuuaaugccucaguguagagaaaugccaggacagugaagcaggagugaguggguugaugagcaaggggagacaggagauggggauagggggauuuuggaggggaaacuaggaaaggggauaacauuugaaauguaaauaaagaaaauaucuaauaaaaaugaaaaaaugagcaugcauguaaaaauaaauaaauaaacagagagauaaauaaauaaauaaauaaauaaacagacucugucacacacagaagcuuccagcauggcacuuuuucuuuucuuguucagauaauuugcaaaugaaaugaaucaaccaaagaaagauguuuggguaacaucugcuuucuucaguuguauagauugaaacaaagggugugcuagaguacuucccauuaauuguuuccauugucugugaauuacccugaauauccaauugucuuuauucuacagcuucucauuaaaaccaaagcugcuaaaguuugugggccuucauuuuauaugcuacauuuaauaugcaaacuaauuuugaaaggaagcagcaccugcaaauucaauugaauuuacauaagaaagauaguagagauucaaaacuugccuuguagaagacaaugauagagguagauaugguuaugggugaguacuauguaacaaaaguuuacucagaacugaauuucaaggucagaguaggagaaguaauauacuauaaacauuucauauaaguggacauuuuacauuaaagcacccaagauuuauucuucauucaagcagugacagaggggccauuuauuuugucaccaaaucuugcauuauuuacuugaacaacucacuggcucaauuuauuguuccuggguuuuguagaugacaucucuaauccucauacuguagaagaugaagcaagagaaauaccacaaguuucaagccaggaugggagacacucagugaguuuuagaucaaccuaggcugcagucugagaucuugacaaagagaagauaauaaaagaagacagcaaaagugacucgaauuucaagauaagaaucuguaaaggcuuuucuaccugacuuggcaacaaguauuaaauucuaauacuguca

SEQ ID NO: 7610 - RNA, 806 nt, Mus musculus
gugugugugugugugugugugugugguguauguacgcguuuucucacggugggauguuuauuucggugaacgccaggaaagugcaguguuagagaucugucugugcuagcuagcucgggagcaaacacgccgcaagcaacuguaaucaauauguaacuuucuucauccucagagaaauccccgcuguccccaggcacccaugcaaggaaagucacuugauuaugaaaguguuucagaagaaaagcagacgccgguggagagagaggcagugucucgaaggagggaacaagccucucuuaagacauguuuugcagcuccaugaaacugaaaucugguugaacaguguuuagacuucuaccuuuuaaccaucuccuaucacagcccacauucaagguaauccaaugucccuuaaugucccuagcuuuggugucuaauucacuucuguucaucuuacuaaaauuccaaauagcaauuugauauuuuuuucaaaucaaauagcauugcuaauauguauaaagucuccuauucauagaagcugaacuuaggcaagaacuuauaccagauugaaugauguuuguuuaaauauucucucucugucucuuugucucucucucuucuuccuccucuuccucucccuccucuuccuccuccccccccccauucuaaauuucucaucuccagcuuuagaaucucaaagcuugcuuuugucugaacugcuuucacaaacauccacaaguuacgaucaguuuugguucugaucuagcaguucuggagcagaguuaagagggacaaaggaaaacaauccg

SEQ ID NO: 7611 - RNA, 947 nt, Mus musculus
ucaaguaucugugcacaaagcacagagccagguauauggaagacuuuuaauaauugugagcugacaguuagauagaaaugggcugaucaucucuaucuggacgagguagguagcugagaggagaagaaauaagucucagcaacagcuggagagaaaaguaauauuuaggcauuuuauuuucuuguauuuaaauauaaaaauugaaaagaaaauuccaaaacuuuagacauauauauuguaauauaugagacauuagugaaaaaguaaguuauuaaauacaguucaagugaugaaauaaaauaggaucaggaaugagagacugacaggucuguccccuaacucugggugggaagaauuauuguugaguaugauauagauacaaacauggauucacauuuccaagaugugacagaauauacuauguauuuuauauaacuucacagacuuccaggcaacuucacaaggguaaaaguuuaagcaagcuaaggaauauaagaaaaguuagauauuuaaaaaaaauaaguaucggcaagaaaaacaauugauaugcagcccugaaguacaaucagagguuagaaacaucaauuuauaauaucauucccaaagcugagcgauuuuaagcaccuaguaugagagaagauugauuguacauuauucuacgauuagguauuugggguaagguaaaagagcaaugaaaucaagugugcaaaguaauugagcaauccagaaaaaucaucuucuuucaugcucaaaugggagaauauaucuaggaaaaagaaagucuucggccuugggaaaagagaaaaggcaacaaauuagauucuuuggagauuaaagaagaaguuuuaguaagcuaaaaugaugaaauagaaagauuaaguaauuugaucaggaaauuguacuaacguuuuauacacuacuaguggcuauaacccaccuauguuaaa

SEQ ID NO: 7612 - RNA, 485 nt, Mus musculus
uucauggguucuccaugggcugguggggccaguacggguacuucuucuuguccagcuuggcuucugggaagaucucauuccagucaucacuggucagcuggucaaagggaauuguguuccucguuuucuccagcugcuucucacacuccuggguccugagcugagguccagacacaaacucagcacagcucuccacauccuccucuuccuccuguccaccagggcuguguguuuauccucaggcacagggaucuucagggcauuauacugcuuucaaaaucauccaccaagccaggcuuggccacauuggcccuguagaaagcccagucaaucgcaggugguuucucagacagacuagccgaccugggguggaaggucucauuccaggacuucagggcauuuccaguugccuucugguuugggggugugaucuacacaaaagaucccaaucaaugguuuuuagagcaaguuuaugcccagccauc

SEQ ID NO: 7613 - RNA, 889 nt, Mus musculus
caucaauuuuuuuuuuuuuaacgaucacaaauaggacuuuuuauuugucacuauuaaaaaucuggauuuuacacugauucuuggacuggcgguucauauccgucagcucgcucaaccuuagcacccgucucgucuccagcugcuuugccagagcugccgccuuccccaugcagcuccaugagcuugcccaauucagacuuggguuucuucagcauuuuaacuuuucuaacaaagacgucauggagaggauaaauggacuggcaagccuuuucuaugucuuucccaaugcugucuggaaucaguuuauuaacuacuuccuucaagucauuggucugcaccucucgggucaugauuuccaucaucuucuuccggaucuggcggacuugcuggugcugcgcauaggaugucuuucuuaucugguuguugcguuucuuagugaagccaacacagaaaagucggagcaaauacccaucggucgucuugacaucaacgugagcuucgaucauggucugccacuucuugaccauggagcacauuuugucccggguaagauccauaccauggaaguuagucagacaguuuuugcccugaacguccucagugauuagcuugaauuuucuaaacgcaacuucaucauucuguagaucggcaaggcucacuucaaacacacgacccuugaggccaucagaggcaauuuugguuccuugaguccucgugacuagugucuucccgauguuccuaauauugaacauggcuggagcuuucacaucguaccagucuuucuuagaaaauggaucgaccacuuucuucuuagcucccuucuugccaccuuucgucaggcgcuuguucuugccgaccgccauggugccgacuggagagccaaaaggga

SEQ ID NO: 7614 - RNA, 3240 nt, Mus musculus
acucuauuuuuuuuuuuauggagauuuuauuuccuuuauuugagaaacuuaagucuuggguacaucaaaaccaauuucugggaugagggaaaaaaaaaaccagaacccauaauagaaaaaaaaaguuaucaucugggucacaacagaacccagagaauauauucuuauaauugaaaaaauuauaggugcuucauaauugaccuucugauacaaaaugaccuauugaauuugcaacuugguucuugguguggagguccacagacaaacuaggaugucuucagaccuuagcuggaugccaugagggguuauuuggcuuucgacucuuuuuuucuugucuaagagguagcagcagcaacagugcccaccuucugggcagcuucuuucuuggcauggugagccugcaggacugccaccgcuucaucuaccuuggagcggagggacucgggggacuccagcaugugcagcagcucagaguugucgauuuccagcagcaucccggugauuuucccagccagguuugaaugcauuguuuggauaagcgggaacagacgcucccccagcaucugcuucugcuccugagggggcgcugcagcaagcauggaggcagucaggggcuccugacccuggacguggacugcaggcuggggggccugcagcggcuggauggcagggugugggcugcggacacuggaggcguacuuguauggagccacagcccugggagcggcggcagcaacugcggcccgaggugcaagguuuggcacggcuccagacuggcagcugucagucagcccuugcugggcggcaccagccccaccaaaguccauagccaagcgguccgggcacucagacccaguuggagccagaugucgaagagcuggacgaggcccagacugccgcagggcacuuggcauuccuuggaagccuugaggucucccgccuugcugccagcguggauuaggccucaucugugcuaacugguuaggcguguaauaugggggucuucccugagccugcggaacugcaggcacaaaauagccaccagcugcaggcuggaacugauuuaagauggcacuggcagggagugcucucauccccgccacacgcugcauguacugguuagucaggugagccuuccgcucuuccuuccucugggccagggcgacguacagaggcuuggagcccacaaugcguccauucaucucggugacagcuuuggucgccucuucaggagaggagaaacagacaaagccaaacccuuugcuucucccaucuucuagcaucaccuucgcacuggugauugauccaaagggagaaaacucuuuccuuaauuucucaucaucaauggugucauccaaguucuuaauguagagauucacccccugguaccggcuaauccucuccugcuugagcugcucaaacuuccgcuuuagcucagccugccuuucuaccuuuuucugugcacggccuacaaauauggcuuucccgcucauuuccuuuccauucauuucuuccacagccuuauuggcauccucguguuucucguaacuuacaaagccaaagccuuuggacuucccacuggagucucucaucaccuugacacuuagggucuuaccaaacuggcugaagagcucuuucagauucccaucauccaccucuucuccaaaguuuuugauauaaacauuggugaauuccuuggccuuggcuccaagcuccgcuucccgcucuuugcgagacuugaaucuacccacgaacacuuuacggucauugagaagcaugccauucaucuucucgauggccuugucggcggccucuugggucucgaagugaacaaaagcauagcccuuagagccguucucaucacagaccaccuuacaggacaagauguuuccaaaggcagagaaagugucauacagugccuuguugucuauggauuuguccagguucuugaugaagacauucccaaccccagauuuucucaacgagggaucccucugcgaccacaugaugcggaucggcuuucccuucaucacgucgaaguucaugguguccaaggcccucucagcgucagcuggcugcuggaaguugacguaggcauaacccagagagcgccgggugaucauaucgcgacagacccggauggacagcacaggccccgcagggcuaaacuuuucauacagcauggcuucggugacguccgagugcaaaucgcccacguauaaggaggccaugggguagcugcuggcugcagcauucaucuccccaccccccacgaccccgagccccgccaggaggacuucuaacaaggccuacugcaggacaaaaggggcuccgaggagcuauggcacgcgccgcagcgcacagguggcaccagcgacaccggagaaggcuggagcagggaggcuccgagccgggacccgugugccggacgacuugcacgggacugcaaaagccccaagacaaaaggcucucaaaaacaauauggcccgcuccuggaguuuguacucuccagcuguccuggcuugaggcuuaaaaaauaaaaauuaaaguaggaaauccccucguaaaaggggcaaaaaauuuucaagaggcaaucagaugcugcgcucacggccgccuugggaacacgcguuucgugauaaauauaggccccggacucccggcgguuuacaguuacagcagcccgggaagggggaaaccaaaucuuugcgggugccggcgaagggcagugcggacacguggugcggccagccgggacgcggggcugccacgcggcgcagaggcgugcaggggcgggccgggccgagggggauggcucaccaccggacggacagacagacgcugacggacaggcaggccggaagcugugaaagucacuuccccacgggcucccagcacaagucgcugucugguucuuuuucuucuuuuuuucccuuuugcuuuuuuuuuuuuuuuccucuucuuuucuuuucuuuuuuuuuuuuaagguuuuugaggcuuuuguauuuuuuuuaagcuuuuucuuuuuucugcuucaggcuugcugagcccaaacgcaacacugacggcugcgacccggggcggagagagccaggaacucuauuacuaucaauuucaaaugacaucuaaaaacuugaacauguaaaauuagccuuuaucauuauacuauucauuggaaaaacagacuuacaaaaaaaacugauguaaauuuuguguaaaauaaaauugcuuuugagauca

SEQ ID NO: 7615 - RNA, 1534 nt, Mus musculus
ugacuuagagaacagagcaauguaagucuggcugguugccuaaaucuuuuaacucuccuaagaacgcuaaguaaaugcuguaaucaauaguuuguauugccuuaaaauaucuucaaugucuuuucucuguuuuauuuucuuccuuuuuuuuucuagaaguuauuaaaagcuggaaacaucuuaaaugaguaguuagcuucaauauuagcugguaccacauucaaagacaaugaauuaauauuauuaauauaugauaauauuaaacagucauauugauuagaaguagcauagcuuaugaacacauuugaucaaaguaaugucuuauguagaauaaaguaauuaaagucuaaauuagauuuguuuagcuuuaaguguaguuuuggugguagcaaucuaauaggaagcuuuuaucucuuuuuucgcuuaccuccagcgggccuggcugagcauugaguggauaccuaccggaugacccauaaggaagccaacagacagccaagacuacaugaacagauuuaggacacuuucagucucaauuaucagaaguacacugaaaaaaaaauggaugucucuggaucaaaacaaauacacaaaaggaaaauacugcaguuguuuucuuguuucucuuguacccgaaaucagaagaaacucaaacauaaaucccacgaaguagaaaaaaaacucuguagagaaaauaaggcguugagagaugaaaacagggcucugagaaaagacaacaaauuucucuggggcgaaaacaaagccuuaggacgagagaauaaaaccuuucggauggacaaccaguucaucagggagaggaaccgcauccuacggcagcagaaccagcuacuccggaaggugaaaagguugaugucagagaacccaaaacugucgggggaagaauacaacgccuugagcacagaaggaaagucuuuuuggcaacagaaucgagccauggaagcucagaucacagcucuccggcagcaagagaaagccuuccagaaugaggcuaaggcucugcaugaggagaucaaaucccugugugaggagaccaaggcucugcaacaccaggagagggcucucagaauggaagagaaagcucugaugagggauggaguggcggcggagcuggccgaggcccugaccaaggagggggcugcucuggagauggaagaacaggcucuguggaaggaggagcaggcucuccgggaggagaacaaagcacugagagaagagcauggggcucuccaagaugaagaaguugcccugcaggaagaggcgaaaauccuccaggaguggaauaaucuucuucaggggaagaucacaaacaaccucccagggaaaacgcaaaaccaagacccaaagaaguguggcccaagaauguaaccacgaagucaugacaauaaguagcuuuccagaacauaaaaguagaauucgaucgaucguguaaccuuauugucagaagccucagaaguugaugugcucgauauuugguccuggaaacaaaauaaaggccugagaaaugaacuaaaau

SEQ ID NO: 7616 - RNA, 12353 nt, Mus musculus
augauccuuagagacgucauguuggaugaaggaagacaacaauggacagauaauauauggugcaacuuauagaagacgccuaggauuaaguuaauggucagaaugcagaaaaaaugccuggucaggggaagggauggggaaucacuaauuagcgugcuguuucagucugagaugaugacaauguuguaaauaugguaagagucacacaacaauggcagguucuucaugucaggaagcugcucgauuuaacucacuagaacucaucauacauuuuacauuauauuucacuacaacauaaaauaguuaaagaaacaaggaacugaguucuuaauuaaauguuugaaacauauuugguucacauauugggaaauguucacauauuugaacaugcaaauaaauuuuaugacucuccacauaaagauacagaaaaaaaaaccauuuaucugaauugucaauauuuaucugaauugucaauauuuaucugaauugucaauuuagucguaaagccaaaucaaugcuauuauaauaauuucugcuauuauaauaauuucugcuauuauaauaauuucugcuauuauuauaauuuccccucacuaucaggaaaaaagaaucccacccauacucaggguuaagauguaauuauacgaugcaucauagccaucuuaacauuuuuauacacaguaaauuccuucaguuuagauuaccuucaaaaacagaacugaacccacagaaguauacaguauaucaaaaggacaaggccaauaacacaaaaugauuuuauuuuugucacuggugacaaacauguaucgcugguuucuuaaauauuacuuauguacucauuaaaaauauguuuacaucuaaaaaugugacacaauuaggaaguucucucuaaacauaaucuuuccuaaauauaauuuccuaguuuguuucacacauaacuuaaucuacaaaaucaaaaauaaaacuaccaaccaacucuguggucuagaaauacauacaaacugugaaaucugagaaaguacuuucugauuuuaaaaauaauauacaauauaugcauaucacuaaucaaaugguucuuacaaguucuuacugucucccaacuuggaagagaugccuguaauagaccuuucaauuuacuuaguaaagaugccauacauguaaaaagucaaaacaaucacaaucaagauuuugucuguagagaucaggucucacuuuguugccuaagcagcguacgcuggccugcgagucaccguuccucggccucagccucugacagcagggacuacugaccagcagacgagaugagucucagagcagaggaaacagcuacuucauuacuaaguggcuuaaaaccaccuuggcuucucugaaauaaaaaaggguuggcauggaaucaaacuuaaaauuuaagaaucaagacaggcggugguggcgcaugccuuuacucccagcacuugggaggcagaggcagguggauuucugaguucaaggccagccuggucuacagaaugaguuccaggacagccagggcuacacagagaaacccugucuugaaaaacaaaacaaaacaaaacaaaaacaauuuaagaaucaaaaaauucagauuaaauacacacugagcucaugaaaauaucccacugagauucuguaacaggggcagaagcaacuccauccagcuuuucaaauuuaucuuugaccaucauuuuaaugaguuaaaagcuuuaaugguaaaaauuacaaacauuuucugcaaauaauacugguacauauuucauuaguuuuuguugaacaacuggaaauccuacuucuuuagaaaacaugaauuaaucuguugaaauacaccaccuauguacugacuuaauagccacucaagauucgcuaguaagcuuauuguuuuuaugcaauaacauuaaaaaggaauuuuguauguuugcuguuuucacuucauacauuauuuuguggaccuuuaugugguuauaagauuuacagagaaaugcauuucagcuguucuuauuagauuuuaaugguucaaacuacaaauaaugcuaagucaagcccuggcauuccuuuuuaaaaauccaaguuucuaaaaguucuaaguuuucggcaauauaaaaaugaucuucuuuacaccuuuaacugccaaaaacuggguaaaaaacaaaauauucuguuaaggagaugauuugagauguuuuggauccuauuuuuaaaaacaagaugugaaacagaaaacuucacaaacagcagcucaaauuccauuaacuuacagcucaauggaacacacagccaguuuuuaugcuuaaacaauucaaaauuaagguuuauauugguaaugucaacaagucauaacuacuacacaucaccucugauacaacccacuaacuucaaacaggcucagcagcugugcaugucggguagaugcuguuuagaaacucacagcuagcagagcuauaaauauacauaaauaaguguggcaacacucuggaguuggggccauuacaacaagacgugauguaaacacacgugcugauucucgcucaagccacuucccacugacaugcucagccaugguuuuauaauucuuuguaaaagaaaacauuuucuacucagcaugcagcauugucauuuuauaucuugacuaugauggaaucuucaaauuuucuugcuaagcuugacauaucucaucaggaauucucuggaagucagcuuguguuuucagcagccuagacaaaacaagagagcaagauccauuauuuuaagaaaccauaguuaagacaaccauggagguaaaucuaccuauaccauauuuaacaaacagcuaguuauuccacaucacaacucaauugguuuuacuggaaaaauacaaugauuuuuauuuuuuguuguauuaucagauauuuuaaauuuacugccagauuauaaaaagaaggagucauuuauauaauagagaucauguaaaauguacuacuucuuuaagaguuaacacauaacuuguuuuccaaggucuucauuaguuuuuuuuuacuauaguguaaagacagaauuaauaaugagaaagaccuaguaagcuacaaauaaagaauaccagcaaacagggaagauauuuguaauuuuucuucuuuuuauuucuuuuuuauuuuugcuaaaagguauuuaugguauuuuacuuaaaaacagaaauaauuuuauuguaaugaacucagaaauagagaaaucacgcuugaacucgcagucccaagcugcacauaguucacugacacagccagccaugcagcuucauucagugcuuuaccuucaguaccaauuacauuuuauguucugaugcagacgcacagacggagcggagacagcaugacaguuaaaacuagagaaacaaugagcucuguauuuucaggacucgcugacaucacccaggaucacccuucuuggucucuuuucugaaugguaugcaguauccuuuacaccugucuacacacguauguauuacagaguaggauuugcaugagugagaaugugcaguguguuuucuuccccagacugggugaccucaccucccagguuugucugauucacaaauaaaauaaaauaaaauaaaauaaaauaaaauaaaauaaaaaaaauagagaugauauguagucuaggacuugaaagaauaaacaucuaucuaccaguaagcccagcagagcuagagcuaaccuugaacuccauggggaagaaguccugcuucaaaaaaaaaaaaaaaaaaaaaaggaacaaaacauagacuuaauauaauuucuuagaugaucaauuuuaucuuagaaacacaugcucgauuuuuaauguacuucuauuuuuauuuccuaguuaaaauguucuuuuuagcuaguucaggaaaauacaauaaaauauuggggaaaugauaaauaauucaaagaagcagccuaaccguuuccuuugcaggcagcagaacugaccuugcuugccuuagacucaucugcucacaaccagucugaauuagcuuuuuccuccuccagacuuacugcccaagaguaagaacacaguuugaaaacuguugccaguugucaugguuugaauaugcuuagccaagggaguggcacuauauggagguguggccuuguuggaguaggugagucacugugggcauaggcuuuaagacccuuauccuagcugccuggaagucagucuuccacuagcagccuuuagaucucucagcucugccuguaccaugccugaaccugguaagcuagccccaaauacauguuguccuuauaagccuugccuuggucguggugucuguucccaacaaccacucacuaaggucugguggcacucugaagacagaggcaggcugaucuccaucagucugauugaggccagcuuuggauacccauugaaauucugucucaaaaaagaaaccauuuaaaaagcuggcucacacauucuuugucagucggugcaaauuaaaacuccagucuaccacuuacugucaguagcuggacugcauugccaucagcuucagauugcugagcagcaccuugcuguuacuguaugacuggaggaagugaugcccgcacggucugagccuauggucucucuaguacaaggaaggguucacuucacugcuuccuacuaacuuugcaguuuucauccugcugugaaagcuauaaacugaguuuuuaaaaagaugacaaagaaagcaagugaauuuuuaaaaaggcugggcgaaccccaugaacugcauucacucuuaggguucucagaagugcaauuuacacaaagaggucccaaacaugcuccuuaaugagagauggcugaccacugacgaacaugaagcagaggcaaaucaugugcugcuggugaaauauaaaucaagacaacuacucugggaaagaaagcgcggcacuguaaugaucauuaacacacaaccaacagcccagcauuuuaugccuggguacauaccuagaacaacugcacauauauaagcaugaagagcuaugaacuacaauaaugcuaaauaaggcucagaguagcacaacucaguaucuacucagcacagaaaggguaaauuguuguauauuuguggaaggaaaucuauuugcaugaaaggaacacauuacaguggcauucaacauaaaugaagacgauagauguaacagaaaagggggaaaaacccaguggaaaaagaagauuguauuuaaacaaagcauaaacuuuucuaaaguuaaaguaauuucagacuccuaguucagucagugagacuggugaaugucuacuuuagaacucaggaugcuggaggggaaagcuagggugcugagaacagugacuauggagggaagagaggucucuaaagugcuaguagugauaacugugguuccguaauucucugugcagugcacaagugucugcaaucagcaccaggugccuuccacagucaccuuccaccuuagcuugaccaggucuuaagucgauugauuggucugcacuaacuggccagcaggacccaggaacccuaucucuacccuggcaccccagcucuaggaaacacaucccugaacccagacuccuauugaacgcuggggaucaaaaccauguuuguaucucaaaggcuucacugagccauugucccauguaaccucccgcacaagccugaagcaggcugagccagaccuugacuuugcuuaccacuaaggagaucaccuaggguggagccugccucccugauuguucuauuguucugccauugcugccgcugcugccugcugggaguccgccuagcuguuuccgagucuacaucugaugcuacacauggucaccugcagcugggcuccaaggaugauuuggugggaaugggcuucccccuccuuuauaaagugugucugccauuaaaaauuugagucuugaucagaauacugucuuggcuccauuucucucuuccaccuagauuccuuuucuuucagcuccaggcugccucccaggcucaaacccagacaugagagcugcaggccggcccccacagucccagcccuuuuuguaccauuaaaucaauauuuacucuaaguacauuuugucuacccuuuguauuagguuuaaaaacucagagauuaaaaagaagaaaauaaaaaacccuuggguuguuugaaaaacaauuuacauauuucauauaguaccauuuucucagaagaaaagggaagccauuuugcuguuggacaaguuuaacuguaaucacuuacaauuucaauagucacaguuaaugagauaccucaccaccauacagacuucucuccuauugucuucacacgguguucuuucuguuuaucuguauucaaauuucccuuaucuaauuaugacaccaauugcuggauuagaagccaccguaauucaguaugagcucauuguaaucugugacaaauacauaaauacuauuuucaaauaugguuagacucaauugguaccagggaucagaacuugaacccaacauuuggcaggaagcacgauucuagucaacacagaaaaauucuaaaaauaguaggaaauuucuaagaaaugauaucaagguuuaucaauaauuucuguggucugaacauuuagcuucuggucuugagacuuucaccugauagcaucagaaguuugcacaaccugguuuaguuaagauuuuucauauaacuugcuaguuacuucuagauguaguauuucuauuuaucacaaacuaacaugcaacccuaaccuuuagugccucaguacccuugcgaagcuccuuaauaacagacgauaaggcuucuggguugauuccuuguucacaaagccguacacaaauagacagcguuuccauaucuaagccgguauucaaaauucuugaaaucucaagcagaacugaaaaagauauagacauaauuuuuaaaagcauagacaccuaaaaauaaaaaugcauguggcacuucuuuuuuuuaaaggacuguacagguuuuauuuaggcauacuuauguauauacacaugcaugcaauaacaacuauuauacuuacguauguacauaugcaugcaauaacaacuagaaaagaacgagagaccaugaguuuggaggacagcaaggaggguacacgccuauggggaauauuuggaaggaagaaagcaagagagaauauaguaaccaaauuauaauaugaacaguuauaaagagaaguuaaagaauuuguggaaaacacuuuagcaugauaacuauaacuugaaauucaagacuuucacucauccuuuaaaaauauccuucacuagauuauuuuuucccauacuauauccugguuccgguuuccccucccgcuacuccuuccagauccucccuccucuuucuaugagccuuagaaacaaacagaaggagaagagcucgggaaaggaacgaggagccagagacccacucuggauuggauauucagaaaucccacuuaaaaacaaaccaacaaaaacccacuaaacuggaagccagaaucuacacaggccaggggcagauccaggcagcccugugccugcugcuucaucucugaguucagaucaguuguggucguuuggauuuaggggccuuguuuucuuagugucuucuucagcagggcucccugagcucuaagggggauuugauagagauaucgcauuugggucugagauuuccaagggcucuaacugcacaaugucuggcugugggucucuguaguuucucucacuuccugcaagaggaagcuucucugaugauggcugaguaaggcacugaucuauaaaggagccagcaccuuagaauucagaagccagcaugugcuucucuggcucuuuuuuuaaaaaaaaaaaacgcuuacugacugacugaugcauguguguguguguguguggggggggguguuccccuaggccgcagugcacaagcagaggucugagaaccacuuucaguucacuccuugcaccauguagguccuagggaacuaaucuagguugucgggcuugcuggcauggcaccuuuaccuaauaaaccaucuugccagccuugugccucaaucuuaaaaaauagcugccuaacacaccuuuucaugggaaugccaacuucuuaaccugugcucugccuucagcugcucuugccauacugccgagguaacugugauacaucuauauaucuacaugcuaugagaaauccucagcaacauaggcacaaaaagcuuuagaaccuuucagaauaauuugacauaacugcaucuguuggcuuuauuaauaaaagcguguauaauuuaacuucacuuuuaaacuuuuuauauuuauuuuauguacaugaguguuuuaccuauagguacguacgagcaccgcaugugacccuaccuucauuuucuccagcacugcauuucuugguaauucauuagaauaucugucuuugacaugaaaagcaacagcagaaccucucuacccaagcacuuugccaggaaucccuuuccuuacaggacauacacacagcagucacaguaacuuuguuaacggauggcuguucccaacagugugcauagaauucaugccaacugauaacauagcgucuauugcauuaugcuugcauuacgcuuaggacauaauuucccaugcagagugaauguaucacuauucuuguccagcacuugagaguugauuucugacuuccauaaacauuuaaauauucaauuccuguaguguagguagaagaaaagacccuuuucccagaaauaagccaguuaccacaauauuauuuacuggaugauauacccuuuuaucacuaaacugcaacugcuaccuuuacuacaugaauguucucagagaucuauauagcacauuuguaucauaccuguaucauuaauuacuaauuuuauacugcacagaguuaaauauucuauuaaauauucacuuucaaguauauaagccuuuuuauucucuggguaaagucagacauuuucaugaauuuccaaaacaaauguucugggauuccugcuucgguugcagggaacuguggauuauuuugggaaaacagacacguuaacaauauuuaguuguucaccaauuuaacccuaaguacugaaaacuguaguauucaugugagcauccaacuuuuccuacuucucaugucucaaaguucagcaugagacuuaaaaauauauuuuccaugucaguauuaaaaguuuuuaauauggaauacaguauugccugugccuuuuuuuccauuaaugguuugcauuuuucucaucacaacucauauuuuccuguuuuauauaccuagugauuauaagccaaauauuguaaauuuuacuugaaaggacauugucuuagucaggguuucuauuccugcacaaacaucaugaccaagaagcaguuggggaggaaaggguuuauucagcuuacacuuccacacugcuguucaucaccaaggaagucaggacuggaacucaggcaggucaggaagcaggagcugaugcagaggccauggagggauguuucuuacuggcuugcuuccccuggcuugcucagccuucucucuuacagaacccaagacugccagcccagagauggucccacccacaaggggccuuucccccuugaucacuaauugagaaaaugccuuauagcuggaucucauggaggcauuuccccaacugaagcuccuuucucugugauaaccccagccugugucaaguugacacauaaaaccagccaguacagacauguuuuauuuuucuauauuauugagcuuauaauaaauauaguuacacaauaacagauucuuucaggucuaacucuucaaaugaguugggcagaaucaaagcaccuuagccaacaacugaugcugcuacuaagguaagaaccucccacagacucuacccauugcuucacaaauuguguuuuccacccaggcugguaaaauggcauuguccuccagcccugugggagggagcaugguguuguauuccucuacuacuguggguguuuugugccccucccaucugggucucuggcuggugacuguguuaacucaggcucugugcacugugcuccacuccagucacucucuguucucuuauguuuucagucucucuuacucuguguuucucucuugccgucuccuucuccuuuccuguccucugcuacggcuucucuguccucauggcucuacucccaccugcgcgccugcuuauauguccaacuaccccuucuccaggcccucacuccucuccugucccccaaacaaacccccuuuauaccagaucugcugcauggugugauuucucagggggacacuuuggcaugggcucaccagguauccugccgccauuagauuucauaaccauuacguauaacgccuuucucuuuucuccuuuuguacuuugugacauuuggaugcagaugggaagcucuuccuggucacaagcuccuugacaccucucaauccgacccaaguucucaggacaaagguuaauagaagcaucuuagcuccccacacagcgggugcuucuccauccugggauggcagauggugcauuucugcagagcaaugcgcuuccucaaaagccucaaaaccccaccgugguucccuccugcuccugucguauagggaaaaccucucuuccaucgauagagacuuccuugucuuguuugugaguguacggcugggaaaaaucauauuccucccacaacaugugcaaaguuacauaccugcuugcccucgaaauugaaaagaacacuuuacaggugagucccacuaaccuagcaaccacugacaggaaaagcuuaaagucacuguuaguaaccugaaaugagcaaaaugauaaggagaaaaaaauuugagcuucaagaaaaacugcuaucaaaggaagauccaaacugaaaauuucaugcugguucuuuuacaaugacuuaaaugggcuaaaaccucacacauacucuuacuucguuaaaaaagcaaacaaacuucuuaaauguuuuuauacuguguacuuuuuacuuuacaacacguucucucacaaaagguugggaugcaaagccuuagcccucacagcaggcccaccaacuuaaccaguucucuucagacacuacucacaacacacacuggugcacccagcaccccauggacgcuccagaggcaaaaagagaagcucaggaacuugaggucacucuaggcuacacaggcaagagucuuaucucagaacaacacaaccuaaaaaccacaacgguacccuuguguacauacauuuauuuuuacaaaacaauaagccguggaacaucuaagaugaaagaaaaaagaaaaaaaaaaaagacaggcuggagacagaaaaagaacaauguggcaaacaauuagguggggaaaaccacugcaaagcguaagguuaucuuuugagaaagauguugaggggguaaccucuggaaaccaucaaagccacugccaaaacagacauguagaaccacacguagauggaaacguguaaaauuaagacaaagaaagaugcuugcuaacgcaaaagaaaaagcaaauaaaaccgaucacuugacacacacuuuaccuggcugucuuauuuuaaauacccggagcuacaacuuuauuuuauuguuuacgaauaauaguuacuuucuaaguguuggguccgagagggacaaagcugcagaaccauagcagagagaagggaacucugagacuuauuucuguaccucugggugcgcucuaccuaucaggcagcgggcgcggacacacccacaaccgcggucacccgugucgcccgaucuaaggagugggagauggugacggggaguggugcucaaucacuggaaacaaauaacccguuacugaaacgccugggccccggaacugagcucaccgcguggacaaaaagguccacgaccccuuucgccccggguccccaggccacgagcacgcgccagacacgagcaggcgccagacacuuggcgggucgcguggccccaggaugggcucgcaggcagcggucgcgaggccuggaacgccccgcgcgcgccaaacuccgccgcagcggaagaccggagcucuggggccgccagcuucgaggucgcggcggguccccuuccccguccccucgcaggauaccgccgaggccgacgcggggaccguggggcccucuacgacgccuccauccgggggcucggcgccgggaagcgcaggcccggucagacgagaacgacgcgcacucaccguccauggucucccucaccgcguucagguuggccgaggccgccgcgcccgggccgcuaccgcucgccauggagaggagaggcccccgccccggugggagaaggccugacccggaacuggagcgcccgccgccgcucggccccg

SEQ ID NO: 7617 - RNA, 1493 nt, Mus musculus
guauuauucaggcuuccuuuauuuuuauaugacuuuugaauacuccaaacaguauuuagaaacgguacaagcaagccauuagagacaagcuggggugguagaccagcuggauggggaaacugauggcagcguuuauugucgcguuggacaaacuccugaagagcacaaaggaagagcacuugguaacuugucugcugacgcuggagaguucacaguuccuugcgggaaauguuucguaaaguauuaaagugaacagccuuuaugauuacaauauuaaaguuauucacaaugaucacuauuaauuauauuguucagauauagcgaauuauacuauaugcucacuuagccuuuacguuucuuaaacgauuucauguaaaccagaaaaaugaaugugaguuugcaaucguaugauuagguguuuuguuuuucauuuccuuccagaugaauagugacuauaacacacagacuuguguaaguaauaucacugauauuguugggacagaaagauauugcaaagaaaaugucacacauacaaauguuccagugcccuuugaaguggaaaugaaaucucaaguuaauaacguaacgguauggaaaacacagcuugauaaaaauuuauguaauguuuaccaaaugagaccuggagggggagaacuaacuaaacccuaaacgacgugucagguuauauccaugggaaacaggaaaggcagaaacuuugcucuccuggaaacauuucaaauagcucaaaccuaaacaaaaaauaauuacuguuagaggggaaacuaauccaacugauuauguagguaaaagcauuuauaaagauguuguuuuugcgguuguacaaaauaauggucuucuaguauccguguuagaugcuuaucauguaguuugauaauauuuauccucuucuguucuccuuaccuaauggaucccuuauaacucaguagcccauugcagguuuucaucauucuaaggaaaagaaacauauauagaucugucaaauaucugcacuaauacagcuuacuucugauguagacauuucauguccuuugcucauucacauuugaaacccaucccuguaggacaggacaggacaggacagucucugcuaagucguuuauauacagcauagacaucaacgcugcaacacaaucucucccacaacguucaguaagaaauccaccuuccuuuuccuuuuuuuuuuuuuucuguuacauguagcaaaguugauuaugaucaucuaucucacuucaguuaucccuguaaaccuaagggagggauucuuuugaaacaguauauuaaaauacaaucuuuugugcucaguaaaacacuugacuaaaaaaggaaaacaaacaagcaaacaaacaaaaccacccccaaacaaaagcuuuguuuacucucccuuucaaaccaggaaaugugcaugcagauuuaaacagguuuugaauggccuagacugaagagaggguguuuucucuuucacagcccggcca

SEQ ID NO: 7618 - RNA, 16378 nt, Mus musculus
ugaaauagaggcgggcgucaagugucaguagucgcggggcagguacgcgcucucuuagguugcugguggagcuuggggguggcgggagcggguuccggcgagagggugagcgagcgcuggggcggggcgggagaaaguggcugcccgaggaccucggcggugacgcguggccgagcccaggagccccgaucuccgugcccgccuucgugagcgucuggcugccggcccaggggucccccgccgcggccccccgccgaguccgccgucccgugccagcccgagcgaggugggaucgcgaucgcuccgugucccgcucccguaauccccagaccguccaugcccacgcgggugcugaccaugagcgcccgccugggaccacugccccagccgccggccgcgcaggacgagcccguguucgcgcagcucaagccggugcugggcgcugcgaacccggcccgcgacgcggcgcucuucuccggagacgaucugaaacacgcgcaccaccacccgccugcgccgccgccagccgcuggcccgcgacugcccucggaggagcugguccagguaagcagagcggccggccucccuuccccggcucgggcgugucccgccgcuacgaggcgcgggcgacaggggccgcuccagacugggacgcgcgggaacgggugcccggguggacagccccgcccugcgcucccagacggggcgccggggaguggaugggggagcagggcgggggcccacccggaucuguccagaggagcuaaagagagccgcgcgcucgcgugcaccuucucuuugcuugcguggggaugaaagcuugugcccacgcucaacuuggcuuaaaaugcuucuugaccgcucucucccgauggcccuggccuuggaaguccaccugccugcguccucuggggugaaauagaaaugcaaauuggaguacugggguuucauauacccccguggaggcucacccuagaauguauuguagggccccguuuggaaaacuagaaucuuaagguuguauuggaacaccgcuuuucccuuaaaaagaaacacggacaaaaaaggccagggguguuguuuuucuuagugugcgcguaaauuuccucucggagucgcguugaaagcuggcaguuggcuuuuacacuugcccagcagccgaauuagagcaagcgccuguuucuuucgcccacgcacgggagucauauagccuagaaaaaacuucccgggacuuuuagcuagucccaaggaaaaaaaaaauuggaaacagacccacaugcaaacagcuggaagagcuaaaaucagaaaccacuaaccgccacgggagcgcagugcacgaaaggguuuaagaucgguuuauuucaagacgcuuaguuuaauagccucuugcuguauuguguauuugcacugagcgccuauuucuuggggucugccagugucguggugcuuugagaagacaguggcauuuugucagaugugacucacauggcuacagcaugaaucuuuauuuuuaaguccugcauauccgggaaaucccguccguccucguccacauccagaucuugaugaucugagguccgaggugacauuucuuuggaaaauuaaaagcaaaauauacgacuccuauucacugacugaggugaaugguucuaugaaccauuucauuuaccuggggcuugaucuuuuucugacuuccuuuuuuuucaaugucaaaaaaaaaaucaagagaaagcguucguuauauuagagaagagagcugggggaaagauaggcgucuggucaguagcuggauugauuauguauguucuuaaacaaucagggccuggaagauauuugguuauuuuauucugguaguuuucgcucaggagauagcaagaugacugcgcuuuuuacagaggaagggggaauguagcauuggcccacggagaggacaugauaaauguuuugcugaugacugugccugcgaugcagcagccucuccccacccacgggagucuuagcacccgucuaccaagggagugauuuuucuccuugauaauuaaagaucuguuuuagauagggauaugaauagguccauuucauuaugauagugacccauuaccgaaucuacugguucaagugaacauuuggaccaaacguugagggugcaauuguuuuguaucaguggauacaauacaggcuucugcuccacagguucaaguuucuauucaaaaaguauugaaauggccagagaacauuuuauauuaggccugauaaaauaaccuaguccacacacaaaagcccuuuggaauaauuauuuuuaagauuugcacagguuuuaguuuucaaguguaauggaugugaacagauuugaggcaguuuggcaaaacugugauaccauaguuuaacugaagauauacccuaauuugacugugugugcgcgugugcgcgcgcgugugugugacuugauugcaucagaaaauguuuugaccuccaccccccaccccauuugccuuucacuuuugucuggggaugauuugcgggagugacuuuagugaagacaugucguagagucuugguuaaccgauaauuacacaauugacaaaauaaacuuguguguucauaagcaacacuuaggaguuggccccuguacuccugucgaguuuuuaaguaaaccauauuauuuauuuauccuuccugacugagucggguagauuacguguauucgucuuuucuuuuuuagacaagaugugaaauggagaaguaucugaccccucagcucccuccaguuccgauaauuucagagcauaaaaaguauagacgagacagugccucagugguagaccaguucuucacugacacugaaggcauaccuuacagcaucaacaugaacgucuuccucccugacaucacucaccugagaacuggccucuacaaaucccagagaccaugcguaacacagaucaagacagaaccuguuaccauuuucagccaccagagcgagucgacggccccuccuccuccuccggcccccacccaggcucuccccgaguucacuaguaucuucagcucccaccagaccacagcgccaccacaggaggugaacaauaucuucaucaaacaagaacuuccuauaccagaucuucaucucucugucccuucccagcagggccaccuguaccagcuguugaauacaccggaucuagacaugcccaguucgacaaaccagacggcaguaauggacacccuuaauguuucuauggcaggccuuaacccacaccccucugcuguuccacagacgucaaugaaacaguuccagggcaugcccccuugcacguacaccaugccaagucaguuucuuccacagcaggccaccuacuuucccccgucaccaccaagcucagagccuggaagucccgauagacaagcugagaugcugcagaaucucaccccaccuccguccuaugccgcuacaauugcuuccaaacuggcgauucacaacccaaauuuaccugccacucugccaguuaauucgccaacucucccaccugucagauacaacagaaggaguaacccggaucuggagaagcgacguauccacuucugcgauuauaaugguauguggucugugugcucagggcaucaggaggguuucauguuccagagugccaauagguaggguauaccugacaguuaaagaaaucaccuauucguaauauuucuguguuuuaugcugauguauaauggcauaaaacaccagccauggcaauucaugccuuuaaucuuagcaaugaggccgagacaggaagauuacacguucaaacuaaccugggcuacauagugagauccuuuuauuauuuacuuauuauuucuguuuugguuuuucgagacaggguuucucuguauauaccccuggcuguccuggaacucacuuuguagcccaggcuggccucaaacucagaaauccgccugccucugcuucccaagugcuggaauuaaaggcaugugccaccacaccuuuaauuaaaaaaaauauuauuuuuauuuaacgguuagaccauucuaggaaauaaucuaauuuagauuucuuucuuuuuaguaguaaaugacaacuugggguucauuuaaucuaauagauuauagcaccaaauggauuuaagaaugguuguuuccgauaguguaugcucauucuugaaugagauacgugacccaaaauauaauuggaugguaauaaauauauuuccaaguugcaggcauaagcaaguuuaugauuaaugcagggcauaauuuauugacugcacgauguggcaugacaugcuaaaugagaaaaacaaaguaggauuauagaaaaugauagucaucuccgauaaugacuuaacacuguuaguucugcauccauuacauuaaauauacauacauauauacauacauaacacacacacacacacacacacacgcacacacacgucccacgauugcucuccauuuacugaaaaagcaccuacuggagcauaaacacagaauuuccauuuauugguuggcuggguuaaccuguguucuuugcucccaaaaaugauacauagagcagaucaccucugccuucuaauaaggucaggagggcaccuugaaacuucuuagccaaagcuucgagugugacccucuagcacaagcuaguucaucuuuagagccagguuuuaaacagugaaucaucgaauguaaagauuucaaaaggcccuggagaugacaagcuguucuuccucuguucccuuucuucuucuagguugcacaaaaguuuauacaaagucgucucacuuaaaagcucaccugaggacucauacggguaggugaucuucuugcuaauucugcgaguucuguaaacaguguaagcggcauucauccuuuuaaaaagccaauacguguuugaucucuucuuucuucugucaacuuuuauuuuuuaauggccuaccuuuucagcaagggcuugcuuggcucaaaauuccguuccccaagaaagucugguuccgggaaggcugagguuuccccagugagaccuugcccugucacccucacguagaauuaaugacccucaaaacguaaacggcaguguuuacuaauggauuuuaaaacuuuaauggcaaugcuauuccugucuugaaagaaggaagaaaacccuccuugguaaaucgucguugcuucaauaaggccccuuuuuaagcuaaaaacuuuucccgucaccauguuaggcaccggugcuuagcacauuaucuucaguuucaccaguggcuucaaauauuuguguuuucaccuuuuugccaugucugagaaguaggccuaagaucugcagagggugaaagagcucggccagggugagggcaggauuugaagcauuccucuccagccaaccccgggccuuggcuugucugagaggccuaguccauccuuaagucuuccauuucauuuucuucugcagcuugcuuuuaaguucagucucuaauuauauuuugauguguuuuguuaaauucacagcaacccccuuguaggagcuauucauuuugaagccgcccuuguaucagaaacacguuuacaaugacguucaguagccuacuuuauuagagggauccaccuacccauaauaucuucaagugucuggaugguuacuauuauaauuuucuuaaagaauagcccugaaggaaaagacagauauaaaagugacugcauucccccccucaauaaauacacccuccuuaccuaaaguucaaagaauaaguuugcuaauaaaagcagugaccuagcaaaauguauuauuccaucauugcuauggaaaccagaguauucaacagcuccuuugaauggguuguuggauuagugugaggacuugccucucccuaggcuggagguuacuauggaaauugaguuuugauaaaugaaguaguuaucucuaaccacugcauuaaaaaguaaaagcuuuuggacaaaggucaguggcgaagcagagcucugugagaguaugguuucagacauuguguaugcguguuaggagggagcagugcuugguuaucugaaugccuaacacuuccuaaaacccgggugguagcugugagcuuuccaagaauggcuuuugaaagaaaaggcaucucucaguuuaucugugauaggagugaaauuauuugggccugagguuggguuggguuuuuugugggcagguaagcaugaacagaauaaauccaaagaugauucaaacuccagucuaaaaccucccaaauagaguugacaggugccagaagaguccauauagaaacacuaaagcaaccuacuaaaauguccuuuuguagacuaguguuagggaaacacugaacaugggguuuugagcuuuggaucaagaggagaaacagaaguaguuuaggaacauuugagcuguuguuucuucucucucaucagaaguccuugaaacuggagauaggaaagaggaaagguauuuuuugagguuaaaguccccauaauaaaagaagugugcaauugcauauaccgacguaaucaagugcuuauugcaggcacaucgucaggcuauaucuaaauagccuuuccacccugucaggguuuacugcucugaaugcuuguaccugggauccuggaacuugaccugcuggcagagaaauuuaauagugggucgucugaacaaugcccacacuaauaaaaauaaaaaauaaaaaaaaagacuacgaugaaggauccaggccuagucagggucccauggagcaacuuugucacaugaucguaaauauuguggccuuaaaacaucuaaugaguaaggccguguaaugcaguuuaaugaaguuguuugauagucuuucagaugccuugaagggggggggguguaacagacucgcucaucuggcuaaacccguucuuagguaaucauggugcauggaggcuuucuccucauuucugguuucuagacaaugccuuuuaaaaucaccugugugcuggcuaccauugucuccgcccuccgcuccugcccccugaaugugcaggaagccaggagaggcuuguggcuuguuucuuucuuucuuuuuuuuuuuuccuuucuccuucgacugcccagguagaugaaacaguuuuuuguuuuuccuuucugaauaguaccucugacuuaauagcuuguccuguuuuucuuucugucccauuuccucgcacuuggaaaacuuguuaggggacucuuaaaaaaaaaaaaaaaacuacauggcaauauugacuguguauuugaugauauuaaaagaaauguuuuuguacugauugcagguagagcgugaaacaccccagccuuucuguaauuguaguaauuguagcugcuuuuuuaaaaaaauguauacuuaccauaugccacaguagauuuaagcauauaaaagaacccucauuuguguucuguuuaaugacuuauucuggggauuuuuagauaacuugaguuacagagggagucuaagcaagccgccagucuacugcacaacuaacgcauucuuccugagcugagacagaaguguaaaacaucagucugccuuucgaaucacaaguauagcauucgaguuuucuaaguuuguggacuucagauuucuuuauagagaacacauacaaaaaaaaaaaacccuuaagcucuuccaugucuggucagacguagcugugucuguauuuaucuguauguaacacagcacacuuggcuacauauaggcacccuuuaugugggugagaggguguuuguguauguuauuugagauacgugaacauuaauaugcuucuguuuagaaaugguuaggaccgcuuguaggcaaccgugucaguaaguggucucuucuucccaaaucaaaucauuuguacuuucuauggcauuugaaagaacaugucguuggagcucuuccagcuugugacgguacacuuuaccaucaaucugcaauuucuuaucagcaccuuucaaaaaacaacccaacucugguaucguaagucaccauaacugauaagcucucuucugcuguccguuaaagacagaacuuuaugcauucuaggcuaccucagacagacuccuucccuaaauuccauuaugaauauguaucagccuuggcuuucuggucaagguagcguuagcagcuguauauacaaguauuuagaagcaacacucaaaagagucugcaccacugugucucaaaugaacauaaauagcagacacuugaguucugugcucaagauucccugaugaagagggacuguagucugucugucagugugaagagucucuaccuucaccccuuccccugcugugggaaccacauuauucagugacauuuaucugugaguuguuagcaugugugccuguaaguacauaauuuuggauucugcuuuaguuucuaagcucgacuugggcacuaugcaagcauccugcauccuguguacaaaugucucgagccaggugcucacugagaacuccucuuuccaucggcucucugagacacaguuuugauaacguuggcugcugagauuaggacggacauuuccacugaaagaaccccuuuccaacuaaccuaugcagaggggggaaggagaaccaggagggauuucauuucaggccauaauggacgauggcgcucauaugauuugaaucuagaauagauagauaucaguuagcugcauaaccuguguaucagaauaagcaagcaucccaucuuagagauauucuguacguauaauaucuaguggaauauggcacugauaagcaucaccauucgggaacuggugaaacgcacucguguucuuuguauuggaucucacuuguagcuuugaguuaaagaguaguggcuuaagcaacuuguuagcuuagaccccaggaaaaagguacuuacgaacgggaaagcuuagacaacaguuucuuuuuaaugacucaccagugagacuaaccugcuucggggaguggaguccuuccaucagcaaaacauuuacauaggaaauuaaucaaacauuguugauaaagcuuacuaagguuaagaaggauaacugaacucagcugauugguuucaugaagaauccaaagaauugaucucgucuuacuuacccuucaguuuuuaagcucacgggaggagagggcuccuauguagauaaaguagaauugcuggaacugagcuggaagcagucgugcaugugagguggaaagcaguauuuaaaaauauacauuuuaauuacccgggaauuuucccuagcuagguauuuuuaguucuaucugauggccuacaucuuuucuggugaaagauaagaaacagaguccuguccuacaugaggggaagugacucuuugccugccugugacaauucauaguccgagacuuuuagcaggccuguuuaaagagaccaggcaaugcuuuagaggcucacaguggcuggcuuuugccuaaaaaccaucuguauagaaugaguugucccuuuggcuguuccuaaagaggcaugucagcugcugggcgggguggggggcggggcgcaggugaagguuagguagaggggagggggcuucaaauugaugauccauuuccacuguuacugcuuguugaggcugggaauuagccaaguguauaggaaggagcaagggaccacuccugucacccgucccuucagccuccacagcaagggcaugucucuccauucuacucuccagcagaugagcaagcucuggcuccccauaggagccccguggagcuuguguccagccuccaggccuuucagaacuacuccaguucuauagaaguucagguuacagagaaucuccauccugugcccuuuugggauaagggauucuagaauuuaauccugaagacacucaaagcaagguucucgucuaaauauauucacauuaauuaccccagucaucccaagccucagccaagccuucccucguuuucauuaugagaauaacugcucagauuuggccuauccaguuuucagaggcagaaaauggggaacucggaacagagggauagucaggaauacaaaauacagcccaccaagacccaauccuuuccccuccucgcccagggcuucauugaacaacugauuggcucaagugcauuugaucuggggauaaaacccaucacccugugcaugaaaacgacggcugcuagcacugagccacauccccagccccagucaaagucgcgcagguggugaggacacagugcaguggccacucguggucugucagguuuuuuuuucuagagggagggagaaagaggaauuggauuuaaaaggaugcaaugaguugagaaacaagaugaagagaaggggucccguaauccccuuuacauuaguucccuugaaugggccacuacuggcauccaggaagccuuagcuuacaaagugaaccuuccuguuccaaggaggcuacugcugcuacacacacacaaucucuucauggaaaaguacuagcaugguuguauaaagaaacaaagacagugagcccaaaucacuaucacucuucucagauauguaaauccuacuuuccuucccauaauuccuuaauuguauucuguuuuccccuuuugaguauuagcagaucugguauugaguguuccaggaacacccacgagacaaggugaugugagggagggagacagguaucggucagucaccaucuucccacacuaagcaccccagugcaggcugugcccucuucagcucugguuugagggcuuuuaauauauugauugagauaucuuuucgccauugaaggagacauaacuauucacuguaaaacagaccucagaguuaccucauuuccuuuguuagaacagucuauguggaacuuucuagaaaagggccuugcugucggacuauugaguauguucaacagagcagagaaaccuccauucuauuguauaguuggcucagaaaaagaaauuuuaaaucuguucagagaaaaauagauguuucuuauugaggauuuuuuuuuaaaaauacuuggcaaaacaagcauucuaacacagagaagggacccucuacaggguagcauuagagauggcaugaggcuuuguaacggaccgguccagccacagugugccucaagccucucacaacaggcuucuacaggccucccgaguccuucagagucccguucccuucacgagaggcuguagaguccaaguaaauuugaacaauauguaugcgcucguuccuagagucagagagugugguaauguuuaccaauggaagacuuaagugugacauugagaaagcagcagacuaggcagucaucuucaaaguucuggagcuggcuuuuuuugaggguugaaugaagagaacgaccuagcuuuagagcggacuucuggagaccugaugguggcuugccucuuucuucugguaguuucugcugugguuuuuauacagaguauacuaaugagcuuuaccagcaaggggagugaguguguuuaacuugggccuauucuucggagaccagggcuucuucagccaucucugucucuaacugugaggcagagacagcaaaggcacgcugugcgagcgagcgagcgauaaggcacaagccaggggugccacggcacacaagccugccacuguguucccuuugcccugccguacguagcuugacgcuagcagcaagacuuaaaaauaaauacaguggaugucgaaagagcuuaaccgaguauuucaaauuggugguauuggaaagagauucuuuaaaaauccaauuaaacuuuugaaagcucuauccuguugaaauauaacuuggaggaagucaguuugcuuucccagaaguacuggccguaguguuucuggcugaggaaaaaagguuugagccuucuccucagccagaaauggggucccggcuuccucugcgguguuuggcuugaacaguguugacacuugaacaaaucccauagaaacugccccaagugggggauagucgucccugcuuuuauaguaagccuuggccccgguuccugcccuuccagacacuggcgguauucuuggcugaauaagcuauagaugcacauaaauugagagcaaaaccccaaauguuuuaggaacguuaauggcuacuguaugucaaccaaucaguaaagucaacuugacaaaauauuggugcaguuuauggcuuugcagccaauaaaaacagugaacaaaaaaguucaguguccccugcuucuaacauagacccugaaaacuucauucugagccauguaauuauuaaauucaaaagggcuugaaugauccuucuuaaauugggacucugaggaaguguuuuuuuuuuucuuuuuuucuuuuuugauuuaaacaccagaauuagaccucucuccuccauggaaugacaggaaagccaugcuuguuacuguaauuuuuuuuucacuagacuuuucugugugaggcuuucuucugugugauugacaccccugauccagaaaguaaccguuaccacuaccauuaaagucuuucugugaauccagcauugugugugaauggaagagaaaugacuuucugauuacuuaaaagccuggaguguuaguguaacuuucuagaucgaguuuucugcgagagagugaaagcacaaaccuuuaaauucaccagacaggacuacauggugaaauacacacaugaugauucagcacacacacacaacacacacacacacaccccacagaacacacaccugugauggacgagaaauuuagaaucgagguguuguucauuugacuuuuuuuuuuuuguugagguagcauguuauauguaguguagggugguuucaaaaucaucccccugccuuagcccugccaguacugggauuacaggaauuuaccuucaugucucucggagaugugcauuuugagaaaugggaugaugauaggagcuuugcaucagaggcagaagcagggccacagagggacggucagggugaaucgcuacaagggaaggaccaggcaugggacuacccccgagugauucauucuggcuguugcuucuuugcccuguuagacuguagggucacacuaguuaucaggauaaugaaaguacagccuuuguggacacucacauucacccagguagucaccagcauccagaagaugacacugcuaaacugaguuaaaacaagaaagguugugcaguugcucugcuuagagcuccccuuucaccccuaagcuggcuuuuagcagcaaucuuccugccucaggccagccagaagaaaaccuuuuuuuuuuuugaaaggaaguugggagaaaugucucuugaaaaaccccagcaaaacaaauaacaaaugaagucaugacaaguugggagugcucagagacaugaaauuuggagaauuuggcguagaaaaaaaaauuuacaugauccuaaauagcaaauugcaauuguauuauaaauauuaagugauuuuuggaaguggcuggcacauuugggagaacauuagugaucauaaacauuguacagugggauuggcucggguauccgcucacuguuaaaagcagaugacuggggauaaaaaccagaaagauuaggcagaaauccgccugccucugccuccugagugcugggauuaaaggugugcgccaccacgcccggcuucaaauuuucuuuuucuuuuucuuuuuuuuuuuguuuuaggccaggcuuuuaggggucaccaguguaagugcccccaggccuggucuucuuguuuuguuuauuguauuccucgccuggacaauugccaaauuguuuguugacugucuuggaacucaauauguagaccaggcuagccaagaauucacaguuuaagccgagcagugguggcucacacauuuaaucccagcauuugggaagcagaggcaggcagauuucuugaguuuaaggacagccagggcuacacagagaaaccuugucucaacacccccccacccccacccaaaaaaaaaagagcucagaucaaccaacuucucccaaaugcuaggauuaaaggugugcaccaccauguccaccaaguccaacaucauagaaauuugauagcgucuggaguggcccucaucauagaaaauguucgauacacuugugcaaccagcugaugcuaagauucuggguuggagacaagggcucagaguagcccuugccuaacaagcugaaggacacagguuuaauauccuuagcacuuaaaagaagagagagccucuugccuuccuuauuagugugaaucagaguaaccagacucuagauuacuuagggaauuuuaaaaaaaauaucaaaugcaaaauguuuacauaaagcaauuaaauuuucugguuuguaugguuggccuugaguagugguguggaaggccggguggacugauucccaacauaccauguacauuauccucgccgcuacuuguauaucauccucgccgcuacuuggggggggagggauggggggcgcacugcacgguucaccauggggauggggugugggcugugccgcuggucuugcagcagaccaccucacccugucucuuccuugucacaggcgagaagcccuacaagugcaccugggagggcugcgacuggagguuugcccggucggaugagcugacccgccacuacaggaagcacacgggcgccaagccguuccagugcauggugugccaacgcagcuucucccgcuccgaccaccucgcgcugcacaugaagcgccaccagaacugagcgagcgagcgcugcgcccacccgccugacgccuugcaguccgcucugccauccuuuaaaccgcagaccuaacuucauaaaaagaaaaaaaaaggaaaaaaaaaggaaaaaaaaaaaaagcaaaggaacuggaaauguauauuuuguacauuugaggccacagggaauacauuguaucaauaccaaaguguuuggucauuuugagaagcuggaagcuugcucucaugcucaccacuagcuuuaucccagcaaacuuccucuccagacaggcagccgcaucucagcauggggaaccggugggggugcacggggugcguaugcuguuucuauaaagacugcacacacgcaaucgugugugccauuuuuuaggguaaacaaaccgauuggcaggcacccaggcacauugucaagauuuuacuugacguggacucguuuuuuuucugaagauuugauuauuuccagagaugggagguacacgguuguguguaccuggcaguucacaaauagccauugaacaaaaauuuuguuuuuguuuuuguuuuguuuuguuuuuauaugaguugccuauauuugcuauuccgaauuuuguaaauaugcaaaucagcuuuauagauuuaucacaaguuuuuaaggauuguugggggggggggaagaaaucguacuuuugaaaauaauuaugaauacauuuccaauuagaauuuguggugagauaccucucagaaaaauuaccaaauccauuucuuuggggaggggauaaucauucaaaugagaguaaaaugcaaauuucacucacugauugaaaugagauuuuauuuuaaauaugagaguuuuuuuuaugugaauuuaaacugaaaugcuuaaagauagcuaccauacacagacgcuaauggucuuuaccauaaguuaaacaguaucuuuuuuuuuuguuuuguuuucuuuuuuuuuuguuuuuuaaguggaggaggacuguuguggcuguguuccuuguugaacuuaagacucuguuuucacucguggaagcauugaauuuccaggauuucuaggauguuugcucaugcagugcuguuggcgaaaugacaauuuaugcggauuuuugcauguacuauccagugagacaguaauuuuauugaaauuacagugccacguaguagguagccuguuguuaauacugacucgucugccuuugauaucagugauguguugaaaacuuaaccaauaugcaacauggcuaugaaugugacauggaugcuguuaaccaaaggacagaaaccacaagcaaaaugccaaaagcgaucuuaauuagaaaucuuaauuuuguuuuuaagauauuguuuuaucauuauuuauuuugugguaauauaguaagguuuuuuuucuuuucuucuuuuuuuuuuuuuaggaaacaacuuucguaacuugauaaauuauaguuuuguuuguuagaaaaguugcuucucaacguguaaauaggcgacaaaugguguaaauaguuuuguaaggcuccaagauguuuauacguggacacaccuacaucagaagcauaacucggcugcuguucugccgccuccucccuuauuuuuguauugugguaauuuccuaugcaaauaucagagcaagcagcugucgagcuguagaauuuuuugagagaaugagauguuuauauauuaacuuuuuuuuuuuugaaaauaaaaagugccuaaaagaugu

SEQ ID NO: 7619 - RNA, 2005 nt, Mus musculus
aaucaccuauucguaauauuucuguguuuuaugcugauguauaauggcauaaaacaccagccauggcaauucaugccuuuaaucuuagcaaugaggccgagacaggaagauuacacguucaaacuaaccugggcuacauagugagauccuuuuauuauuuacuuauuauuucuguuuugguuuuucgagacaggguuucucuguauauaccccuggcuguccuggaacucacuuuguagcccaggcuggccucaaacucagaaauccgccugccucugcuucccaagugcuggaauuaaaggcaugugccaccacaccuuuaauuaaaaaaaauauuauuuuuauuuaacgguuagaccauucuaggaaauaaucuaauuuagauuucuuucuuuuuaguaguaaaugacaacuugggguucauuuaaucuaauagauuauagcaccaaauggauuuaagaaugguuguuuccgauaguguaugcucauucuugaaugagauacgugacccaaaauauaauuggaugguaauaaauauauuuccaaguugcaggcauaagcaaguuuaugauuaaugcagggcauaauuuauugacugcacgauguggcaugacaugcuaaaugagaaaaacaaaguaggauuauagaaaaugauagucaucuccgauaaugacuuaacacuguuaguucugcauccauuacauuaaauauacauacauauauacauacauaacacacacacacacacacacacacgcacacacacgucccacgauugcucuccauuuacugaaaaagcaccuacuggagcauaaacacagaauuuccauuuauugguuggcuggguuaaccuguguucuuugcucccaaaaaugauacauagagcagaucaccucugccuucuaauaaggucaggagggcaccuugaaacuucuuagccaaagcuucgagugugacccucuagcacaagcuaguucaucuuuagagccagguuuuaaacagugaaucaucgaauguaaagauuucaaaaggcccuggagaugacaagcuguucuuccucuguucccuuucuucuucuagguugcacaaaaguuuauacaaagucgucucacuuaaaagcucaccugaggacucauacggguaggugaucuucuugcuaauucugcgaguucuguaaacaguguaagcggcauucauccuuuuaaaaagccaauacguguuugaucucuucuuucuucugucaacuuuuauuuuuuaauggccuaccuuuucagcaagggcuugcuuggcucaaaauuccguuccccaagaaagucugguuccgggaaggcugagguuuccccagugagaccuugcccugucacccucacguagaauuaaugacccucaaaacguaaacggcaguguuuacuaauggauuuuaaaacuuuaauggcaaugcuauuccugucuugaaagaaggaagaaaacccuccuugguaaaucgucguugcuucaauaaggccccuuuuuaagcuaaaaacuuuucccgucaccauguuaggcaccggugcuuagcacauuaucuucaguuucaccaguggcuucaaauauuuguguuuucaccuuuuugccaugucugagaaguaggccuaagaucugcagagggugaaagagcucggccagggugagggcaggauuugaagcauuccucuccagccaaccccgggccuuggcuugucugagaggccuaguccauccuuaagucuuccauuucauuuucuucugcagcuugcuuuuaaguucagucucuaauuauauuuugauguguuuuguuaaauucacagcaacccccuuguaggagcuauucauuuugaagccgcccuuguaucagaaacacguuuacaaugacguucaguagccuacuuuauuagagggauccaccuacccauaauaucuucaagugucuggaugguuacuauuauaauuuucuuaaagaauagcccugaaggaaaagacagauaua

SEQ ID NO: 7620 - RNA, 980 nt, Mus musculus
ucuaaggcagcauauuuggggguagggcauuuuuuuuuuuuugcauggcuucuaauuuuaaaguuucuuaggaucuucuuguugcucugaacacauucaggacauagaaaauuaucuuccacuccugguucugggauaauacaggccgguaacaggaggagaaaauucauccuuuggggagugucuggaacccaggucuguccagcaagaaauugcaggcgaacccagccuuucuuacgugcagggagcugccugccauggacuacacaccaucugaauccaguggcuuguggcagaaaggccuccacguuagacggaagaggacaucgauucuuagacauugacugagcugcucucauggcaauccuugcccaggcugcaaauguggacuccuuaggugaaguuagaauucccaggauaccauucuccugcuucuuccuuuggcaccugcuuggagacccgauuccucuggugacaaucuuggauuucuugggacucugcuucauucuggccucacgagauguauugggaauauaacauucuuguuuagaauaugagugucucugaagucucaaauagaccucaacuuucuugccauccaugcucaaguuaugauaccgacaccacucccgaagaguguuccgggacacgucccuaauaggaggcaggcugggcggaggacaggugcuugguauggaucugguuggauguuugauucccgcaugccucaccagagaacgaacgggcuggugguguguggucugagguugaagaagaaacauuugauugcauaggguagucugugauugacuccuccuccuccuuaaaugggaccagcguuaaaaucauacuuucuucauccaaguuuuccucagauugguucucguugaaagucuccaggccgaaguaugacauuuucaggcaggcuggggagaagacaaaggcagcugcugaauggaugccgacuucuuuuauaaguc

SEQ ID NO: 7621 - RNA, 980 nt, Mus musculus
gacuuauaaaagaagucggcauccauucagcagcugccuuugucuucuccccagccugccugaaaaugucauacuucggccuggagacuuucaacgagaaccaaucugaggaaaacuuggaugaagaaaguaugauuuuaacgcuggucccauuuaaggaggaggaggagucaaucacagacuacccuaugcaaucaaauguuucuucuucaaccucagaccacacaccaccagcccguucguucucuggugaggcaugcgggaaucaaacauccaaccagauccauaccaagcaccuguccuccgcccagccugccuccuauuagggacgugucccggaacacucuucgggaguggugucgguaucauaacuugagcauggauggcaagaaaguugaggucuauuugagacuucagagacacucauauucuaaacaagaauguuauauucccaauacaucucgugaggccagaaugaagcagagucccaagaaauccaagauugucaccagaggaaucgggucuccaagcaggugccaaaggaagaagcaggagaaugguauccugggaauucuaacuucaccuaaggaguccacauuugcagccugggcaaggauugccaugagagcagcucagucaaugucuaagaaucgauguccucuuccgucuaacguggaggccuuucugccacaagccacuggauucagaugguguguaguccauggcaggcagcucccugcacguaagaaaggcuggguucgccugcaauuucuugcuggacagaccuggguuccagacacuccccaaaggaugaauuuucuccuccuguuaccggccuguauuaucccagaaccaggaguggaagauaauuuucuauguccugaauguguucagagcaacaagaagauccuaagaaacuuuaaaauuagaagccaugcaaaaaaaaaaaaaugcccuacccccaaauaugcugccuuaga

SEQ ID NO: 7622 - RNA, 643 nt, Mus musculus
ccacccauuuuguaaaaacuggaguugauuucuuuuuuugccauguccgcuggauagguggaguauacauauagugguguuauauaucuuauaacaagaaagagcaguggucacuguugguagaacacucuuggaaccaccacagaggcgucucagcucucgcaccuuuuucaaaguggaugccauuauguuauuuuguaaugaaaacaaacaaacacgacuacaacaacaaccaggaguguuuuuuuuuuuuuuuugguuguuguuuuuuuuguuauuuuggagaggaaagaguuuauuucaucuuauaucuuacaguacauuaugagugguaguuaggacaggaaaucaaacaugaacuuggaggcaggcacugaagaagaggucaugaaggaauagaauuacuauccugugcagacugacuucuuauuccagcuguucagggauggcacuggcaauaguaaaucaucagucaagaaaaauacucaaugaucuuuugcauauuagacaauuugauggagacauuuuuucaaaugaaguuuccuuuuuuugguuugacuccuguuagacuauauuugauaaaaaaaauaaaaaaauaaaaaaaauaaagaaggaacaaaggaaagaaggaagcaaggaagga

SEQ ID NO: 7623 - RNA, 6060 nt, Mus musculus
aguaauuaaaggagugaauguuuuauucuuuaguguuuaauagaauacauaacaagucacauaaucaaugauucauuacuucgcacacagcagggaaaacaguauuggguguuuccauuauacaacugguugugaauagaagaaaugaaggagaguauuuagauggaugaagacaauuucaaaguuugagcaccucugaaaagauuucauccauguguuuuuguuucccuuuggauauagaagagcuuuuauucuuggauuuauguuucauuagaaaagugugauauuauuauauuuuccauguccccuuagauuuuaaagaaacagcucaaagguaucgcuuagcaaauaacaauuucaacaugucagaacccaaauaaguauuacaaacagcauuuuuuucaaauacccagaaaauuuaauuuacauguucaaaguguauaaccaugaugaauguuucaauccuucaucauccaacggauaugaucagugguaaugaaugaguauauaucguuuguauucaauaguuauagcaaaguuuacauggcuaucaagucacaaagacaguuguauagcaguuuacauuaaaauugaugucugcacaccuugaaacacauuuuaaacaaacaaaacuggcuuggaaaaauauuauaaaauaaaguggcaagcauucuuggucaacuggucaacccuccuaccauccaacagcugacuccaguggaggucuucuaauaggauucuuccaucuuuguuuaaugggccuuguaaagaaucuaaauccuccaguauuaauauuuugagauguguacuauccaaaacugucaccaagaaaaguuagcuauaacauaaccuacuuccagguaugugaaaacuucuuccaaguacuguggacacagagaacacuguguuuuauucacuacuugagagagagagagagagagagagagagagagagagagagagagagagacuuacauuauccaaaauauucagauuuuaaaagauuuguagugagaggaaacacaauaaaauuuuaagcaaagacguaacuaagaguuuuacaauaaaaauaccaaauuuacuauuuuuaaaacaugucaguuuuaugguacuuguaauuuuagacuguaaaagaaauucuuaaggaauucacuuccuucacucaauauuuuucuaaauauuuguauagcucauuuuacauauaggaguacaaaaauuauuugaaugcuagauuggaauuuaucauaauaugaagaguuaaaaauuuaucaaagcuucguaauacauggcuuuaacguaauaacugcauuccauggaaacggccauagaaauuagaccacguuguaagcacugccaguugucucuggguauuggcacaucauacaucuccccggagaagcagcagguauacacacauaugauucugcuuugaaaaagaagacaauuggggcuaaaauuaucauuuugcuagcaacugaacaaaaacaaauaagacacacuagaauaaaaacaguauuaaaggggaaauuucucacaccugcaagguauauuuuccauuacauguuugaaaaucuagaacgaaugugguuuguaauccacacguauuaaaauaaaaacagacauaucaaacaucugauagacaagcauggaaccugggaccuguuuuguuuuguuuuuuuacaaccacagagacugucaacacuuuuuaaaaaaauuacuuauuaaaccuaaugucauuccauuauuuaugagcaucaaaugguaauuugaucaacauaugcaaaugauugccucucugagauagauuaaugcagccgugaauaucugaguaguuuauaauauucuucugggucauuucaaagauacugaugagagaggcuccacuguuugguacagucaucaaauucacaggugcugaccgagauuucagaacauuuuauaagcccuaaggguuucuucuacaacccaaagugcauggagaggaaaggacccaacgacaucagccuggcucagucauacuuaccuaucauauaaugagaugacugcucagacuuaacuugggcugaaaagcacuaaguuuuuaugcauugccccuaacagcagagggcacagucacucccaggaagagguccauguacugucccuuauacuaauggcccaaucuuuaacaggccagccaguaugguggaagguacagaaaugucuguguguuagugagacaaacugaauaauuuuccaagcuucaauucauaaacaaugcagacaaaacuucagcaguuucccauggcuucuaguguuaugcagacuugacaaggaagcuagaacuuccguuuugucaucucucaguguauuuugagcuguccuaaagaugguuuuuauucauacauuucuuucuuaagcaaucuagcacuguuccguggcaugggagaagucugagacucacacuuggccagugauugacaguccuaagucauuucaggcuugaaacaaagguucugagccauuaccugauccaccgccuaaaaacaagcccaaagcuggaguaagcacagcuuccuggaccccugcugcccuuucuuuaaaaucacacacuuuguacaugaagcuaacucuucucuaaaggaaaaaaaaaucucccaauuaaaaugaagacaucauuggauuaaaaauauggauagcuugaauacagguagcugacacaugauuacuauacaacuaacaucccagcaaaaaaguauggagcaaacccagccuuguaguugugacuguuuuccugacccaaguucacaggcaaggauaugagaagcucaccaaaaugcguugcuuuuguauauacaccaucaaaugcaaguuaccagggguaaauauaggaaauuuuauagcaucaguagaugaauuaaaaaacuaaaugauucguguaaaauguuuguauaugguauguacagauuugaucacaggagucugagaauaaaacugucccaauucauaacaucugccucggauaugaugagauacacgguacaagguucguuuuuuaaaaacaaggaaaaaauagcucuaauuuaaacacuucaaauggcucuuacaaaaauccuuaaaaacauauuucagaguaagaugauaaaacaaacacacacacauacacaaaggcuucucuguaaucacagauuauccaaaggacgucucucagagggaagcauacgggcauaccuccucucugcugugguguggaagcauacgggcauaccuccucucugcugugguguacacaggauacacacugggaauucauuccacgugagaggaaaggcaauaaggcaaagguccccuguuucuguugcauucaccuaaauaccgcguuauugcucggcucacacugaaguacuuauuugccuucauuuagaaacauuccacuugacagcuaucuacagaugggcagccccccccccccgugcuuccguugaucuuucgaaucugucacugcaacgucaaacaaacgcaggaaagaaagagcauuguuccgguuuucagaacagcccagcagcccacacuugcuggccuugcagaaaacaucaauuuaaaaacacuacugcuaacaauaauaauaauaauaauaaagagaucugaagucuaaguaauuaaaaaucaaacuuauuuugcuuaaguaaauaggcuauaagugaggaaauagaaucaacaagaaaaauaaauguucaaaucacuaaaaacucuacuagguaacucuuugguuagguuauacaaguauuagcaacuaaguuuaggacucaaaauagcucgauagacuuccagcugaagaugggucuucuacuaaucuugauaaaaucuaaguuuacacguacuguuucauauuuuuuuaaaugcgcacauacucaaauggauuauacaaacuuccaacuuucaaauaauaaaugagcaugucccccuccucccucccgcccuuccucccaucuuuccucccuccccaacccucccacaguccuagaccuaaguaagggcugacugucccuacuaaccacuccugcguuacugggucacugccaggugacuucuagaagcgcugccucccgcucccugccugcuccuagccuagaagccuuaaccaacaaaaccuaaagcucggcaaacagcugaagagaaagggcgccuccgcaggcaggaggauugcuuucuacaauuuuaagccacaggagaucuaauguguuggggguaaauagaacucuccccuguugccaguacuagaauuuacuucuaccuguaacuuuaaaaacaaacaaaaaaaucucuuuauuuacagucucugaacugcguccuuggggucuuccagcauacggucuaccauucaauugucuaaaacucucuuucuaaugagggucaaaucucuaacaaccuuuuaaagcacucucuccacacagcacucucaguucugaucucugaaaccgcuauggagucaaaggguuuaagaugucaaggacucguccgaacugcacgccggacaccgugcaauccgauucugaucaauucagucauucccagguacuuggugacugucccacuagaucacgacaaucugggggaagggugguuggaggccaggaguagaggaagcaugagugaagggcuacaucagaacacucucucggcuagugggguccaaagaugaugaagacgcccagaggauuuguggcugcagauucgcaaguggggugcagacgggucugggugaccuacuaggagaucugggggugggggcagaaggaaucgggaaacagggaggaagcgagggcaucuauaauccugucccccgaggggaggaagggaagugggcaccggaguggcgaggggcgggcguggggagcucacucccugcagaagacguacucgguguagcugguccagaucuuguccucgcucuggucggugcugcuagcaaaagcgcaggugcccguggagcugcacgccaccauguggaagcccgacucggacagcuuaucgaaggccugcucuaggaaguugaacuugagguaauagcgggagguguagcgcuccgggggccggucggggucccggcucucauucaggguguccccaaacaccuccuuggccagcgacgucuugccgcacacggugaugcgcgccacccgccggaacuuggcguccgccugagcgucgcgcccgaugguguaggagccgcgguagccgauggugauguagccggagcgccggcugccguccaaagacugggacggcgugagcaggggccccgccgcgcccccggacgggcugcggcuagccagcuccagcgugggcgaaggcgccccggccgaggcgcccuccugcggcucgggcucugcguagcccagcggcagcagcucaucgcccagagagcccuccuugugcaccccgcggcgcgagugcggcggcgguggccccggaccggguugcuggggcgccccgaggcgacgcacgagcuccggcagcucgaaguacucggccucgcgcugcagccggcugcgcuccgggaaguagucgggcagcacgagcugcaagucccgcagguaauccaggauguagcggaagaggaagccgucccgguccagaaagaagcggccuuugcugucccgggccagcuccugcggcugcugcugcgugaacauacgccagagcagcgagucgggcacggacaccacggugcagcgccgggucacauacaccugcccucccacguucagcucuacgauguccgggaagagcggcggcuccgccgaggacgacgacgagccgcugccaccuccgccuccgcccccguuggguaauccucgggugcuguccgccagagccauggccaaaaagagguggcccggaugggccaaguggcagggagcggggucgcgaucggaagccccagcggcucuuaucggggagcccugcgcucaggcggcggccggccacugagagccgcgcggugcgagcgcgcagcagugcgcccacgagagccccggugcgcugcgccugccucgcccgcgcgcuccaggcgagugg

SEQ ID NO: 7624 - RNA, 725 nt, Mus musculus
aagcggccagaggccaccugccaagaugguucgcuacucucuugacccagaaaaccccacaaaaucacgcaaaucaagagggucaaaccuucguguucacuuuaagaacacccaggaaacugcccaggccaucgaggguaugcauauccgcaaagccacugaguaucugaaggaugucacuuuaaagaagcaaugugugccauuccggcgguauaaugguggagucgguaggugugcucaggccaaacaguggggcuggacacagggucgguggccaaaaaagagugcugaauuuuugcugcacgugcuuaaaaaaugcagagaguaacgcugaacuuaaggguuuagacguagauucucuagucauugaacacauccaggugaacaaggcaccuaagaugcgccgacgaaccuacagagcucauggcuggauuaacccauacaugagcucccccugccacacugagaugauccucacugagaaggaacagaucguuccaaagccagaagaggaggcugcacagaagaaaaagauaucccagaagaaacugaagaaacaaaaacucauggucuggggauaaauucagcauaaaauaaaugcagauaaaguucaaggucuucugguggucuuuaaugagcccuguugggagagaggugcuuuaaaaugcagaagcauguuauuaaacagugaaauagaugguucaaaaccacgugaccaugaaaag

SEQ ID NO: 7625 - RNA, 725 nt, Mus musculus
cuuuucauggucacgugguuuugaaccaucuauuucacuguuuaauaacaugcuucugcauuuuaaagcaccucucucccaacagggcucauuaaagaccaccagaagaccuugaacuuuaucugcauuuauuuuaugcugaauuuauccccagaccaugaguuuuuguuucuucaguuucuucugggauaucuuuuucuucugugcagccuccucuucuggcuuuggaacgaucuguuccuucucagugaggaucaucucaguguggcagggggagcucauguauggguuaauccagccaugagcucuguagguucgucggcgcaucuuaggugccuuguucaccuggauguguucaaugacuagagaaucuacgucuaaacccuuaaguucagcguuacucucugcauuuuuuaagcacgugcagcaaaaauucagcacucuuuuuuggccaccgacccuguguccagccccacuguuuggccugagcacaccuaccgacuccaccauuauaccgccggaauggcacacauugcuucuuuaaagugacauccuucagauacucaguggcuuugcggauaugcauacccucgauggccugggcaguuuccuggguguucuuaaagugaacacgaagguuugacccucuugauuugcgugauuuugugggguuuucugggucaagagaguagcgaaccaucuuggcagguggccucuggccgcuu

SEQ ID NO: 7626 - RNA, 7417 nt, Mus musculus
caggggaggcgucacgcgcccggaggucacacggccaagccggcgcuggugcuuggcuggcuccucgcggcggcgcgcacgcaaggccgacgccggggccccggagccuccgggaucucagggagccgcggaugcugcgcggggggccauguggagcgcacuggcgcccggcgcucgcgcuggcgcugcucgggcuggcgacgauucugggcgcguccccgacgucugggcaacgcuggccggugcccuacaagugagugagacggagcggggcggggaggggacuuggagagggcggauccgauaccuuagcgcgcccggggacgcagggcacagggcgggcgacacuaagagcauaguuccuaaauaguuggcaacucggggauccucaccgguucugggcaguucagaguccugggaggaauggagagugacaucacugcacggagugacuuuuaggugcuacugacuuggagagcagguuaaaauguuuuaaacacugcaauuauuucaugccuuaucguuagcugccauugcauaacauuuggggagaauuuacagggagccugcuugcuccccuguguccuuacugagcuaaauggggaauuuagcugacugacccggggaauuuccucccuaggcuagucaggaucaccuuguugguccacuucaaccuggaggguagguagggcuccggaccugaggaggugaucgcagucuuugacuuagcuaaguuuugacagccuguggggaauugcgaaacaagaagcgcucggucuucgggguugcgggggacagggguggguggagugguggcuggcgugggcauagugaaguggaaagagaugcagcuuuugaaagcauauguuuugcauaacagaaugaggggcggggggguucauggcaugaugcauguuccucuaaggaguucuuaguucugaaggcugcagaccaaaucuggucccauuugcucauccucugugcggucuuagggaauuuaacucagaaucuucaugcucacauacccuggacagaaaacaggaaaugauaguagcccucgcauuucuggugaaaaccagcaguugccaaacuuaaauauucauguguucuguucaugaauugguucuucuaaauauauaugagagaaaaaaaaguuuaggguugagguugguuuucaugaaaauauucacaagaaaaaaaaaaccuuaaauacccaauaaaacaagaaagagauuguaaaucucaaaguauuuuaucuaauaccaggagacggaggcugacuggucuuuugacucuaaagaagccccgauugacauucccaccugacaacugguauauagcuguaaguuagaucagguuuuguccccguguuaagauuguuagaagagcaauucugaggaugguucucuuucucaccaggcgcuucucuuuccguccgaagacagaucccuacugucaagcuaaguauacuuucuguccuaccggcucgcccaucccaguuaugaaggacaaugacgucaucgaggucuuacgacuacaagccccgauuugggaauuuaaauauggagaccuccugggacacuuuguaagaaugcaucuugaucuuguagcuuuacuuaaguaauucagcuauuacuuugacuuaaaugaguagucaaaugguuacuaggucauauuaauugauaacuuuguaugugcggguuaugugugugugugugcaccuguucacaagcaucaaguggcuggaggcugcugggugucacucaucauaucauucccuuaggacagggucccucacugaaccugaagcauacauuuuugucuaaacugguuggccagugagacaacuccugcccucaacacugggaugacagacacaaguggaaaugacuggcuuuuagguacgacaugcgugcuggggauuugaacucaggucuucaugcuugcauaacaagcacccuuacccauucagccaucucugcagccugugauauaguuccuagcaccuuuauguugggagucaggaagaguuaguuaccacuggaucggcauggagcugugcaacuguaaucuugggacuuggaagguccuagcaagagcaucaccauuccagagucaagcugggguacaggauaccacugucucaaacacagagcaaaggcugccaugaggagcaugugcccugcccuucaucuguuuugcugugaagagucuugcagugggcgcccagaccuuagcacagcugaugccuucugaccuaaaagcucagcauguagaccccaacccuggcugagacaagagcaaagacucagucuaucaugguaaagaauucugggaaagugucuaaauguaugaaccguguguguguguguguguguguguguguguguguguguguguguguaaagccaagguugguaaggcucauggcuacacaccuggacaaguuucccagguuagcccuuuggccugugaauacagacuuucuguuggcuuggacaguccauguguucucaggagggguuaccuugcaacaaucucaacccuccuugcauacucagcuucuaggaaugagaagaaggucacaacagacaggaaucacuucuugaucuccaaguucugcuguaggccccuucccggcucagugaaucacucugggaggcaggcacacucuggaacagucccaaaggcuuuucauguuugccauauuccuuagcuucgagaggauuucaaguguccuuacacagcucacaugugugcugaaaugagcccuaguugccaggacaaaagugaugggugccugcagcuugaggggccauggugucaccaccaggauagugacacagaaguauagccccuuugagcgguuguugugcauggugagcauuuguggggcagcaaacucucucccgugggugaccugggccuacgguuaccucgcagacgacuucacacguguuaucccuacacagaaacuuaugcaugacgccgugggauucaggagcacacugacaggcaagaacuacacaauugagugguaugaacuuuuccagcugggcaacuguacauuuccccaccuccggccugacaagagcgcucccuucugguguaaccaaggggcagccugcuuuuuugaaggaauagaugauaaacacuggaaggaaaacgggacacugucagucguugcaaccauauccgguaaguaggguuugaugacgguaccagugagcaaguggaagauuccauuccuucacugagaucgcagccauccauguucugccuccuggugaucauuuguagucuguacuuccgguuccauuccacacggagccgacuggauccugauguagagccuugcuaggaauugcgaggcucaucugcucuguccaugauaaacaugagugaaacagaugcuguguauagcuaaauuggaauccaaauagauagcaguuaggggauccauaaaaugcccuauuagggaggccucuuaacugugucugaaaagaauugugguuauaacuuauuuuuacggggagaaauacuaaggauuugcuguuucuuggccugucuuuuuucugagcacuccacuucgaucacuuacuggcaucuccugagagaaucauuacaguucuccccauugugcagauggcgaaacuaagauacagguuaaagcuauccagacaauaagugggauucuggucuuguaggagagccuugcgggcaguucucuuuaagaacuucaggacauuucugcuguuuuguauugggaaguugaugacgcagcaaauuuugccuuccuggcauuauauguugcagauucuuuugccaucagaacucuuaucgguagcuuauuacgcgaccauggaucacauugaccuuccuggcccauugccucuucuggguaauucagggccagcucauacugugugugugaaccucacuuuauacaaguugguugucuaccgugcuggaacggaagcacucuuugugaugcuaaugaucccagggcuggaggaaaagaucuggcuauuucuuaguuuuuacacaacacuuuaagacguguuaacucaaaauucaguguguguaggggugggggugggggugggggcuaagacuuuccuuaggucacagagcuggauggaacaggccacaauggaaccugcagucuuuuuuuuuuuucagauuuuauuuuacauauaugaguauguauuuuauuuuauucauaugaguacacuguagcugucuucagacaaaccagaagagggcaucagaucccauuacagaugguugugagccaccaugugguugcugggaauugaacuccggacccuuggaagagcagucagugcucuuaaccacugagccaucucuccagcccaauagccugccaucuuuuaacacggccaccacuuuucugaccuuccuucuacuuucuaauucacaugacccacuuaucccaaccaugaaagcucaucucuuucagcaacacucaguaaagccaguggcuucuaucuuacaucccaacccaguucauaaccucuuuucuucuucuccuuuaagcugguaauucuaucaaacacugaucauucuuuuacuguaaacugcuuuaauuucuagaauuugaagcuuguaagugcguucuucgucuugccugugauucacccuuuccccagaccuugucuggauguuaggacacaguguuugggaguccagcuuuuccaggugacuuccaaagagccaggccuccaaugcuaaagcagauuuucuaacacugcaguuuuguggcccuaauuguaguaaaggaauccagugggaucacucagcacaugaguucuucaugaacucagucugguggagcccaggaaugguuugcugguaguaagauucaggggccucgaucuguuguaucucuaaaagcccugguaagagcaucacugggcagaaaaaacagcauucucuugaguauuuggagagauucuucugaucugguucgaggugguaggagaagccuuagccaccaaggagucugaagccagcacaaacaguggccaguuugguugacggguuagagggauuuguguagugcguuaucaguagcagcccagcaagcagaauacaggaggaagcggguagcugguauucacgugugugagagaggaugcaugucgcuuagcugugacagggcagcagcucccucagcagcccuuuguucccaccaagcauccaucugcccuuucccuuguucuuacacugucuuugccuuuccucuuuccccacuucugggucuugcuucucuuuucuccuuugcuucugaagccaggaugugaacagagaagaauggcuucgguauacguauacugacacucuccguguagugcugaccuuagcuuaaauacguauagaauuuuaggaguccucugucuacccccauugugucuuguauuugcaguucaaaggccuuaagaauggaagaaaacguggccaggcuugcaauccuguugugggcuuugaaguuuuaaaaguauuucuuauucauccauucuggucuuaauggcauuggaacuuuuuauaaacaguuuauuuuguuguugguauuuuuuucuucuuaacuaggaaacacauuuaacaaaguggccgagugggugaagcaggacaaugaaacugggauuuauuaugagacauggacgguccgagccggcccaggacaaggggcccagacgugguucgaguccuacgacuguucgaauuuugucuuaaggacauauaagaaauuggcugaauuuggaacagaauucaagaagauagaaacaaacuauacgaaaauauuucuuuacaguggagagccuauuuaccugggaaaugaaacaucuauuuuugggcccaaaggaaacaagacucuugcuuuggccauaaaaaaauuuuauggccccuucagaccguauuugucaaccaaagauuuucugaugaauuucuugaaaauuuuugauacagugauuauacacagacaguucuacuuguuuuauaacuuugaguauugguuucuaccaaugaaaccccccuuugucaaaauaacauacgaagaaaccccguuaccuacccgacauacaacauuuaccgacuugugacaacuuccacucugcugcucuccagacagcagcauccauguucuuccagggcugugucuacaguggugucuuuauucaccuucccucccuggggcucacuguuggaagugcaguaucuggacauuucaagacucuugcagaguagcagaaaccguaauuguacuggccaaagugaauggguuguaaucguuauuugagaauuacuccaucucagcuauggagagccuuugaucccaagguagcauuuuucucgggcuacuuuuucuguuacaguagugcuguuucguaguuuaaggguuuuuuuuuggggggggggucaucuaaagaauugcuguuuuuauaguuauuaccgccuuagguuccaggucuauuuucuauucacaagguuuuaaaaccuuguuuggacucuguuacuggaauagugccucuagccauggcaaauacagaaaaauuuuuggcuagcuggcuguugugacagaagcaauuuaacaucucuagauuuauguccuuaccucuaaagugauucaucuaccaggaguauguagauugggggcaccuauguaggcacaggaaggcacacggagugcauauacgguguccacugggacuaaaagaacacaaacugccauccuugaauuugccugacguacguacaggccauccauuccuggguaauugcugagacuuugagcuggcacaguacacauugcuucuuuaguacaggccauggaagcuucuggcuccagacauggcuaggugaaguguccuucugacuuccugugcauguccucugguuucucucccaccaucaucagagagagcacacuuuccuggaaaggacagaaguuugucaagggccuuuguuagcuugcuauguugcuuuuaggggcauuagacaggcuaucaagcuccuguauuuugaucaguugaacucauuuuguuuuccuaucuaacacuagcauaauaauggaaaagucuuuuaauauagaaacaugccaguuauuaauuuccuaauuuacuaauagcuggcugcuucuugagacaucaguacacuacugugucuuaagaagucucaucuacguaucugcuggcccagaugucagggcuuagcaagauaaagugaccuggaauuagguucucacucaggauacacuggaggcuuuccagcacucuucagauuguggccuuuagaccgguaucugugcaccaaauguuaccagucuguguuauuguucagucuaauaaaaaacauaaacaaaacaaaaaaaauaaacucaagaaaaaaaccaggg

SEQ ID NO: 7627 - RNA, 940 nt, Mus musculus
ugauuugucuagggagccacuauugaauagagauucugaguacucgauaguuauuucaccuuuuagcuguuggcuucuauguguaacaguaaauuaccuguuaaugagccagauuaaugggugaagcccuaauauucaagcucuuagaagaaauauuacacauucauaacuugaacugacauagagauagaaacacaccguaacucacggcaacaaagcugagucuguaggugaaaagcaggagguagaaacuggccaggcagcguaggguaggagacccgaaaaguaaagguuuuccuuggcuuaaaaccugagaauguccuucacccucugcagaagggagagccaccuuccucccuaaugaccaugccugccugggauuuguagagcagcacucacucacugauggccgagccaaugggcuccuccauuccccacgcucugguuuuugcuuuaaauccacaaaagccucuagacaagcaguucguguuaucccagaaucuccuccgcuacacaagaauggcaccucuuuuaagcucccaccuaugagucuguagugaaaccccuggcccaugaauugcauucuuuugauuuaccuacaagaaccuggccgcggacuuuggaaacggaagcaguacuaaagccuucagagucggagacaccccauucugcccacucacuuugauuucccaauuacugauugaaagagguucugaaucacgauacagcguugucucuuaucuuguaaaucuauuucacagcuugaugaacucuugggaaaucaugugacucguggcucugccagcacuaccugacucuccaguacuuucguuucauuuccuaacauucucuacaaagaaacaaaaugcuuuuucuuuuaauuuuuuuuuuaacucauucacuuuacauccugcucacuguccccaucccaggcaauccc

SEQ ID NO: 7628 - RNA, 233406 nt, Mus musculus
cucccauugcgggcaacuccggugguggcagcagcagcggcggcggcggcaccgccuccuccucacacuccgcggguggcgggguuagaugagcggccccaacagcggcgagggcggcgcagggaggaggaggagaaggcggcggcggcggaggaggucgcugucuuuguagugucccugcugcgggcgcccgaggccgccgcuccagccgucgucguuggcggagccugugagggcgcgcgcgugcuugcccgcggggacgaggcggcgggcggcggcggcggcggcgguggcgaggaugaugaugugcgcggcgacugcuucccccgccgccgccuccuccgggcccggcggggacggcuucuuugcagccgccaccaucucuuccuccccggcaccgggggcgcuguucaugccgguuccugauggcucgguggccgccgcggggcuggggcuggggcugccuaccacggacucccggggucacuaucagcugcugcugucaggccgggccuuggcagaucgcuaccggaggauuuacaccacggcgcucagugacagggaccaggccggcagcagcacuggacacccggccuccaggugagucucccgggcgcccuuccuugccgcgugugcauccgugccccccccccccccccguguguguguacccgugcguguguguccgcguaauuggcacccggcuuucagucagggcuggaugcuggugguagaagcacuuuggugauaagagggugugguggccacggggucugugcgugcgugcuuguguguguggugugugugugucuaugugucuuuuggaggggaaggagggaagguacagaagauggguacguaucgguuaacgcuagagagggugauggugcuggucugucacgacacguguguauuguugagaaaggaggcaugggucgagagggauaagaccacaaagcauggagagaauuugcaagaguccuaaggggauguguuccuguuucuagugucugagcugcaguguuauuugcacgaccccuccccaucacauuccuuccuccagcugccuuccauaaaagccaccuuucacuacaggggagcaaugguguagguuaaagauacugauguuuguaggauguuguagacaaaaagccagugguuucauuugagauuuaggaauaaaggauacagauggggguuugcacagaccuuagaagugucugauagggguuuuuagaaguguaguuugauuccggagccuuuuggccuugaaaugcguuugcagcugcugccuuguucugaugucccguccggccauuucccuucgccuucuguucuauuuccugccacuuacagauuugagaguacaaggaguuuuguaggaaaaauggaaaaaaaauacuccuuuuuuuuuuuuuugccaguuuuuaaaugaaaaacuuuaaaaauaugucagccuacuaggguucaccugcuaucagaaaaucugaguagcucucaggucucuuucaacuagaacuggauacaccuucaaguuacuucguauaguuggcaagucacuuucauuuucuuuuucuuaaaauuuggguacuuuuuuggcuaaaggcucuccauuccgugccuuaacuugucacagauccugaaggcugguugcugacucuuuuugccagcuuugagagugguaauugggagucccuuugcuucuuccuauagccucuuacagggcauucaaaaagcauaguaggauuuuuaaaagugaguuugcugaaguguuucuuuuuuccucccuuacuaaaucuuauuaggacuuauuagggaacgccagaugcccuuuucucccguuauagaaggucucuaguccauacaucuagcuacuguaucagucuauguuacggcuuaucugcuggagaggguuguaaagaccaacuuuauucacaguuuuuauagauaaagcagccuuaucuauuuguugacaggauugggugcauccuuaguugagucauggauauaaaugaucauaacuacucuuugcuauuuaggaugaagguaacaaugucauagguaugguucuugcugaugguuuuggaaagcagcacacaucacauuacagaauuuaccuugagggcuagguuuaagcuugagugaugcaucucuaaauuauuguacugugauauaucuguacaaauuccucuuaccgauuuaaaauuauauuauuucuaaacuuaugcaauaaucuaugauguauacucuuauuuugacuuuuuacugcuuuuuaaauaaugacuuucuuguaucuacaaauguacuuggaguaguagagaaaguuaaauauagguucauauacuuaaaauuggugauuuaaugguuugaucaauuucuacaaacugucaaugaaauauaaggaauugguuuauugaucucauggaaauauuuauggaaaauaaccuuacuuugauaaugccuuccgaugcuuguucauaauauuguuuacuauaguucacucuccccauuuuuaucuacaacuguucuuuacugugaauugaauuaaauuugcuuacuaaaaaacuaaggauggcagggaagaauugggaauuaguuuauuuauguagggcauugagguagaugggaaagauagaaauagggcugaaauucuagagagcaucaagcguaaaggugagagaaaggggagacaauaaaagaaaccacgagaggagauuagaaaacagaagaggagcaggcaggagcgccucgggcucuaggggaggaagagaaucuuuucagaagugauagauacugaagaaaaccagaacaguuucugagucaccgauaacuucugagccaaguggucauaacugggauaagcauaaagaggggagggcagauggaaaggauuggauaaccuggggaauaugcaagaagguuauuggagggcaaugggauagucaaguaugggaacuuaaguagagaggauauuaaagaguugaaagaggaaauaauugacagaaaucaguggaggcaguuuuaucaugacagauuagccauuagaaaaguuaaggauugaucguccuuuacuagagaaggaaguguuucuaaguaugcagacugauaacuuuauugaagaugagugccauagguauucuuucuggugaucugaauggguggcaucauuuuuuggcauuuauugugucaguaagugucuacauuaugcacuguuguagacauuaaaggcacagccuuaaguacaacagaugggaucucacuguuuuugcagugugcacugggggugcugguaacaacugguaauuucuuugauaaugaugaaagaaauacagucagcuucauggauugagcuacuacagugauagggccggcagaguccucacugggaguuggcauuuaacuugacguguaaggaggaaggagaucuggaagugcauaugaggaaauuauaaaagccuuaagagaagagaaaacaugugcuucagggaacaaauauauaagugaauuaucagcccaaguugaacaauuucaguauuauagguuguuuuggguauaagauuuaagccuaagguaggcuugauuuugaagguauuuuaacaaaauggcucagagcuuggacucuugacacuacacuggcucuaaguccugccuguccugucauuugcuaguuguguaaccuugaauguuacauaacuuucaugucuugguuuucuuauagaguggagauaauaauugcauuauuuuauagauuagaugaacaaauacuuaucaaguccuuggaauguuauauguuauuaaauauuagggguuuuguuuuuuuuugaaagugagggguuugaggauacggagagaggcaauagucuugcuuguaacucuugguuuuuggaucaauaauugcugacuaugggaauagcuuuuaugcauucagugacugaauauguaugguuuugaaugaguaagacuggaugaaauuauaacauuuucucagagaaagugaccagccagggaaggcagaaaaaaaaaaguuuccucaguuuucugaguggcaagauaaguuuccauuugggaagugccacacuucugugauaggauuucacagcauguagauuaccuuugaugccaguuuuaccuuuuuauguguuagguugcaguguauguguguaugugugugugugugugugugugugugugugugugugugagagagagagagagagagagagagagagagagagagagagauagacugagauugauucugcucuguagacguuuucaggucuggaacuuauaacauugcuggugguuggaguuacagcucuugugucagcugccugaauguuugguuuuauguguuugaggugggaucucauguaacccuaacaggaucacuauguagcccagaaauaaaaguuauccucuugguucggcauucugaugauuacaggugaguacacuagagcuggccuuuuuacaguaaucuaaaggcuguuuggccacacauguuaaaugccuuuuaaauguuggcugcuguuguuauuauuaaaguaauauuuacaauuccaaucugcuuauuauaauaaaccuuccuaguuagaagauagaugaggaaaacuuuuaguugacugauucaggguaaaagugugacuggaggucaaagaaaaguagaaauugaaagcuuugcuugacuguggggaaggggaagcagugcugggagggaagugguaagcugagcuagaaagaaaagccugcacucuggggcuagcagagcaggagagcagcccugcucugaguaccagagaacacuuuacuaaaugaggauuccuguccuuauuuuaaagcuaaacuaguuucuuuauuacuacuuucuuuuuguuagaaaugccauuugacuggcuuguuaguauacucugauaagcccagccuguggguggugaaggucaggaguucaaggccagcuucugauauauaacaacuucaaggccagccucuggcccugguacucuaucucacaggaaaacagaacagaacagaaaugguauuugaguccauuccaucugugcuuagaauuuggguuguaagagguuaaggagucaaaccuaugaauguugaagguuacuagauguugaaguuccuagucuugaguguguuguaugucuggggaugaaagauaaaaggcagauacuucaacaacuguuacgugauggugcccuggcccugcucagcugcaggagcacaggugaggaaggcagucuguguguaagugaugcuaacauuuuuauuaaugcuaggauguagauaucaggagagagaggggaguaagaauucauugcaggauuggagagauuagccaaaaggacaguaucuggaagaacaagaaaaauuaaauuuugaucagaauuucugggaaaauccugauaguuuugaguuaagaagaaacauuauuauagaaguaggcuacggaaugaugcgggguugaguuaguguauguguaucuguguugggugguaguuaauacuuuucuucacauagguguuaaaucugugaaguucuguauguucuauaaacacauuaagacaaugguacuacucuguugguauacugauugguaaaaaauguaaaaugaauuagucuccuagcacaaaagaagugaaaaaauauuggaucuuauaaaaaauauguucauuuaauaaauuuaaguauguuaauuuaaucauaauauuuuuauauuauaagcuauucaguuuagaaguucaaaaaauaauuuccuguuuuacucaaagacugauuaaaugugucaauucuuuuuggggggugguuagguuaagauuuaauuuauauauaauaaaauuaacccuccuuaaacagucacuuaaugaaucuuagacuauuuucaccacuucagaaagcuuuuuuagggccucacacuccugccucccauuaugacuaucuagccuuuuaccuuuucuauaauaguaugucagucuaguucauuuuagggcagggccauacguauuguugcuacuucugucuuccauucuguguuuuauguaaauggaaauuaggccuuaagacuucauuggauucuuguaaacaucuuagcaggaacaucuuguguaugguacuaagcacugcauguugccccagccccaaguuacuggcuuuccuuacuugcaguggugcuaacaccaguacccaacagaccuuccccuuguaauaaagaacugugggaguaaggacuggcacucugcaccuuucaccgagugguuuuaauauccuuugauagucuuugaccgaaucaguaauuuuauuaaaaguuuaaaaauguuuuuccccucuuagaauucugcuaaucuuucuguauuuauuagagagugcuuuuugguguccuauaccaguggcaguguggcggggcuacaguuagccucccagauuacccaccuuccuucccagauugagucacaugcuuuucuagauuuggggacuauuaagaacuaaaagagaagguagcugaauuccccaggcaugcuuccuauucacugcauccauaaguuggcucugugaugaugugguagugccuggccuguuugccuagaggaaagacaguuuuuauuggauauuuuauguauuuacauuucaaauccccuuucccaguucccccuccggaaccucccucuccuauccccccaaggcaagacaguuuugaaggauccucucaacuuguccuuccccagggcucugguugaggccuuuauggcugaagugcaguccugcucagaacuacuacuuucccuuacccuuagcuguugauucuugggcacgccagugaguucugguguguauaucuccuuucuagucauuucacuugcuaccaggaacggucuuaggaaccuuaguguuggcuaggaugaaccacaugcuaacacugucagcugaacacugcugcugcugcagcucagcaugcacaguuguguaacuauuaaaacugucaugcugauccccaucgaaauuccaacucaauucuucacugagauagaaagggcaauuugcaaauucaucuggaaaaauaaaaaaccuaggauagcaaaaacuauucucaacaauaaaagaaccucugguggaaucaccuugucugacauuaaacuguacuacagagcaguugugauaaaaacugcaugguacugguacagugacagacagguagaucaauggaguagaauugaagacccagagaugaacccacacaccuauggucacuugaucuuugacaagggagcuaaaaccauccaguggaagaaagacagcauuuucaacaaaugguacuggcacaacuggugguuauguagaagaaugcgaaucaauccauucuuaucuccuuguacaaaacucaugucuaaguggaucaaagaccuccacauaaaauaagagacauugaaauuaauagaggagaaaguggggaaaagccucaaagauaugggcacaggggaaaaauuccuaaacagaacagcaauggcuugugcuguaagaucuagaaugacaaaugggaccucguaaaauuacaaagcuucuguaaggcaaaagacaccgucaguaagacaaaaagaccaccaacaaauugggaaaggauuuuuaccaaucuuaaaucugguaggggacuaauauccaauauauacaaagagcucaagaagcuggacuccagaaauucuaauaaccccauuaaaaaugggguacagagcuaaacaaagaauucucaacugaggacuaccgaauggcugagaagcaccugaaaaaauguucaacauccuuaaucaucagggaaaugcaaaucaaaacaaccuugagauuccaccucauaccagucagaauggcuaggaucaaaaauucaggugacagcagaugcuggcgaggauguggagaaagaggaacauuccuccauugcugaugggauugcaagcuuguacaaccacucuggaagucagucuggagguuccucagaaaauuggacauaauacuacuagaagauccagcaauaccucuccugggcacauacccagaagaaguuccaacauguaauaaggacacaugcuccucuauguucauagcagccuuauuuauaauagccagaagcuggaaagaacccagaugucccucaacagaggaauggauacagaaaaugugguacauuuacauaauggaguacuacucaacuauuaaaaaauggauuuaugaaauucuuggacaaauggauauaucuggaggauaucauccuuagugagguaacccaaucacaaaagaagucauuggauaugcacucacuaaguggauauuagcucagaaacauagaacacccaagauacaauuugcaaaacacaagaaaaucaagaagagggaagaccauggguggauacuccguuccuccuuagaauagggaacaaaauacccauggaaggaguuacagagacaaaguuuggagcuaagaagaaaggauggacuuaucaagggacuaccccaccuggggauccaucccauaaucagccaccaaacccagacacuauugcacaaugccagaaagauuuugcugaagggacccuguuauagcugucuuguaugaggcuaugccagugccuggcaaauacagaaguggaugaucacagucagcuauuggauggaacacaggggccuccaauggagaagcuagagaaagcacucaaggagcugaaggggucugcaacucuauagguggaacaacaauaugaacuaaccaguacccccagagcucauaccucuagcugcauauguagcagaagauggcccaguuggccaucacugggaagagaggcccauugauauugcaaacuuuauaugucccagugcaggggaauugccagggccaagaagcaggagugguggguaggggagcagggcugucggaggguauagguaacuuuugggauagcauuugaaauuugaaauguauauaaagaaaauaucuaauaaaaacaauaaauaaaaccaaaaaaccauuaaaucauaugcuuuuacaaaugaaaaaacaaaaacaaaaagaaaacaaaacugccaugcagagugcgguguguaugauuggaaaugucuugguggguacuguaucuuggacuuuugagaggcuuagggaaguauucauuauaaggguaguauaaugugcccacuguugcuaaaugacauugauagaugagaaugacaaagaaaaacugaaaguaauugggcaugaaagguaaaaggaauuuucuuuuucuuuuuuaguaacauauagaggaauaucugcaguggggauaagaagcaaagggcaggucaaccaaaggcuuaauuaauguugaaggugcuaggguagauagaauucuuguuugcuauaaccacugucaguguucugauuggguugaaauggauuccugacccuuagaauagaaccucucucugaauugauguaccuguaaaccuuagaaucucuaaguuuuccaaaguuaucuaggcuugcagagguugcuuauuuaugaguagaaaaugccuucuuaaagacuguguagaaguuuguacucuccugccucuccuggaccaucucugaccuuuaguuauaacaaaccaguaaauagagucaaggcaugaaggcacuggaucucucucucucucucucucucucucucucucucucucucucucucucucacacacacacacacacacguacauuucuaaacuaaauugagauacucuaaaccaccacaauagacacacagaaauaucauaugauauucgaacuuuucaaagcaaauacuacagugucugucucaccacuaguuugaaauaguuaaugguuuugacuuuaguuacuacuacauuucuuuugauggcagccuacuuuugcaguuaggcuuuuggugguugugauauaaauuaagcauuacuugucagaaauauggagcugcacaggaggguggccucuucagucugacuccaugcuagagaauuguuacagugcccaauaguugcccuuagcacagggauuguuuuagacuaagaauccacuuuauaucaaagaaggaccagugagguccauuugucucaucauacaccacaugagccagaagcugcauuucugauagggcaucaagucuucugauggcaguacugaugacaguacccuggcuugaacaugaugcucugcaaggaugagcagccgugcuuugacauucccagaaaaaagcacagcuacgagugguucuacccaacaucauucucaguuauacaguuagggaguuuguguuuccugucaucagagcuugcgaaggagaaguuaagagauacugguucuuagaugagaaacauuuaaaaagaaaacacagaagaauccuguuauauuugaaucuacaguugguagggcucagagguccaaagaaaccuuccuuuggauugggcuuauggauauguuugaaaagucaguuugucagcacaacagagcacagguguuugucacaugagugauccaguggguuucucucagauguuaguauuauaguuauccucauaaaaugaauuuaauaauucuguauucaaaauuguauagacucaguguucacaaauauuugauagacucuauccgaggcacuuagugguauguguuuuuucuuuaauggccugauagcuuguuucuuuuaauacuuaaugauaucuacugccuaaaugugccauaguugguucucuggaagggaaucuugacugcaccuaaguuuugacaauuaugaauggaauuccuauaaacauccaugugcagguuuuuuuuuuuguguguguguggacauaaguuuccagcuucucugaauaaauacauuccagaaucuguaauugucacuggaucauauggucaggauauguuuaguuuuguaggaaacugccaaauucucucccccaggggauguaccauuuauauauaugaaauaaagcuuccaguugcauaugagaguuugcauugcucuguguccucagugacauuuagaguugucaguguucuggauuuugggcauucugauugauggaucucauuguuguuuuaaucuguauuagugugcuaacaccugucuagaacuccuuuucaggugcugguuuguuauuucucuaucuacuuuggggacauaucaaggauguuuacucacuuuuaaacuccaacauuguuguuuugguacugauggauuagagaguucuuuuuucuuuucuuuuuuuaaaauuuacuuauuuauuuuaugugugugaguacaucauugcugucuucaggacaccaggagagggcaucugaucccauuacagaugguugugagucaccaugugguugcugggaauugaacucaaggccucuggaagagcagucagugcucuuaacugcugagccaucucuccagcccuagagaguucuuaaauaguuuggauaauagucuucuauuagcuaugucuuuuauagaucaauauuuucuccuaaucuguaucauuuuucucauucuauuaauaauuuuuuuaaagcaggcaguuuugauuuuaaugaaguucucaacuauuuuuuuccuaguucauguuuaccauuuuauuuaaaaaaaaacaacaacuuggggcugucuagaguuucuccuguuucaucuucugaacacuguauuguuuuguguuuugcaugcaaaguuuauuuuccauuuugaguuaaucuuuguguguuggcugcaaggccugggugucuaguuguuccagcauccuuuguuuguuuuuuuuuuuuuuuucguugcuuucuuuguuccucuucuacugcuguuuggcuguauuuaugugggucuguucugaguucccugcucucuguucuguugggcugucucuuguuucuucaguacuacauggucuuuguuacuguagucucauaggaaaucuugaagugagauauuuacuuuuuucuuuucacauugucuuaguuauuauggguguuugucucuucucauaaacucuuaaacauuugccaaaaucccagaaauaaccuacuagaauauuuauugaaacucucuuagauuaauggauuagaaagaggacaucuugauaauaauacugagcuuuccuaucugcaucuaugggauauuuauuauuuaguuucuuuuauuaaaauuuugcaguuuucuuuauuuagcucuuacaaguauuuuauuagauuuauaucuuuauauuucuuuguugaggauacaacauuuuuauauucuacuuugcuucugguauauaggaaaauggcacacacauacucacgcauauauacauacacaaugcuaauguuuugugcauacaugcuguaaucuuuuauuagguuuaccaggguucuuuuguuuugucucuuccuuuagauuuuugacuaggaagccacaucauccaucuuuccuucucuuguuuuauugcauuagcuguaguucucacagagauacugauagaguggugagagagcaagcacaccguugcuuuguuuccuaucuuagugagaaagcuuguacuuucucacugucaagucuggcgucaucuggaggaguuucugcagguauucuuuuugcauguugaggaaacauucuuaauuucuaguuuacugagaacuuuuauuaugaacuagggguugcauuugucaaauaccuucccugcaucuauugaugugaucaucucauagauuauuuuuagccuguuaauuuuuuuucagaugauacauaccuagcugcgauacauuucacuuugguugcugugaauguuucuguguacugcuggauaaaauuuagagguucucuuuugcauaugcauucaugagagaugcuggcuugugcuuuucuaauauuucauugccaugucgaggcuaauguuacuguuacccuggccucauaaagugagccaggauggugucuucuguuucguccucuaaagagagucgcagaagccugauagaauucaccagugaacuucugaaaggcugguaagguacugauuugcugccgucucauaguuucgacaaauuuuuuauuuuaaugucuguacaauuaguaaugaugauuccucuuucauuucugauaacauucauucaaucagucagucauucaguucauuuucuaguuuugcuucucaaguuuaaagaaccaacuuuugguugguugauuuguuuguuucuaauuuauucuucucucauauaaugcauccauucacaguugcccuccccuccaucccucucaguacccccucuaccccagauccccucccccgcacccccuccagaaaggagcaggccucccagggauuucagcugaacacacacacuguaacaagacaaaauaagaaaaggcacagacuucaugccauggcugggcagggugacccaggaggaggaggagggucccaggaguguaugacuaugcugcccuuguguuuacuuuugggcuggcuuccccucagcacugucaucuacuucucacuuugacuuuauuuuaccucugacccccagcuuuggaaucuuaggucauucacuguagauuuuuauuucuagugugaaacuuggaggcuugggauacuuugggugcauuccaggcauuuuaguauacuucccauuuaguuaaguuauuuaagauuuguauuccugguuuuuuuauuugaauagcacaguaccuaggauuauuuuacuuaacuuucagguauuuaguaauaucacaaauuccauugucaauacuucuaacacauacuuuuuauaauuuugauuuuuuaaauugaauuuauuugaagcuuucauggaugacuuuaugaggacuguauuccauccuuuccauucuccccuguccucuaccagaacuuccacuguuccccuucccucacucucacauucaucacacacacacacacacacacacgcacgcacgcacgcacgcacgcacgcacgcacgcacacacgcacgcacgcacgcacgcacgcgcgcacacacacacacacacacacacacacgcacgcacgcacacgcacacacacacacgcacgcacacacacacacacacacacacacacgcaugcacacacacgcacacacacgcacacacgcacacacgcacacacacacacaugcacugggauuguguauccuaucaugggguuugucccuugagaaaacugauucucccucuguggguggggccuugugcaauuucuuccaaccacaucaacaauguuauuuuuuucuuuugcucacaaucagauaauuaugccacuugcccuuaaaaagaguauuuuuucucuuggguuuagauguuauauaagagucaguguauugguuaggauuuuguuucugugacaaauauauuacacauagagauuuauucuggcucaguuuuugacauuucagucguccuggcaaggcaggaacaccacggagaugggcaugacaggaaacuucucucauagcagccacaaaguccaguuauagccucccaaggccgcccuuccauaguuuuaccuaacaaucuauacuaucauuaugccaugaauuaggucagaguacugaugaucuaacuauaucuagaaauguccucauagauguaccccagagaugguuuguucuaaucuuuuagguguaucuuuuaaccuaauccaguugacaaucaguauuaaccaucacaaucaauuauuuaaauuuggguggagaguuguuuggacauucuauauaucuguacucuuuuuuuuugucuuaacuauagauagguauuaaaauagauuuauccuuuuaauuuugucaauggcugcuuuauauaauuuuagucuuuucuauugggcaccuauacauuuauaacuauuaaaaauucuggugcauuggcacuagagagacgacauaguagagaacauuuacugcucuuguggaggacccauaauuaauuccuagcauccacauuagauggcuuacaacauccagcuccaagggggauuuuuuuuuuauuacguauuuuccucaauuacauuuccaaugcuaucccaaaagucccccacaccgccccccccccccacuccccuacccacccauucccauuuuuuggcccuggcguuccccuguacuggggcauauaaaguuugccugaccaaugggccucucuuuccagugauggcugacuaggccaucuuuugauacauaugcagcuaagucaagagcucugggguacugguuaguucauaaaguuguuccaccgauaggguugcagaucucuuuagcuccuuggauacuuucucuagcuccuccauugggggcccugugauccauccaauaguugacugugagcauccacuucuguguaguccuagucucacaagagacagcuauaucaggauccuuucagcaaaaucuugcuaguguaugcaguggugucagcguuuggaggcuaauuaugggauggaucccuggauauggcagucucuagauggccauccuuuugucucagcuccaaacuuugucucuguaacuccuuccaugggugauuguuuccaauucuaagaaggagcaaaguguccacacuuuggucuucauucuucuucaguuucauguguuuugcauauuguaccuuauaucucgcuauacuaaguuucugggcuaauauccacuuaucagugaguacauuucauuugaguucuuuugugauuggguuaccucacucaggaugaugcccuccagguccaaccauuuuccuaggaauuucauacauucauucuuuuuaauagcugaguaguacuccauuguguaaauguaccacauuuuuugcauccauuccucuguugaggggcauuuggguucuuuccagcuucuggcuauuauaaauaaggcugcuaugaacauaguggagcauguguccuucuuaccgguugggacaucuggauauaugcccaggagagguauugcgggauccuccaguaguacuauguccaauuuucugaggaaccgccagacugauuuccagagugguuguacaagcuugcaaucccaccaacaauggaggaguguuccucuuucuccacauccucgccagcaucugcugucaccugaauuuuuuaucuuagccauucugacuggugugagauggaaucucaggguuguuuugauuugcauuucucugaugauuaaggauguugaacauuuuuucagguguuucucggccuuuuuucgguauuccucgggugagaauucuuuguucaguucugagccccaucuuuuaaggggguuauuugauuuucuggaguccacccucuugaguucuuuauauauauuggauauuaguccccuaucugauuuaagauagguaaagauccuuucccaaucuguugguggucuuuuugucuuauugacggugucuuuugccuugcagaagcuuugcaguuucaugaggucccauuuguuaauccucgaucuuaaagcacaagccauugcuguucuauucaggaauuuuuucccugugcccauaucuucgaggcuuuuccccacuuucuccucuauaaguuucagugucucugguuuuaugugaaguuccuugauccacuuagauuugaccuuaguacaaggagagaggaaugggucaauucgcauucuucuacaugauaacaaccaguugugccagcaccauuuguugaaaaugcugucuuucuuccacuggaugguuuuagcucccuugucgaagaucaagugaccauagguguguggguucauuucugggucuucaauucuauuccauuugucuacuugucugucgcuauaccaguaccaugcaguuuuuauaacaauugcucuguaguaaagcuuuagguuaggcauggugauuccaccagagguacuuuuauccuugagaaaagcuuuugcuauccuagguuuuuuguuauuccagaugaauuugcagauugcucuuucuaauucguugaagaauugaguuggaauuuugaaggggauugcguugaaucuguagauugcuuuuggcaagauagccauuuuuacaauguugaucuugccaauccaugagcaugggagaucuuuccaucuucugagaucuuuaauuucuuuuuucagggacuugaaguuuuuaucguacagaucuuucacuuccuuaguuagagucaugccaagguauuuuauacuauuugugacuauugagaaggguguuguuucccuaauuucuuucucagccuguuuauucuuuggguagagaaaggcgauugacuuguuugaguuaauuuuauauccagcuacuucaccgaagcuguucaucagguuuaggaguucucugguggaauuuuuagggucacuuauauauacuaucauaucaucugcaaaaagugauauuuugacuucaucuuuuccaauuuguauccccuugaucucuuuuuguugucgaauugcucuggcuaggacuucaaguacuauguugaagagguagggagaaagugggcagccucaagggggauucuaugccucuugucucagcagguaccuguauucucuucuuguguuagaaucucuucuuguguuguacacguacauauacaugugcacguacacaaacacauaauuuaaaaaauucuggugcaaguuuuuguuuuauuaguaucacauguuuccaugucuaguaauacuuuugaauacuuuugaaugaguuuacuuuuuugauauaaaaauaguuuuuaagggcugaaaagaagguuuaguguuuaaaaugccuauuugcaagcuuaagggcccaaguuugggucucuaacuacccacacaaaauccaggcugaauaguagagguauguacccccagcccuugacugauucaagagugguuauagacaggcuuacuggccauacaggcuauccagaaugaugcgcuccauguucagugagagaaccauucuaaaaaguaagaugggagaggggucagggaagaucuuuccugugugugaagaucagaggacagcuguguagaguaacuucucuccuuucaccauucuuuugaggcagggucucauuauuucugcugccaaugcugcuuuguaacuuccucccaugucacugugggugugcugacauuacaugcuggaacuggcacaucacucauuuauuuauuuacuuaauuuguuuuuuuuaagguuugucuguuuuaugguaaaguacacugucacugucuucagacacaccagaagaagagggcaucggauucuauuacagguguuugugagccaccaugugguugcugggaguugaacucaggaccucugguagagcugucacugcucuuaaucccugagccaucucuccagcccacauugcucuuuuauuuugguucugggcauuggagguagguaggcccucaggcuuacacaguaagcacauuggcuuccugggccaucuugccagccccaauuggauaauuuuuauugacucauuuucaaauuuuuagauuuuguguuaucuccauuuucuuaaugaauuauuuaaugaaauuuaaauuuuuauauuguuaaauuuuucuauauuauauauuuugaucauauuuucuuuucucaacuccucuaaaaucuauccccacccaacuucaucccuccaacuuuauguucucuguaucaaacaaaacaaauaaaccaaugagauaaaaaauagcaagacaaaaagugccuguaggugcuuugcacguccacacacacacacacacacacacacacacacacacacacgcgccacagaaaccaauggaguuuauuuuguguuggccaaauacucauagccauggagauugcccuagaguguggcugauauauccagugacaucucauugggaaaaguggauuuuuccuuuucaagcaaguaugaacugcaaauagguucucuguuagggauggacuuuguggcuacuuccccuucucagugaggugauuuuaacgauugaaccugcacaggucaucugcuugcugccauagucguuguauagcaaauguauaucaguccugcuaugucuggagguugcuuuuucccuggagucauuucaccaucucuggcuccugccaucuuuuaucaccuucuuuucagcguagauucugagucuuaaggggaauuguuuuugauuuggucaguugugggucugaguuaauuaccuucuacuauaaggagcuuuucugauaagauugagugauguucugaucuauggguguccuagucacuguucuauugcucuuuaguaguguagcgcacuuccucauggacuacacuuucuaccuccccucuaagggccuacuuugccuugaggacacuguugguggguccugaggaaccucaguauugucuugccugguauuuucuucagaaaaaguggcugguuuaucagacaauggaagauuaauuuccucaugugaaagagggucaaggggugggacugagaguacuacuuccccagguuagguaaaccuuugaggauuugaguaauccccaccccaaguuauaggaucccauucuuugccaauaaaugcucuuacacuuuaacugcugacacccugugaggcugagacuuggauuuuugcuguaauucagccaacuuuauaaugagggcuuugguuucauuuucugcaacuugagcuccauggcugcuagagagaagauucucuucaagggcacacuuagaaaccuuuagauuguuuauucacauauggagccauucaauuuuaccacagaaauuauucuuuuccuuuaucaauuuauccauagaugcuacgagcaaugaaccagcaaaauaauuuucuuuauuuucccccagacucuagauauuuucauauacugggucuacuaauccauugccagacacaauuggcagaucaagauaaucaaaggcauuuacgucuuuaaguuugaaauauaguuuccaccaugggccuuccauauucuuccagcucccaggagagagagucugaagaaguuucaguaguugaagguguucaugaauuagaaaauacugucaaauaauuaagccaauucuagauacuaaaaagauucauucuuauacuucugcuccuuuagaacuacuccagguaccaacuucucuauuagucagggucuagagucacagaacuuauggaauguuuauauauuaaggggguuuauuguaaugaccuagagucugcaguccaauuaauccagcaguggacaccuuagaaugggaaguccaagaaucuagucauugcucagucccauaaagcuaguugcaucuuuuguauaagcuggaaucccaaagaaguagguucuaucagaugugcuggcaaguaagugcaagcaggcgaaggcgaauaagacuuccuuauuccauuauccuuauguaguccuccagcugaagguaugguccagauuaaagguguguaccaccacaccugaguuuggaacuugcucugucccaggcuggucuugaacucagagaucugcuugccucaguagucuuuauaaccuugucuggaccuaagcuuuuuguggccacuaugccucaagaucuggaucaaaagcaugugucaucccaugucaagagcugggucacagauguguucuccguuucuggauuguaguucauuccagauguagucaaguugacaaccaggaauagccaucacaaugacuaaggcaacuuuuugaaacaaaagcauuuaauugggggcuuacuuacaguuccauugguuuaguccauuaugaucauggcaggugucaucauggcauguagcauaguggcacacucaaugcuggagcaguagcggaaagucacauccugauccacagacugagagugaaccuggcucuggcaugggcuuuugaaaccucaaagcauaauaguuccuguaacacacuuucuaugacaaguccauaccuccuaauccuucaaauccuuucaaugacuaccauucccuuggugauuaagcauucaaacuuaugccacagcuuccaucauaauaguuauaagaucuuaagaacuucaacaucuaugaucguuacugugauugucuuuaucuccucuuccucuuuauucauuuccucuacuguccucccuuuucuaucuuuaagucauuuaauuacauccaucuauuugcuaguucuuucucuguaacccguguguguguguguguguguguguguguguguguguguguguguaaaaucagagaacaaccuguggaaauugguucucuccuuuuaccauaugcgacccaaggaauugaacucaggucacugagucaucucacuagucccuccuuuucuauuuuuguuuuauuuugaggcaguaucucucuguuuagcacacggugcuaauucuaauuucuaauucuccugcuuuauccuaacaggaacugugaaugcugggauuauaggcagagaaucaccaugcaguccaccuuuuauuuuuauuagaguaaugacagucuuuuacaagacagauaaauuguucuuuucacuuaagucucugcuuuccuccagagcaaaaacugucuuuuuauuuuaagucuuugcuaccuaggaauguauuucucaucauaguaggcauucagaauaugaaguucuauaaaagugaaaaguuuggcuagccucuuauuccucccacuuuauucuuuacuauguugagggcggacagggagaaaggguguuuucucuuaaguuacucagaaggcuccuucuccuuaaugcaaaagcaggccugggguugaggcacugagaacuaguugcuaaggauaugagcucaaauuuucuuuccuuuccuccucucuccucuccuccucucaccuuaaccuugauuucuauuuuuggguaugaaugcucugccuacccaaugucugugugucauuuguauccagugccuguagagacuggaagaugcuaucccauccccuaggacuggagguacugguggugugagcugccaugugggugcugagaauugaacucuaguccucuuaaccacugaaccauuucuccagccccucaauauuuucuuuauauuaauaguaauguaguaaaaaguuacuugagcuuuuguauugccgccuucacuaguauaacgaacacaguuuuggauguuuauuagcauacccacugauuaaaaaaaauguuaguucuuuuaaaauuauauuuacucugugcaugugugcacaaguaugcuucaacauacauguaaauuucagagacagcuagccugacaccaaaugaguuucacagauugaacucagguugagagauuuaguggcaaccuacccucccccaugagcaucugaugauaggucuugaaagaagguuuucuguuuaaaacauuugcuuuacuuugauaaaaagcuuuauagaauucccuuugggaauuaauguccauuguugucuuuuuaaaagcuacuguaaacaaccaccaaacccagacacuauugcauaugccagcaagauuuuugcugacaagacccugauauagcugucucuugugaggcuaugccugugccuggcaaacacagaaguggaugcucacagucaucuauuggauggaacacagggcccccaauagaggagcuagagaaaguacccaaggagccaaaggggucugcaacucuauaggaggaacaacaauaugaacuaaccagugccccucagaacugugucucuaguugcauuuguagcagaggauggccuagucagccaucaaugggaggagaugcccuugguauugcaaagaucauaugccucaguacaagggaaugcuaaggccaggaagcugccaggaagcgggaguggguggguuggggaguagggcgaggggaggguauaaggaacuuuugggauagcauuugaaauguaaaugaagaaacuaucuaauaaauaaaaaaauaaaagcuacuauaauacuaacuaaauauacuauguauauuuagaguauauugcuuuauagaagcuauaagaaauaugcaagugucuauuaaaauaccuauuucacugauuuuguaugucuugauguaaguauucauaauguuugcaccuuuuauuuuuaggaauaagaaaauuuuaaauaagaagaaauugaagcgaaaacagaaaagcaaaucaaaaguaaagacaagaagcaagguaaaguugcuagcaacuuguugacauaguaauugaagcaaaaguaaaaagaaaaacuaaacauaggacuauaacuagcaaaucauucugcccugugugcucgagucauuuuguagaugccuguuuuuaaaaguauuuugaaaauuuuaaacaugucuacaguguguuuugaucuuaucuauuuauacaaccaccauccaguuauuccgaagacccaacaacccuaucuauuugcauucuucuacaugucggaauacuguuagacuacuaccauuuguugaaggugcuuucuuuuuuccacuguauauuucuagcuucuuuauccaaagguauccauagguguguggauuuacuucugguucuuugauuugauuccguugaucaaccugucuguuuuuaugccaauacagugugguuguuacuauaauaguacaguagaauagcuugaaaucagggaugaugauaccucuacaaguucuuuuguuuuucagaauuguuucacuuaccaggugguugguugguugcuuuuuuuuuuuuuuuuuuuuuaaugaaguugaauauugcccuaucaaggucuauaaagaauuguguggaauuuugauggggauuguguuaaauguguagauugcuuuugguaagauggccacuuuuacuauauuaauucuacugagcaugggagauuuuuuacaucuuuugguaccuuuucaagcuucuuucuucaaagacuuggaaguucuugucauauagcucuuucacuuguuuaguuagaguuauaaugcgacauuuuauauuauuugugauuguuauaaaggguguuguuuccuugguguucuucccucaguccacuugucauuuauaggagggccaccucacuggcaguguuuaucagguauaggaguucauugguagagcuuuuggggacacuuauccauacuaucauaucaucugugaguagggauacuuugauuucuuccuuuccaauuuguucuagcuauaauuucaguacuauauugaagaaauaugaagagagugggcagccuugucuuguuccugauuuuagugcaauugcuuugaguuucacuacauuuaauuuguuguuggcuguuggcuugcuguaaacugccuuuauuguuuaggcauguaccuuauauauauuccugauauuuccuagacuuuuaucaugaacugguguugaauuuugucaaaggcuuuuucacaucuaaugagaugauugugccuuuuuuuucuuucagcuuguuuauaugguagauuacacugacagguuuuuuuguauguugaaccaucccugcaucgcugagauuaaaccuacuugaucaugguggaugaucuuuuugauguauucuuggauuugguuugaguauucuuugcaucuauauucauaucggaaauugguuuguaauucucuuuguugaaucuuugugugguuugaguaucagaguaacugaggccuaauaaaaugacuuuggcaguguuuuucuguuucuguuuuguggaauaauuugagggguauuggauuuagcucuuccuuggaagucugguagaauucagacuuuuagugcuaaauccaucuggcccuugguagguagguagguagguauauauguauugguuaggagacuuuaaugacugcuucuauuuucuuagggguuuuaggucuauuuaaauuguuuaucugaacuggauuuaacuuucauacgugguaucuauagaaaauuauuuagaaaucuuuuagaaaauuucuuuuagauuuuuccaguuuuguggacuacauguuuuuaaaacaugaacuaaugauucuuuugauguccucagucucuguuuucauuucugauuuuacuaguuuggauauuaucucccaaucuuuuaguuaguuuggauaaagauuuguuuaucuugguuuuuguuguuguuuuguuuuguuuuuucaaaaaaaccuuuguuucauugauucuuugaauugauuuauuuguuucuguuuuauugauuucaguccuuaguuuuauuauuucuucuaucuacucuuggguaugcuagcuucauuuuuuuuuuuuccucgagcuuucagguguacauuaaguuacuaauauaaguucauuccuuuucuuuuuucuuuuuucuuuuaauguaggcauuuagugcugugaccuuuccucuuaucauggcuuucauugugucccauaagucuggguauguuguauguucauuuucauugaauucuagaaagucuugaauuguuuauuucuauccuggcuuguuuuucauucaguagaaacguacaauuuucaugaguuuguauaacuuuucugcuguuucuguuguuguugacauccagcuuuaaucuguaguguucugauagaauggagggggcuauuucaauuuucucaucuguugagacuugcuuuaugaccgaguauguggucaguuuugggggugaggugcagagaagaaggucucuuuuucuuugaguuucuuccuugugguugagugaagugcucuguagauagcuuguagguccauuugguuuauaaugucuguuaguuccagcauuucucuauuuagguuuuugucugggugaccuaucuauuagugugaaugugcuaguaaagucucucucacuaucagcgugugaggggcaauaugugguuuaagcugugguaguguuucuuuuacaaacuuugaugcccuuguuuuagaaaauuagauguuaagaauugaaaugucaucuuggugggguuucccuugauaaauguguaguguccuuccacauuucuuuuauuuaguuuuuguuggaagucuguuuuguuagauauuaaaauggcuacacuagcuugcuucuuaggucaagcuggaguaucuugcuuggaguaucuuuuuccauccuuuacccucaaugauauauauauauccuugauguugagguguguucuugaaugcagcagaagaauggauccuguuuucauauauaggcuuugucuuuuuuauugggaaauuaagaucauugauguugagcaauaucaaugauuguugauuccuguuacugugguaaugguaguggugauggugguguguguguauucuucuuuugauuuugcuggugugaguuuauguuuuucuggguauaguuagccuucuuaguuuagaguuuuucuuuuagcaccuucuuuaggacuagguuuguagauagauacuguuuaaauuugucuuuaucauguaauaucuuauuuucaucuauggugauugauaguuuugcuggguauaauagucuuggcuguuuucaauggccucauagagucuguagcacaucuauccaugaccuuccagcuuuuagagucucuguugagaagucagguguaauucugauaggucugccuuuauauaucaguagcucuuuuuccauugcagcuuuuccuuuucuuucuuuuucccguacguuuaauguuuugacuauuguaagcggacuuucuuucuugguucaaucuauuugguguuuuguaugcucuacuaccuuuauaggcauaugcuucuuuagguuaggauaauuuucuuccaugauuuuguuggauaucauuuuucugggacuuugagcugggauucuucuuuuauuucuauucuuagguuucgucuuuucauagugucccagauuuccuggauguuuugugucaggaauuuuuuagguuuaauauuuucuuugaccaaugcauccauuucuucuaucaucucuuuaaugccugcaauuuucucuaccauuucuuauauucucuuguugaagcuugccucuguaguucuuauuugaauaccuagauuuuucauuucuagaauuuccuguuuguuuuucuuuauugcuucuuggguuuucuuagguuucuuuaagggauuuauuuauuucuacaauuguuuguuuguguuuuccuguauuucuuuaagggauuuauucaucuccucuuuaaggaccuuuaucaucuucauauaguuauuuuaagguauuuuucuuguacuucagcuauguuguaauauucagggccuacuuugguaggauagcugggcucuaguggagacauguugcccuggcuguuguuguccagcuguccagcuauuuacugaccaaaccaucuccucagaccuugguuucuuaagauuuauauaugcuuauuagugugcaucuaauucugugugauaugacugccucugugacuuaucauugucaggaugcggaacaguuucaucuuaggauugcugcccuuuuaccacccucauagccauucacgucauuucucucuuugguuggugguuuagucccugggagcucugggggugggguggaggucugauugauugauauuguuguucuuacugugggguuacaaaccacuucagcuccuucaguccuuuuucuaacuccccuauuggggaucucagcucaguccaauggguggcugcgagcauccaccucuguauuugucaggcucuagcagagucgcucaagagacagcuauaucaggcucaugucagcaagcacuucuuggcauccacccuagugucuggguuuggucacuguaugugggauggauccccagguggggcagucucugcauggccuuuccuucggucucugcuccacacuuugucuccauauuuccucccuugaguauuuuguucccccuucuaagaaggauugaagcauccacacuuuggucugacuuccuuuugagguucacguggccugugaguuauaucuuggguauucugagcuuuugcgcuaauauccacuuaucagugaguggaaaccuugaguuuucuuuuguaacuggguuaccuugcucaggaugauauuuucuaauuucacccauuugccuaagaauuucaugaauuuguuguuuuuaauagccaaauaguacucuacugcguaaauguaccacauuuucuguauccauuccucuguugagagacaucuggguucuuuccagcuucuggcuauuauaaauaaggcugcuaugaacauaguggagcauguguucuuauuacauauuggagcaucuucuggguauaugcccaggagugguauugcuggguccucagauaguacuauauccaguuuucugaggaaccgccauacugauuuccagaguggcuguacaagcuugcaaucccaccaacaauggaggaguguuccucuuucuccacauccuugccagcauuugcugucaccugaguuuuugaucuuagccauucugacuggugugagguggaaucucagggauguuuugauuugcauuucccugaugacuaaggauguugaacauuuuuuuuggugcuucucagcacuuccaguuuucucauuacuauugugaacuucuguucacaagaauuuuauugaaaaaaaaauuuuuuuucgguuuuucaagacaggguuucucuguauagcccuggcuguccuggaacucacuuuguagaacaggcugccaggcuggccuagaacucagaaguccaccugccucugccucccaagugcugggaucaaaggugugcaccaccacaccuggcauuauugaauauuuuugcaucaauauucauaagugaaauuggucugaaguucucuuucuuuguuugggacuuugugugguuuagguaugaguguaauugugucuuaauagaacgaauuggguagugcuccuucuguuucuguuuuauggacuaguuuaaagauuauggcauuagguuuuauuugaaggucugauagaauucugcacuaaacccaucugguccugggcucuuuuugguugggagacuuuaaauacugcuucuguuucuuuagggguuauggaacuguuuagauguuuuaucugauccugauuuaacuuugguaccugguaucugauuagaaaauuguccauuuuauccagauuuuccaguuuuguuaaguauaagcuuuuguaguuggaucugaugaauuuuauaauuuucucaguuucuacuguuaugucucccuuuucauuuguaauucgguuaauuuugauacugucucugugccuucuuguuagucugacuaaggguuuaacuaucuuguggauuuucucaaagaaucagcuccugguuuuguugauuauuuauauaguucuuuuuguuuccacuugguugauuucagccuugaguuugauuauuuccugccuacuuggguguauuugcuucuuuuuguucuagagcuuucaagugugcugucaaguaguauauguucucucuaguuucuuuuucauggcacucagaccuaugaguuuuccuuuuagcacugcuuucauugugucccauaaauauggguauguugugccuucauuuuccuuaaaucuuagaaagucuuuaauuucuuuguuuauuucuuccuugaccaaguuaucauuguguagaacauuguucagcuuccauguguaugugggcguucuguuuuguuuguuuguuuguuuguuuuguaauugaagaccagccuuagucugugauuaucugauaggauucaugggauuaucuguugaggcuuguuuugugacugauuauaugguaacaaauuuuggaaaagguacuaugagguguugagaagaagguauauucuuucauuuuaggauaaaauguucuauagguaucuguuaaauccauuugguucauaacuucuguuaguuucacugugucucuguuuaguuucuguuuccaugaucuguccauugauuagaaugggguguugaagucucccacuauuauuuugugaggugcaaugugugcuuugagcuuuaguaaaguuccuuuugugaauuuggaugcccuugcauucggagcauagauguuuagaauugagaguccaucuugguagguuuuucuuuugaugaguaugaaguguucuuucuuaucuuuuuugguaacuugugguugaagguugcuuuuauucaauauuagaauggcuucuccagcuuguuucuugggaccauuugcuuggaauuuuuuuuuuccagccuuucagucugaguuagcaucugucuuugucacucaggugcguuuucuguaugugucaaaaugcuggguucuguuuacauauccagucuguuagucuaugucuuuuuauugaagaacugaguccauugauauuaagagauauuaaggagaugugauuguugcuuccuauuauuuuuguuguuagagguggaauuauguguguguggcuaucuucuuuuggguuuguugaaaaaagauuacuuucuugcuuuuuccaggguguaguuucccucauuguguugguguuuucuaucuauuauucuuuguagagcuggauuuguggaaagauauuggguaaguuuguuuuuuucauagaauaucuugguuucuccaucuacguuaauugagaguuuugcugggaauaguaaccugggcuggcauuuguguucuuuuagggucuguauaacaucugcccuggaucuucugucuuuuagagucucuggugagaagucuuguguaauucugauaggucugccuuuauauguuacuugaccuuuuucccuuacugcuuucaauauucuuucuuuguuuugugcauuugguguuuugauuauuaugugacaggaggaauuucucuucugguucagucuguuugaaguucuguaggcuucuuguauguucaugagcaucucuuucuuuagauuagggaaguuuucuucuauaguuuuguugaagauauuuacuggcccuuuaaguuggaaaucuuuauucucaucuacuccuauuauccuuagguuugguuuucucauuguguccuggauuuucuggauguuuugaguuaggagcuuuuugcauuucacauuuacuucgacugcugugucaauguuugcuugcaucugugacuccuaaccuauuuucuagauuuucuaucuccaggguugucuccguuugugauuucuuuauuauuucuauuuccauuuuuagauccuugaugguuuuguucaauuucuucaccuauuugguuguguucuccuguaauucuuuaagggauguuuguguuuucucuuuaaagguaucuaccuguuuaccuguguucuccuguauuucuuuaagagaguuauuuauguccuucuuaaaguccucuaucaucuuaaugagacgugauuuuuaaaucugaaucuugcuuuucugguguguuggaguacccaggacuugcuguagugggagaacuggguucugaugaugccaaguagccuugguuucuguugcuuagguucuugugcuugccccucgccaucugguucucucuaguguuaguuggucuugcugucucccuccugugagucugugagccugugauguuagaugugucagcacuccugggaaaccaggucucucagggugggauuuggguccagagagcugucccacagggauaacuccagggugcagauggagaccagaagaauccugucuccaguugcuccaugguucuugaucccuguggucuccaggcagaucccucuuuggccaguuauuggagcaaaaguguuuguaucaccuguuaacuugguagugaugggugagauuugggucuggagagcugugccacaggguuaauuccagggcacagauagauacuagaaggcaugaugaguuucagugcaguuucaaugaugaaaauaccauuaaaacuauuccauugcucaucauauuccaaaugacagcaccacugaagcugaugauuaguuucuucagguucugaaguucaguccauuaucaucaaggcuggagcacagcagcauccaggcaggcauggugcaggaggaacugagaguucuacauccucaccugaaggcugcuagcagaaucuaauagauucucaauauacuuauguugucuauuuuuuaguauuuugaaagguauauuuacaaguuacaugacgauuuaacuguaacauauuucuuauuuaaagaaauauagucuuuugcccuuccucaauacuuuauagaagaggcauuuucuuccuguuuuugguacaugaaauauaauaaauacuguguuuuuauaugcaaguuaguuuaaacugucuauacuuuuauguacaaugaaaugauaauuacaaagaauguaaaccagaaauguuuuguuuuauauuucagucugaaaauguggagaauacaguaauuauaccagauaucaaacuacauagcaaucccucugccuucaacauuuacuguaacgugcggcauugcguuuuggaauggcagaaaaaggaaacaucacuggcagcugcaucgaaaaacucaguacagaguggagagucagacagugaugaggaagaggaguccagagagcccccaaucaagcugccaaagguaagccacagaauucuacuuauaugcauugccuacuaguggucugguuaccauacaugcccacacauuccugagauacccugcuuuuucuaaaauacugcauuaaaauaacauggguuauggauaaaaauagguuugguuugggguagaccaggaaaauucaaugggauuuuuaaacuggcuaacaaagccaguaauucggaacacagcaggaugagcaucagaaacacaggcagcaaggucaguggguuguaccuuguuaagggcuguuagugugcaaaagcaguagcauggaucugcuuggguggaggccuucaacaguagcagagggaagaucagcucugagcuggugaacuuccauuaaggucagcauaaagaggacaugauucagaguaagcccuggaaacagguagauauuuacagucuucuugaaauagaagugaaaaacuuccuuaacagcaacuaaacugaaagcuuuuaucugcuuacuguuuagcugucuucuuaauauucugcuuaccuggcuuacgaaaaaauaagaugagaaacaguccagucuauacuauucugacauuacuuccuauuuccagaagcauauaaucuauuucauauuauaacuggacaaacuauucuuaaaguacuuuguucuaaggauugguuuacuuugagauuaauuuuaucacacaucauguuuacauauauacauauauacauacguacauacaggagacguagucuuucuuuuccucccuuuguccuucuccucuguuucuguuuguuuucuucuuucauagcaaugagguccuuauaauccaacgcaagugcuguucguggguugcaucacuagccuugggguuaguauaugcuccaaaggacaaagggaaaacacgaucaucucaaaaugauuaugugugauucaugcacacuguuuucuaauaaauaaacuuaaacgugauuccuuuaucaaaaugacucauauaaaauuaaauugguguguuaaauucaucugguaaacuuacuuacaaggaaucuuauagauaguuuuguacaugaaguaccuuacuugaguuauggcgacagguggaacucauguuccugggcugauuucucuuucacggucugcgguggcuguuccuaaguaugcacuguccuugacuguacuguuggguucaucuccucuuaucucagagaugacuugguuucuauuucauaagugaagggcaugacauuuuuaugaccguccuugcuuccugaccagcauuuucagagugugugucuucuguccuuuccccuuuccucuggugucuaacugccccugcucuucuagucuccucuuauaaacuaaaaugagugugcugucuuuucccuccugaagguguagcucauggucucuucauugugauuucuuccacuuaauuaggaaaguuggggggaaaaaaaaaggauaaccccuggagaauuugugucguacacuuuuuguaagaauauugcacuauugggggcaggucauacugcacugaauuaaucauggugaauaaauuuaguauuggggggggggaaucagaaguucaaagaaaucuuuuauacagggacauaaaaccaaaacuagauuacaaaacacuuaggaaaauuuaauuauuauacuacuuuaaaacauuagaguagcccucgccaccuugggcacgaacucugcggauggucccaagguccccagaggaugcuccaugccgcaggggcccuagcacacccaggaucuuaggauuacugaggagaaucggccuccagagagagcucugacucuggaacucaggugagagcuccaucuuguauccugcuuaucucagaaaccaauccaugcagaagcagcagagcuucuuggacagggucucuuuaggucuucauuuuucagccaggagguagagcugagacccagaccucugggcaccuucccugccagaggagaguccgccuccugggagggcucugaccccagaacucauaugagauugccaucuuguauuccgggucucucagagaccagacugcacaggagagcacaugggccacagaagcauuagagcuucucggacagggucccuucgggccuucaucuuuagccaagagguggaucugagcuccagacaucugugcaccuucccugaaagaggaaagcuuaccugcagagugcucugaccacugggacugaggagagaguuggacucccaggagugcugacagaggcuaacagaaucagaggaggaacaagcuccaaccagagacagcuagaacagcuaacaccagagauuaccagauggcgaaaggcaaauguaagaaucuuacuaacagaaaccaagaccauucggcaucaucagaacccaguaugcccaccacagugaguucuggauaccccaacacacccaaaaagcaagauuugguuuaaaaucauaucucaugaugcugguagaggauuuuuaaaagggcauuaauaacucacuuaaagaaauauaggagaacacugcuaaacagguagaagcccuuaaagaggaagcacaaaaaucccucaaaggacuacaggaaaacacugcuaaacagguagaagaccuuaaagaagaaaacaaaaaaucccuuaaagaauuacaggaaaacacaaccaaacaggugauggaauugaacaaaaccauccaagaucuaaaaauggaaguagaagcaauaaagaaaacccaaagggagacaacucugaugauagaaauccugggaaauaaaucagaaaccauagaugcgagcaucagcaacagaauacaagagauggaagagagaaucucaggugcagaagauuccauagaaaacauggacacaacaaucaaagaaaacgcaaaaugcaaaaagauccuaacucaaaacauccaggaaaucuaggacacaaugagaagaccaaaccuaaggauaauagguauagaugagaaugaagauuuucaaauuaaagggccagcaaauaucuucaacaaaauuauagaaaacuucccuaaccugaagaaauagaugcccaugaacacacaagaagccuacagaacuacaaauagacuggaccagaaaagaaauuccuccugauacauaauaaucagaacaucaaaugcacuaaauaaagauagaauauuaaaagcaguaagggaaaaaggucaaguaacauauaaaggcagaccuaucagaauuacaccagacuucucaccagaaacuaugaaagccagaagauccuggacagauguuauacagacccuacaagaacacaagugccagcccaggcugcuauacccagcaaaacuuucaauuaccacagauggagaagccaaaguauuccaugacaaaaccaaauucacacaauaucuuucuacgaauccagcccuucaaaggauaauaaagguagaacuccagcacaaggagggaaauuaugcccuagaaaaagcaagaaaguaauccuucaacaaacguaaaagaagacagccacaagaacagaaugccaacauuaacaacaaaaauaacaggaagcaacaauuacuuuuccuuaauaucucuuaauauuaauggacucaauuccccaagaaaaagacauagacuaacagauuggcuccauaaacaggacccaacauuuuccuacauacaggaaacccaccucagagacaaagacagacauuaccucagagucaaaggcuggaaaacaauuuuccaagcaucaguucaaagaaacaaacuggaguagccauuuuaauaucgaauaaaaucaaauuccaacccaaaguugucaaaaaagacagggagggccacuucauacucaucaaagguaaaaucuuccaagaugacuucucaauucugaauaucuaugcuccaaaugaaagggcauccacauucauuaaggaaacuaguagagcucaagccacacauugcaccucacacaauaauaaugggagacuucaacaucccacucucuccaauggacagauccuggaaauggaaacuaaacagagacacauuggaacuaacagaaguuaugaaagaaauggaauuaacagauaucuacauuuuauuaacagauauaacauuuuauccuacaacaaaaggauauaccuucuucucagcaccucauaguaccuucuccaaacuugaccauauaauuguucacaaaacaggccucaacagauauaaaauuauuguaauugucccaugcauccuaucagaucaccauggacuaaugcugaucuucaauaacaacauaaauaauagaaagccaacauucacguggcagcugaacaacacucuacucaaugauaaauuggucaaggaagaaauaaagaaaacauuaaagacuuuuuagaguuuaaugaaaaugaagccauaacacacccaaacuuaugggacacaaugaaagcauuucuaagaggaaaacucauagcucugagugccaugaaaaagaaacuagagagugcauacacuagcagcuugacagcacaucuaaaagcucuagaacaaaaagaagaaaauucacccaagaggaguagagugcaggaaauaaucaaacuuagggcugaaaucaaccaagaagaaacaaaaagaacuauacaaagaaucaaccaaaccaggaacugguucuuugagaaaaucaacaagauagauaagcccuuagccagacuaacuagagggcccaggggcaauauccuaauuaacaaaaaucagaaaugaaaaaggagacauaacaacaucacccgaggaaauccaaaaucaucagauccuacuacaaaaggcuauacucaacaaaacuggaaaaucuggaugaaauggacauuucuuagacagauaccagguaccaaagucaaaucaggaucagauuaaugaucuaaacagucccauuuccuguaaagaaauagaaguagucauuaauggucucccaaccaaaaaaacccaagaccagauggguuuagaucagaguucuaucagaccuucaaagaagaccuauuuccaauucuccucaaacgauuccacaaaauagaaacagaagguacuguucccaguuuauucuaugaagccacaauuacucugauaccuaaaccacaaaaagacccaacaaagaaagagaacuucagaccaauuugccuuaugaauaucaauguaaaaauagucaauaaaauucuugcaaacugaauggaagaacacaucaaaacgaucauccagcccggcaugguggcgcacgccuuuaaucccagcacucgggaggcagaggcagguggauuucugaguucgaggccagccuggucuacagagugaguuccaggacagccagggcuacacagagaaacccugucucgaaaaaacaaaacaaaacaaaaacaacaaaaaaagaucauccaucaugaucaaguaggcuucaucccauggaugcagggaugguuuaauauacagaaauccaucaacguaauccacuauauacacaaacucaaagagaaaaaacaaaugaucaucucauuagaugcugagaaagcauuugacaaaauccaacaccccuucaugauaaaagucuuggaaaguucaggaauucaaggcccaugaacucugcagagauacuuaccugaauauaguccuuuuguuuaaaaucuuaaguguuuucuguagaagacaacagcuggcauaugaaacuuucuguguucuaacuucugccaucucugaccuuaucuuaguuagugcuauguucucuuccccaugagcucuauuuauucuacuauaucuagcacaguguaaauuuuaagucauuaggcaaguuauuuauugauuugguuuuguuucuauuaaaaaaugcuuucuugaaggaagggaauauaucucaacugcuuuuuuuucuuguacccuaaugcacugcuaccuacaaauucagaaagaauuuacuuacuuaagaaccaaauaaauuagucaacauaaaaguauauuuuaaaauaaaauaugcagcaagaugaguuucaagcaucgugagaugggaagcaugaaucccagaaaaaaauuacauagcucuuccuguauuaaaacaggaaacaucauauaaaugaacauccagaacugcccgcucugaagaauuaugaacaguccuuauuguuuauauagaguaagcagccccacauacucgaaucucauagucuuccuuugcuugagaaaagacauacaaauuuuguacuuaacauuuugauuuccucuaaguacagagguagauagaaaucuuagcacauuuuuauuuuuuaaguccauuccaucaacaaaaacuaaaacaggugaaaaaaauuauaggaauguuuaaugaauugaaauucugugcacaaacuuaacuauagucaagaguaggauuuuagauaacuucuguaaagaugaucauauugguuauuuugaccucuuauuuauauacacaugagaaacuauaaaugacagcuagaacagcagaauuugucuacaguuaauuucaucuuugucuaagaaaaccaguuguguuucagaauuguaauuuucaguacacaaaugaguagcuaguuagaugaauauucauuaauugugauuccacauuuaccaaacacugacuuaaaaugggaaauguuucuuguccauagagggauaguuugguuaggaaguaaaaaugaauauacucaguuauacuauaauauauaacuaauauauauauauaauacaauuauaauauauauaauauaauauauaacagaaauuuguuuggggaaagaguuaugcacauagcucacuuauccuccacauuacgaacucucacaagacaggguccagcauaucuuuauaucuccucuagugaguugcauaaaacaaguauuuagaagggugcaguuauaguguauaauaucugcaucacauacaguauaauguaauaaucucaacagaaagaauauuaucucacuaauuuuuucuuagaauuauuguuugaaguguuucuacaauuuggccuuauuuuaauuccuuuuuagauuuauuuauuuauacuguugcucucuucagacacacuagaagagggcauucccauuacagguguuuguaagccaccaugugguugcugggaauugaacucaggaccucuagaagaacagucagucuucuuaacggcugagccaucucucaagccccuuauuuuaauucuucaugucacuucugcucauaauuuacauccuaaagcuauauaucugauucucaaaauugauguuggcugagaaauagaaucuuauuuucuaguguuuuauuaacuauuggucuuccaaaauuauagcagcucauuguaacuuugcucuuacagucuaaaaagauauaguucuuuugcuaaagauagucagggguuucuuggcccaaugaggaugauucugauuaaauuaaaauaccggugguauuugacugagccaguuuuagcuccuuuaaugaucaucuuggccaaaugaaggggacacuaccuauaaaugcuaacauugcaauuauacaaucacaggaauggcaaaggugaaaucaguuuucaaaguugccuuugcuauaucuguuguugucuuuauuuuaguuugugaguacuguaauaaagcuacuugcguacaaccaaaugcacuauauaaauuaacagaguccauuucuucugagugaaugccaucugccccugaguuuaguuaagguuucauucaacaacccuugcuguggcuucauuguuuccaaacuaaucuuuaagcaaugcaacuaguucuuaaacuuguauauuggucccuggcuuucaaaaucuucauguuaaauaaauaaaaauaaguaguuuuuuuuucuuuucuguuuagacaacauggcacuuuaguauugagauaauguacacaccagaguauagaaagugucauuuccuuacacauucggaggccuaacuuucuuuucauauuaaacagauuauugagguugggcuuugugaagucuuugaauugaucaaggagacucgguuuucucauccaucccuguguuuaagaagccuccaagcccugcugaaugugcuucaaggccagcagccagaaggccuccagucagagccgccagaaguccuagguaagauuaugcuuagagugaagccugugaaggcgaaccacgucuccagugcacauacacaagugcaggaagugcagucugcacucacugcacagggaaagcaggaauguaacuuugcugcguuuuacuggagauagagucuaaagaguuaugguucauguacaguuguuucuugguuguuguaacaauaggagagcaacaacacauaaguccuugaaaucccagaauaacacccaaacccuaaaaucccaaugaaccugaauaccuguggccaguagcaaauaugcaucuucucuacuuuuuacucuugggcaguggcccucagccugugggucaacagccccuuuugaggucgacccacccuuucauagggguugccuaagaccauggaaaacacagauauuuacuuuacaauucaugacagucauaaaauuacaguuaugaaguagcaaucaaaguaacuuugugauugguugucaccacggcaugaggaacucuauuaaagugucacagcacugggaagguggagcagaagcuccagacaguuuaaaccagcaagggggggggggggagaaacaagugucacacaccucaaguguacaacuguuucucaagagaggacauuucuuuguauacaucauaaacggcaacaaaaaauuguguuggggagaaagggucuuuagcaugauucauugcauacagauauuggcuuuucuucaaguauuuauuuuuagcguugcuugcuuuuaauauuaauaacuuaggcugauaaaugauggugcuugaugaguugugguucuaaagguaccaaacgggggagccaaaguuuuccaacugcuggauacuuuugacaaggaaaaucuaguuuugucuuccgaucugcauugaugaccuaggccagguaaauaagccugguuuauuucuguaacauuuuaugcagacagucuguuauauacugugguuucagaugugcaauaauuuguacaauacuuuauucccaaguaugccuuuaagcagaacaaauguguuuuucuauauaguuccuugccuuaauaaauauguaauauaaauuuaagcaaacuucuauuuuguauauuuguaaacuacaaaguaaaaaaaaaaaugaacauuuuguggaguuuguauuuuucauacucaaggugagaaauaaguuuuaaauaaaccuauauauuuuaucugaagaaaaaaaaaacuuaggcugaacauagaaccacguaaggaaaacaggagcuugcugcagugugauggaaauggaggugaugcauacguuuuaguuggcuuauuguuuuucucugaugauaaccauggauauucugucagccugcaauuuucuagauuguuuuaacaauaugguaaaauauccucaaagccauagcgauaugauucucaaacauuagccuguaucugagucaucugugacccaggugucaaguuuuucauuuaguaguuuuaagcuggaccaaacauugauauuuugaauaaaauuuuggacuauacugcagcugguggccugggaacacuguugauugaauuagauucugauucuguguucucuguaucuggcuucacuucauuuuucuuuugccuuaaaguguuuuuucugaaacaaagccuugcuuuguagcccaggcuggucuugaacuuuauucuuccugcccugguuucccaaguaguagggcuaauuaauauauauguacaacuaugcccuaccuauuugaauuuuuuuuagauccacauuuuuagaaccuaauuaugugccagaucuuucuuucuuuggucaaauauagugaucuaguuuuuauguuuaccuugucuuauuggaggaguugucugguucuugcucccaggcccauguucccagaaauaagauguagguucaaaauauauuuauaaguaacuuggccauguagcuaugcuccuaucugacuggaucauaacuuaauauaacccauuuauucuaccuacacucugccaugugcuugcuuaggugccaugugucugucuucaucucuugagcuuggcagucucagaauucuuucugccuccuggaugucccaccuucuauucucuccuuuccuguaaguuauaggucuuuuuaauggacaggugauguaucauacaauacacaagauauucucucuacagaggaaagauaugcggagaacuuuaaagacagccuauaucucagccccuggcccaaggcacuuaauugcgucuuccaaacaaaagguaguccagguuaaggauuagucaauuugcugguucuugauacaguagcaccaauaauccuauuaauagugugauaugugacucaacagcauuauuuugaaauuuuuacucauuuuauauaggagcugauuuuuguuugagcucugcuaugguuaauaaagcauauuucucuaacuuuauagccugguuuuucacuuugaaacuugugcaucuucuacuauucuguuuccucuguacuuucccuuacauucauacuuuacauaaauauuuccuuuuaaaaauguaucuuguucuaaauauuagucuuugaacauguuuucacuuaauuauuuucuaucaacaauuuaauuuuaugaaguugccuaucuuuuucuuaggcguuugaaauaccauuauucuguguguuuggugucuugccuuauuuucaggguuaacuucugcugguuuuacuucugggauuggcuuuucuguauaaggguuuuauugucauuucccauuucagauuugcuuaguuacugcaaacuuacguugauauugccuggucuuuccccuuuguucaguccauauccccuuagcugccuucucucaccagcuguuucccagcucacucaugaacauuuacagcacaacuguuacuguuacaauacccuuggauggggacagauaacugaagagaaguucuuacgaucugaauaugacuaguggacagaaggaagggaagaagagggugcgaauauguggaacugucuagacauguucauaagguuuguuucagugcuagggaguagugaaaggcacucucuacuucauuuuaccaaauaaaaaacauuuuuuuauagaaaauaugcaaagauggcuaucuuugcacagagggucagaauuuaguuuccaaaccucauaggaggcauuugacagccucuaguaaucccaguucuagagggucaagugcuuucuucuggccuucuuggguuucuaaacucagaugugcauauccacauacagauacucgcacacacauacguaaacauaaaauaaucuuuaaaaauacuuuaucuugggcugguaagauagcucaguggguagagaucuugccacgcuaaccuggaaagcccaaguuagaccuccaggacuacagagaaggcaauuacugauuccaaaagguugucuucucucuccacaugcacaccauggcaugcauaugcacacauguguacacauguacacauguacguuuuuaaaacuagagaggaaaauguuuuguuuuuuuguuuuuuuuuccauuuucuauuagguauuuagcucauuuacauuuccaaugcuauaccaaaagucccccauacccacccacccccacuucccuacccacccacuuccccuuuuuggcccuggcguuccccuguacuggggcauauaaaguuugcguguccaaugggccucccuuuccagugauggccgacuaggccaucuuuugauacauaugcagcuagagacaagagcuccgggguacugguuaguucauaauguuguuccaccuauaggguugcagaucccuuuagcuccuuggguacuuucucuaccuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaagaggggcauaguguccacacuucagucuucauuugucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuuuauaaauucauucuuuuuaauagcugaguaguacuccauuguguagauguaccacauuuucuguauccauuccucuguugaggggcaucuagguucuuuccagcuucugacuauuauaaauaaggcugcuaugaacauaguggagcauguguccuucuuaccgguugggacaucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacaccagcaucugcugucaccugaauuuuugaucuuagccauucugacugguaugagguggaaucucaguguuguuuugauuugcauuucccugaugacuaaggauguugaacauuuuuucaggugcuucucugccauucgguauuccuuaggugagaauucuuuguucaguucugagccccauuuuuaaugggguuauuugauuuucugaaguccacuuucuugaguucuuuauauauguuggauauuaguccccuaucugauuuaggauagguaaagauccuuucccaaucuguugguggucuuuuugucuuauugauggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuaugaguuucagugucucugguuuuaugugaacuuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguuuggguucauuucugggucuucaauucuguuccauuggucuacuggucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauggaguuggaauuuugauggggauugcauugaaucuguagauuccuuuuggcaagauagccauuuuuacaauguugauccugcuaauccaugagcaugggagaucuuuccaucuucugagaucuucuuuaauuucuuucuucagagacuugaaguuuuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccgaagcuguugaggaaaauguuuuauaucaagaaauuuauuagguaaaauuauuuauuuaaauuguuaacuuuaauuucuuucaucuuaaaacguuuuaaggaaaaagacauuguucccuuugcuugccaguaaaccauuccaacuuagagugcuuccauaugcaggaagacuucagugguuggugacugacugaaagaaagacugcacagcugaggcacaaagacuagcgggagaugugcagaucaggggcagauuaaagaagauaaagaagaaaugacaauagaugggaaagacaagucaaaagaaacgggaaaccaaagagaucucaaaggagaggaaggaaggaagacagaauuaaugaaagaaugaguguguuuuaagcacauaucuagauuuuugguuugaaaauuuucugacuguaauuggaaaaaggaauaaggaauguuaaauuugacccuuuuuuugguagcucuguuaaccacugguaguagaucccauggaucaggaagauggugauaaaagaggaagacuuuacugggaagaagauacaugcuuauuuggggauuagggaaaugaagaauugaugggaccugaucccuggguuccugugaaugacugagggaaucacaaaagucuuccuguuuucagagaauuaccaaggauuacucuuccuuccccucuuccuggucuuccuccuuuaucuuccugagguuuucucucagucugacuugguuuuuuuguuuuuuguuuucacucucuuauuuuacuuucuaagaauugucaguuccccuuucccuuucugcugaagaaccgcccagaugggauugauucaguccuggguggugcucaggugauuugcuaugguaauggagcagucaugcuuucuucuuuucuacugugucacuacauagcuuuaugaaugagggaaagucuuuaaucugccugggucucaauuguguugcccauuaaagaagaaaauuauuuguccucuguccuuggagaguccuuuaauauaaaugaauuauaugccccuucuauuacugugagauguuauuuauaaauuauauuaauuauaaaguuuuuauauuaaagcuauagcauuuuucuugugguuuuauaaauaugcucauagggcccagauagaagggcacauuccuuccacuaugaaaguacagugaauaauccuuauuugaaaagcugugacuuuaaggaugaguuucuuguauaagcaagauggauuuguaugaacguagacaaauuuuauuacuucauuuacaaaaguaagguauaggacuaaauguucucuaaugccuuguuauauaaauguguuaauugugaagcaguuaacuagacaaaaacuugagaaaacuaauaguucuaggugccuuaaaguuuauauauagugaacaagauauaauaaguauguacauuuagugcucuguaccucaaaugaauauaauugaaucuuguuuuauccacagagucucucuuccagcuccuuuuggaaauuacuguucggaguacugggaugaaugacagcacagggcagucccucacagcacucuccugugcuugccucuuuagccugguggcuuccuggggagaaacaggaaggacacuucaggccaucucugcuaucuuaaccaacaauggcagucacgcuugccaaacuauucagguauuucauagcuuuagcuguuaagaaauuucaaagaugcuaaauuguacuuuccuucauuaugucaguagaaauucucugccuuuucucauuauauaguacuuugaucucucugugguugauauauaaauaauguacagcauuugauuuaagcuauauguguuuaauuuuguaucauuuuagauaacaaauggauuuuggcaaaaucucuaaauauuuaaacuauaauuaaugaacauaauauaaaacaguuacauuuaaaaaaauuaaauaagaacuccagaaagugaaaagucaaauaauaauaguuugaaaauuaaaggcagggguaauaaugguaauauggucaaaagcacaaauaguuagcuaaagauaaaagaggaagaaauuauacagaguaugacagagaaagagaaaauaaaagccauguacagagaauaagaaagcuaguguauaauaaagcagacuauauuaacauguucuaacuuccaaagcaaugagagaucaaagugacaaaaaacaagucauagacaagauuuacaaaugugaguaacagaauccuuaaagaagucucaucugccugagcuuaauuuuuuucuuauuuauuuuuuuauagucaguucauugacccccuacccgguccgcccucccacuguuccucaucccguccucuucccuccugucuucaagaggauguaccucccacccucuaucaggccuuccaacucccuggggucucaagucuuucuaggauuaugugcaucuucucugacugaguccaaacccgguagucaucugcuauauauguguugggggccucauaccagcuggugugugcugccugguugguggugcagugucugagagaucccagggguccagguuaguugagauugcuagucuuccuguggggucgccuuccuucucagcuucuuccaggccuccucuaauucaaccucagggguccccaacuucaguccaauggcuagguguaaauaucuguaucuuucucagucaacugcuuguugagccucugggaggacagccauguuugacucccguauguaugcauagcaucagcaauagugcuuuacuucuuacagaugaaguuuuaguuugugccuuuguaagccugccaaaccuugaucaaucuuuauaacuuauuuugccagaaauaguacaaguaucuuuauucugucugaaaaaaaucuaaagugucuuuuuauaucuucucuuuugaauaggugccaacaauacuaaacucacuacagagaaguguacaggcaguguugguuggaaagauucaaguccaggacugguuuagcaauggcauuaagaaagcagcuuuaaugcacaaguggccauuaaaagaaguaucuguugaugaagaugaccagugucugcuucagaaugauggguuuuuucuuuauuuguuaugcaaggauggauuauacaaaauaggcucuggauacaguggaacaguuaggguaauaugacuauuuauuguucuuaucacaacggaaauaaccauaacucaguauugauuguacccugguucuagucccuuuaauacuaucuaaacuuuauuuuuacuuaaaaauuauaauugagaugcauguacuaaauauuauguguauuuuuauuacuuuuauuguuuaauaauuauuaaucacuucauagacaaauuuuuguuauuuuacagggccauauauauaauucuacaucucguaucagaaacagaaaagaaaagaagucuugguuaggguaugcccagguaggcaaauauccucaauaaaugaaacuaucugcucauacuuguugaaugaauuuguauaagaauucuguauuuguaguaaaauggcuagguaaugguacagagcaggagggaaaauacaaagucagaauucaucagucguucaauuucaagccuggcuccgaacuuuaguaacggugugacuuaggacagaucaguuuauuuuguucuguuauuuacauuuaaaaaggaauuaaaaacaccuuccuugguguucucauuuaagcagucuagggauaagaaucauagacagccuuguucaugaacaaaucugaauuaaaaaugaauaagugaccugagaccaaauuagggcuccuugccauaaacucuugcauucuaaguguagauccugucccuucuagcaaacacuuggccugaccaguggacagccaccugcuagagaugcauauagaaacccacaaaguaaggaaacaggaagcucacggagcuccugaaggcugugcucucagcugcgaccaacacagccugucugcuuggacuaguucagcaucagaugcaguugcuuauccucucaugaagaaaaaguaaaugaaagaugggcagaaagauucaggggcacauaauuuuguuguaauuuugucuuugagacaaaguccagguuuccucugggaaguauaaaauggaaaaaauuuccuacacuucauggucucuugagcuaacaguauugguugucagcauaaaaugauaaaagaggcauuugaaaguaguuugaaaacuaaagaaauuguuaguuugucuucauuacuguucaguugcugugaauauacaaugaucaaggcaacuuacaaaggaaaacauuuuuaacacuugcuuacagcuuuagacagucauugauggagaauguggugacaggaagguagauuuggugcuagagcaauagaugaaagcucauaauuuguaaggaggcaaagggacagacagacagagagaaguggggacggggguaaaggaaagaggaugugggagagagagagagaaagagcaggacagcugggaugggcuuuuaaaaacucaaagccuacuccccugacaugccuccuccaacaaggcuacgccuacuaauccuucccaaacaguuccacuaacuggagacuaaagcauucaaacaucugagucucuggggggccauucucauucagaccaccacacagguaaagaaucacucugcuauaucaauauugagauaguuugaaaauaaaauuuuaaaaauaaaaugagugucuuuuaaaacccagugugcuuuaaaauuucucauuaauuuauacuuagguuuuauggaggaaugauauaggaauguuuuaguuuuuagaguuugagagggagagagagagagcuaguuauaugggaguguaugcauguagcauguguguuugcaggucagaagaucaccguaaguucuuccucaauuccuccaucugaaguagacuccgugucuuaaauuuuaaucuuugauauccuuucgauagcauuauugauuuauuauacaucaacaaaauauaauacagaaacauacagcugcuuuuucuauugguaaugaaaaaauaucuuuaacacaaucaaaauuguuuauuaccaggguuacuuauuauaucgagauuugaauaaccacaguaugacugccauaagaauaagcccugagacacuggaacaggaugguacuguacuguuaccagguagguuuuaacuagucauacuuuucuucacaaguuuuaagaaaccaagauguaaaugguaaugaacaaagauuaguacuugcuuacaaaugaguuuuuaaauauuaugacauguuagccauuuuaucuccucaguaaguuaagacauaauacuaggcaucagaaacaaagugcaaugagguuuccuauuuauuuccaaauucauacacaucuacaaggucugacaacuuuacccauuaagaccccagcccccaguuaucaggguaaugcuauuuuguucguuuuuuuuucacuagaaucacuacuuuaacucuuaaguugcccuguacaagaaacauuaucauuauuagucaccuuaacagugcccuagaauuuuccuuugcuuuaaaagacuugcaguggucgggcauagaauggucaagaaaguguuagcauugcucaugugcacuuuguacgaaaguauugacagagccuuugggcacaguucaucugccgcugcucugugccucaugcugcccaagugcugaggcacuuccucucagguuuucugcagcacgagaaagguaucugcucccuccugcuugucaaguuucuaaauauucuuauugcuucauagaaaaugaacugaacuuuucuauuucugcauuuucccaaaauaguauauagacagcaucauaaagcaaaugagcauuuuauguacauguccgugacagccuagcaaaaucauucuauaacaccucuuuucagauucuacauuuccucucgaaacaagucuuggccuauuucauuuguuuaacuuuagaaguaucuccagguaucaccauauaauacaaugaguuucauuaggcuuauuuucauacauuaugacauauaucauacuuuaacuauauugccacuccuaauucuaguuuccuuguauuuuucucuucuuccaccuucuacuaauugaaaagguuuuguuuuuuggauuugggguuuuuuuucauucuuuuguuuuuguuuuuguuuuuguuuuuguuuugagacaacugugcaacugucacuguacagcucugcuuggccuggccuggccuggccuggccugaaauuugcuguguagaccagguuggccuugaacucaaagagaucuaccuguuucugccucgugacugcugggauuaaagacguggaccaccacacccugcugauuuaaaaagagaauuuuaaauuauaccuauaccuccacuaaacucaguacacaguucuaaagauggaucauagucuacuuugagcuuacccuuuacuuacuacucugaauauguucucaggucuuuaggcguuugcaacauuuuuaaauguuauaaauuauacuuuaucguuuauuaauauauauuaaaacaagagucuuccagucuuucuauuuuccaguuuucuuccuuccucccucccucccucccuuucuuccuuccuucccucccuucuuccucuccucccucugucccucccucccucccucccuucauuucauccuccuccuucuccuucuuucuucuucuuuuuugguacaaaaauugcagggggaagaucaacuuuaucucucugucucuguaccaauuauuuuaggauaaugucaucgaagaaauguucauuauugacaaaaccuguccuccuaaauagauggguacaaaagaguaacuucuguccagcucauuuauaagguuguagcugaaaggaaaauuaaaaaauaucuaccuguagguauuuuauuuauuuuccacgauuaaaauuauuuucuaaugucuuuauucaguuuaaauucuucaucauuuaacauaaauguaaauuuuaacuauacaaguguggcuuucuguguuucaaaaauacgugcugugcucacagugaagaacaaaucaaccuuugggaggauagucccauauugugugucuuccgagcuugcagauguugcuuggcauacuccugaagcugcugucuuauaauguuauacacggauacgggaugcaucaagagaaguucucaacaugccauggaaggaagacccagcccucagcugucaaucugaagaagccuguugucauuggcucauuucuuuggcauggacuacauuuucuucaaugaagccauuugcuuuuucccugacaagggacacuucuucucuguagcuuuucaucaagaagagaaguagcaagcugucagguuuuuagguuuacugaauaccauguuuaaaaugaauguaauugguaauucauguaguuucauauucuagcuagucuuacagcuauuucacugcaguauggaugaacggcucuuguugaauaucguuuuauucuuuauauuucagcguaacguugauauuguguucuugugucguuugcugucuucgucuugugacagguggccucagaacacgaggccuuuuugcuacucuugcgccgcuucacucccucaucccugcauuuaucugaaauuauaaugaguuuuucuucuuugcuuuuuaguuuaaaaucuuacugcuuagagcuugagcagcgucucucuugcgccucuuuguauucuguacaguggacuaggaacucuuucuuucgauuucuccucucuuugauuaccaagucucuugggcuaccagugggccuugucucccaguuucuauuuccaguuugugaucacugaauucucuauuugguaagggucugccuguguuuugcauauuuauaauaaggaaguaugcuaguaugaagcucuugggcaaagauauagcuuauuuggguggguuccauugcuguauuccaaaaaagaguuuuauguuuuguugauucauguugaagagaaaugaaauuucuuuuuguauugugauuaauggagagguucauccuaguucuccaugguuacuguagaaagugugugugcucuuagauuugcuugcugaauacuuguuuucccaaaggauacaauuuauacagauguugauuuugcuuguaguuuguguuauuagcagcagucacuaacacauguuccaguguccuucuaugauacugguaucccuugucacaauuggcuugugcguuacuuugaucaaagaaauguuugaucaaagugcaccauucuacauagauauguucaaugcuggcaaauagggguaguagcggagauguuuggcuauuuugagauaauaagaaagaaaugaguauagauuuguuggcuauccauaaauagauaggagaaggauaaaugguuagaaaaucuaggacauuguaaauaguaaacaugcuggaacagacauugacuuucuacgugagaaauauauagguaguuuugauccuucauuuuguaaagcaagggauaucugcaguuggacaccguagacuuaaauacagaagccuuagaucuaucuguauuucucugugacacuaaugaccgugguguaugucuguugguaguguugccuacauugcaugugaugguauugaaaugauuauaaccacacuguuuguuuaccauggugcauguucgacucucagacuauaucauaggcuacuaauucauuuugaaauuagauuggcucucagauccuuaauuaugcaagcuuuauaaauguaagcacaaugugaucagaacucuuaguugaaucauuuauuuuuugauaauuuguaauucuuaauuuuaaaaaagucccuuuuugaguguaagucuauuuuuauuaugugaagagcccucauucugacuucagcagaggaguaaaaucauuucaugaguugcuuaauuguuguguaguauaauuacuuuuucuuucauuuguauagauugccacacugaaggucaaaauauuuuauuuacugauggagaauauauuaaccagauagcugcuucaagagauguaaguauuuggaauagcuguuguaaaugaaaccacuuuuucuuaaauuacugggucuuuauuaacugaagacugauucaugcaaugcaauacuugauuuuuuuuuaauucuuaauuuuuaaaauuuuuuaggauggcuuuguuguaaggauauuugccacaagcacugaaccuguacugcaacaagaacuacagcuuaaacuggccaggaagugcuuacacgccuguggcauaucacuguuugaucuggaaaaggauuugcauauaauaaguaagaugacaaaauaaauguuucuuuuuuacuccuuuaaaaaaagaucauuguguuuuuagcauuucagcuaauaauuuaguggcuauuuugucuacuacuguagaauaacuuuugauuaauauauggagguaacuaggaaauacagccugaaaauagaugacguguuagaaagugcugagaaaaaugacugacaacaauacuuuccagcucaguuugaauagggcaaaugagauacaccgguauuucuuaaggauuguggcagacagugcugaguguaaucuaguaccacugcucauugaguauuguuguucucuaacuuagggaaaacucuauaauaucugccuuuaaauuuuuucaucuuugggaguauaauaaucuuacacuagauuuuuaucucauguuuuaauugcauaagauauauuuuuuuuuguaucuucccuuccaugggaaaauaugcuaaacugagcucaaauuuuccauuuaaaaagcccacagaauuauugguuguguauauuacuggccaaacaucauaaaauguacuauauagaaaauuguaauuugugguuugaagauauaugcauguauuuacacauauuuuuuuuaauuuagggguuuuucuuuuaucaaaaagcaaaggaccaagaaucugaaaauuuuauucagcuaucuucauauuuuuucaaucccaaauaaagguguuagaagaaucuuuaauuuuguauuuauucauuuaaacagugggcacuaaguuaugaaaaucacaugagauaaaauuuauacauuuaaugauguuuaguacaugggaugcuuaauaaaaauauauauuuauuauuuuaugcacauugguguuuugccugcauguaugacuguguaagggccgugucagauccccuagaacuggagccacggacaguugugagcugccaagagggugcuaggaauugaacccuuguccucuggaacaguagcuaguacuccaaacuucugaaccaucucuccaauccauaacaauguauauauuuuuuaauaccuuaaaucagugacuacuguugacacugaguuuuuaaauguuuuauuguaaauguugauaguaauagaacagccucaucuucucuugaagcugcagacgucgucuguguaagucagcagacgauggggcagacgauggggcagacgugggcuucccugugcuuugucucaucgcacugugacagucuuccuaggcagaccagggugcucucaggcuaguuguccuccagauauaugacuaggccguuuuuauuuuuaauaauacuaauugaauugacugaaauuauuucauagauugcaugcuguacuuaggauuaugaguauuagaaauacagucauauuuauuagucuuguuuugaucgcaggcacaggauuugaugaagagucagccauacucggugcaggacgagaauuugcgcuaaugaaaacagcaaauggaaagguaagugacgcauguuguucaaaauuaacauuuucugcuuaaugaaaaaguacaaauuguuacauaauucagaucauuuucauauuuaaauauugucauaaauuuuuaugugguaaaacauaaucauguugaaaauaauauugugaaagaguagugacauuuaagaccuuaaaaauuuguaaacuuuuaaaaagguauauauuugaaaguauuuaauuaugaauaaaaagguauauauuugaaaguauuuaauuaugaauuccuauaauuuuugaaguuauaaguuuguauuuguuauucuguaaaugauaaagcagaaauuucuaaaaauguccauaauaagauaucuaauuaagauaccauagaagcauguuuaaguaacguguagauuguguagguuagccuacauagauuggaguuucuuuuuuaucuaauaaauauuaagagaaauuaagguaaguaaggaaauucugaaaauagaaauuaucaggcauauacuuaaugaagcuuuauguaaauuuggaaaauuaauaacagauuuuaugaauuuuucugugaguguuuaugggaauauaaacaugaaaauuguaaauaucaagaauacauaugaaaaagcaagcuugaaugggucaauuuuucugucguucagaucaccaaauuugaauaguauaaaaaauauugaguucuuuuuuuaccuuuuaauaaaauauggaaacuuuuacaguuuuguaaaaccuggugcaccacuccaaaaggcagucuaauuucuuuuuuucuucccucucuaacauguaagauauauuacacuggcaaguaccagagucuuggaaucaaacaaggugguccuucagcaggaaaauggguugaguuaccaaucaccaaaucuccaaagauagugcacuucucugugggacaugauggcucgcaugcccuuuuaguugcagaggauggaaguguguucuucacaggaucugcaagcaaaggagaagauggagagucaaguaaguuggcugagaguuggcacuucugaguuaguguagagucaucucagcagcacuagccucgcagcuuagauggugcgugucaguaaacgaugagcuaaggaaggugcccgucucacuacagaucacaggaaggaauuuucauacuuauggccaugcgauuauuuguuugagaauaggugguugguaauguuuuguuucauuuacuuauucuaguagauuacuuaaaaagcugaacacuugguaaggacuauguauuucaaagugaagauaaaccuuauguaacuuuguuuauaguauuaucgcuuaugaaauucuuuaucuacuaggaaaucauuugcucagcaaugaaaaaguaaauaauuugauguauuuuuuucuguuuauauccuucuuuaaaacaucauuuuucucucuuaaauaacuuuucauaauccuuagaguagcaucuuacagcgauucgucuuuuaaagucuauacauaauggaaaauuaugugaaaauaaaaguugccuugggaauaacacuuuacaaagccacagaguauguuaccaucuccuagaaacuugaacauauagaaaacauccauguaaacuaguuacuucacauaagcauaggugucaauccauaugaaaggcacgcuauagcauaacaagauucuuuauucugaaagcuugcagaaaauugauuaaucaaaccaacagcucgucgauguuuuccaucuuuggcuuguuucauggguagaauuuuuuuagaauaguaguuuguuauaucacccaugcuucuguuuauuuguucuauuuuauauguguaucaccuuuauaaucagguugaguugggauagcacuuaauaucuguuagaugaaugagaaacuguuuccagaaucuaauauaagagcauacauuaauuaucaggggagaucaaaaggagaggauauaaguauguguguaggggacugagaugguaugugugcuuguggcauuugacaggcuaaauauuaguugacuucaugaggcuagcaaguuuaaucugugugguuuuaagcccaggcuuucugagacuuaauaaaguguaucaagaauuguaacaaagaaaacaguuugugucuuuucuuugguuuuauauauaaaucauuguuauuuccguauauucauuuuauucauucuuuuuagcuaagagcagacggcagucaaagcccuauaagccgaaaaagauuauuaaaauggaagggaagauugugguguauacagccugcaauaauggaaguaguucuguuauuucuaaagauggagaacuauacauguuuggaaaagaugcuauuuauucugauagcucaaguaaguuuccucacuuagacaauguggaaguauuauuucccuugcuaauuacuguuuucuauauaaaacagguaccugacugaaacuuaaggaggggaaacgagggauagacguagcuagauaguuuuauauuuauaaacuccaaucuauaacuucauacuauuuggucgcuggauuguuuucuaguaauuagaaaugauuauagugagugugucaucccacuuggggagauuuuguuugagaccuauaauguaaaacagagagcagaguaaaugaaguuuaugacuauaaaguuaagugauuaucccaaggaugaagaaaucaaacguagacaauuuagagcaguuaaucauuaacugaaacugcuuccagguaauaggaauacugacuuaguguggggacauucagauucucagugggcugaaauuguuugagugacuucaggaguagcauguuaauaguuuaaaaauaauaucuauauaacuauugcuugcuaaaaugcugauagaaauugaacauuuacauguaaggugggccagacagacaaugucuaccugccccuuugcagucugagagacauuugauugugauagacuuaaggagcuauuguucagggccuauauacagagucagauuuauuacuaacuuuuuuaguuggacaaaguuuaccuaacuuucagauuuuucauuuuuucuacuuucuuuaagaaaaggcuaaaugauaauaauguguuucauaauuuaguuuuguaaguuuauaagaaaggacauguaagaaaugcuuugcauagaaucuagaauguagaauguaguagcucacuguauaaucaccuauuauagguagucaaauuuuguucuguuaaauaaauauuauuacauuuuucaagugaaaaauauaauacugaaauuaggaauauuuucaacuuaaauaaccaccaaaauuuuuggaaaugaaauuuuugauauauuuuauaaaacucuuuaguuuuuacuguuauuauuacuuaaugaggcuaagcagcaugccuuuguaauuuuaaaauuauugcaaaaauaaguaaucaguguagcacauggguguaaaaaucaugcuaaauggaacauaagggaaguugaggaaauacuggaguggacuguggaagaaaguuaugagagguucaaaaauacuguuuguggccugcugagagagcucagaacgcaauggugcuugcuucuaagcucaacagccugagucuguccacaggacucaggggcugaaaagagagaaccaagccccacaaguuccccucugaccuagacgugugcaucauagacacaggugcauuugaaugcaugcacaggaagcagauacauaaacgugauuguacagugaaaucuacuauauugaagagccuuacagguuuauaaaaaacaauacuguuuuauuauaccauuccaaguguuuugcuauuugucugcuuagguaaguuuaagccaguaaagguucaugacuucuuugugcugguaguuggguuugagagccgcugguccuucugaguacucauuguuuaaccuguuaguacuugcagcaagcaggcagaagucaguuagaaaugcuguuaccauaaguuuuugucccaaguaugaaugcauuuuaaaauuuauugaaacuacauuuaaugcuuuuuuuuuuuuaauuuggugauaaccuacuaggaguuuggucacuuguuuuguccaggaaauucuucauuaaaguuguucuucuagguacaggaauauuuuguuguuuuuauuaauuuuguaucuuuuuucuagguuugguaucugauuugaaaggccauuuuguaacucagguagcaauggguaaagcucacacauguguuuuaaugaagaauggagagguuuggacauuugguguaaauaauaaaggacaauguggacgagacacuggugcuaugaaccaaggagggaaagguaggaguuaaaggcucggauauuaagaacguuguugucuuuucauucgccuuuuagaacagagugaagaaucccacucuuuucgaaaauaaauguguaagagaugucucaacaguuaggaggcccugcuauucuuuaagaggacccagguucuaucacugcacuuguguggugccuuacaccaucuguaacuccaguuccagaggucugaugcucuguacaugcacacacacacacucacacacacacacacucacacacacacacacacacacacaggcaaacgucauacauaacaauuaaaaacaaugacucuuugauuuuuauaaauuuagaaaaccccuaaauuuuuacuugauaauaauuaaugauaaaagucaaucacugcaaaaauaaaauaggcuuuauuguaauaguaacuuuuauuggccugaagcuuauuuaucgcaucugucugcuaaaguagaccuagucuuggaagcuucuagcccccauacaaucuacucuaauccuagaauguuuuuagccuccgaaacuuacugcuaaauaauaaaauuaccuuuucuaucucuuuuugugcucuggcugguuuaacucagcuguucuggcucaaacuccuccaggcagauugauuuggucccuccugcacuacucucccaggcgucauacuagucagugauguguucuagucuuuuggcuccuugucauucuccugcugguucuagccagagaaugugucuagcuuauucucucugcagccugucucuguacaacugucccucacccucacugcugccuuucucuuguccucuccugcagugcucuccuuacauagcuuccuuccuuccuuucuaugcugccucucaaguagcuucccuuucuucucuguucuucugagagugugcauauccuauucugucaaaucuuuuucugauucaucacuuugucugccauucaauuagucaucacucucacuuaugagugcuuccuucuacagacuaaguuugccuucaucguuuggacugaaggugugugcugagagugagucuguauuucagucagagggauugaaggugugugcugaggcugagcacaucuagaaacaauuuuuuccagcaaacaacacaauuucagaguucacagccugaucaaauauccuguaauacuuguauuuuuguuuuuugaagaaguaauguuccuagcuguuuaauauuauaaaaaucuacauuaauuaauaguucuucuguaacauuuuugaugacugaauuauucauggaaaggagauuuuucucauaugcuugucaccuucaguuuuaacuacuuucuggcaguagucuuucaacaguauugcccuucuaguuuaaucaugaguauuuugacagcucagacugcucuuauucccuggccuuuuguuagggaaaggugaaacuguagcuaucuauuuucauagugucuucuucucaauucuuaggcuguugaagggaagggauguuuuauccuucaauuuccuugcugucgugaucuugaucuuugcuuguaaugguauguuuaguuaauuguugcuucugguuuuuacuuuuagcuguuaccaacauugccuguauucuuuaguucaauuuuugacuaucuuugauuuuuuuuuuuaaagcagugggagaagauauguucauacagucagaacuaagcauuggacuaugauaaacuucaaucauucgagguuuaaacuuucaauuuauuaaccaaaccaagagcaucucuucugaggucugcuugaccauggauucaaauagguuacaagaaccaguuuugauagguagaguguuggucccauuuguguauauaacuauauuaguuuuuaaaaagauaguuagcauuuuuaaaacaauuguuuauguuucagguagcuagcuuggaucuuuuauuuuaaauuaugaaauaugaauaagaguccuuuuguauuuuauugaauauacagauuaauucaaagacaauaguuaugcuguugacucuuaaauacuacuauguauaaaucuaguaaagauugugcuugauaccagaauucuaccagaauugcauauucuagcucuaaccaaaauuaucugguauuugcuugucucauuuuuuauauuguucacugaugacaaagcuaaacgaagaccucaugugcugugcucuauuucucgauuguuagcuuagccuuuaacagcuuagcauccugcaucccugaacgaaguucuugauuagacauaguuaccuugaguggcuuuucuuuaggugguaugcuacagauaagagauaaaugaguaaguuggaugaggaauaauagauugaguaaauacauaaccacugugauuacagcaggguuucacguauguuuuuaaguugggagauauguuuucagauauggaaauaauucacauacaauuauaaauuuaauugucauacaggguuuggaguugaaaauauggcaacagcaauggaugaagaccuggaggaagaacuggaugagaaagacgagaaguccaugaugugcccuccaggcaugcacaaguggaagcuggagcagugcauggugugcaccguguguggagacugcacuggcuacggcgccagcuguguuagcaguggccguccugacagaguuccuggaggguaggacuagacuuccuaggaagaaaauaagcacgcucucccuccccucuguuuuuguuuuuuugugucucaggcuaucucacaguguguccaccuacguuuuauaugugcccguguauugggguagugguguguggguuucagaccuagagcuucagacuaauaccaguucaguacucuaccacugagcuacacauucaagccuaaacuugaauucuuaguuauuuucuacuauauuguguucuaauuuagucaccuuuauguuuggccuccuuucauuugauucaucgaagccauuacuuaaaaauuaaguuauacuuuucuucaaaucuagggccuuguuuuuuuccuaagcuuguuuaaugcgaaauguuuauugaucuuuucuuaguacaguuaucaaauuuauaugauucuugaguaaaaauacauucuuuuucucucuaacaugauauccugcuuaccuaucugucuaucuaucuagccugccuaucuaucuauccauccauccacccaucuguccaucuucuuauagauucuugauuuaaggguuugucuugguuaguuuuuuguuuuuguuuuuguuuuuuguuuuuuguuuuuuuuuguuuuuuuuuuuuuuguuaauuugauauaaaccuauacauaucuggggaagaggacuucuuaauugaggaagcacuuccauaugauuguccuguagacaagucuguggaguauuguguugauuaaugauucagaguggaagaaucuuguuuauugcguauggugccacaccugggcaggcugagcaaaccaugaagagcaagauguagcacuccuccaugggcuguaugucaguuccugccuccagguuccugcccuggccucccucugugauggccucccucugugauguggaacugugagcugaaaugaaccuuuccucuccaagguucuaaauuauugucaauucuaaguuaguaugugaggugcaucaaauaauagaauuuucuccuagaacuuuagaagaauuucacguuuacauuuuauagguaauauaacacauaaaggguugucuuuuuuaagacuagguuucugauaauuggcugauuuagggugggagugaaauuuugugaagaaaagccuaguuugaggaaaacuaccuucagucucugauuuuacuauuuagcaaaugcuuagcuaucaaguaaugcuucccaauuccuggcagcaucuccugugauuguauuucuggacuuaugcuuuuuuugucauaaguagauuguauacaauagccauuuuccuucaaggcuauugaaauauuauuucaggcuuguuuuguuaaauuguguugcuugagauaaggucaaucuggccucauacuucaaggcucaagugauaaccccugauucaggcuuaccacuuacugcagccacaggcuuuuucuuguucuuggcauggcuuauuuuauuagcauaaguaaaaaauguacucuacgaauagguaauuuuuauucuguggugcuuuguuggauaccauuuucuacuuuagugaccuaacuuauuuaucuuuaauuaauuuuuauuuugaguauuuuuauguaaaaggauccaacuuuucuuuguaaacaguguuagaauuuaaucucucaaaccuuuccuagucuguuuucauuaaaaaucagccccccaaacuucaagcuugauccagaauaaagaauccagaaaugcagacauacuuuugaauucucuguguccuacuaaaauuauuuuucuuaaaugcucuuccacagauauuuauacaauuuucauugcuaacacuuagccaauuaaaauauuuuuuguuaaugaccaaaauaaauauucgaauaaauuuaagauaauauuaaaugccagaguacugugaacuuuuagagaugauuuaagucaucauaaaauucuuacuacauaccuuauaauacacuuaaaaauuaggcauuuucuacaguuucuuuggugguucaaggcauuguaacauaaaacugacuauugugaucauuuguaaguauacaauucaauguuuuuuaguauuucacacuguuaugcuguaaaaacacacacacacacacacacagcuuuuugucuuauaaaacuaacuauauuccuuuaacagccauucccacuucccacucuccuccucucucuacccucaugcuuucugucugccugucuuugacuacuggaaagaugucacgcaaguggagcacaugguacuagggcuuccuuucacuugcucauguuacuuacucgaacguccucagaguucauccauguugccauacaugucagaauuuccuuccuucaggacaaauugagugaauguguuucuuauccuuuugccuuuugauggacacaucuaagcgcaugugcauauugcuacugugcacuuagguaggcggguagguaguucuuagagagugcaucgaguucuuuuggcuaugccuacugcaauggaauugcugaaccauauuaauucauguuuuaauccuucaagaaauguucauuguguuuucuacaacaacugccaucuuauauuuccauuaguagugcauacauuuugcaguuucuccauguucuuccuaguuuugucuucuuuguuuggauuuuaugcaucccgagagaugugaaauggcuccaguguaguuuugauuugaguuuccuuaauaaugauguuaagcaccucuucuuuguuuuguaggcaguuguagcucuuaggagaacuaccccuucaagucuuacaccagcagaaccuggugaagccaggagagccaggagaauuggguucuuuauucuuuuugguugacuuauaguuggucggugugugaguacgugauucgaaauaaaugaugucuaugagcuaccuuuuaauuguguuggcaguuuuuugauauaaaaagauuuuuaacuuucgucaagcccaacuuguuuaguuuuguguuguugccugugcuuuuggugacauauuuaaaaguauuacucaauucaagaaaguuugucauacauaacacaucaugaauuguuuucuucuaguaaaaauuuagcacauuuauugugaaugcuguaggugugcacaugccuugacgcacacauggcugucagagcaugaaugggaggagucaccucuuucucacaggguacagggauugaacucaagucaacaggcuucauagcuggggccuuuaccuaggaccccuagaaaaauuucuuuauaguuuuagaucuuccauuugaguugauuuuuguauauuguaaauguuauuagauggaggccuaauguuauuauaaugcauguggauauccagucuucuaacauaguuuccuuuuuuuuucuuuccuaauuucuuucuauuuuuucuuacuagauaauuuucuuuauuuacauuucaaauguuauucccuuuccuaguuuccccucugaaaauccccuguccucuccccccuccccugcuccccaaccuacccacuccugcuuccuggccuaggcauuccccuauacuggggcauagaaccuucacaggaccaagggccucuccucccauugaugaccgauuaggccauccucugcuacauaugcagcuagagccaugagucccaccauguguuuucuuugauuggaaauuuagucccagggagcucuguaggugcugguuaguucauauuguuguuucuccuaggaggcugcaaaccccuucagcuccuuggguacuuucucuaguuccuucauuggggacccugugcuuugucuaauggauggcugugagcauccacuucuaaauuagucaggcacuggcagagccucucaggagacaccuauaucaggcuccugucagcaaacucuuguuggacucugccauagugccuggguuuggugguugucuaugggauggauccccaggugggguaguuucuggauggucaugccuuaagucucugcucugaacuuugucucuguaacuccuuccaugggaguuuuguucccccuucuaagaaggaucgaaauauuuacacuuuguucuuccuucuucuugaguuucauguguuuugcaaacugcaucuuggguauucuucuaacauaguuucuugaccaagacugucuuuuuuauaguuaguggucuugacacccuugucaaaaagucauuuggauauuagugugaacauuuguuucugggcuuccuuucugcuucuuuggccucuaagcuucucuuuuggccagcaucauucacauuucagacuuguggccuuaauauguuuagaaaucacaaagaauaguauuucuuuaucaaaauuauuuggcuuuuuaaggaacucuuaauuuuaugauauguuuccuacucaugugagaaauaucauuaagauuuuauuuuaaugggaaugcauugaaucuguaggcuucauagggugauucucacaucuuaacaauauuaagucuuuaucuuugaacuugggaugugguccuauuuauuugucuuaacuuuuuuucaccaguguuugugguuuucauuauucaagucuuucaccuucuugguuaaauuaauugcugauuuuuuuuuauucuuucugaugguuuugucaguguaauuuuuguuggaguuuucuuuaauguuaagaaaugccaccugucagucauguugccuuucucuccugccaguucucugaguuucuuuauuaguucuaccaguucuuuuagcguuucagugucuguauaagauuuuuagagauuucuaaugaugaaauuauauguagagggagauaacaauacuucuuucagauuuggauaucuuuuguuuuuucuucccuccugauugcucugguaaccuaugcuguauuauguuaaucaaaugcgagucuaauuuuuuaucuagucuuagaagacgugcuuuucaucuuucauugaauguaauguucauuguauguuuucauuuguggcucugaauguguuuaaggauuuuuuuuucuguucuuaguuucuugaauuccuuaaauaaugaaguauguuaaauuuguuaaaaguuaauuuauauagauugagaaaauucugcauuuuccuccuuuaucgucuuagcgugguauaugauuuauacauuuucuagugcuacauuccagggggcgcuccaccuugggugguuaucuugugucguguuuuauuucauuugguaguauuuaguuguuggguuuuuuuuuuuuuuuuugccucaauuuuugugaaggcuuuuagucuuuugaggguuguguuuuuauuuauucuaugucuuugcaucaaauaucaacauaagacaugaucuuccacauugucagugauccuuauuuuucaaagcucacaguuugcaggauacuuagcagccacaccauuugagcugcugcuagaagcauuugucucuugucccuuuacaaaacucuauauuaccaugaaugugacagggcuaucaaaaguuucaaaggaccaauuagugaguaauuaaagcuaugacuucuauaucuaugaagaguguuacaaagaaguuaguuuuucacuaaccugguagccgacuucagggaguauuuuuucuuuacuuagugauaaagacauguuauaugcuuuucaguuugucugauagugacaaagcagaagcaaggauuagguaguuacaugcagagagaagagaagcaugggacaugguaauguaucaagacugaggagagagacagagcugacccuuugcugauaaggcugcggccuaucacugcaggcggccuacacacccucuccuggagacagaguuggugcaagugccagccaccgcccaugcugguccuuaguccuaacacuccugcacucaugagaaaacucauaggacaauggccauuuauaauuaguuguagcaucuauuuugauuuuguguagaaauauacuagaaucauuagacucauaacacauucuuuucauuguuuuucuaaaauuccuacuuuucuuugaaaucaauacaagagauuggaaaagugguuacaaaaaagaauauuaaaaaauuagaggauuuccguuaagccuguguuuuguuguuuguuuguuugcuucuacguaggaucugugguugugguucaggggaaucuggcugugccguguguggauguugcaaggcaugugcaagagaguuggacggucaagaagcaagacaaagagggauucuugaugcagugaaagaaaugauaccuuuagaccuccuuuuagguaauuuauuuuauuauguuuaauaucuuacccucaccucaauaauucuaguaguugaaagucuuucuauuaaauauuguuuuaaaguuaagguuaacaugaacauuguuguuuugguaacugauaugaucaugggugauacuuuuuucaugaaccuuuuaugguaggaauuucuuuuggggguuguuuuuuuuuuuuuuuuuuuuggaaacaggguuuuauguguguagacuugguuguuguguaacucccucuguagaccagccuugaagucagaaaccugccugucuuugccuccugagugcugggacuaaaggaaugcaccaccacugcccagcuuauauaagaauucuugcaauaaaauuuuaaguuuaaggugguuuucugcuagcuuuuacuuauucauauuuguauagguacagcuauuauauacucaaauuauaugauauauguuauuuucauuauuuuggccaauuauucagcugucccuguaccggggguuaauauugaggaacaucuucaguuaagacaagaagaaaaacggcaacgugucauuagaagacacagauuagaagauggaagagguaagauaacuacagagaaaaaguauagggaaacuugcauacuuuaacugaggcaagugaaauauuuauagaauauccucauuuaguaagaaguauuaaaguuuacaacauucuuguagcaagugaaguuacgugaacauauuuacagcauuuauaauuauguuaguaauaacacauuuaguucaguagaguacuccucaacugcaguaaagugugugcuggguagcucagcaugauggcucauacuuauaauuucagcauccugauguuaacacaggauugcuacaaauuccaagccugucugcagugagacuguuacaaaaaaagauaaaaggauguaccacuggaaaauguaaaugccauugccaaugacaauuacagaucguaucaauccugucuucagauuuugggucaaauacagauauuugaccauagguccauauuuaguuuaaccuaggcuguucaggucuguuuucauagcugaucacgucauugccauuugguauaauaucauuaugcuguccagccauccagugcaugauugugacauuuuuaugucuuucuuuuucuuucuuucuuuuuuuuuuuaauacaaaaagauuauuuacaaaaaggaauugaaagucauguuuauuugcaaagacagauguauugcuuauauuauuuccuuauuguuuaggacaguuucuuaaccugaaaauauauuuaauacuaauuguacauaaaugacauuuuaaaauguaugaauaagacagaaauaaauauuauguuacuaaaauuguuuuccaacaaaaccucuuuguacauugugacaagaauguuaaaaaugugugauuuaaugaggcagacucuuacuuggaagaauacauuggcauuguauguuuucagugcaucucggaauguauaaacuuuugguauagaaauacauuuauuaccauuuuuauauauuuuucauaaacucaugguaacuucuuaccaucacuguucauuuuucuuaguucuguuauaugaaguacaauaaguaauagcuggcguaccuguaaacuuuuuggaauguacagauuauuguuuccagaaacagaagcagugauggcugguagaaugaguguuugccacuuuggcuuuaugcauguaaagucauugccuuuaaaggauuucauggauuugugggugugcuguuauuuuuacauuucauaaauguuugcaaaauuuguagguuguaggucucuaacauggcaauuuauuucuuacauuaaugguauuuuugcuuaaggcuauugucucuuugcuauuuguuuuuuauucuuugauacauuaguuugauucacauaaauugaccuacaaaauccaguaauuucauagauguuauucaaaguagcgcuuauuacagugggucuuaaccgggaccauuguuaacugggcacuuaucagagggaccaguucucgggccccacccacccugucuaaaauuuggauauuagggucuagcaaaauguuguuuaacaaguuuucuaggggguuccagugaugccaaacucauaagccaguauuuuaggccguguaguucaguucugaacagucaugguucuguuggagaagguugcuuguuucugguuucccacacaagaacaguaacaauagaauuguaauguugcagcucccacuccuacucauucauuagugaugaauuuauacccauguauguaguuuaaggguuugguaugcuguucucauauuguaagucugccuuuguuguuucaaaguugaucaacauucagaacuuagcucuauauuaaagccuauuuagucagcuguaggucuguuuguacaauucaguacuguuauaugacacaagcugucccauaaugcugucacuuucaguggcaccucaguuggauaauaguuuacauugaugaccuagcuguacuacuguacagauaaggccauaguguauauuagugaccugugugaaaaugucacuuagcaugggcuaagcuguaaguaauuguuaaauuagagaagaauuggaauuagaaaaauagucuauuuucuuuuaagugcuauuuucauaucucuguccuugacauaauugcuuuucuuacaacauuuugauucucauuguaaaauguugauucugauaaagaaaaauauucagcugcuucucaagaauaaaagagauuccauuuugauacuuacaaaucuguuuggacacaagugaggauauaaagauaaauuuauuagaaaguagccaaguugcaguuacaauugguaagacucuaaaggcauugcuugguugacuuaauacaugaauacaguauuaauuuaaauucuaaugccacauaaaaguauuuuaaaauuagacuauaugaaggacuuagaaaguaucuauuaaaaaucuguauaauucuucaugugaguauagaaacagaauuuuguuauaauuucuuucauaauuuuauauaugaugcuuuauuauuuuagaugauuuuauucuguaauguagauuguuguguccuuuuaauaaugcuuucuauuauuuaaguuuuuacugcauauaaaauaauugaaguaguauaggaagugagguucagcuauaaaguucacuuguuuccuugccacguccuaaucaagcauaggcacacagccuucacaaagcgcucugcugugauggauacaagggcaaaaacccaccgucaguucuagucuagaauaaauacagauuagcucagucaguagacucuccuaagugcaucacaaacuuaugcaacuguuauugguugguugacacuuggguucuucuuaggcuuuugagaaaucuguugaaaugaacauuguuaaaccuacaacugugcggagagcagcucuagcuuuacccaggcauuggaugccugaggcacagagcaucuacuguggaagagucaugcuucccacuagugccccuuuuauuaguuuuucuuuuaauuuuugcacaaggacaguuugaucucauuguuaaacagcacaaaauacuuuuuugcauaaaugugcuguguacguugcaguuuaauaucuuaauguucuuccacuuagggcuuuccauaguccuucaauugauuuuaauugcguauggguuauuuuagauuuuuccucaauuaaugagauaaaauuaaauaaguaccuuugaccuaaaauuucuuuucaacuuugaaggaauuuuccuuaggauaagugagaacugcagggcauguauccauguaagcauuugugcccgaggugaacauugggauggcuuccucagggacuuuccagccuuaacaguucuugagacagugucucuccccugaacauagagcuugccuuuuuaucucaaggcaaguagccacuucccucugccucauccuuggucuugccaugccugcuuguuaauguaggugcugagauuuuaacucagguccuuacgcuuacauggugaguacuuuaccuacagagccaucuccccagucccaagaauaacaguuaaauuauuaguguauaucacuaagacuuugcugaaaagcuugucuuauuuaaugcugucauucacucuacaugcuucuuacaugcuugugagugggcuccaaauaaucuacuuuauacacauacauacauaaugugagcuguuagauagcuuuuuuauuauuucaaaccucccacuugguaguguguaaacaccacccuucauuagacugugaugcuugaagcaggguguguguaugccuuauuucccaauuguaguaaguguuuaaucucagacuagggguuucuaccccaccuuugaucaguucccggauaaagacacacaaccuuuauauuuauaagccuuagucagcacuaaagcugggcagauauauaccuauuguacuauuaugucuacuucccuuucaauagccccaaguuauagcuugcuauguuccaucugggcugcucuuaauuccaguuggccauguuuucaugauucacgaaucuaucccauggugccucuccucucuccacuuucuccuucucuccuuuauccagaucccuuccucccaucccaaucccagaaaguuaaaccucugccuaucucucuucugcccagcuauaggcuguaggcaucuuuauucacuaaucaggauaacucgggggccagguuacauagcaucacuugggucuaugugcagauucuauuguccuggggacaaccaggcuuuuuuuugggguggggggggcaguauuuaacauuauaauacauagcaaaagaccaaaucucaacaccuaguuguucucuuaaguggaguccaaauuggaauaucuuugcuaguugauugaaaacaauucaggcauuccugauuaccucuagaauggagauugauucuaucaaacucccaagugcuggaauuauagaggaguacugucaugccaggcacacaaacuaauaucucaugacugcaugccuaccuucuguuuuggcuuuauguguuauuaaugacagaacaauacuguuuaauguucaaaagugcuucuaaaucuuuaacuggaaugucuuuuccaucucucuugaauuaccacaucuuuugaaaccuuucugagucaaccaaauuaauuauaagacuuuucaaccuuuagugacauacagacuucuuuuauugcacuaauaauaucauauaguugauucuuccuagugugcuucuaugucuuuauaauuucaucgcuaguaccuaguauuugcuacauaaacaauaacugaauguuuugugacuaaauaaauaaucaagucaguacuugggaaaagugauuucaguuuacgaugcuguugagagccucggguuuuccaggcaugauugugcacguacugucaguguuccugugucagaagauuauuaaaagcuugaauuuagugagaaacuacuucauaaauuaauagcuguauuuucuauguaaaaaauaucuccaucagacucccaaaucagaaaaugguaauauagcuugcuauguuauaauaaauuauuacuucaauauucuuuuuuauagguggaaaguauuuuacaguauuuaugcuaauuucuuuaguaaaucaaauaaugacaauaccuaaugaggaaauaagauauuuaguucauuuuugaaauauguauuuugguuccuuuagaaauagaacucaauuuauaugaauuuacugcacuacaggaaaauaauacuuaauccuccuaacauuaaaccuguuuguuucuauuauaauuaaucaaagaaaauauuuuucuguuuuucaaaguauuggugcugcucauuuuuuucugggaacagaaucaacaugucuucauucuuuguuucguguuuacuaaagauacccuauauuuaaacuauuuagaagaguaauuaugacuguaguuuuaauuuuugcaucauuagaaaaguuaauuaaaaugaagagcauuagagaguugugaaaaugcuuuauuaaaaaauagucagcacuuauauauuuucauaauucucuuuucagaugcuaguaauuuaacuuucaaauuuacagguuuuuuuaaacuuuggcuuuguugaaguugcuaaaacuuaagauuguuguucuuauguccuucaaauguaaccuaaauuucuuuuucuuuucaacuaaguguucacaagaaaaagugaucuuuacaaaaaaauuuuuaaauuauuuugacuguagauauuuuucuuaagaacuaaauaaauagaagaaacaaauaugugugauuauguuuuuuuauacuggugcuucagaaagaaaugguuuaaugaaugauaauguuuuuaaaauguuccuugaauuggaugguccuuuccacuaucaguaugagacacaguccaggucauccuuguucccacagaugugggacacagacagauagaugucagggacaaguuuaccuugguuuuauagcaaagguguuagagaucuguuaacuuaaaaugcuguuguauacuauuauuucaauuggaaacaaauuuguuaucauucaauauauguuuacuaaucuuuaagauaugguaucaagaaugccuuaaagauuauuuuaguauaacuucuaguaauccacuugagauuauguguaaaugcccagucuuuauaagaauaaaagauuggacuuuuccuuuauaaacuguacuugagauaauaaugugucggauugaaguaguuauugggaagaggaauugggaaaaguagaauguccaaaacaguuacaaauaaauuucucaugcauuugagcuuuaauuauuuuuguucauuauaguguuuuccuuuugugagcuuuucuaugcacaugcaaaauguuucuccucaggcccccuuguauuugcugguccuauuuuuaugaaccaccgagaacaggcacuagccagacucagaucccauccagcucagcuaaagcauaaacgggacaagcacaaagguauuuggucuuccuuaccaccuaggugggaugcucuccaaauuucuuccacucgauggaauuuugucucugggaaaaugcacaaaacugacucuucugcucugcuucugugguguagccugaggagaaaggacaugucaaagugggacuguccuuuguggcucuggugcucccuucucucuuucuuguugugaacugcaacaaggaauguguucugcauucugucuuuucauuugcuuuccucuuucauagcuuuaaacagguaaugaauaucauuuuuauucuuugucauuugccuuuugaagaucacaauguaagguuuuaguuuaauacuguuaauauuuacaaaauuauggaguauaguguguaaaacuguuaaaacugccaauacauuucugcuauuuuaauggcaauaacauauaagaauguauaaauauuugcuauuugaaggccagguggaaagcuauaaauagagaguaaagcuuagagauguguuguaguuuccgagaggucagaguucuaaccagagagagaccaggaaucgccuccugcaucacuauuucuuaggcagagcucugggcuaaguauaaucauuccgaaguauguuuaugucuguuuuaaacaaccaguuguaucuugguuaauaucaagugcuaauaauguagacaauuuuuuauuuaugucuaaauugugucuugaauccuagcaugugaaacagguacucaucauucauuggcuacuuaagaauuauugcaacuuauuuuugcuguucucuaaaaugccuaaggugggacugaugauuguuggaaguuuuaaaacauuuuucuauauagacagguuggucgaauuacuaugucuaccuugcuuuuuucuuuugccuagagaccuuuaaccugucuuuaaaaagugacuuucaugugagaacuggcagucauaugcucuugauuaucugcccuagucagcuucaaaguagacaaagcagggacuuuaaacuaaauauauagauuaaguuuauauauaguauaaauauauaauauguauaguagaaacaauguuuuagauguauuauuacuuauaagaaauauauuauuuuacuuauuauaagaucagauuuguguuuauuuacuggguaaucaagcaauuuauauauacauaaaacuuuuacaaaauauuuagaauaaauuauguaaauuuuauuugcuauuugccagacucuaugguaucaugcuccacuuuuaguacagaccuucuuaaucucuuuucuccauaaauuuaugauggugaguucuucuaaaacuuuacauaaaguagaacaaaauauuucaauuuuaugauauacauuaaaaucuuaguauauuauuacaaaccacacuugaaaaauuguuuugacuauaguacuaaacgaaaaccaguguuacagauuucaaucacuuuuuccauguuggagacuaguagcuauagaaccuuuaagcaaaaugagagucugaaaucacucccgugugcgcuggacuaguguuuguagaucuauaacagucucuuugagaaggaggugauauuacagaaccagguuuguacauuuauauauauuccugguuuuauaaagugagauaauuucaucuguuuacuucaagaggaaugcaguguuagguuaggagacgguguccuaucuauacgaaauauuagcugcccacuuccugcugucuaccuacucacuaugcuagcuguccagcuccuuauucacucuccugucuuuuauuccucucuauugacgacucuuacugccuuucacuguauuuuaauauuuccccuuuauacacuuuuuuuaaaaaguacuuuagacauuaguuuaccucuuacuuaguucacugugcuaguuaucuucugacuuaaauauaauuauguugauaaacauaggaugacaacaguuacaguuucugaccugugacuuuacaugggcuaaaaacucgauuuauuaguaacagugcuuucuaaaauggaaagcuagagagcuccuggcgaaguugaagaacuucagagaugcucauaggauggcaguuugugaucacaaaaacuccacugcuaaggcugaaucacagaguggaauucuguuaucacauauaguagguuacagucauaaacuagauuucuacgggauucuuggauuagcauuuucuccagcuacauaucaaaguaagggaaguuuuuugauaugucauaccuaguuaggaacaucugaauuauucaagaaauagucuuagacucuaucuuagagcagcugaugugacaugcugaagacauggugcuaagcaccugggaguguuuucugcucgcucuuucugucuuucuuucuuucuuucuuucuuucuuucuuucuuucuuucuuucuuuuuugagacaggguuucucuguguagcacuggcuguccuagaacucacuuuguagaccaggcuggccucgaacucagaaauccaccugccugggauuaaaggcaugcuccaccaccgccugacauuuucugguauuucuauuugagaaugugucuuaggguuuucauugcuguaaaaauacaguaugaccaagaaccuagggacaacauuaauugagccuggcuuacagguucagagauucaguccauuaucaucauggcagaaagcauggcaccauccaggcagacacuguucuagcaaaggagcugagaguucuacaucuuguucugaaggcagcuaggagaagacuagcuaacuuucuacuccaacaaggccacaccuccuaauagugccauucacugggccaagcaaaggcaaaccuugaaagagugcugaagaguauaguggaagcaugagcuuuaaugggguucaguguucaugcuaugucuuucauuuacucaaaccacacagcuguucuauauuugguaguccuuuuagggucuguaucuuuauuuuaaaaguaagaauaauuuacaaccuauauugcuguaaagauuauauuaaaaauaugagauguauguguaauuuuugcacauagaaauccaugaauccaaccauaacucucaguggcaugcuuugcuuucuauuuuaggacucucuugauauacaagacuugcaauaucauuaaauauguaaauaguuuauuuuuacuagagauuuacaauuuggugauuugauaaugggaaaaacacaugagccuuauuaauauccaaaaucuaaauuaguuccaucauuuaugauuuuggacuuguugguaacccuuacgguuuaguaaaauggucaaagaauacuguguuguuggacugcuacguugauuaaagcaaacaauaacaaacaacagugguaaauauuaauugaauacuuugcauaaauuacuuuguuuaaucugccaaagaacuuugugaggugugcaccacuguugauguuuuacaagugggaggaguaaugcaaaaggcccagugucucccgggcugugacucccgggcugugacucccgggcugugucucccgggcugugucucccgggcugugucucccgggcugugucucccgugcugugucucccgggcugugacucccgggcugugacucccgugcugggauccguaugcuacuuuauccacaguggcacuggaaguuuugcacuguuuauggcacaaaucaaguccuuaagauauugcaggagcuaccucuccuggucuuuuaaauuuaaguauuuugcucaaagcacucaccguauucugagaccacuuuuagguuuguuuaacuuagguuagcuaaaaaaauaccugacuuuauguaaaaauuaaauuucaaguuuauaauccuucagaugccaagucuucuuuucuucuacauaaauauguucagagaagauaaaugccauguuuuaauuauauaucuaccaaauugucaguuuuaauaucauaggaacauugauuagaaaaagacaguuauggucuugcuaagaagaccauuauacgauuauucagauuuauuuauuuaucguaacacaaaaugaagucuuuugguugcucauuuaucuuuuucugaguauugagcuucaacauauuugacauuucugaauuucacuugcugauucuugauuuggacuacauuuuggcuguuuacuaaguacuucuuuucaaaacuuaaaaauguucaaauuuuauaauuauaucacuuuuucuaugaagaccccaguguguguguauguguguguuuaugcaugugugugugcuuacaaacucugcgacugacuaagacugucuuuuauuaauacuuucacaaucuguaguuaagguaugguuuuacauauaggguguuuauaugaacucuuagcaaaacuucuaguagaaguuguacaucaaauaaaaucuuucauugucuuauucauaucaauuuuauuuaguaaacuauuaggccuugaaaauuuuuucuucugugauguuguacaucuuuuguuggauuuguaucucuguuagccuccaacucauagaacgagaacaauauucaagucaagguagaaguuucuaaauggacaaaauacauuuauauaguggaauauguuuuauuaugucuggaaagaucauaaaucacacuucuuucaauaaguauauauuuugccaguuaugacaaaguuagaaaguuuguucccaucuaguacuugauuuaaauagauaacucuuggaaaauauauauuccuuuuuguuugagaccuuuaguguauccacuaucuuccaagaugaaagagaagccuuuaaacaaaaaauauauuuuaucugaacugcaacaaaauacugaacuuucuaaauuuguuuuuucuuugauuuaacaaacucacauuagaauauuuagcaaaagagguauuauuuguuauccugucauaguaaaaccccucacuaauucagguguaguauuuaugauauuuuuaaauaaaauuucaaaguaauuucuuccucugaauuuucagggucauacuuuuaaggggaauccugucuaaaaucacuagcuuuucaaaccaagggcucaagaaaugaaggauuccuucaacgugccuucagccucuggguccagcaguuaauucuuguauguuaaaggaauuucauguuuaugguacauuuuaauguaaugucagccuauuuugaaguuuaauguaugugaauacauuuucuucguuguagcauuuaauauauaaucuauauugcuugacaauaacaaaacugaacuuuuacauacauauucuguaauuaauacuucuucauuaagucacacaggcccacccauuuuaugcuauucugaacuagugagguuuuacuguccaaguguuagaaaguauucaacguuuucaagauaaaguccacuuagagcaaagaaagucauauuuuaggacaaguuuguguuaacuaaauauugauaaaaguaaaucagagugaaugauuuacugaugaaaaugaaaauuaaaugauucaauguucuuguauuuaauauuuuaaagaggguaauaaaauccagaauucaaacuguuugcuauagauuaacauauguaucugcauguuuaaugcacuuguuuaauguuucugugccacaauggagugguucagcccaggugaccuguuggaauuccuuccaauuucauacacaccacaugaaaggaauuugacuauugauaaaauaaaggucacauucuagauuguaauguauaguuuuuguuucaaaaaacaaguuaugugucuuauuuacacauuucuaaauucaaguuuuaaaauucuagaauguggaaguuaugguuagaaugucauauaauuucuauaucaaauauagaaagcagugguugagagaagccuaaagggagggaaaauuaucaaugaacaaacuaaagauagaaagaaggaaggagcgcagacagaggaccggcuaacuuacagcaggugagggaggccacacuaaacacugagagggaagguagaggaacgguggggaagaagaggccauugaacugcaggauccugaagaaagcucuuuggucuuuaucaaguuucuuuuuaaguuuaguugccauccuggugggcagaaaggcagcagccuuucugagagcugauuaagaaaucggucauuugugagucuacuaggauuuuuuaaauuagcaaucacuaacaguauuccuaaguaaaauuauuguuaaaugacauugcauguaguuauuuuuuauucagacuauauucuuccauaucaaauuuaaauuucauauuaaaauuuuauuucuauuacuuaauugugcauuuucauuacacagcuaauuagcuuacuagauuuuaccagaucauaucuuuauuuuuuacugauuuaguaggcuauaacagaaguauacuauauaucuauucagacuggcuucuuuaaugauagcuucuugaucuaucucuucuaacaacuacagggucuucuugcucauuccuuuuaacauuuuucucuuuuucuuccauaguaaacugauuuaaauuucguuaugaauaugaauaauuguauaauugugcauguuaacacuuucagauggaaguggagacagaggggaaaaggacgcaagcaaaaucaccaccuacccuccaggcucugugagguuugacugugagcuccgagcaguacaagucagcuguggauuucaccacucagguagcagcuggaaccuuaggguauaacugcauuuuuaccauugugucuaacuugcuuagaguugauaaacauugcuuguuaccugcaugacaaggcaccguaucucucaagucgaugggguuuuuguuuuguuuuguuuuguugucacuaaagaaucuuuaaaaaaaaaaacuauagcaugaugauagaguguuauacuugucaaaagaucuaaauucuaguuugucugcugauaaaccuauuuucuaauucaguucaggaaauuaaaggaaaugaaaucauuccugaaaugccuuuuaauccuaaaauccuauggcuuucauaauauugucucauguuuuauuguuauugaauuagaaauguauauaauuaauaaaaugaucaaaauaauuagauuuucaauaaauuauugacauugcauuuaaauagcuuggguugcacuauucaaccuuucucaaaaguuaaaaaauauguuuucuuauuugagaagacauuggcaagccuuaggcucuguuauguuguugauguauauaauugucuagacuacuauccuaccugccaaccucuaaauguucuaaauuauugaacaggauuuuauaugucuuuacacauuaguaagacaggcuaacauauaucauuaaauguuacuguuauuuauaagagguauuuauaagagguuuagaguauauuaugagaagcguacauuuaugaccuauaaaauacucugcaguacuaaggugauuaauuuucauuaaauguagaauuauauaagcccucucucucucucucucuugaggaaaggccccacuguguacccaggcuggccuagaguucaguuuuuagaugaggcuggagcucacagagauccaccugccugugcuucacaaggacuaggauuccuaggagucuuccuuggucugcuuccuuguccacccagccuucuugucucucuguccguccuuccuuccuuccuuccuuccuuccuuccuuccuuccuuccuuccuuccuuccuuccuuccuuccucccucccucccuccuccccccuccuucuuacucuuucccucccuccuucccucccuucccaucaauuuguauuacccaaagacucuucaaagugggacuugcccugaaguuaggguucucauccuuaaaaaaaauuacucucccucucccaacagcuaucaaaugcuaauagauuaucagcuuuugugggacuccaugcccaccuccccagcuucaugcuagaauuuugucuaguuuggacuuuuaugggucuuguucauacugucacaaucaaucacugaaaauccauuuguacaucugcccuuugugucuggaaaaugauguuucuuuguagucauguguuacgucuagcuuuuuaaaucaucuuccccucuguccugugaagauuccugagccuuugagaggaagggugugugauacugauguccccauuuaggucugaacacucugaaguauugcauucucuguaggcugaccaguugugcgucuguuugcuaacugccauccacugcaagaagaagcuccucugauggguacugaggaaugccacaguccgugugucuagccaaaauccuuaggauuuguuuuuacuaaacaaaguaaugggagcagcucuucccuguggcccaugaccuuucuagccacaggcuugcccugcuaaguaugguuucuauuuaacaggaugggucuuaaauccgaucagaauuuugguuacaacaaaaacauucaugccacuccugcaccagugggaauaucauccccagagagucauuguggcucacagggcucuaccguggguaacaguuuugauuacuuucccuuuugguaauggguacauagcacccugaaagcuagccaagguggauggagcugucaggccaacucuugcuggauuuuucauuuuauguaguugaagcguguauaguguauuuagcaguagggucuuaccaucaaguucuagagaugaacuaagagcacugacaguagcuuuuaauacuuagaugggcucuaugugucaacaguggagaacaacucaaaaggagaaaaccuguuuccagcauuggguuucuggcuuugucaucaucuucacgguuggcaucaucacuauuuugccaguguguuuucuaguugugauacuguccccacuauaggauagcucaguuuaaucuguuuuuguaugugucuauuuuaggaggcaucuauuugguaggcuucaauaugguguugucauggcuugcaauauuaguuuucccucccuauaguucuugccccacugugcccucccaucuaaugcccuucuaugacuaaagauugaacaguggaaauuacacugcucucaguauugcucugauagaaauguaaaaugcauauaauaaagauauaaaacuauuauuuucagugguucucauggaaaacggagacgucuauaccuuuggauaugggcagcacggccagcugggacauggggaugucaauuccagguagugaccaacuuuauuuuacuauacucuuuuuucccaucucccuuccucucucuccuuucuauaguuuaauaucucucugucuuugucucugucucugucucugucucucucucucucucgcucucucucucucuguuuacugaaacuacuacuacuacuacuacuacuguuuuugaaaaccuagcucuacaauuacuugaugguuccugguugggugcuuauaugagguagcugauuuguaguuagugugaacaguugauaagcauuuuauguaugagagugaguaggauuaccacaaaacccaaccauauucuuuacagauauucuuuuuuuaaucaaggcuucacauggcaauaggaagauagugaacauaccgaauuguauugcaaaauaaagcaaagaguuugcagugugacugggaguguagcucaguggcagucguuagacuuguaaaggcaggggcucacuccugucacugcagggggaggagaaggaaggaaggggguacuuacugauauuucugucuaauauuugcaugacauugaaaccugcuggucgcucugauauuuugacuuaccauaaauagcaagagcucaacuguuagagguaaguccuuuagcaauacucacucuucccuagguaaguuggugugaccaugugaagcagguagauaggaguagcucuggcauugugcuguucuuguagcugguugguugaauuuaugaaugcuggcaggaucuaagauguucuuagauaccaccauuuggaacuuacggagaauaacaaaacuacaaauuagaaauagcuuaguuuucugcacuauaaauugccacaccaauuccuuacaaauaauuucuuuaaagguaagaaauaauuuaguucaaguccuuuuuguuauggccuuuguucgguggcuaauacaugccucaauacagccagaugagcuuucugccaaaagugagaggauaucuguuuuuaucuuuuuacgcuuuccuuccuuccuuccuuccuuccuuccuuccuuccuuccucccucccucccucccucccucccucccucccucccucccuuccuuccuuccuucccuccucuuuguuuuuuucuuuuuucuuuuuuagauuuauuaauucauuuuauguaugugaguacacaguuacugucuucagacacaccagaagaaggcaucgaauccauuacaaaugguugugagccaccaugugcuugcugggggagaucuguuuucuuaguuccugucuucugugaaggaguagauaaggcaggauuggauaugcaugugauuuuuuuagaggaaaacccgaaaguuaaaagggguaguaacagaugcaaaaggucucacccacaggaaagagaacuaagaaaaauggagguucugcuguagcuuuuaaggguaugucagcuagagcagcaagguguuucugagccagggaaaauccuuugaaucaagaguccuaccuuagguacaaaaggcccacauguaugcauucaccauguuccaugcugauaguaucucaagaggcgaguggccuuauggaccuagagauuacagcucugugcuccugaaguagguuaucuuaacgaaaaucgaaguugcuuaugucuacauagagacuuauuuaucacuucuggagagucagcuuuaggucagcaguugaguuuuauaagaaccugcuucuacucugccucauuucucccuccauagucauaguauaugguugagucacugucagaaucaagaugacaucuacaauuucuuauuuauagcccuugaaagaaagaaacucuuuuucuccuagguauuaaauaaacucaacaguuuuaauuguguuaacucaccacacugcuguggcaugcauaucauagggccuaugauucuguaaagugucaacauuuuguuucucucugaaaguucaugguacauaaagguuuauuauaaguuaccaugacuguuacuaauaauuaccugguaagcacauuggagccuuauacagaaagaucauuguauuuagauaugauagaauugcggucauguaugaaguagagcacuuucugaaaaguaagacuugguacuggaaugucauuuugcaaauaaauacuugccaaacaacauacuuggaaaagaaagagugauaaucaugacuacucagauuccagugcuaggguuauuuuaacuauuguauaaugugaaaagguuguaguauaaaacaagauccuuguauuaguuuguuaagauguaaagucuguugaaagaauguuuauauugucuucuaaaaugaaaggguaccuaaaacccauguuucccugaacauuuuagucggcaccauccaugaauuuauaaugaguucccgaggaaagaaaaucaaaguaauaugcuuaguaguuuugauaggucaauuuguucaucuucaaggaauacugguguugaaacaaaauuauuuguguauuaaacuccaauaagaucuguuuuuaaugcauuaagcauuuauauguuuauuuuauguguaugauguucugucuacauguauguccauguaucacauguuugacugguuuuaccagaggaaaagagggagggagcuggaguuguaugugguugugagccacacugggccugugcuggggaccagaaaccaggucuuuugcaagagcaaugagugaucccaagugcugagucaucuccagcccugugcgaucuguuuuaauuucucaaaauuguccuuuucuagcaugaacaguuuuccuuaugcuuucaucuuaacuggguaacuuaaaggcucggggcauguuuauagcucagaaagccugcucaggucugggacugggaaucccaccagucccugagcucauuccaagcucaggacacggaauccuaccauaccuuuccugggaaucucuacccugggaaacuccacuccuaagaagcccuauacacgccugccuucuccucagcuugccgcuauuucuccuccucgcagaggcagcuagccgcuccugaguuuuccccaguaaauauuuugugugaaguuuuugugucgugugucuuuucuguauuccuugcauuccgacagccagaauaccuuucuagucagagcuguaacacuuguacauaugguguagcagagcuaaacugggcgacacagcagucugccuacaugauauccuuguggacuagaaauucauccagaccacuucuaauuuuaaguaaaccaauuuugacuuggagcucugugugacuugcaaaagauguuaauuuagacaugaguuuaucaauuauuuacaauuaucaauuaucaacaaagccucuguagcacgcuuauuaccacaaaaacaaagcaugaauagauguuuaguuaacuugacauauguaguugaaugcauuuuaaauguuucuaguaaccaaauauacauuauuaguuaacacauaauaaaauauguugacugauauaaggagacuauuauaguguauauauagugguccaauauggaggagauauuauugccagcuccuuccguaagucauucuguccuaaggacuuaguugacuguucaggcaggguuuuuguuuguuuuccccauuuaguagcugaucauagucaaguuuuugagcugugugccugagguuuugcucuaaguaggauucaguguaucucccuagaugcaugugugggauuccagagaugauuugggucauggacucauugugcagcccagccuguaacaaguguuaaguaaaagcacgcauuacuguggaugccuuuugguaauuuaucuguuagagcuauaauagccugugcuagagccaagccuggucuuacugccuugauuguuuucuacuacacuaacaccauucuucguguauuucgaaaauaaauguuggaaggcuaauaagacuuuugugcauucauuccugaaaagggucuauuaggauuuuaaaauucaaaauuuguuuuguuuuguucauugugcucucaaguuucugaauuccaaauuaauuuaccauucucuguagccuuaaagucagacuugggaauuaauuauggaguucuggugcuuuguccagcaugcuaauguaucagaauuuuaccuuucucuucuuguccuuguauccagauauacuauugauuauuaugucugaaagucuuuagacaagggucacgucccugcuucaccaccucccauaagugcucugauugucauuucuuugagcucuaguuuucagguccugucugacauugcagaauuuauauaauuuauguagaguacauggaaugcacauauauauacacagguauaauuuuuauuuuuuguucuucucuuuuuaaauaguuuaguaaaugaacucaugacuaccauagacgaaguucaaagaaccuauucugcaaguccugcuuaucuuuggucucagauucccagugcuccuacugaaaaucagugggaacauuucauauguccgugcuuuuugaaccguccccguuugcauugaaguagauguucccaugaggacauuaauucacaaggcacaccucuaaagugacacuuguucacuugcccaaacuugcuguccccagaguugagaaucaaccuuuuucacuguucuucccauucauaugacuguauucucuagaugaaaaccaagugaaaaacuauaucuagcuaucuaccuaccuaucaucuauucauuuguuuauaggcacggccuucuguuuuauuuuccuuuuauugccugccuaugcagauaaauuuuugauuauuugaaaauuuaauuugguugacagugguuuuaauauauggucuuauugugguaagugacuuaaguauaguguaaaggguccuauauggucuuguuaccuugguacucauaaaguggugaaaugcacacacaugcacccauucacacacacaucuuugaguuuaucauugcuauacuuucuacagccuuuauucuuagccuuuuucacuuuucauuuuauuucuuaaucaauuuagagacuauuucauuuuuuuucacucuguacauuauguugcauaaauguaucagucugccuguauuuuucauaacuauuguuuaagaacuuguaaagauuuaaaucaccauaucuauauagacaccauaucuauauagauaccauaucuauauagacaccauaucaucuauauagacaccauaucuauauagacaccauaucuauauagacaccauaucuaucuauauagacaccauaucuaucuauauagacaccauaucuauauagacaccauaucuauauagacaccauaucuauauagacaccauaucuauauagacagauaccaugucuauauagacaccauaucuauauagacaccauaucuauauagacagaugccauuucagauucagcucaugccucugcagugagugcaacucugcuuuugcauggcuuuuuaguuguuuucauuuauuuuuuacaaacugguuuaagauauuuugagaauuugauaguaaacauucuugucaggaaaaaauagaauaaaauuucugagaaguauuacugguaagucccaagcuuguuaacaagcuaaaagguuucucucagcuuuccugaagcucaguugugaucuccuagaaaggcugaugaucugucucaguugugagcucuuucaguccucagcuagguguccaucuguucuguccccaacagcugagcagauucucacugugaacuguucuguucgccagucccuuuucucagcacaggaucugcauaacacaucacaacaaaaauaaagacuuaugaagcaggauaguuuuucguccacuaaccuuauaaccauauuuucaacuccuauuauccccuccuaccccugugagaugugccuucaccauucccugagccuccugccucagcaugucugcaggaucuaugcagugcuguucuuagcuccgucugaccucugaagucugucugucuauuuuuuugggggggaugggggggugcggaggugguuucaagacaggguuucucuguguagccuuggcuguccuggaacucaguuuguagaccaggcuggccuugaacucagaaauccaccugccucugccucccgaaugcugggauuaaaggcgugugccaccacgcccggcuuuuuaauguguucacccuuccucagauuugccaucuuaaauggagugcaccuguccugcagcucaguuuuguuuuuagcuguuuguucuccuuuguuugucccuuuauuccuggucugcgugaagggacugugccucuuucuucuccagccacacugagcacuucaguguuuugcuugcucccaguggcugacuuuucugccucccugccuuccuagaguguuggcaagcaucuuguuugucccucugggaauuccuucaguaauucuucucauucgaauuccuaagacucuuuucuucugccccucugaauuuagcugcccagauccauucuuuuucuuagaauaagcaguuguuucuaucaucuacuuuuuguuuccuuuccccauacuugacaauuuucuaaggcugaagauuauaaaaucaguuauuacaccuaguuccgaaauuaaauuucuguuaagauaucaaaugcgaacuagcucauaguagauuucuccuguuuaauaaagguaacaccuauauaucugaaaauguacaaguuugugucuguuguaguccuuaucuagcugucaaauauauccaucuuuucacaacacaguaucccuaguucauauuuuuaugagaacauaccauaacuucugugauucuaguugggagccuugcuccuuuccgagucauuuuuaguuauauucuaauuuuaguggauaaauuguacauaauuaaagaaaaugcaaaguauaauuugaucuuacugugugcguuguacuuucuaguggauauuuuuucaauuacagauaaugguuacuaaaaaugguuaauaacauaguuuauaaaacuagauaaggauacuaggauaucauuauccuaacacuuaacauuaauuauguguuuacuaugugucaggcaugggcccaaacacuucuuaauuguuuccagaagcaacaugggauaaacacaguuucuuauuauucucuguauuguaguagaaaaacugaaacacaaugaaugauuuggucaauagccucgucucuugcccugaaggaguaggacucaauccuagcugucuuacucuagauccugagcgaacagcugcugcugcagagcuccucauugugcaagcucugaguucuuaacuaguacuuuaccaucgaugugcugacaauuagaacagaagauuguaaaguuauuucaucggguuccugaauugaguaccugcugaggacccauguaccacuuacuguacaagcuaaacugauuucuccucuuaaaguuggcgcccauauuucugaaaagauaaaaccacguguuuacgguuagguaguacaagaaucuuuccuuaaagucauuguccgcuuacccagugccucgcauggagacgggugugucacaccgaaacaagugauugcugaguguaccuacuagugccuugaccuuuucaacuccuuauuuuacuguuauauauuguuuuauauuucaguugacucuuguaagaaauugacuuauuuuuuucuuaaaccuaggggaugccccacucuuguccaagccuugccaggcccuagcacacaagucacugccggcagcaaccacacggcaguccuuuuaauggauggacaggucuucacauuuggaaguuuuucuguaaggaaauuuuaaaacauuaauaauauuguauuauacaauugccuuauaauuugcuacuuuagcuuuuuuuuucugguuccaguaaaauucuuguauuaagauaauuacauaugcauauuuccuuccuaccccaacacacacagcuccugagugacagauuuucaaauaauuuucaucucuaguucagcauuagaauuuauugaauuuagugauuguauuagaauugaacauguuuauugcaaaucaacagcuucuaagcagucaguggggcugaaucgaccacuuaaagguguuucucaucucauuuauaaagaaauaaaucuucuuaacaugaagaacuauuucuauuuuagaauuuuggaaaguuuagaguuuaaucuaauuuauggcucuugucuuuuugccuaucaucaagugcaaaauuacuuuucuuuguccucucccauucuguuuguuuauucaucucucucauugccuuucccaaaacuguuuucuauaguuugauuuagugaauaugaaggaaaaucucccuaaggcucuguuaguaaguuuacacuguaugaggugagaacguugagacggaacuccacaauguuugucucuuuaagugugugaguaaguuugaaugcaugaacaugugaagugcacaugccagcacagaggugaaggcuacaggacgaccuugaauguuacgcuucagggccuaugcaacccuguuuuuugagaaauaauuaaaauguaaaauggagauagucuguugcaaaaguuuaggcuuggcgacaggauccuaaggaccacagagcaucugccuucaguuuucugcuugccuucuucccuccuccucucuucuuccucagccccgccuccucuuuuucuucuguuuuugcgaugagcuguuucagaaaaagcccuuacuagccuagaacucuauguagagcaaucuggaaccaacucacagaaaucuaccuguguuggcuuaccuccugagugcugagauuaaagccaugugccaccaugcucagcuuugcuuugugcuuuuccccauagagagcuacugccuccuaauaagauggaguuucucaucccaguugacccaguauagaaacuugguucacagaugugcccagaguuuugucugcaaauugaucguagauccugucaaguugacaaaauagcugccccacuccaucaguucacgcagaccuuaccucuccuuuguuauaggcuuuggagcaauuaaaaaaaaaaucuuuggcagguauuuuaauuuuuuuuucaggacauucacuauguauucuggccgugguuaucugauguuucaaugguacuuguagagaauaagacauaaaaaauguaacuuucuuuaucuucuaauauucuggacauaucuuggcacauaaugcuuauauaguuauauuuucuuacauauccuuuucugguguuaguaagauaaggccuuggguucauaauccuucugccuuagacuucugaauucuaggguuacaggccuccuguaucuuaccugguuacgauuugguuugcuauuauuuuucuuaaggaacccaaaaggaagaggccaauguuguucuuccucaucuaggucucuauuuaaucauguuugauaaucaaauauuaaccuuuuuaaaacuuuaacaucguauucucuuuuuauuucaugaaaauauuuaauuaauuuauuuuuugagauuauaaucauaccauauccuccgacccuuuucugccucuaaacuuuuaaauaaaaggagaggaucaugagaguaaguaugugaauguucaugaggcaagcacguguuuaaugaagcuagacuuuauuauguuugucugacuucugaggauucggaacugcuuaugccuuaggaguuuuuaugucacggugccaggccugcugcccagucuacuagaguuccucagagauagcugacacuuaccgcaucugcacuccacugugugucuauacuauaauuguccaguuucuuacacuuggauauuuauguacuuuacauuuugauuacauaauaauuuuauuagaaggcuaucuuuuaguuuaacuauaagaagugagaauuuugggucaaaaguuggugggucaaaaagccuugguagguuucugagugcuaacagucucuuauuuuuaagcugcaugugagaguggcuuucucgaaagcuuugacaacagaaugugcuguugugccuuuucauuggcacugaucugauagcugaccaaggaucugcucgcuuucaaguuggugcuaugaacuaagugucuugaccuauuuaccacauuccuacuaagggucugcuuuuaucucuugaaggacaacuaucccuuuuccauguccucucuauucaguccuccucuuuauccuccccuguugugccuccgggacccuuaggcuuucuggacagaucagaggaacgcaggguauugguuuucucugguuucaagucaagauuucuucagaauccuaguacaguuaaacguuuaagucauguacuuauuuaucuguucuguuggcucugugucuuuagguggguaaugugacucagucauuaugguuuucuagacuaacauucuaguugcagauuucuguggcuuuauguaugucugacuuuucaccacacucuugggucccuaugggguugucuagguaucucacuguuuuucuucauauuuguuggguggugguaaggcaauccaugcuuauuuuaauugucagucugucugucuuuuccucccagaacagaauauauaugaauauugugugcuucuuucauuguucaccuucuaaugcuuuuuuuuuucuuugucaaaaaaaaauggccauugaaaaaggcuaauuagcuacuucucuuauuguauaaugucuucuccuucacuagguucucuuccuaggggugaggcuuagcugcaucuguaguuggccuguuuugauuucuggcuaugauguugaaggaguagaccuuuucuuaggaaccuggcaauuguguggggacuugaguguuugcaguagccuguguuaccucauugcuaagguguugcuuuucuguccaugcuuuguugguuauccucauuggugagcuuguguuaagugguucuggggccacgagguaguauuuucucuccucagggguuucugaaaggagagugaugugagagacugcucuugauccacaugagucagugucaccuaauccagugucaguguccuuuuguagugagaaacccccuacuucuuuugaaaugcauuuuuagcuaacuaccuaccuuuaggcagcuauacuuuuuaagugaguuaacauguuugaaacacacaccuuauuccuacuguuuaucuuaaaacauaaaugaaauaacuuacuaaaacuuuacauaaaaacuucauugaauauuuuucuaaguuuauucucaguuccaaacuuaagucuuaucacaaaauguccugacacugucugugauuaagaaugacuuuguuuuauacuguaacugaaaaugucagagugguuguuuuggaggaguccuuuguggcagugugcuucaggcauuguauauguaagauacuuuaaauuuaaaaauaggugacuacagaguauuuuggaagcauuccuuauauggaaaauacuucaacuaauacaaacauauacuuuauguauuguuaaaaggagauuaucuagaaauaauagaaauuauuacuuuuaagguauuagguccaaauuccacauuuauuuauuuaaaaaacuaaaaguucauaaaaauaugaucucauauaguuauguagauuauccagcaauaauacuaauaugauuuauuuaacuuuuagaaaggacaacugggaagacccauuuuggauauaccauacuggaaugcaaagccagcucccaugccuaacauuggaucaaaauauggccggaaggccacuuggaucggugcgaguggggaccagacuuucuuacgaauugaugaagcacuuauaaauucucauguacuugcaacaucagaaauuuuugcuagcaaacacauaauagguaaauaucuugucuuucuaaugagauacagcuguaucuuuuuaugugcgugugugauagaaaaauaauagggauauuuaagaaccagaguauucauaauccaggcaauggcagaaccaggagcuguguuguaaauggaucagacuuauauugucaugagugacuuucuacauugaaucuuuaaauaaauaauugaaauuaauuuuuuuugagagauuauggugacccaaccuauacccaugacaauaaauuucacaguacaggcauaacaagaacauuugucacagacauagucagagguguuuucaugcugucauuuaaaaaagacucuguuuaaacuuauuagacauauaucagcuucuguauguaugaaauuguaauaauacuacauuccuugugggcuuggaggaauguauaaagguaaugcaaaguaaaauuauauuuacuuauauuuucauaaggccugguuccugcuuccauaucagaaccuccaccauuuaaaugucuucugauaaauaaaguugauggaaguuguaaaacuuucaaugacucugaacaagaagaccugcaaggauuuggugugugucuugauccuguauaugaugugcuuuggagguaagcaugugucuuuauaaaauacaguauccauaaaacaaacagaaacggaugcuacagaauuuguuucuagguuucuucacaaaguuagaaauaaauguuuaacagggaguaacugugaugguuuguauauguuuggcccagggaguggcacuauuagaagguguggccuuucuagaauagauauggcacugugggcgugggcuuuaagacccucauccuggcugccuggaagccaguaguuuucuggcagccuuuagaugaagauguagaacucucaacucuucuugcacuauaucugcccggacucugccgugcuucugccuugaugauaguggauuaaauaucugagccuguaagccagccccaauuaaaugcuguccuuauaagaguugccuuggucaugaugucuguucacagcaguaaaacccuaacuaagacaauacuuaucuguuagcaaacauucuagauuauuuuuaaaguuauguuuuccuaggaugcuucacagaaccacugauaccuaccuuagaguuacaucacauaaaguaaacaaaucuuugugcugugaccuuuaagaaacccgauugcagggcuggagaaguggcucagggauucagugcuccucuugcuccagguuccagcauccucauaaggcuuaguuuauagcaauguguaacccgagcuccagggauuccgcaccucuucugagcucuguaggugccugcauucaugugcaucuaucuacaccccagcacacacacacauacacacacacacacacacacacacacacacacacacacauaaucacuuaaaauuauuuuuuuauaaaagaacaagugaaauugccgggcuggugagaaagcucagugaguuaugacauuugcuggagauaucaaaguagguuauaacauuuacuguuauauccgacaaguucuauucuaaguuuaucccaagggacacacaugguagaaggagaagcagcugacucuuacaguugucuucugacauccacauuccacugugucuacagauacaaacaaacaaauuagaagguuuuuuuuagaaaaaaaaauaggauuacugagucaaaaguagucauagacuguaaaacuuccucuuaauacucacauuuaaguauuuuauugauaauuuuuagcaucuaugcuuaugagggaaagcauaauuuucuuucuugguaauuuucuuuuuugguuuuuuuuguuauucuuucuauuuauuuauuuauuuauuuuacacuccauauuuuauuccuuucccccugucccuacuguuccaaaucccauaucuccuccccaccccccugucuccacguggaugcccccaacccccaucccaucugaccucuaaacucccuggagccuccagucucugaggguuaggugcaucaucucugaaugaacacagacccggaaguccucuacuguauguguguugcgggccucauaucagcugguguaugcuguuuggugauccaguguuugagagaucucggggguccagauuaauugagacugcugguccuccuacagaaucgcccuucuccucagcuucuuucagccuucccuaauucaacaacaggggucagcuacuucuguccauugguugggugcaaauaucugcaucugacucuuucagcugcucauuugaucuuucgggggacagucaugauaggucccuuuuugugagcgcuccauagccucagugauagugucaggccuugggaccuccccuugagcuggauuccacuuuaggccugucacuggaccuucuuuuccucaggcuucucuccauuuccaucccuguaauucuuuuagacagaaacaauuaugggucagagaugugacugugggaugcgccucccucccucauuugacgcccugucuuccugcuggagguuacgcuuuugguaugagaguaguuaguucuggcuuuauaaagaguuuggaagaauuccuuucuuugucaucuuuuggaaugauuugaauauaauuaguauugugggguuuuuuggggggguaagggggguugguuuuuuugagacaggguuucucuguauagcccuggcuguccuggaacucacucuguagaccaggcuggccucgaacucagaaaucugccugccucugccuuccgagugcugggauuaaaggcgugcaccaccaccgcccggcuauaauuaguauuauguuagauuuucucugaaagucuuguugaauucugcugcgaaucuauuugguccuggccuuugauuuuguuuguuuauugauggauugauuauuaagcaauauuuuauuacugauucaauauuguuagaucuauaucuuuguaaauuccuucuuucgauuuguuuaaauuguuuauuuucaguuauucauuuaaauuguugcuucauuuugguagaucucauguaucuagaaauucaucaauuucuuuuauauuugucaauuuguggaauauagguuuguuuuaaaguguggccuuaugguuuuuguauuuuauuucuauauauugucauauaucuccuuucaucucuauuuuucuuaauuuagauauucuuucucuuuugguuaguuuugcuauggauuuguuaauguuauuugucuuuucaaagaaccagauuuuuauuuuguuuucuuuuagucauuuuuuucuauuguauuaauuucugcccugauuuauuuauuuauuuauuuauuuauuuauuuauuucuguccacuucuuuugguuugauuuguugcaaggccuuaaggugcaucaauaaauuauugauugaccaucguuuggcuucuccaagcaccauguacucacauagaaugcacacacauacagacacacacacacacucacauaugcagggaacacacgcauacauauacauuuaaacauuuuuuaaaagauuggaaaaagugcugcaugaaagggcauuacuacccuuaguaguacagcagggcacaaauaggugacucugaauguuuagauacguaaaggauuuaaugugaaaucuaaaggaugucauaaggaaguauuagcaucucagugcaggcacuagagaaggugaaggaaaucagcacugcagaagaaaugccuaaauauuuucuagaaacaaggagauuuaaauccucaaauacuaaaaacuguacuuuugauuaucugcagucaaaagaauguauugcuacaauagaacaauaaagaucagaagauaguuauuaaaucaaccagagagaaaaugauuguguagaaagaagaaaguuacauuaauaacaguuuucaaauguagugaugcaaugauacucauauuaauuauagaagcuuuuuuauauauuuaucguguuuagaguauuauucuaaccaguaccccagagcucgugucuccagcugcauauguagcagaagauggccuagucggccaucaguggaaagagaggccccuuggucuugcaaacuuuaucugccucaguacaggggaacgccagggccaggaauugggaguugguaguuagggaagcagugcaggggaggguauagggaacuuucgggauagcauuugaaauguaaaugaagaaaauaucuaauaaaaaauuuuuagaaaaucuuuuuuuaaucugugggacaguugcagggagggguuaaaggaggaaaggaaagggaaaagugagauaauucuauguuaauguauuguuuauuuuuuaaacauuuauuaaucuauucgauuuaaaaauacaaaagcuuaaagacaauacauuuugauaaaaauggaacauaggccuuauuguccuuuuuuaaaaauguguagauguauaauuuaaaauauucggauuauuaggcuauagaguucuugagcauuuucauugugcuaaaaugaaacucuguauucauuagauaauaacucucacuuagucuuuuccuaaccucuugaggaauuaccgugagucggauaaucagagacuaaugcaggaggacacugagacuugacuuccauccaguucuaaucggugcuucacugcuguuuauuucucuguguccuaggggagccauccauagcauuugcuccuuuuuugcuacuguauugaucuucucuugcuguuuuacaggugcucauacacauuauaaguauuauaguuuuguuauauauuucuuaucaaaugauuuugguauaagaaauccuuacuuuuauguaugcaucaaauuuaaguauauaauugcuaugguauuuacaaaguuuuauaauguauuacuauuuucagauguuguaguuuuuguaguaaauuacuuuaguuauguauuuagcuuagcuauguauuuuccuauguacacuagcaauauuauuuauuuuauagucaauuucaauuuagaaauuugcaaaguaauucaaaguguuaaagugcuguaauuaucuuucuccauagguuucgaccaagcaccagagagcucugguguuacaaucaauuuagaaauuugcaaaguaauucaaaguguuaaagugcuguaauuaucuuucuccauagguuucgaccaagcaccagagagcucugguguuacaaugccgugguugcugaugccagacuucccucugcaacagacaugcaguccagauguaguauucuaaguccugaacuugcucugccaacaggaucaagggcucuuaccacccgaucucacgcagccuugcauauccuggguacggcuacccuuugaugucagcugaauggcauucuuguaugcugugcuaauagucaggauuuuuuuaauaguuaaauuuguaugucuugccuguuaaauaauaauggauucaagucacaaaauaaauuuaauuaccuaagaaguuuguccucuaugaaaugguacagaaauucucaaacaauaucaugaaagaucagugaaugccuaacuauaaagcaucccccaaaauuuaauuuucuuaauaaagugaaaaagaaacuugaacacauaaauuuuuagauauauagagauaaguuuuuauaguauuuaaguauaucuuuauuuaauuagagauacagagcuuuugagauuaacuaguugcuagguuuuuuuucuucuucuucuuuuuaaaucaguccacauucauaugccuucuguugcuuuuagaaaaucucauuuaagagcuggagagaugagucuauggauaaaguuugccuuccacaugucaugaccagaguucagauuuauacuaauuaauacagcauucauuaauaacaucggugugauaggacauuuucacuucaggguuugaauuuuacuuguugauugccuuagguugucuugacacuuuggcugcuaugcaggacuuaaagaugggcauugcaaguacagaggaggagacccaagcagugaugaaagucuauuccaaggaggacuacaguguagucaacagguuugaaaguauguaugcugagacuuagcacacgcucucuacucauagaaacacaggcagcuucuaaaccucaugauuugcaucuuucaggucauggcgggggcuggggcuacucugcccauucaguagaagccauacguuuuagugcugacacugacauuuuacuugguggucuuggccuguuuggaggaagaggagaauauacugcuaaaauuaagguaaaguucacgauacuguaacuguuucaucggaagacauuuauuuggccuaguugucucauugcgcauuuucuuuuccccuuuucccuuggcuuguuuuuaauggauccuuuagagaaaggaaacauuguuaaacucuuacucaaaaaaaaaaaaaauguguacaaaaggagaaaaugaguuuucagaauugaaaauugaagaaggcuuccuagccaaugucacugguuugugcugagcuuccaagggguuaguuggcuggaguguuguaugugguugccuucccagagccgguuuaguaagaggguacaaaucuguucuauauggaaaagucuuguacgcuuuuuguugucaguuauuauguaaacaggcacccuccacacucauccacaugggaacuagggaugaagugagaugauggagggaucugucuuguaugaaaguuuaagccggcccagugugcuggcacaggcuuguaagccuagagacaugggaggcugagcaaaagacucauggugcgcucaagacuagugugcuaguuucgggcuauuucccacaccugcuuaucuccugaagaacuagcagucguuguguggagauuaccugucuguuuuuuauuucuacuuacuaguauggacacacugugucuauaggcaucuguuucuucacuaagaaacucacacugcaaguucugaccuaauuccaguaucauguuuugcaagaaaguuuaguuuagucucuuuugugagagguauuuuuuuuagaucauucuauaauaccccaaaucuaauauauuaaagcuuuuauuauuuuugaggauaauguacauaaaucucaaccagaacugaaaacuuaaaaauguuuacuuauaauguugauguuaguauguacacuuuaaauuuuucagacacuauaggaaugaauuugguaaaaguuaaaguucuuagaguuauagaaaucaucugaauagaauaaaaguuaagaauaccucuagcagaggacaggggucuguccgcccgucccgggagguuuugccucaggaucugcgggagccaucuuggcucugggaccccgcagaaaguugucugcacagaugagaguguggacuacugaaauuaacagcuucugggacaggccaaagcagcacagcuucugggaaagguccuguuuuggcccuucaucuucagccaggagguccaaacaccagauaacuaagcaccuucccuguaagaggugagcuugccugcagagacugcucuaacuacugaaacucggaggaaagagcuagucuuucaggucugcugauagaggguaacagaaucaccagaggaacaaucuaaacagagaccacuauaacaaguaacuccagagauuaccagauggcgaaagguaaacguaagaaucuuacugacagaaaccaagaccacucaccaucaucagaauccagcacucccacuugacccaguccagggcaccccaacacacccaaaaagcuagacuuggauuuaaaagcauaucucaugaugaugguagaggacaucaagaaggacuuuaauaacucacuuaaagaaauacaggagaacacugcuaaagaguuacaaguccuuaaagaaaaacaagaaaacacaaccaaacagguagaaguccuuaaagaaaaacaggaaaacacauccaaacaggugauagaaaugaacaaaaccauacuagacccaaaaagggaaguagacacaauaaagaaaacccaaagugaggcaaugcugaagauagaaaccuuaggaaagaaaucuggaaccauagaugcgagcaucagcaacagaauacaagagauggaagagaaaaucucaggugcagaagauuccauagagaacaucggcacaacaaucaaagaaaauagaaaaugcaaaaggauccuaacucaaaacauccaggaaauccaggacacaaugagaagaccaaaccuacggauaauaggaguggaugagaaugaagauuuucaacucaaaggaccagcaaacaucuucaacaaaauuauugaagaaaacuucccaaaucuaaagaaagagaugcccaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuguucaccagagacuaugaaagccagaagagccuggacagauguuauacagacacuaagagaacacaaauuccagcccaggcuacuauacccagccaaacucucaauuaccauagauggagaaaccaaaguauuccacgacaaaacuaaauucacccauuaucucuccacgaauccagcccuucaaaggauaauaacagaaaaaaaccaauacaaggacgggaaccacgcccuagagaaaacaagaagauaaucccucaacaaaacuaaaagaagacagccacaagaacagaaugccaacauuaacaacaaaaauaacaggaagcaacaauuacuuuuccuuaauaucucuuaauaucaauggucucaacuccccaauaaaaagacauagacuaacaaacuggcuacacaaacaagacccaacauuuuacugcuuacaggaaacucaucucagagaaaaagauagacacuaccucagaaugaaaggcuggaaaacaauuuuccaagcaaauggucugaagaaacaagcuggaguagccauccuaauaucugauaagauugacuuccaacccaaagucaucaaaaaagacaaggaggggcacuucauacucaucaaagguaaaauccuccaagaggaacucucaauucugaauaucuaugcuccaaauacaagggcagccacauucauuaaagaaacuuuaguaaagcucaaagcacacauugcaccucacacaauaauagugggagacuucaacagaccacuuucaccaauggacagaucauggaaacagaaacuaaacagggacacagugaaacuaacagaagugauaaaacaaauggacuuaacagauaucuacagaacauuuuauccuaaaacaaaaggauauaccuucuucucagcaccucaugguaccugcuuuaaaauugaccacauaauuggucacaaaacaagccucaacauauacaaaaauauugaaauuguccccugcauccuaucagaucaccauggacuaaggcugaucuucaaaaacaaaauaaauaauagaaagccaacauucacauggaaacuaaacaacacucuucucaaugauaccuuggucaaggaaggaauaaagaaagaaauuaaggacuuuuuggaguuuaaugaaaaugaagccacaacauacccaaacuuaugggacacaaugaaagcauuccuaagaggaaaacucauagcucugagugccuccaaaaagaaaguagagagaacacacauuagcagcuugacaacacaccuaaaaggucuagaagaaaaggaagcaaauucacccaagaggaguagaaggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuagagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaauuaggaucauguugaccaucuaaacagucccauauccccuaaagaaauagaagcaguuauuaauagucucccagccaaaaaaagcccaggaccagauggguuuagugcagaguucuaucagaccuucaaagaagaccuaauuccaguucuucacaaacuauuccacaaaauagaaacggaagguacucuacccaacucauucuaugaagccacaauuacucugcuaccuaaaccagaaaaagacccaacaaagauagagaacuucagaccaguuuccguuaugaauauugaugcaaaaauccucaauaaaguucuugcuaaccgaauccaagaacacaucaaaacaaucauccauccugaccaaguagguuucaucccagggaugcagggaugguuuaauauauagaacucaaucaauguaauccaguauauaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaaccaauagccaacaucaaaguaaauggugagaagcuggaagcaaucccacuaaaaucagggacuagacaaggcuguccacucucgcccuaccuauucaacauuguacuugaaguccuagccagagcaauuagacaacaaaaggagaacaaggggauacaaauuggaaaggaagaagucaaaauaucacuuuuugcagaugauaugauaguauauauaagugacccuaaaaauuccaccagagaacuccuaagccugauaaacagcuucaaugaaguagcuggauauaaaauuaacucacacaagucaauggccuuucuguauacaaaggauaaacaggcugagaaagaaauuagggaaacaacacccuucucaauagucacaaauaauauaaaauaccuuggugugacucuaacuaaggaagugaaagaucuguaugauaagaacuucaagucucuaaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaagggcaaucggcaaauucaucuggaauaacaaaaaaccgaggauagcaaaaacucuucucaaggauaaaagaaccucugguggaaucaccaugccagaccuaaaacuguacuacagagcaauugugaucaaaacugcaugguacugguauagugacagacaaguagaccaauggaacagaauugaagacccagagacgaacccacacaccuauggucacuugaucuuugacaagggagcuaaaacccuccaguggaaaaaagacagcauuuucaacaaauggugcuggcaaaacuggugguuaucauguagaagaaugcgaauugauccauuucuaucuccuuguacuaaggucaaaucuaaguggauuaaggaacuccacauaaaaccagagacacugaaacuuauagaggagaaaguagggaaaagccuauggguacaggggaaaaauuccugaauagaacagcaauggcuugugcuguaagaucaagaaucgauaaaugggaccucauaaaauugcaaagccucugcaaugcaaaagacacugucaauaagauaaaaaggccaccaacagauugagaaaggaucuuuaccuaucccaaaucggauaggggacuaauauccaauauauauaaagaacucaagaagguggacuccagaaaaacaaauaaccccauuaaaaauggggcucagagcugaacaaagaauucucaccugaggaauacugaaugccagagaagcaccugaaaaaauguucaacauccuucaucaucagggaaaugcaaaucaaaacaacccugagauucuaccucacaccagucagaauggcuaagaucaaaaauucaggugacagcagaugcuggagaggauguggagaaagaggaacacuccuccauuguugguggaauugcaagcuuguacaaccacucuggaaaucagucuggcaguuccucagaaaauuggacauaguucuccuagaggauccagcaauaccucuccugggcauauauccagaagaugucccaaccgguaagaaggacacaugcuccacuauguuuauagcagccuuauuuauaauagccagaagcuggaaagaacccagaugccccucaacagaggaauggauacagaaaaugugauacauuuacacaauggaguacgacucagcuauuaaaaagaaugaauuuaugaaauuccuaggcaaauggauggaccuggaggguauuauccugagugagguaacccauucacaaaggaacucacacaauauguacucacugauaaguggauauuagcccagaaacuuaggauacccaagauauaagauacaauuugcuaagugcaugaaacucaagaagaacgaagaccaaaguguggacaauuuguuccuucuuagaauugggagcaaaacacucauggaaggaguuacagagacaaaauuuggagcugugacgaaaggauggaccaucuagugauagccauauccagcgauccaucccauaaucagcuuccaaauucugauaccauugcauacacuagcaagauuuugcugaaaggaccccgauauagcugucucuugugagauuaugcuggggccuagcaaacacagaaguggaugcucacagucagcuauuggauggaucacagcgcccccaauggaagagcuagagaaagcacccaaggagcuaaagggaucugcaacccuauagguggaacaacauuaugaacuaaccaguacccgggagcucuugucucuagcugaauauguaucaaaagauggccuaguuggccaucacugcaaagagaggcccauuggacuugcaaacuuuauaugccccaguacaggggaaugccagggccaaaaaaggggaguggguggacuggggaguggggcgcguggguaugggggacuuuugggguagcauuggaaauguaaaugagaaaaaucuuaauuaaaaaaaaaaagaauaccucuagcacaucugcuuauacuaaaaccacaguaguuucaggcuguguguauuuuaguccaccaucuucagaaugguucagagugguuugacucagugaaucagugagucguggaguucaguagcuaauacccagccaacucgucaggaugauucacauggaacggcugauuuauauuuauuaguacauuugcauagcauccaccaagcucuucaagaugauguauguuucucccuugugccgaaagaguuuuuuugagggguggaauaucacaguguguuucugcccuaugacugaagaaggcauuagagcagugcuucucaccuccugaugcugccacucauucaucuagugccacagcuguggugacugccagccuuaaaaguauuuuuuuguuccuucauaacuaauuugauaguuaugaaucgaauguaaauuucugauauucaggauaucugacaugugacccacaaauugcuuguggcccacagguugagaaccaaugccuuaacagaacuagagucuaucagaauucccuggaacacgucugauuucauguaugcuuccugugucacuguccucuguuuucuagcacuugcuuguuucucagauaggucaagcaaugcagcgucaggaccuugguacuuguucuucucucuggcuacaacucuuccugcacgucucacuuccucauccccuuugaccuugacucugaugaguccacuuaaaaucagucacuuaaaauccuauucccugucacaaacauagacugauaucucuuuuugcucguuuuguuuguuuuuuuuuuguuuguuuguuugcuuuaaugaucuguauuuuuuaacuuacgguuccuaaagccgugacuggaauguuguaugaguuuaaaaguguuuguugaguacaauggaagagacaaauugugagaucaucucagaaaagaaggaaaagcacugaacaguuuuacacugggauauucuucucagauacucuuguuacugaguggcagugcacuugugacgcaugugagggcccgaguucauucauucccacuacaaaagauaagagacaagcuauuguauauaaguugaauuaguucaggauuauuaaaauucucagccagaaguaagaguguggcugagcugacagucuuuuuuuacugcugaagacgagacacagugacgucagggaaauggaagcauaugcuuuucugugggcaguggagugaaagucccugcccccguguacagagugaggcuggcaagaaggggccagugaucacuuuacuuuagaacaaagaauacuagggucgcugggagagagacucuguaaaguaugaucauagaaacagguuucuaggcccuaggguauaguugaaaauuugaaauauaggcuuaguaauguucaguaauuuuaaugucuuaucugcuguuguugcugcuuaccugcuauaacucucuagaaauaaauguguuuacaaauguuaguccauuuuucuuagaaaauguuaauuaaauuauaauugcaucacucccucuaccuuccuggucucccucaaaucccuuuuaggacuccuccucccaaccccucccauguugcccuucacuccuucucaaucucuuuauuauuagugucacauauagaaaagcauaaauauauaaauauagucuggagucucauuucagggcugaaagcuuuguauuagguaagaguuuaggggcuuguaucugaaaagucucauucucauauuagcccaguuuuuaaaaagaugucuuugcucaugauuucuuuuuccuuaccuagagucuuagccuaucuauagccuuuauuucaagguuuucgucucuucucuuuccaugcugcuuacuaaacuccuuuuugcuaucugaauuuuuuuuuucuuuuagaaccuuaaugugacuuuucaauuccucuguaguaauauuuuuauaaucuuuuugugcaagguuuuuguccaaggguuccacaaauauccuuucauuugauuugcaugaucacuacaggauggacauuguuaguaucuacuuucuuuuuuaugggcgaggaaacuagaccccagaucuucacagcuuuuaaguaaugagauaagagucugccucauuuagaauuucugaguugaaaugcuuuaaguuuuuucaaaauccuuugaaauuuauauuccuacuuuaucauaucagguacaaaauuaauaguauagaacagaauugauacaucccuaaaacacuguauaauucuuauuuuaaaugcauguauacuaauauaauuuauuuagcuauugaauuuaauauuuaacuuaguaauuauaauuuaguagauaagaguuuuauauaacuuauagguuaguuauacuggacaugcacaaaauuauaaauuuggugcacaaaacugaaugauugggaacaauguguuuuuucucuacucuagcuauuugaauuggguccugauggaggagaucaugaaacggauggagaccuucuugcagagacugauguguuggcuuaugacugugcggcuagguaaauguuuuccucguuuuucacugaaguuuuuacacauuugaaauaaaaauuuuauuuuauuuuaauuuaauaaacauuuuuaaaaggaaguuuuugaauaaucuauuaaagguaaaauaaggaaauauaacuauauaaagcuauguuucacucaguguuggaaauauauucugagaaguucauuguuaaacaguuucauccacuuauaaauaucauagaaugucuucacacaaacagauauucugucccccuauaccagguacacaacuuggcaaaauaguuuagucacuauccauuacauugugacuuguuaucugaaauguuaaguagaauaugaauauauuaguaaguguaaucuuaauuuuucauauagauaaccaacucaagacugaaaauuaaaaaaaaauacauauauuuguauuuucauucuugaguuagucaauauuuuacauguaugacacacucaggcaggugaucagcuuuauugaaggcucuuggcaacauacuuagaucagaguauugauuuauaaacauuuauuaguauaaaaagacuuagguuuugccuccuuucuggaauucuaagaauugugucgccaauacacuaugauaaauuaguguuuugaucccuguacuguugugauggaaaaaagacauaaacugagcuuuauaauaacaauaguucacuauacuucccaaaaauagcuauguuuaacaaaugcuauuugguggccaggggaaauggcucaguugucacaguauagcucuucucucugucuccguucugucugucugucugccugucugucucucucucucucucucucucucucucucucuuacacacacacacacacagacacacacagacacacacacacacacacacacacacacacacacacacacacacaacacccuuacuucagauugccagccuucacaugaaagccaaggugaucauuucccuagcugggaugccuugucuggccucaguggaagaggaugugcuuaguccugauuugacuuaaugucccaggcaaguuggugccgggguagagagcucccuuucucugaggaaaaggggagggggaagggagguugcaggagaggagagaggggccugcaaaccagaacugauaugaaucaauaaauaaauuaauggggaaaaaauccaaagaagugguggggcuguggagguaggugaccccuggcacacacaggccugcuaguauagcaaaauuagcaagcuccaggguuagugagauaaccuacccugugucagaaaauaaguuggagaaaaagugaggaagacucuccauguucacuuggccucuaggagugcauguguguacacacgcacgcgugcacacacacacacacacacacacacacacauacacacacacacacauacauacacgcaugcacacacacagagacaaccucacggaugcacguaaacaugugccaaaaguaaccuuaaaagguacgucacaucuuuuugcggauaauaguacauguuuucagaaaugcaggcuaggcguuggcuuuaccuauaguaccagagauaacacuuuugagaacugaagauuguauacuguuuacgguaagcacuagaucaaugguucucaaccuaugggucacgaccccuuuggcaaacaucugucuucacauauauuuccauuacaguuaguaagagcagcaggauuacacuugugaaguagcagugaccaucauguugugguuggggaucgcggcagcaggaggagcugcauuagaggaucccaggguuaggacgaucgagaaccaccgcacuggucuucaggaugcucuuguccuaugucaucuucagauuuuauacaguuucaccuaaacagcacauuaaaacaagaucauuuucgugacacuuuaauagacccuuauuauuugcuacuuauuuuugaacagaggauuaugguucuaagauuugaacaaugaugaacuugguagugaguguuguggaguuucuucauuaccucacuccccuggccccagguuuucuggguagcauuugugucuuuuugguguagucuucauucauagcagaucauggacuagcaaagcaggaucccucacacauuuuuacugagcucugcugagucuccugcuuauugcucuuucuuuuuguuuguuaucaauaccaguuagauccagccacguuuacuuggccuccuaccagcuauucuuacaguucagugucauuuccuguuaaaagaaauuaacuuuuuauauguguaguucuuguucucugacaggcucaauuccagacagcaucuguauuaauuuaguccacagacaacucagugaacuaaacaguuuuugaccauuucauuauuuaaagauuuuuauuuggaggggauuucauacaggaauauaauauauuuacacuucaggguucagguaaacuaaaacacagaauaauuguaguaacuuguccuaaauguccaagcuagcgggucauuuuccugacauuucaccccucagaacucuuagcuaaauaaauaguucuuaaaacuaauggaaaauucucuugucuagauaaugcuuuuguaacaauuucuaauugucuuguuuuaaaacaaguuuuauaaauuugaaaguuuuaaaaauuuaagaauguuguagaauucauaaagaaagggaagaaaauuugauuuuccaaagcuaaggaacugaaauuaguuaaguguccaaauuuuaagauucuuguuuggaaaaaaucuuaaaauaaaaaagcaauuuuaggccgggcgugguggcacacgccuuuaaucucagcacucgggaggcagaggcagguggauuucugaguucgaggccagccuggucuacaaagugaguuccaggacagccagggcuacacagagaaacccugucucgaaaaaccaaaaaaaaaaaaaaaaaagcaauuuuauggguuuugguauaagguaguugauaguagguaaauguaacagacgagggcuaagguguuugacuucuucauuucuuuagagaaaaauaugcaaugauguuugaugagccaguucuccugcaagcuggauggugguacguagcaugggcucgagugucagggcccagcagugacuguggcucucacggccaagcgucuauuaccacagaugauggguaagcauaauggaaaccuuugacuuagucaauucuuauuuuuguuuuugggauauugaucugaaaucucacagagcauuaauauaauugcuaaaaaauaaauuuacauaauauauaaccaaauaugcauuaauuaaacuagacagagcaaggagaaaagagugcauuauucuuaccaaauggcauuuguaucuuucuggguaucaagauguuucaaagcuuuauaacugaauuaacaauugcauagaggaagggugcaggauacugaugaguuuggaauaauaaaaaggaugugugcauguauacaugcauauauaaacauauauagugaauauauacauacauagcuuauauacagauauauauguauauguacacauaauguuuugaugaguagauugauacgauauuugcaaaccguuuguaagauacaaagcuucugucauauaaaauauuaucuuaaugaaaugcagaggaaauuuuucucacuuucagacuaggaggaaagcucagucaguaagguguuugccacacaagccugagagaaggaucugagucuaaucccaagaauccauguagaaaauugggaugagggaacauauacuggggagcagcgacaaguaugucccugagcuugcuagucagacagccuaaccacugaaagacggggaccgaccuuccuuccuuccuuccuuccuuccuuccuuccuuccuuccuuccuuccuuccuuccuuccuuccucccucccucccucccucccucccucccucccucccucccucccucccucccucccccccucucuccccucccucucaccccccccuuguguguaccucuggcuuuacuggaacucacucuguagagugaccaagcuagccucaaacucacaaaaauuucuuuugucuaccacacaagugcaagaauuaaagucgagugucaccaccacccgggagagacauuuuccuaaaaaccacugauugacucuugagaaguaaugauugagguagacccuggucuccauguguacacauacauacacagggcugcaagcacucacagugcaugcacauacauacacacugcacuaaguaacaaaacaauuccuuauacaguauacuauuggauucccucaguaauuuuaaagcaguaacuuucccauuuauacucaggaaauuagagaaauacaaugggaaaaugauaugcuuagaguaauggugugguuacuaugugcagaauccagcccucugucuacacuucuagucugauccuaguguuuguaagagaaacaguucauuucauuucucuugaacauagucguauacaagguucaugcuaauuuaugaggugaauucuguucugaugaguguuuacaggaaguuaagucugccuuaggauguuucucuuucagcucccuguuggauuuuugcuagaacugaauucacccaaaguugcaugauuauuguacauaguuuguuccaaauggaaucucaugacucuggaggcugaagcuucuacauguaucuaguuaagcugcuuuuaugcucagaaguggaaaucuuuaguugaacacugacuguggagcuccucauccaggaguucccgucaagcucagucguucguuagguucauaacucaggagcuccaaaucaggacacuacuguuucaguugagauugaacaaaugaauaauuuuuauuagcauaaaauuugaagaucuuauuauuaaaugucuuacuaacuuuaaucacccuuaaagcuugucauuuuugauaucauccuauuccuucuugcuuuuagggugauuuuccaguucaagaguucaaagaagucaaauaaugguaccgauguaaaugcuggucagauaccucaacuguuauacagguauuaaaguuaacuaacuuugaguuaacuaauacaacuuagucauuugcuaugcugaaauaaaaucacuauaaauuaugcagcaguggagaaauuauucaagcacugaggacauuaauguuacccugguagaauacaguuacuuaaauuuuuguuaguauuuaguauaacuagugaauauuuucugcaucagacuuaauucagaauuuuacauauuguggcaaaguauuauaucaauagcaauauaccaauaacuaauuuuuuaaucugccuuuugauuuuaauaccaauuucaaaauguaauaaaguuugucuuaaagaaugugaauuaggaugggaaaauacuuuagaugugcaccuaaucaauuuauuggacuccuuuuuccccucugugcuagagauuaaaguuagggagugacaggccaggccagcacuggauacucugcuucauuucuguccugauagucuuacaacaguauuuugugauagaagccauugaaaaaaaucuuagcuuccacuuuuaaaugaaaucgcaaauugcucguaguguuuauuauuauauuacuaacaauaagaauuuuaauuaauucaaacuuggaaugagaagcaguugauauuucaaaguauuugucuauuucuagauuaaccccccauuaaaacugccuuucuuccuauacauaguuccuaaaaguaucuucuaguaaucacugagauaauuugaauguuacaaaucucauauuaucaagaaagcacuuuuggucauuacauuguagccauuguuugacauuagcaguguuugucugcuugguugugagguuuggcuuuuaaaaauucaguucucucucuggcccgaaagcacuuugugaauauagcaaauugcacagacugcucuugugaacuaccguugaauaugugcaucccuagggaauaugacauuuauauucuuaaugcuggauauuaaagaugauuauuucacuauggugaauguacauuuuaauauauuauuuuuauuacuucuuugggaauuucacaauguauuuuaagaguauucauccaugcuucucccucuaauucauuccagaucuacccugcccuuucccuagcccuauuucaugccccuccuuugcuuucuaugauguuuuuccugauuucuuaagauauauagauauuuuugaaggugaauuuuuuuuauuauuucuaauauauacacuuaaaacugaaauuuuaccuguaauucauuguuugguuuaauuguauaaucuuugauguacacugauuuuaguauuucauuacucaauauuauauauuucacaaauacauauauuuuauauaugaauaccaaaucuauauaauuaugugugugcauuugcguguguguguaugugugugcguauuugcguguguguguguguguguagcuuugugguuagguagguggcuaggugggaagaugacaucuuguaccgagucuaguuagugucacucccauguguuuagugcugaccacuuggaauuguguaaccuagcagaagcuccucccuagagaaaacugcauuccauucccacucucagcagccauugagugucuguagcucaucaucuguggugggcuugggagauuucucccauccacgugggcauguuagcuaguauccugcaagucucgugcugauauugucccggcaaccacagauacacugucuccgugugguuagcauuccagucaggcccagaagacacugauucgcuccugucuaccaaacuucucucuggaucuuaaucuggaucuuaaaaaucugucuccucuucuauuauuguccuuuagucuugaggauagcgggacauaauauagauauugcauuuguaacugagcacuccacugacaauaaggaaugagcauugaaaguuuucacuggacguuugaacagaguauauuauuuaucuucucccaccagacucccgaccagugacggcaguaccucaaaaggcaagcagcaaacgagugagccuguccacaucuuaaagaggucuuuugcaagaacugucuccgugguaagccacuuuaacaccuuugcuguuuagugcugaguguuaauuuuaaggcuaucucagcauagcuuuaugaauucagaucugcuuuuauuuugauguuuauagauagucuaggcaaagauaaugcacccugucaguagugggaaaguaaaaauguugcuugugacuuuaccauguccagcuacaguggcuuuucuacaucugaaaugaccugugacuuuucggacuagacaccacauacccugauaaguaauuaccuuuucauuaagauaauacuguucuugucauuuccaaaaauuucuauauguauauauaaauggccuugugguuaauagguaauugaaauuauuuauuuauuauucggucauuuauuuuaaauuuuuuauuuuuuuuuauuaugucagcagucaucuggaccugugugaggauuggggaggaaaguacuccuuucugagguucuauaguguuugccaccauuuaagugugaccuuucucagacuaucuagaaccuuacuuaaggaagccaaccccaugagcccaugcuugggaauuuuaaaaaacccaaauaauggguuuuguuaguaucuucuggucaacuucucaaaaauuggcuauaguuuuaauuauacauuuuaauauauauguauuguauagauagauagauaucacugauuuauaauauuuuaacacuacuugaaauuguuauacuauauaaauuuaucauuucgaugaaacauguaaacuauauuuuuucuuuuucuucuuuugucuacauuuauaagauaagcuagcuaggcagguaaaaggaaaauauaaaaaaauauauaaagguguuuuauuucaucuaccaaaacucagcaagaaguucaaguuaguuuugaaguggcgugccgauggcccccuuuacuccaagugugcucucacuugaacugacggugugccuuccuugucccgaguaggagugcuucgagucgcugcugagcauucuucacuggagcuggaccaccuuagucuuaggaguggaagagcucagggggcugaaaggguuccaguucaccgcuacacuccuugacuuagagcggcugcgcuucgugggcaccuguugucugcgguuacugcgcgucuacaccugugagauauacccaguaucagguauggugaucuuuuaaaauaacauuggagaaaaucaauauagagauagucaaguguuuaagauccuaagauaccuuuaaguucuuccuaaaauaaagacagaaaaauguaacuuuuaaacuuuuuuuucaaauagaaaacauuucaaccacuaauugacacuuaaguauuaaugccaguucuuuuuuucuauauugaauuuuguagcacacuuaaucucugucuuagucaggguuucuauuccuguacaaacaucaugaccaagaagcaaguuggggaagaaagguuuuauucagcuuacauuucuacauugcuguucaucacugaaagaagucaggacuggaacucaaacaggucagggagcaggagcugaugcagaggccauagagggauguucuuuacuagcuugcuuccccugacuugcucaaccugcucucuuauaaacccaagacuaccagcccagagauggcaccacccacaaggggccuuucccccuugaucacugucuuaggguuuuauugcugugagcagacaccaugaccaaggcaagucuuauaaaaaacaacauuugcuuggggcuggcuuacaaguucagagguuuaguucauuaucaccaaggagggagcauggcagcauccaggcugucauggcgcaggcagagcugagagcucuaugucuucauccaaagacugcuaguggaagauugacuuccaggccacuggggugagagucuuaagcccacacccacagugacacaccuacuguaaccaggucacaccuauuccaucaaggccacaccuccagauggugccacucgcugguccaagaauauacaaaccaucauaaucacuaauugagaaaaugccuuacagcuggaucucauggaggcauuuccccaacugaagcuccuuucucugugauaacuccagccuguaucaaguugacacacaaaaccagcccauacaaucucuuaaacaguuucauuucuggguuuugguguuugcuuuuuauuuguauaguaaaugacuggauuacuaucauauauacacuuugguuuauuggcaccuuuuauuuucucaaagcuacaggaaaagcaguuguugaagaaacuagcaaauuagcugaguguauuggaaaaacaagaacuuuguuaagaaaaaucuuaucggaaggaguugaucauugcauggugaaguuggauaaugacccucagggauaccucagccagccccugaggcuacuagaagcugugcuucaggagugccacaacaccuucaccgccugcuuucacuccuucuacccaacgccggcacuacagugggcaugccucugugaucugcucaauugccuggaucaggucaguuacucuuuuaagguauugguugaaaauaaaauagauugcuuacuauucagcaagaaaauugauucaaauuuucuuaccuuauuaaauacuagugaucaguuagaaaucuacugggggggaauaaaaaaagaaaucuacuugguaugcaucacuuuuauagcuaaaauuuagaaaaauugcuucauucucugguauugucuauuauaaauuaucagacauguuuucuuucagucuagaggugagguuauuugagagggagagagaccacagugagugugagaacaagugcagcaccacaugacccugggcaaaggcuuuccauuauaagaacagggagagggagggagugaagggcgugccaacaucauucacacaugaaggcacuuggcacaaaugcuugacagagcuauaagacagacagacgcugagacugauggguggagacaucaguucucauguugcaauaaucagugguacaaccagacaaaagguggaggggaguggggauuugaacaaugauguaaaccaucuugauauuuaagauuuucuuuuauuuuuaauuacguguuuauauaucuguaugugugugcacauauaugcaguuaaguagagaggagaagaggacuguuggagcuggagucauaggcagcucugaucuacugaauucaauucguccucugaagaaaacaggaaguguucuuaacugccaaguggaaccaucucuccaucccauaguaaucuuauugacauuuaaaaaacuauaaaaagcagcuacaggauacauauuuuuucaauacacauggaauaucugcuaagauaaaucauauacuuggccauaaauaaaucuagcagaauuuaaaagauuaaaguugugaaaucagagcaggagagauggucgcucagccauugaggauacuggccagucaucaagcagacccuggcccaguucccagugcccacaugagggcuuacagccaccuguaacuccagcuccgccaugguagacguccucuucugccuuucucaagcuuaagguucccaaguggugcaguguuacaugaagaaaaaacacucagauacacauuuuuuaaaaauuacuuuaaagaguagagccuacauaauaaguuccagggccaccuggcagaccuuaacucuaaaggucuaagggggaaagggggaucuuaauugccuuuuguccauuaaaaaaauagaauucgguauuuaaacuuugccacaaaucaaauuucuaacuuggauauugucuuccagagucuuuaaacauuuaugaaaaaucccgucuuuaacacaggcagggccuagggagcccuccuuacucucuugaauacaaucaauaauguuugcugcacccacaagcaaacaaacaaacaaacagagcccauaacugaugauaugccuaauaccaaaaccuaacagauacugugagaauaaauacuggacaaauaucacuaaggcacaagcauucuuauaacacuauugaguuagaaagcacgaauagaguaguguuaguuaucuugaagugcggggggauuaacaucuagaagucauuagaaggaauuguucuggaguacggcucagugauaaggugcucuccuagugcuaauagaguucgguuucaaguacuggagagaaaaggagcucuuuauauuaacuaaauuaagggaaaaucauauuauauuuucaauagguauucaaaauaugcucaccagaauuagcaguuaaucagugauaagaacuuuguaaacaagaauggagugaagcauccuaaccuguauuaggaucucuuaagaacaaccuauaacuaacagcuuacuuggugauaaaauaauauugaauacuuucuuuaguuugggaacacuaugcuguguuguagaagaauaaucuauagcuaacauccuccuuaacugugaagucuugaaugaguuuggaaacacguacuguguuuucuugccacuuucauuuaauauuguagcggaagugacagcuugauuuacccuguucuucgggauucaucgucaucacaguggaccccagugcacuuggauccaugguaggacaggauauuuacccgaccagugguucccugaacagugcugcuggggccagugggucaacuagguauucucagcauagcagucucccuuuguugggcuagcuuuuacagcauugcaucaaagugauauauugcuauauuuuuauucuucacugauaacacaaaugcuugaagagcuaaguaguguauguauguauaauuuuuuuugaguuaggauuuccuugguuaauaaguuuuaaaaaaucagaaaaaaauauacagccgagcuaagauuucuacauaaacuuggguguaacauuuugugaccuuaguaaaaugguauuacaaaagugcaauccguauucuuuauuucuguguaaaguaguuccauugcuuacagacuguguguuugauagagucuagugggaguccuuuaacaucucacauugaaagaugcuagaaagaaggugacuguacagacacacacaugccugaccauuggguugcaguaggacugaaaguaaccuuugcuugagucuucuuccccguuaucacuagauaaugguuuaaugguguuuugcuguauugcugugcuuuuauccaguauugaagccacuuagaugacugggugauauacccggguauaugugagggaacuugguuuacagcgaugcaguacuuaaggguuacuuuuguucuuacaaggauauccaggaagcaaacuuuaagacgucaaguagccggcuccuugcagcugucaugucagcucugugucacacuucugugaagcugacuucucucuucccuauugcauacgauggagaaguguugcugcgaucgauuguuaagcaagucagcacggagaacgacucaacacuaguucaucguuuuccacuuuuagugggacauauggaaaagcucagccagguauguccuuuuuggaaaucucuuacaguggaggaauaaaacaacaauaaguagagacauucauagguuggugccucaucuuccuuauuaauaauuauuauauuugcaaaugauuaacaaaugacuaucuguuucauaauaaguuauucucuaauugucaugcuuauguaaaaagucuuacucuuuuauugccaugacaaaacaccacgaggaaggcaucuuguagaagaagcgcuuccucggggcuggcuuacaguuucagaggguagugagccgauggucaucauggcagggagcacaguaacggcagguguggcagagcugcuuacauggugagccacuagcaguaggcagagagaaacugggcucugugugugugggcuccugaaacccugaaguucaccuccgugggacacagcuccucuaacaaggucagaccucuccaacagugcuccaucuccuaacccuuucaaaugguuccaguggcugggaaccaagcacucaauaggacgagccuaugggggccguucuuaacuguaaugagcagucuuagucuaagugacagcuccccucuaaagugugauuagacaguaaauauguauauaauuguguauugcuguuucauuugaaaguaaguuacacugcagagacucaaugugccaggaugguggguacccacggagggaagggcacaaaccucucagaggagaaggagagggaaaugggaguagggacucugugagggggggaccaaauaagaggggggaaagcaaucagauguaaaaugaauaaaucaauuaaugacaaaaaaagaaaguaaguuacagagcauaagcaaucuuuucuguucuaaauaggguuagcaaaauggcacaguacguaagggugcuuugccgcuaagcaggaguucagugugauccagacccuccaugacacacugucagagcucuauuacacaccuccacacacaccuccaaacacacgcaccuccacacauacacacacacacacacaccuccaccacacacaccuccacacacacacaccuccacacacacacacaccuccacaccuccacacacacacacacacacacacacacaaaccuccaccacacacacacaccuccaccacacacacuuccacacacacacacacaccuccacacauacacacauacacacauacacacacacaccuccaccacacacaccuacacaccuacacacauacacacauacacacacacacaaaccuccaccacacacauacacacacauacaaaccuccaccacacacacacacacacaccuccaucacacacacacacaccuccacacauacacacauacacacacacacacacacaccuccaccacacacaccuccacacacaaacacacacacacacaccuccaccacacacaccuccacacauacacacaccuccacacacacacacacaugcacacauacacaugcacacgcaaaacacaagaauggauaaaguacauaagaaauaaauaacguaugaaaugguuuuuauaaaauaugcuggcauguuaaacauaggaagcauuuaguaacugcuuuugcauuguuagaaagcacuauaaaaaaaucgaugacacauauuuuuuuaggaucucaguagaaauuuacaguaauuuaagagccagcauuggaaaacauuagcuuuauuaguuauuaaugaaugccagggaaagaaauacuaagauuaguaauuuguuucuagaaaauuuuuaaaaaguuaaaaucuuuucuuuacauuucaaugcuggugagauuaugaauauucuaaccuuaaucuuauagacagcuguuugcaauuuaaauuagucuaaauaucuuuuucaaccucucaacaaguauuuauugcacacuuauuuacuguaauuuuaacuagauuauaguugaaauagguaaaaaaauuuaccagauauuuucagguaauaagcugucauuucacuauugcuuguugucaguguuuucagagggaccuggaaguguaacugaaaacugaagcuuuguguguauuugcuaaaaagaaaguaguaauuaaguauguguuuaaauuaaagucuuugaaaauauaccacaauuaauauauauucuuuuucuguuuuuuuauaacuuaaauuuuuuuauaaaaaaauuuuuauacauacuuaauugaaauaaaauuacaucaauuuccccuuccucuccuacuggagauuauacaugucaaccauguccauaaauacauauauuugaacaucucaaauauuuaauauuuuaaacagugucauugccugacuucucuuuauggucaugacuauuuuuccaguuuaaguuuucaguauugaaugauccuuuuucccucuaucuuaagucagcuggaacuugcauccuuuugucuuaguuucccaagcccuacagcuauuggcauguucccuuauuucccauguagaauuuucuuacgucaaggaaaauauguaaaggugugcuagaaacugccaaaaaucauuagaaagcuaguauuaccuugcauuugguauguugcugucggacauguuacaugacagauuguuauuagagcagcuuuuuguauugcuucucuuggcagcuacagacuagaaacgaaacauauauacuuuucuccugcagacauuuccuaaaggaagcaccacaagauucucgguuaugauguaucacuagcgauugaguguuuuucaaagcagacuuucuggaaaagugaaguuucuggagaagggaaagauggaagggaaaaacuaacuugaguuuuaauuaaaaauggauuauuuuaauuacaaaaauuguuagguuagaaguucacaaaaauauuguaauuuacucagauguuaauagacuaacugaaauaugggggaaaaacuuuuaagcacuuuuauguauagcauuaagacuguaguuuaggaaguaaauaguguguuacgcugaugacaguccugacugacagacugauuccuaagugggugacuguugcgaguaauauuaaaaagcagucgacacuaucucccacuaaacaccagccugcgguuuccaucuguucccagccuagucccgggagggagggagggacggcaugguucccuuuugcccaagccugucccaccaaagagggcucugccucuccagagcucauucucuccuccccacaguuacaucucccuagagcucaguugaaucaccguggaaggaaaacaccaggcaaucuucguuuagaaccaacagauaguauaaucccuggguagagaaccuagcauccuaaauuccccaguuauucuguuagaaaucaccaggguccugccaccuaaacuaacagccccugucuacauuggauccuccuuguucccacauaccaaaagggaguccucuuccaccacuacccccuucccucuuccucuucagacccagaaggcccaccuccuucucacaguaauuggcuucuuguauuuauuauuuuaaucaauuaugggaaaauuccgcuauaggugauucauauauaaauuugauuugaggagaaaaugacuuaguuucuaggccccuguucauucaaacuguauuuuuucugaauauuuuuauguauaaagcaggaauauaauuauuauaaaagagcuaacuuauccaggaacuaggaauguaguuuugaaaacugagugauagcaaauaauaccccugagucagaaaaguugagucucgguggaagaauucccacucaguaucaaacugugugauuuuuuuuuuuuuuuguuuuuuuuuuguuucucgucuuuggugaaacugagggauugguugguuacugugcccucuaaugaacuuaaauggccucaguccguucacuggggugaagugcaugagacugugacagagcuuuguguggaguaacaggugaauuaauaauccuuucaguauuuagcgggggaagucuuuuuggaguuugaauuuuaaugaaauucuaauuucacaaauggacuuuucuauugacagaaauugggauuuuuguuuucuuucagaaauugaauauaauaguuguaaaaggauuagcuguguaggaauugcauaaauguacaaaccauuuuuauagagacaaguuuuucugaagucuuguagauaaauaauuuuaaauagaaugacuaauugucuaucacagacacagauuuuaaacuguuauguaguuaaaauaagaaaguaugugaaaaugucacaaagcuaauaaaagcacauuuuauaaauuaugaaacaaaaagaacuaauucagguagaucuuuaggguaucuaucauauggaaagauuuguccgcggaggacucuguacuccuuggggauguaaggcagagcuuugccucgcucuugucccacacccugcuguagagugaagagaacaucuccggcaugacgagcuuccgggaagugcuggagaagaugcuggucauuguugugcuuccagugagaaacagccuucggagggagagugagcucuucuccucucaccuggucuccaacaccugcggacugcuggccagcauugucagugagcugacugcaucagcccucgggucggagguaagggugaguaagcaugugguucuguagcaugggaaggaaacccaucuccuaagacacuggucacucauagccuaaagaggucaggccaaaacccaaaaccccuacaccucugugggacaguuaggaagccaagcuguguuggacuuuaucaccacuaaguuauaguccuucucagcacacucuucuaaucacacacacacacacacacacacacacacacacacacacacacacaggcaugcacacaugcauguuagguguuuucuaucauucaggagauuuauuucuuugaagauucuccucuguucuccgcacaccaucuacccccaccauccugucugugguaacuuuccuucucguuuacuuagacaucuuagcgaagcuccuccuucccucuaaggccucuucauauugucccugauauuuaauguucaccuaccucaguaccugaucaaggcacuuguaaaaggccugugcaucaauaaagcuuauuucugauggucacuuccuaucaguugcuuucccaaagcagccuugcccucuucuucacaguaucacucacuacauuaguacacgccuguaaucccagcacucacuauauuaguacaucacucacuauauuaguacaucacucacuauauuaguacaucacucacuauauuaguacaucacucacuauauuaguauauuaguacaucacucacuauauuaguauauuaguauauuaguacaucacucacuauauuaguacacgccuguaaucccagcacucacuauauuaguacaucacucacuauauuaguacaucacucacuauauuaguacaucacucacuauauuaguauauuaguacaucacucacuauauuaguauauuaguauauuaguacaucacucacuauauuaguacacgccuguaaucccagcacucacuauauuaguacaucacucacuauauuaguacaucacucacuauauuaguacaucacucacuauauuaguacaucacucacuauauuaguauauuaguacaucacucacuauauuaguauauuaguauauuaguacaucacucacuauauuaguacacgccuguaaucccagcacucacuauauuaguacaucacucacuauauuaguacacgccuguaaucccagcacucacuauauuaguacaucacucacuauauuaguauauuaguauauuaguacaucacucacuacauuaguacaugccuguaaucccagcacucaagagguagaagggaggcgaggcuagucgggauucuucaaaacgacaaauagagaacaguaacaacacacauacuuaccuuucaguguugcuucuuuauucauaauuuccaguuaggucagggauauguguuuagaaacgaucucuggcucuuuuugcugccagucuagcuccuguuucucgugaguaaggagaguaauugagcaaaacgccugcuguccuuuggcuucugugugugcuccuguacaaaauaauacaguuuuuucuuugcuuuccuguucuucuaugauuuacucauuuuauuuuuacuuuuuaaaacucacucucucaaucucuuucacagagugugugugugcacgugcacuuaugguauauauguauguguacauauagguaugccucacuauguguguauauauguagaagccagagauugauauuagcugucuaucucaguccuucucaaccauauuuauugagacaugaucuacacugaauguagagacucaucuauuagacuggucagagagccccagguuauaucugcuugugcaccuccuacugaugggguuacagcuaugcugccuuuaccacaggucuccgugacuauagagcaaauacuacuaccugagccauuuccccacuccagucccaucuuuuaacugcguccccauuaauagaacagcucaucacuuuauauaaaguacauaggguuuucuagacaaaguucuuggcugccucauuacacaacaccaugaacuugcaccaguuguuuuauuaauaaguaacaaguaauguucugagaucaggcugguaauaauaaacaaauuauguuuaaagaacaaaaagcuccaaagcuuugcucugucuauaguuacauauagaaauucauauaaaagccuggcagaaucucugucuuaccuauaccauaguuuauguaacugugguaagagagucguaaaguaaacuuccuuguuggaauaaaucccaugaguagcacuugcacaucuuguucuggagccaaugcagcaaaauguaaguaucaaauauguuugauacauuuugugaaguauuguuauuuuccucuuuucacugccuuucuuagccauguuuuauaacuuaucugaauguuuuaacugauuuugaugcuucuguuuuuuguuuuuccucccaaaaaggauuguggguuuauuuugaaaauauuaucuuaaugugaaaugcauuauucaaaugcauguuuaauaucuaacaugugucuacuaaauauuuuguuucaguuguuacucauaauacucagguuaacaacugcuaauggaauuguguguguuguuuacagguugauggacuuaauucucuucacucugucaaagccagugcuaaccgauucacaaaaacaagucagggaagaaguuggaacacuggaaauggguccccugaugcaaucuguuuugcagucgacaaaccuggaauugugguuguugguuucgcugucuauggaggaggcggcauccaugaguaugagcuggagguguugguugaugaugugagugucacgcuugcagcuuuuucuugcuguguggucaucagaguuuaccaucaucuuaguguggugacuucaaaccuucagaaauuuaacagaucagcuauauguaaacuuuaaacuggaaucaaaagccuuauguuuguuuggaacauuucagcacacuucugucuuacuuuauuuuguuuauguuaguuuuggaauuauagaaaaggagggauuuuuaaauggaauuauaaacuagaaaguacauagcuaagccuuuuauuccaagucuuaugggguuuuguuugguuguuugguugguugguuaguuuggcuugcuuugguuuuguucuuuuuguuuguuuguuugguugguugguuuuuuuuuuuuuuuugcuguugccauuuuucaugauccuagaacagcaguuaggugaauacuguuucuccuaacaaaggcuacacaaucuuaucaaauuccuaauagaaaaugcuuacugaagacagaacuuauugacugcuguagcucuauuuuucucuaauaucacuuaauauuuuaagugcuugaauuuuuauaaaguaucuuuaauguaagacagaaaacacaaaaauaagucucuugcaguagcaucuauuugacugauucuuuugcucaauuaauuuuaauuaacaucuacuucauucugcucagugugcagucuuuccuugaagauguucaaauacucccaagaccuaagaugguacaagucagucuauguuuuaauuucugcaggaaacaagauaaaagugaauagcuuagagugucaaaaucuuucuuuagauuguauaaagaaaugcuaaugacuaauuucauuuuuuaauacauuuauuuggguaugugagcgugugugcauacauccauuuacaugcuaaguugcauauguggagaucagagaacaauggugggagccagucuuccccaccauguguaggaucucagauauuaaacucaggcugucaggcuuguuugccugcugaccuaucuucaccagcccauaacuaauuuuuuuuauacaaggcaauaaaacuaccugaagacauuaaagaauuauaaucagaacuguuccuacaauaaguuaaccaucuuguaacuguuuuucuaucuucauuagagugaacaugcaggagauucaacucauucucauagauggacgucucuagaauuaguuaaaggaacuuauacaacagacgauucacccagugacauagcugaaaucagacuugacaaaguuguucccuuaaagguaauucaaccacauuucuuuuuaaacuaagagguaguguuccacgguuaaagauaaugaugaguagagcuggagagugcacucugcuucugagcacugcucucgcagaggacauaaguuugaaucuuagcacccauguccaguggaucacaagcaccagguacuucagguucaccguccccagugcccucuucugaccucuucaggugccugcacucacaggcauaggcauacacucccacauagauaugcaugcaugcuaauuaacaauaaagaugcauugacuauggcuucucccaagguuuuuaucuguuauguugcuuuaacuccucgugcauuuaccuacuccaauauaauauccgagguauuguacuauauuaugcucuggucuuuacauguaucaaagucugguauacuaggaccaauuguuagguuguauagucagacaguucuagauucaggguaagacagauuuagcuuuuuaaaaggcuguccaauauaaguagaaaagauauauaguaguauuuauucaguuucagugcuacuacagcauucuccugugugaucuuucuuaaaucuggcauauugucauuuuacuacuuuuaagccucuuuuguuggugaggaagacuaaucaauacuguaguguucuacuguuuaaguaaugagagcaaagcacaagccuugguguugcagaguauuuaaacugauugugcguuagucuucaugcuuccaacuuauauuacaccaaaaaugcuuuaagaaaagcaaaggcggucuuaagaguuaguauuaauggaggccagaaagaugacacagcaauuaacacuaguugcuccugccgcggacccagguucaguucccagcauccacauggugucuuucaacuauccguaauccuaguucaggggaucugaugaccucuuugaacuacucaggcauaagggaugcucauggugcacaugcauuucuauguaggcaaaacauguacauacauacauacaaguauguaucccuuauuuaagauuuaucccuuauuuucuaaauacaagcauuugccaaaguagauaaauuguauuaaaguaauuauuaguguuaaaguaaaauuaaacuaacccugaugcaagugaauaaauaccauuucagaauagaaucuaaaguggaaauagacucaucagagacuuccuaaauaacuuuaagguuuauagcugcgucagugguuaggagcacauaauacucucguagcggacuggaguucagcucccagccccacaucaagaggccuauucucaccuguaacuguagcccagcgguucuauaugaucaucucuccuccacaacauugaucaaccccaucaugagagcaacuggguaggccgaguuuauuugguuuacauuuccacauccaucacugagggcagucagggcagaaacucaaacauggcaggaaccugaaggcagaagcagaugcaguggccauggaagaguguugcauauuggcuugcucuuugcugcuuguucagcuugcuaucuuauagaagccaggaccaccagccuggggguggcacuacccauaauagacuuggucucccacaucaaucacuaagaaaaugcccuacaggcuugccugcagccugaucuuauggguguauuuucucaguuaagguucccuccuuucagaugauuauaauuuguguguaguugacauaaaacuaggcggcauaaaugaaagaaaaaauacaaaaaauuccuggaucauaaaauuugaguaucugcaucucuguuuuccuacauauuguggacaguuauacauggauuuuuuuuccuguguuugugugcauauuuuugucucugaguaaauagauuuaacaauuaugguuuuaacauacuuaaauuauuuuaagaauuuaaacugacagaacaauauuagcuuauauuuguaugacuaauauuuuaugcauguaauuaagcacugauaaccuguaguuguugauggucaacugcuaguuucaccgcuucccagcuauguuacuuugggcaaguuauuuagcaacugcaucucaaauucuuuuaucugucaaguaauauacuuaacuacugagggcacuugaauuaauucauuuaauucauauaaaguauuuggaaaagauucuguuaucuaaagguauucaguaaguauuagcuauuauauucauuaaaaacucauuuaaugauauuauuuauaaugaccacaauauuucaguauauuugaguaguuuauugcuagaguucuuucuguauuuuccuuauacugugaacgcauauaacaugcuuuaugucuucaucaugaaggaaaauguuaaguaugcugugcgcuugaggaacuauggcagucgcacagccaauggagauggagggaugaccacuguucagugcccugauggagugaccuuuaccuucagcacaugcagcuugagcaguaauggcacaaaccaaaccagaggacagauuccccagauacuauacuauagguaggugugcuuauaguuagagacgaaugugcucaagugguggguaacauucacaaugauacaaaacaugccaaguugguaauguaccugaauuacaguuuaucuuccuagcacauacuuagucaaacccuuugaagaauccucauuuuaaaauauaaauucaguauuaacuauuaaggugaaugcuuuuaaauuuuugucauucuuucaauaucacuaaagguuuuuuuguacuaucauauauguugcuaauacuacuuuaauucuuugauuuuuauuuuaaaauacaaguagaacuuacucauuuuuaaaauaauuauuuaaacuaggugacccagccugacucuccagguagugguauugccuugguuauuuuauccaauuggagaauaguuuuacauguaaaacuauuuucaccugcucagguuagccucugggacucuagaccauauaauagugggaguguucuuagaguacuuuagugagcuauuuguuagguaaaugauggaaaaacagaaaauuaugaucuuugaggaaaaauaacccuauauauacauuuuucauuaucucugauuuauuuugaauaauaacuuaucuaucaucuuagugaaauuaucccccuuuccccucaacauaacuuuguaucaagccacuaauuuuguauauguagugcuucuuguguuugccuuggcuaggcacacagugggaauuuuuucuacccuuauucacagaagagggagccaaggcauugaguauuuaaacauuguucccaaaucucauuuguagugacuuaugauaaggggguuuauagucuggauguuggacuccagguuacaaaauacccuuaaaucaccguaccguacauccuccguaaggauaauaaugggugucuuagugauauagcugucauuugagaaucaguuauaguaauuguuucuaaauuuaagaaauuguaagauaugggcauggaguuuccauagucacauuuuuauuuuucuaacauucuaguaaguccuuauaguucucaccuaaaaaaauaaauaaauaagaaauaaaaaaaggaugcuuucugugguuggccgacagacguuguagguuuaaugugucccuuaguaggcacccagcuguaguaacaccuuguucuagaugucucuuucucuugcaucuaauuugguaauuucugacauacguauuuguaaaguguucuacuugugacuucuccuaucauuccuauaauugaacugcugauucccagucucucuaauuuaaaaugaucaucaucucuaucgcagggucucuucuuucucugcugcccuuuacauuccguucuccacagaacagucagcguucuccgacaggaaugagggcauaccccucccuccucaguucucucuugaugcuuugcgauuaaauaggaguuugcuacucuggccuugaaaguccauaugaucagacccuguuuacugucuaauccugucccaugaacucugcaccuggcucccacuguccagauaauauucucucacauuuuccaugaguuuguaguuuguuuuuaaacacaacucggguauuucuuaaguauuaguucaacaaagaacaacuuaaucuaacagaaaauagcacccuuuacuuuauagucugcuuugguuuuuguucaaagccuuuauccaaaacuaacauaauuacacauaugcugucuuuuuauuauuucaugcaccuuuccauacauucauuaaaaacucuggcaggugcuaugauauaucaccuucauguuguauuccaguauguaugacugcauaguggcaucugaucugaagauugcuuugcaucccuuacaucuucagauuugaugccacauauacugucuuaacuguaauuguuuuucacuuuaaguuuauugaggauuucugaucggaauaugaugccugaauuucucagugaaaacuguuuucauuuuauucaugccccaggagugaauuugauggagauuuacaaucccaacuucuaaguaaagcuaaugaagaagauaaaaacuguagcagagcacucucugugguaagcacuguuguucgagcugcgaaggaccuguugcacagagcucuugcuguggaugguaagacgauccuuuuccuuucuuuagaguuagauuuuagagccuguaguucuuuugugaauaguuaaugaaggggagauaccuuuuagaaucccugaguauuuaguuccuuauuuauuuauccauccauuuauccaguauugauuuuggaucauucacuuccuucauacucugaggaagauuuuuuuaaagugaaccaaaaaaaaaaaaaaaaaauuacagaauacuuuaaauuuuuuaguuuggucaauaagagaaacaucucaucugauuaaauucauuuuugcuuauuuucuuguuagugaaacuuuuuugcuauugugaaaauuuuuuucuuacugugcuuccuguaucuauuaacuauucauccaaauggcuggugaauaaccagaugcauaaccugcccgucuccucaggucuacuugucuaagucaaguucuagaacuguuucuucucugcaaaguccagucaguauguucuucuuucucugcucuaccagugccugguuaagcugccuuagugcagccucacgugcauuuucuugaauggaaauguccaaguaauugcauugcuaccuuucuccuguuauccaccugugucucuaggcaucuucucuacacuaaggagaaucacuaguauaaaauauucaggguuauccuuucaucuaaaauguuauuccaucccaaagguuuaggcuaggcugaaaaaguauuuuguuaauauaugucauucguucauaugcaauagguuuagaacuccauauuugaaagaauaauugcccuacaguauaaauauauaggcucagccaaucuuuuaagcaucaugaucauggguaaauaacuaaaauggcugucagcaaagugcuuuaaugggaaaaaagaagucacaauagcuuuguaacaacaaaugcuuuuuggaauguuuauauguacagauauuauucuaaccguuuuauauuauauguugauuaauuuaauccuaauagcauucagugaagaaauauuguugauauucuaaauaauuugcuucgugucacucauguagccguguuuaaaaccauugcccuagcuucuacuccuuucucuagcauuuuacagguauauauguagaccauguuaugaauuuacuauaagauauacaaacacuuuguaacuugacuuuuccuuuuaaaaaguggaaaguaucuauuguaaggauugagauaacaauaaaucccuuagaauaaauugagccuguccuucauaaauguguaguugaugucaagcacagcuuucugaggauaacaggguagagguuaggagagcaugcauacaguauaacaaacuaccuucuaacuacagucucaaugcuuuuuuuagcugaugacauuccagaacugcuuagcucuuccagucuguuuuccaugcugcuuccccuuauuauagccuacauaggaccaguagccgcugcuauucccaagguguguaaucaaaauucuauaacuuugaaucucuuaccacugguaacauuucacaggucuuacaucuucccuuuaaucacugaggcacuaggguaauagguaacagagaaagcauccuaagugcuagaagucguuagcuaagucucauuguucccagaauugcuaauugauuuaguguacauauuugcuucacacuugaagaauuuaggaauaggaaaucuauuuuauaaauaugacauaaagaaagauuaaguaaucagauggguuuuuuuaaaaaaaauucugaacuugaugccaacucuccaguuuuaauaaaauuaucaauaaaaagauuauuuuacaguagugagauaagacaugaagaacaucauaaacuguacagucuuuggcauaauuuaauaaaguagagcuauuuauuucuagaucacagaaaagcaaggguuuuaaaauauagauuuuuuugguauaauauuuagaauaaauuucuuuacccacuaaaaacacauuuaaaaaaaaaguacuuuauagaaacuauaugaaaacugguacuuauaagaguuaccaacaauuaggguaguuccuaaguaaagugaauuucacacuuacuuaaucaucuuuauuuuuuauaucuacuagguugcuguagaaguuuuuggccuuguccagcaauugcuucccucaguugccauuuugaaucagaaguaugcacccccugcguucaaucccaaucagucaacugauaguacgacaggcaaccagcccgagcaaggccucucagcuuguaccacuuccaaucacuaugcugucauugagagugagcacccauacaagccugccugugugaugcacuacaaggugggcaccguucuuagcaagacucaaagucaaagcuggaucugaggcuuucuaaugauaucagaaaguggauuuugugaauguucagaaauguuacuucuuguaguaguuaaauauaaggcaucaaucgagacaguaugguacuguuggauuaaagaagaccugaagacauagucuuuccuaauacgauauauccugaauaguuuccccucccucuucucuuaguucuuccccaccuaaccuacccccguccacucccuuucugccucucauuagaaaagagcaggcuucuaaaagacaacaaccaaacaugucaaaauaaaauauaauuagauaaaacaaaaccaucacgaggcaacccaacagaaggagcagagccccacgagaaggcacaagaaucagagacccacucguuuacacacucuaccaaacuaaacugaacgcaacaguauguauguagaggaccuguuuuggcuccguacugcugcuucagccucuguggguuccuaggagccaugcccagcugaguugagucagauggcuuugcucuccggggguccuccaucccuucuggcauuuauggccuccucuucuauguggguccuuaacccugaugggagggauuuguuggaaacaucccaauuagagcuguauauuccaagaucucucucucucucucucucucucucucucucucucucucucucugugugugugugugugugugugugugucucacccucccucucaugucugggcuguagucucuguucucaucugaagcaagaggacacuuuucugaugauggcugaauaugucacugaucuaagagaguauaguagaauguuauuagccaucauuuuauuguuacuuuuuuuuuuuuuuaacccaguaguauuugguuuuauccuaugucucugggcuaucuaggaagacagaccuucuaccuuaaagauuuuauacacugguagguuuuuuguuuuuuuuguuuuguuuuguuuuguuuuuugagaguuguuugaaaauaucuuucuaacaguauugcaguauauaaugcuaaacucugugcuguauaauuauagugauuauaacucuuaaaaauuguaaauaguauuuuuauauaugguccugugggcauguuuguucacagacagagggcagaaggacaaccuuguguuauuccuuaagcaguauccucauuauuuugaaacagggucucucacugaccuagaacuugguaaguagacuagcuuggcuggccaugaagaucuggagaccauguugucucaccuccccaagccagggauuaaagcuuguaccaccaugcccagcuuuuauuuaucuauuuuugcacugguccuagagacuacaguguaggcuucaagcucuuuucagacucaucucucucccuaccuauaagucauacuuuucaaacuggcauuacuuuacuacaaucagaacucuggaaacuuaaaggagccuacucagaauauugugaaaaauaaaguaaaauauuuuaaaaauuaagguuaucauauucaaguccuuuuaguaaguagaugaaaaugaaccacauuuuuucaauuuaauuauguuuuuacaccuguaaaauauucaaucuguuauagaaauagauacauaagaguagacaagacaguagcuuacuggucuccugauuaaagucuuaagcucuuaauaaaccuauuucauuuguuuucuacuuauuccuuccgguuuauauuauuguaaaacaauauuuucuuuugcaugucuuuacuauaagaaccauuuaaaauaacuguaguuuuacagcugaguaacuccuuaauauuaucaaauauacauaugugauaaguuuguuugaauuugauuuaacauaagaugaauccucugggcauuauuucuucaguccuuuuuuauguuaaaucccuguaagcauacucuucucucugcaccuuugucuuuugguuuccccaacuuuugauuguuggggaaacuggcccagugucccugcuuuucacccgaccuugcugagucuucagagucucuccucuaauuuucguuuucccacgaaugugcacauaugaagcuugugucugcugcuuccgcuuugugaugauggcggaggaccuucuaguucuugucccacaaacacauugaaugcuuuaagguacauugggauaauagugucuuuuacagugaguuauauaucugucucuuuguauuuuuguacuaaauuguaugugugugugugugugugagugugugugugaaucauuuaaugaauugauuuuuaaauuggauuuuuguacuggcugguuuugugugucaaguugacacagcuggaguuaucacagagaaaggagcuucaguugaggaaaugccuccaugagauccaacuguaacgcauuuucucaauuagugaucaaggaggaaaaggccccuuguggguggugccaucucugggcugauagucuugguucuauaagaaaacaggcugagcaagccaggggaggcaagccaguaaagaacaucccuccauggcuucugcaucagcuccugcuuccugaccugcuugaguuccaguccgacuuccuuggugaugaacaacaguuugggagucuaagcugaauuaacccuuuccuccccaacuugcuucuugguuuugaugcuuuguguaggaauagaaacccugacuaagacaauuuuguuuucuaauuauuaaauggaugauaagacaaaugauaaacuaaauaagacaaucuguuguuuccuucaguuuguuucuccuuuaguccuucauuuuuuguaguauaacauuauucuguuucauuuaauaaaacuauacauacacauaaacagauauccucuugucuaccgacaggugacauucccagaauguguuagguggaugacaaucgaauuugacccucagugugguacugcacagucagaagacgucauccguuugcuuauuccugucagaaccauucagaacucuggauauggagcaaaacugacaucuguucaugaaaaccuuaauucauggguagaauuaaagaaauauucaggauccucuggauggccuacuaugguuuuaguguugccaggugaauuuucacuucucuauuuaugggaugaaauggaaacguguguguguguguguguguguguguguguguguguguaaaaaaauucauuauggaaaguguuuaacuucagagaaaacuauuuuaaaacauaugggucuugguuacaguuaaggauaaauaagaugugcugggaaaggggcauggucccaucuaaguuugugaagagagacuguugugaagauuuugugugggggugggguagggugggacuaucaggguuaauaacgccucuucuguauaguugggaccaaacuaccuaaaaagugugcaaguggacuugauuuucuauuuucucgguagaugccauguuuuuuagaaauaggauucaagcuccucauuuuaacauguggguaagggugguggugaagguggauguacaugaauacuuauuucugauauucauauuuuccuuuaaagcuguaaauuuuaaacucuugucugaaguauccuaauuguaaucaguuaacaguaacugcuguuucaaacacuuaaaacuauagagggaagcuuugucaucuuucacaucaucuagccuugaugaauuuagaguuuucccuuugacucuaaccuacuuuuguuggauugguugauuuguuaagggauccuagaaauccagauaccaggguggaagauuacuuaauucaaagaagggaagacuaacuuagguacucaauaauugauagaugauuuuuaaaauugcccaaacuuagguaaaguaggauuaagggaacagaguugauuauaaugagaauuagcagcaauucguuagaguugguucuguuguugauaggauugcuucuaacagcuugcuuaagcaaaugaagggcucuuccucaaaacaccuucuuucuauuuuaauaaccguuuugacaaauuauuuauauaauaaaauaaugaaauauuuagacuuugaccucaauagcagagacagguacuugcucacagacacacauuuuuguuuuguuuuguuuuuaaaggaaaugaagcccuuuucucacuggaaacugcuucagauuaugugaaagaugacaaagccuccuucuauggguucaaguguuuugcaauuggauaugaauuuagcccuggaccugaugagguaagaaaaauuguuuucccagucuguuaagaacaauuggcucuuuuaaagugucuguugauuuaaaaugccuugcaagcuaaagguuuauaauuaaaaugccaugugguuucauuacgugugguaccauuuugcugcucuuuccucagacauggggauaauugagguuauacaguauguucccauuuaagugaagugcauuuugaagcauaacucaugcuccaugcuaaagugguuuaaccuuuacuuauaucagaaccuagauucacaaagugauuuaucuuauucuggguuuucuuaaauguuuuauaucaaacacuaaaauaaacccaagaucguaauuucccuaaauaaugaauagagcaugauuuggaccgugaaggucaucgcauacuugugacaucguuggguguaguauuaaaucuuugucucucagcuucaucugaggcaucuuucuuucuaguuucaacugcagagacuaacuuugaauuacauguuuucauaccucacauucaagcauguuuuaaauagugacuuuuaugcaauucuacagggaguuauucagcuggaaaaagaauuagccaaucuuggugggguuugugccgcagcccugaugaagaaggaucucgcacugccuguuggugagucuaguuaaucauagguguugcuaaggcuuuagaaggaaauguaagaguaaaauacauuuauuacagaacacuuaaagauaaacuuucaacacaaauccugucacuacauauacauaggaacaauagcuguuugguacacugcuguuguuuaaauggaaacuggagcauaucauaaaaucuuaauuuauucaaauucauauauaugucuauaacuuaugauuuuauaaaucaucauuguuuacgugaaauauaucuuauuauuacucaaaauaauaaucuuuuuguaaaaaaagauauauuaaguauaaaaacuucacacauaaaugcauucauauaguuacuuucucagauucauauaaccuuuuuuacauugaaacaugaaauugucaccuacaaaauucacacuugagaaccaugucagugaccuacacacauggcacauacacauggcacacagaaagacacaaacgacacaaagucuugcaucuuuugcacugcagugugaguuugccuaauuuuucccauugcuuggugaaugauacuugauuaccagcuuagcaguuaccgcuuauaggacacaaaacaacugaacauuuuaaaaucuaaacuacuggauuuaucuagauuuguaaauuuuuuucaaucaacaauagcaagauuacaaaaacaaauagugaagacaaaggauugguaagguauuaguauauuuuaguauaacuuuuuaauuuguguaacagguaacgaguuggaggaagaucuugaaauucuugaagaggcugcauugcagguauugcaccaagcauuuuagcuuuuguucauugguguuaaaauaauaguuucugggaugauucuuaauucuucaauagaugacuccgugguuaaguacuuauuucuguuuauuggcaguuggagagucacauaauuuauacggguccucuuaaugagagagcccauaugaacaugauuuccaugugcuggggaugccccagaguaggggaauccagggcagggaggcgggaguaggugggugggugggggagcacccucauagaagcaggggauggggaugggauaaggggaaccaggaaaggugauaaaauuugaaguguaaauaaagaaaauaugcaauaaaaaguucauauauuaucauuucauaagaugauguuguauaaaauaacacuuagauuagauacuauuuacaaagcuuaacaauuaucuaaauuacgaaguaugauacacaauuaacacccaguccaucauaucugucgauuagauaaaguacucuaccaucuauccuaacuuaaagagcuuacaauucuauacuugaauuauguucugauuuuaacuuguauuaccaucugaaaaucauccuuuuaaaucagcaucaucuuccucaguguuaaacaacguagguuugacuaugagacuagccuuuaggcugguaaggcauauuaaaaauaaugcaccauguguguaucuuuuuuucgcaaauccagagaauucuggcaguuugcuagaaagagcagauuaacuguucacugcuacaguugucaguaauggaaacugaaaaugagagguagccaccacucccugcauucaggagcucuagcugugccuaaugugcagggaacaaagucagcauagauagaccaugccaucuaccaaggagauuuuacaguuacagaauauaggcaacagguacuguuuuccuguauuuucuuaguauaacuuguaugucauggaccaaagauaguaaggcuggggcauaggaggaaauaguuguucucaauaaggcauaccaaaaaugugugcauguugaaaaauucauagagagguuucuguuuuccuuuauuugccauguauauugcacacauauuuaaccucugcacucaaaaggccaagacaacgaaucauaaauguaaggccauggguggacugugagauggagccuuucuuauaaauaaauuagaaauaaguaagauacaaagauucucuuuuuuucccaauaggugugcaaaacucacucuggcauucuuggaaaggguuuggcucuuucucauucaccaacuaucuuagaggcacuugaaggaaacuugccgcuucaaauccaaagcaaugagcaguccuuucuggaugauuucauugcuugugucccagggucaagugguggaaggcuugcaagguauuuuuaauguuacaauuaauuucuuuuaaggcuucaucucugaggagaaauuaaaggaggaaauggccauuuucguguuaaaaugcugucuuuuaaaauccagauuauguguuuuggaccuaaagcaaaaggugauaauauuuuaaaauaugacacuuauuacuguauugucuuucuccauuggcuguauuagaaugaaaagagaaacaugcuagcuuguguuaacuaauuaauaaaaaauaaaaguggaaccuccuuuugguuuugaucuuuaaguuucagagguugcacuucacuauuuaaagccaaaauguugaccaagagacaauagcuaggcuuuucaauuagccucccuuuugugcuuauagacacuuguauauaaugcaugauaggcagagggaaaugguuuuuuuuuuuuucuccagcuuuuaguagaauucuagucacccucagaauucaaauuagcuguaacuuaaugucguuuuuugauaucuuccagauaacaauuuucaguauuuucuaaguugaaaauuguuuaauaguauauguaaacaucagaaacuucauacauuuuuguguaugucuagaggauuuuuauaaauuacuucccaggaaaacacuugcaacuaucacugaauuagaaaugaagauacuaagccgggcgugguggcgcacgccuucaaucccagcacuugggaggcagaggcaggcggauuucugaguucgaggacagccagggcuacacagagaaacccugucucaaaaaacaaacaaaaaagauacugguuuagcauuuuguucaauacaaguuuaguuuauuugacuuaauuucauguucucuuguuuuuaauucuuuuagauggcuucagccagauuccuaugcugacccucagaaaacuucguugauucugaauaaggaugauauucgcuguggcuggcccaccaccauaacuguucaaacaaaagaccaauauggcgaugugguucauguucccaacaugaagguaauucuacgugaguuagcaaugucuacacauugacugcugcuaagaguugagaauggcgagucuucacagucagccugcucuucucucucugucuuuguauaaugaguugcuaugacuuauuuuacauuaacuaacucccuaauuuccaaccuauagucagaugcuacaguggagucaaagaagauaguuuaaauugucugugucaagcacacauuaaaauuuugucucaugauccaaaccuggaagcaaaaagauggaauaggauauacuuuguaguacuucgcguaugggaggagacaugcauauacacucauuguguuauccugugauugucucuucuuugauguuugacccagagcauuugcaacuuaccaccauuaaaaguuuagaguaaaacaaagaagcaaaugcuuucaaaauuuaggaaauuuaaugauaaacauauauauauguauauacuacauagguccauauacuauacauacuuauguguagacuauauauacaugcauauguauguaacauauauaguuaauauaugauacacuaauauacuauuuaaccaagcuauacucucagacacuccaaaauacuucuggcaagguguuagcaauaguuaauauuuucaaguuuuuuuuuuuuuuuuuuuuuuuguuguuguuguuguuguuguugagacagguuuuuucuguauagcccuggcuguccuagaacucauucuguagaccaggcuggccucgaacucagaaauucaucugccucugccuccugagugcugggauuaaaggcgugcgccaccacgcccggcuauuuucaguauuuuaauaugccuuugaaaaacuaguuuuccuauuuguagaugaaggccauuaacauuuuaccauuguagaaacugagcugaaaaguuuacauuguuaaaaucaguaacucaaauuguuuaaugugguauugugugauaugguaaauguguacuuuucuuuucugaaguaaacagauuucugguauguuuuaaaccaucaauuccaaagguuucuacuaaugaauauuuuuuccuuuguaaacuauuacagcaagaauucaaacaaacuuuuacaaauaagcuguuguuauuagaaguauuugcauuuuaauuaucugauaaaauaauauuacuuccugaaauuuucaauauagauuauuucugauuucuuucccaguaucacacuaaugaaagauguaauuuuugugcuuugaaaucugugauuauuuguuguaaaauagugacccaucuguuuucuacuauuagcguauaagucagaggugaggcuauccuggcucucucuggaaaugaccaaggagaacugguguuaacagaauuuguaucacugacuuuguaauuaugaguuccuuccuuugaagugucaagggcaacuguguuugguuuuuauaucauuguguacagguggaagugaaagcuguaccuguuucucagaaaaaaacaucuuugcagcaagaucaaggaaagaaaugucaaaggauuccuggcagccccucagcagcagcuucuagcgccgacaugacuuuugguggguuggcauccccaaagcuggacgucucguaugagccaaugaucgucaaggaggcgcgguauauugccauaacaaugaugaaggugauugauuucugcuuaucagacauuuucaucuuucaccauugacuuauguuucagucaaguauuaaacuggcagcauauaguuuuaaaugcuuuuucuucuccuggagagacugagucaguuucuggcaggcacugagggggugaccccuuauagaacagguucaugcagucagagguugagaugaccuaaagcugaagugcuugucugccagaacacagaccuucaagacucaaggguuuucuugggucccuucaguuuguacaacucccaaauauuaggcuaucuaucucuuuagauuucuuauuucuccuggauuuuuuuuuuauuuuauaauuccuuuagauggauuaaaaaaauaaguucagcuuuuuacuucucuuaaaaggcagaauuacuaccccuggaaucaugcugaguguagugucuugguguuuuuagaaagcaguguccauauucuaguagcugaaagcuaugaucgcacugaucguuuauaaacacugugggacaguaauuaguauaguuaggaagacagcugaguaagaagcaugacuccuuuaaagcucccaggaggacugcugacgugcucuaaggagauacacggagaacaaugugggccuggagaguuaucagucagaguagacuuaaaacacacugacuauuacauuagcccaacuucaaugcuaaugaagagcaaaaugaaaacaaaggaggugggaaauaaaagaugaaguucauaauugaaguuggaaauaucagagaaguaggguauagcaaaacaggaagagcucugcucuaggccguggaugcucucugagagcacucugauucugagcccuuugauuagcagaaacucgggguuucauaaacuaauauuuuuuuaagcuguuagucacaaaauguuaaguuccacaaagagguggacaaggaaugacuuuuuggagggcuaaauauggaccaagauaaauuguaguuuggcucugggccugcagcauuuuaaacacuucacagucagucaaucaacugaagaggguugcucuugaagguguguguucucugggggagcuuucauucacacacgcucuucuguuucuguacuuucuucagaaacucaccuguuccuacuccuagacuccaggagcaugcugaaacaucuaggauuacaacagucacacagaacuacucccaagcugucucugagagaaucauucaugcucugggcagacgcucuuuacuaaccgaucguacauaacuguaaccucacucggcagugagccauauaguagaagauggaaaaauaaaauauggucuuaugguugaaauuggugcagugaaaauauaauauccagagucuggacaccuggauucccagcuguugacuacuguagagucuuggcaaagucaaccuuaaguuacauuuaucuaagacacagccuguggauaagugaaagcagcuagauaauuucugaaucaccauuaugguaaagaaaagggguggggaggggaggagaaaggcagcuuuguaacugguguguguacuuuccuccauaaguaaguacuggggaagcuggaagggcaugaggaaugaguugaagaucuugaagugagcuaugaaaaaugauuaauuugcagguauaaaauguaucaggguucaugugcuaaguuuacuguauguacuacucaucuuuaucuucacauuuugccauaucuuuuguucagauauuuugcuuauuuuugcaagacuggcacacaacaugccaauaaggcuccugcagcuuauaaagaaacauuuuuacagucauaguccauugccaggccauucuacaccuuuccaaagaauaucuuauaauucauucucucucucucucucucucucucucucucucucucuccccuucccucucucucccucuguguguguguauuguguugcauacuuuuacuaaauauaaaaugagccauaaauaauacucuuauuuacucuguguuccaaagcucuguacaauggcauuauuuuuguauguacaugaaaaguuucucuaaaauauauuccuagccauguaauuucugguuguaagaaaggcaugugugacucuuugguaaguguuuccagagcugauccccugcggccggcugcuugcacaucugcacagggucuuuacucagcuccaguugcggcuaugcugugacuuuuuguccuuuuaauuuguacucccuuuccuuccgucucuguucagucacugccccagcacuaguggcuuuuucaguuauucuucagugcguuggcuuuacucaguuuucugcuguuuccucuguguacggauugauuuggccuguauauacgcauguguacccccauguaaguuacagcguugaaguaagucauuaaguagcauuguaaguccaugugaagacucuucucuauaguaucuuuguauuggagauauuuaaaaauguaaugaaccucgaagauuucuauuuuuauaucuuuuaaggcuagaauuucauugcuaugacaaaguaccugguaagcaauuuaaggaaaaguguguucuggcugacgacuguccuccauggugggggauggcacagcugcagacccaggaggcagguugagcugauuggaucucauacaaagcagagacuugaauaagaacugcuugcacuacuuucuccuuuguuauuauugggaauugcuuugcuugucucagcuaacugaacgagaaaauucuucacagacauagccacauaauuguuucuuuaguaauccuggguccugucaaguugacaauauuaagagcugcaucauaaaauuuuagaaaguugguuuuuuguguuuuguuuggauauuuagcacaugugaaauucauuuucaaguggucuugccauuuuuauuccucucuuguguggauagaaugguccauugcaaggguaccaauguuccuuguuucuucuuaaagguauaugaaaacuacucauuugaagaacugcguuuugcaucaccaacuccgaaaagguaagaacuguuuucucaaaguauugcuaaaacuaaaacuuaaucauucagacugaaauaaucuuuuuuuaaaucccuuccuuauuuucuuuuguuuuaaaauacuguuacuaauccuuugaguccauaugugcaacuguuguguuuguuccuggaagucaucucccauccccagcccuuaucaucgucccaccucgcuucaagaagauccuugggccuugacacaagggucuaauaagaacagcccauuuucagccgagugcuuuauagacucuuguucucuguaugcuuaccaguugugagucucuguuaauugccaucuacuguaagaaacuucgcggauaagaauugagaucuauggguacaucaguaguuaaucaauaaucauuucaauaccaugucuauucaccauaauaauauuauuucauuauauccccuauggcuuaugaccuaucuagacauagguuccuggcuccauuaauguuaccagaucuaggcuucaugcuguagagcaggacuuagauccaaucagaaaaugguuguucccaugauguccaugucgcuguggcgccagugggcauuucuuacccugccagucauuguuguagcucucggggcuuacagcugaugggacugaugaucacuccucccaguacuguaaaggccagucagcagggaggaagcuuccagcucagcuacugucuugauuucucuuuguuuuauagcauaagcauagggugucuucgaaauaaggucuuacuauuaacuucuggaggguaacaggagcagugacaauagaguguaacauuuaugggucugugauacccuauuagccaauaucucaaaagauagggaaaacuagugagggcccaugaauguaagugaaucucacacaauagaagcaacauagaacacacuaauauaaaggaaaauauaaagagaauaauagaacagaaagaguuaaaugaguuggagaguggagggccugguagaagaugcaauucagggaggauaacaaacacuaaacacccuuuguaaaaaccaugugaaaaccuacugcuguagaagcuuccucuguguguguguguguguguguguguguguguguguguguguguaaagaguuuaaauggaaucaucucauagaagggaggacuauaccccaugaacaaaguagcaauaaauaaacuuauuuaaauagucaacauugggauugugacagcuugccaaaucauuagaggauggaagaggcauggguaaggacuaacauuuagauagcagcugauugugugaagauuuugagagguucagucuagcuauagaaaaccugggguagauugaacuugaugucuuuggagaacaaacugaaaaaugaugggccuggaggcugcugaggagaguaaagaacuacaugguguguguuuucuguguucuggcagccugugcuuauguagguugaauuuuccuauaagccaacuaauuccaugaguuuuaaacagaagccuuaaaguuuuuagaagaucauugugguagcucuucagagguaaaucgagggaaagcaagaaaagcagcagcgaaguaaguuagaagugguuaggcauuauaggcugaagguggaaucaguagagccugucaccagagagugcucagcccagaaacuaauuacacaaacaacaaaaacagacuuggugggucauguguaugcaugugcaugugugugucuguguguugcauaugcauacauguuuauaauaauaaaaaaaggcucucaauuugagaguggggaguguugaggggcugaagggaagaaagggagaaggacggugauauaauucuauuucaauuuaaaacauauuuuuaggaaacaacaacaggucuucuuuuggucuagcaaaugaauagaacagauuccuaccaauuuugauucacagaccaauuuuagcuuaagaaacuaaaauuguuaccuaaaguauuguccgacucuaguauagauaucauaauuucuuuaaggaucaagaagucauaggaucaagcagguauuuauguuuuucugugaaguauugaucuguaagguaugugcugaguaguaggaaauaggagcuuuuuguuaaauauguuaauauugaaauuccaaauuacuucucauaucucuacuucauauuuaaguagagauauagcugugcagcugcaaauaguuugaaguugaagggaaaagugcauguaggaguugucuuuauagaaaugguacuuaacauuaauggauggcaauaguuggccagcuaaaaagaugauucagagaaugaagauggacaucaaagccuggucauuccaugaaugaacgagaaucagaagagaagccagcagcacuagagaaagaugaguagugaggaagaggaaggccaagagaaggucagaaaccaaguagacaguguuucagcaaggagcacuaucagcucugagacgcugcuaagagacugccaaggaggaagaauucagguuuaaaauuguaacgugcuuuauagugauaaaagagccugguagaguaaaagaaauaagugaugugugagagaaagugaugcugcugaggagaccacaugcccaugggaaaaaccugucuuuagauaagaaccgcauugcuccuuccacuguaaccugagagagaaugaaggaaagaaaauugguuuuccagucugauuauuaauggagauuauaaccaguuguuucuauuuccacagaagggaaaagggaaaucaugaugagcuuagagugugaaggagacguaacggggcuauagggaaagagugaaacucaggugugugugagcugaggaacaugccgugacagcuacaagguugcaggcagugugcugaugcagacacagucacugaagugguaaaugacgguaacugcauaaucaaaaguaaacuuuuugcuauccacuuuuuaauucaggcccagugaaaauaugcuuauucgugucaauaacgaugggaccuacugugcaaacuggacuccaggggcuaucgggcucuacacuguucaugugaccauugauggcauugaaauagguaaauagaguguuaaguaagaaguugcugcaaagaacuagaauuaaaaucauccuuguauuguuuacccuugugacauacauauaaauagguuucauaacaucuuuguggcuucauuuucuccuucauagugagcaauucauuaggacauugcauagauauuauuugaguaugauuuaugugaucacucauuggggcugucaugagcucccccacuuuccuagugugucagugagguaugauucccuccuuaucucuguguuauccuguguaugccacgcccccacccccacccacccugccacagcaaccuguaccuaccauccucaccugguaggagcagacgccaucuauuugacaggugaucugguuuagauaggggucuggcagagaguggcuacuuagcacacauugcuaacuaaaagauuuuauuucucacuaguuuuggaaaaaauacugauuuuucuauaauguguuaaugcuucauuguauaauuuccauguaaaagaauaacaguagaaugaaaagugucauguauggauguugugaaagggugacuauaauaguaacauaacaucagaauacccuuuaggaaguugugcuguaaaccacuuauguuaucauuggaaauaaaaagguuauuugcauuuugauauuuagaaguuauaaguauucaaucagauauauaaauuauaaugccuuucauuuuaccacauugcuaaaaccuuuaggucagcacacauuuacuuagugcuuagcaaaacuugguuguagaaaagauaauuuuaucaagcauuaaagacuuauguguugcugagauuaaauaggcaaccuuauaauaacuuauaagugauuuuaaguagauauaaauacagacuugagcaggaauuuccaagcacugcugccacccagaugcuuguccuuucacguuucuuucagcaucauucagauagcaaggggacagagcagucuggauguccacugauaggcaaugaaaauguguguucuacaguaggguuuuucucaguuguaaagaaugaaauuaauaauuuagcaggaaaaaugaugggucuggaaaguauuacacuaauugaggucauccagauucuagaagaaaaagcaauugcccguuuuuccucauacagagauuacaagcguuaauguuaggaugaggaagaguaggcugugaccuagauaggagaccaugaaggcagcacguggccgagaaaggcaagggaaacaagaggagcccugauaggcaguguagaggagguacucagagagaguucuucuccuuagguagauggcguguggaaucuggcacacaaacuggaaaggcagagagacuugaggucauagccuuuguuugccaucuuuggcuccuuuauuuucaaaagugagagcaaaauggggaguggggagggaagcagcaaagcaguuuguuagggcuguuagcuugggguuagugggacucuaacgguggguuggcugugucucugauucuguugccugcucuugggacucuuugccuucuguuggguugcccuguccagcccccauaugagggcuuugucuuugucucuuguuuguccuguuagguugucuugguuuuuggaggucugcacuuuucugaagaggaaacgggaaauggcuaagggggaggggggaagugagagaaacuaggaggguuggagaagggaaacuguggucgggauguauuguaugaaagaagaaucuauuuucaauauaaaaaagaaaagaaaaacaaaaauaccauaaugaauuguaauccuugcuuugaaaaaaugaaaaguagugugacaguguguguuaggaauggcuucaguagagucuucaaucugauacagcagugagugcagauacuguucuguauugaagcugagaugggcacacauauaugugcagucauccuuuuacuuuccuacucacuucuacuauuuuuuuuuuuuuuuguccuaacucugcucuuuuucaagcugucuucaaucuaggaccuuucuuggccacagacaagggcagauaauaauaauaauaauagcuaauguuauugaauacuuaauacauguacauuguugcacagauauuuuaugucauuuaacucucauagugugagguagcuaguauugucauuccugucuccgagcacugagugguccagcaugaggacgugucucucaccuacuguguuaucacacugccauccaggccucaugccaacagucacagagcuuccauggugggaggugaauaguguucucaccugucucugugcuagucauagcacgugucagaaagccaugccuuauuauuauuauuaucaucauuauuauuaucauuauuauuauuuugaguuuguucaugaucacucgaugugcuccuauuaaacacuucaggaaaugcuauaaagugcucuuugggaaucucaagaccucauuuaaaauuuuuuuuccauuuuuccaacuuaguaucaaucaccucuuuuaaaaaauguaaaauucagguauuugucuucauuguucaagacagucuaugauguggggcuggagagacagcauagccauuaagagugccgaaugcacuuccaggacgcuugcucuccugucugagcaccuacaugcuggcuugcuacaccugcagauccaguccucuacaggccucaggcaugaaugggugaccagacauacaugguggaaaaaaccauauacauaaauaaaaaguaaaauagccuaugaugggcuagauuucccauccuuuuaccugaguagucaaauguuaauuacacuacuuuucuuacagaugcuggccuugaaguaaaagucaaagauccaccaaaggggaugauccccccagggacucagcuagucaagccgaaggcagacccccagccaaauaaggucaguggaggacaaagcaaaaguggaguuggucagagacugaaauuuuucaugccucaaaguagcucucaaauaucuaauauuuuacuugauuuauuguaguauuuuaauuuccaguaucccuaaaucagucugaagagcaguucauaagaauuauuccucucaaauuguacaauuuugcuuuucuggcuucuauauauuuuuuauuguuuuugaguguucuguucaugcuuauauuaaaaguauacuauuaacagaaagucuacugaaauuacaugugagaauucaagguuaaaacauuguuucauuaaaagaaacauuaauuuucuuauaucuaaaaacuagcuaaaggaauuugaauaaacuauuaaaaacuaugagaauguaauuuauauuuugaccuucuaaaaaaucaccuuuuauuuuuuguuauauaucuucauuacuuaaaguggguaaucauaaauauauuaaucauugauaucaaauauucucacguacuuagaggucuaccuucacugcuguuuuaaggaaaccagcuccagaggacugucaggacaugcugagauuguacuucuuuuaacuguauugagucugugcuuucucugccacugucaaaucuguucuuuucucagauucgaaaauuuguggccaaggacagugcuggucuccgcauccggagccacccuucccuucagagugaacagauuggaauagugagagucaauggaacuaucacuuuuauugaugagguaauuaauaaguaugaguaguuuauuuuggacagaaaaucuuuuugauauuugcauaauaacaaggaaacuauguuuuaauguuauuggguucuaaacaguuuuggaacuucuuuaucuaacuuauuaccagucccuuugggguuuuuuccuuacaaaguauuuuagucauauugauuuccucuagcaacugcucccaaauacaucuccccuucccaaccuacccaacuuugugucuucuuucugcuuuuuauuauuacuuagucacuuugugugggggguguuuugccugcaugaaugucugugcacccguggaggucagggagcagccucagauccacugggacuguaguugcagaugguucugagucuccaaauaggugcuggaaaugagacucagggacuguguaagggcagccagugcucuucaccagugaaccaucgcucuggcacuucuuuuguucuuucaucccacugaguccaaacugugcuggcccuaaacucuuaauggucuucacuagaaaguguuccacuaacaggggcuguacccuuaaggacaacugacucucccucuuccagaaacuaccaguugccaauaauuucuuagauggggugugggaccauucuccaugcuaggauuuugucugacuugaacucuugagggucuuguuaaugcuuucuuaaccaccaucaguucuugugugucagcugcacugucuugucaucaucuaccacccguggcccguacagucccuccuuaucuucuuccugaaugauuuuugagacuugggcagagggaaugggaaugugcuguagauggcccacuucagacugagcagucucuucccugcaucuugaacagaaguggguaaucaucacgaucugcagaaaagcaaaacacaaacagacaaagcagcugcugagguuggguagauacgcucgcaucuauaggccaauugggcaucaguuuaauacuguguccaucuaguaugguaauaguggugcacucucuccuagggccuaugaccuaucuagucacagguuccuggucuagacaguugugcuacagcgggguaagauggugguuccucuccuccucugguagugugcauaguaccuucagacacuaugagagguagcuaccaaugaggaagcuuccgggcuuugauaucucuguguucuaugaggcacaugugugaucucuucagcaauauggucuuacugucaguuucuggauggucacaguagcaguagccuaauaauguuuggaggucuuuaagucacuugucaauaacuccaaaagaaauaacccacuccuaacucgaguuucauagaauuacuaugaauaguguuuccuaaaauucuacucaugauuucugacaacaguagccuauaauaaaauuuagauaaacauaauuaucuauacaaaccuauuagaaagagauaucauuuagaaagauaugguaggaggcuggagaagcuuuucuacaugguugaaguugaaagccaauuaccaccuguguuucaaggcauaugcuuccaagaguuugagaaaucuugugaaaaaaaauuuauaggauauguucacugaaguuuucauauuuaauuuauccuccuuuuucaguaaaaacugggaaaauuguacuuugagcauaauaaaaccaguuaaacauaguaaccagaaccuuuagaaauacagcuuucuaaacauagacaaaguuuaaaugaauuuuauaauuguuuugaaacauaguucuuggguugccuuaaccuuggaacauccaaggaauauuucccuacagugcagccaaguagccuggauacaaaacauguucucuugagaaauggcuaauuuugcuguuagauuaucuuauuuuuucccuugcauuuagauuuuaauuuacauucugaaaacacauaagagaaauauaaccccaaaguaaaacaguuuuaaccacaaaaugaaauuaagcuaucuuuaucuauucuuaugcaacagcuuacauauuuaaucucuuuuucuuuuuuaaugagugcgucugaucuuggaagcugagagggccaguccugguuagagcuuggaagggagauuguuucuccuaagugugauuuucuugugcuuuuaauucaugagagaaguugcuuucgcagugucaccaugaaaaugaucaugcugcguggaugucccuugccucaaguucccccaucuaucuucuccuaucacagaugaugcagaaucuccacucccacccucuuuuccugcucugcucauucucagaccucagagcucccuggugcuuacaggaaggcaagcuccuuugcuuucuucuucccuagauccacaaugaugauggcgugugguugagacugaaugaggagacaauaaagaaguauguuccuaacaugaacgguuacacugaagccuggugccucucuuuuaaccagcaucuuggcaagagccuucuggucccuguugacguaagugaaagaugguuuuuaaaagcaucagaguugcacucuauccucauuauaaaccuuucuuuaauuaaggcuuuucaguucugagguaacuggucccuauaucaccuuuacuucaaaggcgccugagugcuuaagggcuucagugcagugaaagugggauaaggcucuuaaagcugucaguaguaguaaguaagaaauugaaacuaaacaugccuaacuccuuucaaagaaguaagaaauuaaaaugcuuacacuuuuuuuucuuauucacaaugcuauuuaaaauaaauuucauccaauauuuaagaaacuagaguuacuaugcacucagaaacaguggguuuguuaugcugacaguuugcaguuauuucuguguuaugucuaucucuggauccuuuguuuugauuuacgguacuguuguguugauauaagaugcgauuuuuagacuuauaucuagcgauaguaacucagacugagaaaaucauuaguuccuugauauugcaguagagugguuaugucacugucaugaaaguauuacuuuaaaauauaacuuuccuucuucacuaaguguuccugugacauuacuaauaaguagcauugguaugcagugcuuggagauugauaacuagucauggugguagaaagcagguagauacugugaaaauuagguucuucccccugguuuguuuguuuuuuuuuuuaaguugcacauuuuuagagugaaaagggcuuaauucuuucucucauuccaacuauucauugaauuuaguuuccuuuauuuaucuucaaccuauuuguguguguguguguguguguguguguguguguguauuaguaugagagggaggggggagggaaagagagaggagacaaggagagagaaagggagagggaaggggagagagacagagagauugauugauuucagauuuaagcuccuuagugguaaggacuaauuaaggauugucauucauauuugcuguuucuacaguguuaaauacuguaauuuacucauaguagucuuucaguauugcuugauaucuaaguugagugcuuuugucuguauaaucauugugcuuaaaauaauuucugacauauaugugugcuucuuaccuuguuugugucaugucauucuuauugugacacugucuuguuaaauguauuguucucauuuuuccaagauuuuaaguguuaguggaacuggugcuagagccccacuugaugugauuccaaaguguauguuuucauguuaauacaccuugguauaaugaagagauaaguguaaguauaguuacaaaaugauaaauaauugcaaaauuuauuaaguugcuuugugauaagcuguuuaauggcuuaacuuaagagauaauaucuaaggcagauaugaagaaaaaggaggaaauuaaaguaguauaauucaaaguaauagaacuauuauucacaucauuaauacguaagauaaacugccaauuuaaguaaguaugaguauuuguaugccuagugauuaaauguaaaugauuaucauaacuuagaagguaaauaagucaauuaaaguuuuaaaaugaaguucuaugagaggguaguucagccaguaaagucuuuccuugaaugagguccugaauucagucucuagcacucacauaaaauccagagcaaacugcuuagcucgggaaggcagagcaggggcaucuccagaccugccucaaaggaugucaccugagguuacacauauagacacacugacaauacacaauauaaacauaaaaauuaauaaauuauuaauuugaaagcuauaaagaaguaguucucaaccuuccuaaugcugagauacuuuaauacaggucuucaugcuuuggugacuccaaccauaaauuauuucauugcaacuucauaaauguaauuuuacaacuuaugaaucauaguauaaauaucugauaugcaggauauuugacauguggcccacaaaggaauuguaacccaaagguugagagccacugcuaauaaaguuaguuacaacaaaauuugauacaucuuggaaaauguaaguaaagagaaaugggugugacauuaaaaaacugucauaugacaucgaagacaguggugacucacaccuuuaaucccagcacucaggagucagaggcaaguaacucucuuacaauucaaggccagcccggucuacagagcaaggucuaggacauccagggcuacacaaaaagaaacccuacauccaaaaaaaaaaaaaaaaaaucacaaaacauuuuuagauaaguuuauuuuuauaauuggagauuuuuaagacuaaaacuaacauacccaauucuucauauauuuugucaaaaaaauuggcaaauauacauuauaaggaauguugacuagaaaagagauauaccaaagaaagcuaaugaguguguucuaaauucuuuuaaaggcaacgagggugucugaauguacuuaugcacuacacagaucgcuuucuaucuagucuaauuguuguucaccuaaagaaaguaugcugauauucaaaauuaggagugcuaaggauuuggaguagagugaagggagauuuguugucuugugagucccuuaucaccuauugauacuuagcaaauauuucuugcauuucacagacauucucuugaaaugcuuaauaacgucuggcagcacaggcuugacauccuucagauuuucuagcuuuagucugugaguggguuuguuuuuauguguaguagcauguuuuuaauacugauaauauuaagucauauuuaauucaacuggaauaaauauauuguccuuaaauuauuauaagcaguuaaaaggauacuguaauuuauguacaguauugauuuuguuauauuuuuucugcuuuaaaauuagcagcccaacuuagugcugugcuuuucuaguagagugauuuuuuucccauaggcgacuaaagauguccccacuguaguaauuaacuuacguaaagucugaugugccuugagaaacucaucauagaauugaacuuuauagauuaguaauuuagcuagguuucuaauauguguuaauauucuaauucuuugaaaagcuauuuuuagacuaggauuuaagaaagaaguaaguuaaauuauuguguauguaucucuguguugcgccauauuaaucuuugaaguuauauaguaugaaaacauaauuugucuuuuguaacaaacugaaauugagucuuuagauaaauuacuauuuugauaaauauucauauaauuagcugaaauauucuuaaaccuucaaaauaaaacuaauuucuauuuggugagucuuaauacuugauaaauaauuuaaauuuacaguaaauuuuuguagugugagaguuuucugcaauuauaggaacuaaagcacaauauauaaaauuagaauuuauaaauaauuagaauaaacaacuuuuuucacugacaaucuguugccauaguauuagcuaaaauuuuuaacaucauuuuauauauuacugacugaacaaacccuuaauuuuguacaaugaaauuaaagagagauauaagcaugaaaaaugaugcuaguccucucuaaugcugaguagaucugcaugaucuguaacacuugccugucaugcugcucuuaguauuaaagucauguauaguaaaugugaaaauacuucuuaauauugacauuuuauaucuaaauaucugcaucacuguucucagggagaacagccacugacagacacauuuucauacacauugaccauccaauauguguaucauuuuccuucagcacggcuuuuuuaaaugcuuuguaaagauuucacuuuaccuaaauagagaggaccuauugaccaugcauuccaaauuucggggauaauggcucugguuuccauguuuuaacuuuauuugcagacacauuacuagaaacucauuuuuacauguuuuauauuauauaauuacuauuuauaaagguguauauguaugucuauauauguuucuguaucuacccacacauaacuuaaggaaauaaagaagcaaauaucuuuauuuuucuauaagugaucaagaauuuuaauaauuauuucauguuaaagucaucagugauauauauuucaauuaacauuugaaugccuugcuugaguaaccuuuuaacacagucuuuacaugagcaauacauuuaugguauguuugcugcauauugauuauauuugaauuuuagguaaaaugaaguauagguugauugugugauguaucugugcaaaacauguauuacauaaauuucuauuaaaauguuugugaaaaauaggacuguguuaucacaaauuaauuguucuuuaacaaaauacuuuggaauucaauuuggaaauccugaacgauuaugauuuccuaaacuuugagaugaacgaguuauuugucuuuugauaaaagauuaagcuuauguuucuuuaugcuuuucuugaauuuuuuuacaaguaguuuuugaaaacacuugcuaagaucuuucuuuguauuucuaucuuuuucuuuuucuucuuucauuuauauagggaggaaauauuuuaaugauuuuuuuauuuggguuaaguuuuuuaaauuuugauuuuaaaagugaugguuuacauacaugccauuauuauuuguaagaguuguauuuucuacguagucuccauuguugacgucuuuauaaaacaacagauuauuuucugucauaaaacagaacuggcuuguaauagaacaaauaauguucucauuuaaggguuucaagguuuucuucuuacacugacucuuaagccuuaauagcaaaaucugcucuuaauguuaauaaauggcaugacacacuacaucuacagagagcuuuugacaaaccuuauuuuucagaacuuuggugugugguuuacucagguggcuucaguuucacuuuagcaaaauuguauuuccuauuggcgcuggaacucaggaaaugucacugugaacgcaucuucugcagaugauccucuguucccuuuccuuguugauaucuuucuuucuuaaacuuuguugcucagaauaucuuuaaugcuagccaaggagucagggauuuggacguauuuucauggacuuccaaagcuuuuuuuccccaggugaguuaacuguaaggaacaauaagcauguuccaggugucucagcaugugcaacaggauugacauuguauuugaggcuuugcuuagaguuaagaaacugaaaaguuacugggggaaaacucugugcaaagugcugcaguugcguuucccucuccucuuccuccagugucauuggcuuuaaaugaaggcgcacucgcucgcucgaggggcugcccagcuacagggguuccuccaacaguuugcuccaacucacuuuguucagcaugaccucacauagggaguagugcuguggucugaagcucuucuaugcagccagccccagccuguucuuuugaauuguccuuuugacuauuuauuuuagauaagggguugggaauugaaugagaaauaaacaaauaaauauaaauauauauuauauaugauugaaauuuaccaauuuuauagucugguauacgguccacauuuguauauugaaaaaaauguaccuuuuaagauuacuuaagaaugacaugcacaguuacaauuuuauguccaccaauuaauuucauauggcuuaauacaaaaguacuuuuuaucuuuuaaaaaaaaaugcaguuuucuagugacucuauauagcuucaauaaugauuagacaauaugaacugucuauuaagacuuuccuguaugaccuuggugacagacugucaggagcaucagcuuugucaugcuagcuccccuugguuacccugaaauggaauuaaugaccccgggagauagaucacugaguaacacucaagcaguuuucaugcucaggauugcauuuugcuguuauuuuuagugucaacaugaaacuuuaaaaagcacaaaaguuuccuccucugacauaauauacuuacugaaguuuacuguugagaaguagcaauuuuuaaauguuuauucaaaaaucuugugauuauacuagcacuguucaaaguuuauauccuauuauaccuuuaaauuuauuuuuaauauucucuuuacauguauagaaguauauauacagauuuuuacaaaugaucuaugaaugccuaauuuaaguuuaguuuacuuagaaaucuaguauuuuugagucacuaauggucucauuuccaguaaguugucaauauguaaauaacaguaauauauaaauguaaauaaauuauugccauaguauauauuuguuucaggaaaaauuuguggucuuuuauuaccaccaggugaugauuuacaaaguauauugugaggggccuagguuauagguacuauauauauauauauauauauauauauauaaaaucuugaauagauauacaucugcuaauauaaagauacuuguagaaauaaaaaaucugcuauaaaguuuaucauguguaaugcuaguauuaucauuuauauaacuuuauucuuauuuuuccuaaauuuaugugucucauuauaguuauuuucuaacucuauguaaauacaauucauagaguucauaauacgauauuuaaagguaggcuuguuuuucuuuaagaaguguaauuguaauucaauacuugccugaguccagucaucaacaccaguuauaugggaauaugacuuuggaaaacaguaauauaggaauagaaaacaguaauaugggaauagaaaaaacccaguguaugcacauugcuauauggcccuguuauagaaaaaacccaguguaugcacauugcuauauggcccuguuuguuccauaagaaauauuucaucacaguauugacauucagcaggaaauacagagcagaaucuuuucauuuagaaauaauacuuuuuaauacggaaauugaaauacaguuuaccuucuuuaaaaauguaucuuuagugccaauuucuccucucuacuaaaaauaugccuuuuuuuacugccacuagcauugauaugucauagaauagugcuggccuagcaaauccagaaagauauuuucauuuguccugagguuugcuaaaaucuuguaagcauuaucuuauguacuauaguacuacauuucucaaauuuggaggcaugaaagacaaaaauucaguuaauuuccuguuccuguuuuuuguuuuuucuccucaaauuuacuuuaaauaucaauguuuaacauugagugguuucuuuaguaguauuaguguuagcuauuauuuuaauuauauauuccuaauuggaaaucuuauagacuugcuccaaaaagucuuaauaagaucaugaaaguaauaaaagacuauauuuuguuuauuuucuuuuccuauucaauuuuucaggaaccuaaaacuaauacugaugacuuuuucaaagacaugaacuccugcggcccacaggaagcaacaaugcaagaacgagaucacccguucuugagaggugggccaggcauguacaagguagugaagacggggccuucaggucacaacaucagaagcugcccuaaccuuagagguaucccaauuggaauguuaguucugggaaacaaagucaaagcagugggagagguauggauucuuguagcuucaugacuuucugauacucauuuuuguuguauauaaucaagcaucacuuuccuuccagacugucauuuccaucucagguucuuaaauguucuuaaaugcuguuggcuuuuacuugguuuggaaacacuaacauaauuaugugugcuuuaagaaaauuauucucauaaauaucuugugaaaacaguauuugcauuguuuauauuaccaucuaaguuguguuguauauauaaaugcuccgcauuuggauauagcuuuucauuauucuaacuguauguuauggguugucagcacuuacagcauuuucuaugaguugguacagagaugugacccuucaaaaguuuccauuucuuuguucccauucacaggucucacugaaguccugagcaaauaaaauuauucuuuagaccacuguggcauuugccuccgcagauaagcuucaagauguagugugucaugcuauuucucagggucaggggcauuucaaaucacacugcaggcaccaguaaccuaaggaagacugccucuacuuccuuaggacaguuuaggucuaaaacauaagccuuggguuucgggcauacuugaaauuaugcagaggugaccuuuaugcguuaaagauauuauuuuaauuaaaggcuuauauaaacaguauuucacagauguuuuaaauugucuuaccucaggcuguggucuuaauuucagaaacuaauuucacaguagaaauguguuggaaucauuacauuguucagaaacacuuagcuuuguguuggauuucaccuggaugcccugagagaguuaagccaaucaaccaugcuuucuguuauguaccagguaaccaauucugaaggugcaugggugcagcuggauaagaacagcaugguagaauucugugagagugaugaaggagaggcaugguccuuagcuagagacagaggcggaaaccaguaccuacggcaugaagauggcaaguuggcuucaauuugugauucguuuucaugaaacuuuuaguauacauaccuuuuauguuuauugcauuaucuuuuccuaaaagagguuuucaaauguuuauuuuuuaaguaaaagaaaaucuaaaaguuuaaagaucuuacaucuaacaaaauugacuuguaaaauacuugaguacuauaugaauguccauaacggagaaaaucacaagaauacugagaguguaguuaugugucuuuguuuaaaaauaaggacaacuugcuuuuguauuaauaacuuuaauuuguacaccucacucuucgcugcaagucugggccugaacuuucacuccuaccaugagcuggaaguucaguuuucaaaacuaauuucaguauuguaugaggaaaucucauuuagcugaauuuccucucaagaaaggaauguuggauaaacgcauagcaucuuugugugcauuuuuuuuguuguuggaauuagcuuucagugcuauuuuuccaacauugauaucaccaagauuucugucuugaugcuuuuugcugguguugguguugaaaagacuuauuucucagugucuuuaaaccagugucuuuaaacucagugucuuaugggcaggcuaucuuuguaccucaguuuguagacacuucugacacauacuagcuagcucauuauaggcuuauuaugcaaaugcuagcucguuuaaaacaucauaguuaggauaucaagcuagaauuuucaagaauauauaucuauucauauauucauauauguagucuuuauucuuaauuuagugucuaauuuauuuuuauaaauuguaaauuuuuugcaauaagauuuacuuauccagaaauauacucaguaauaaggggggggccacuuaaaagcauauauccaguuuuuuuauuuucccuauauacuugauuaaccaaaggaauaauuuauaauaugcuuugaccuguuaagcuggucugacugagaguaauuccauaaggauuacuuuaaaucaaaccauuacaaacucuuucuuaggauuuucucugauauaugaacagggaacaacagguacaaaauuuaacuuuauagcugugacuuuuauuguagaacaaguucugcuggaucagaauucucaaccuccuccuccaagcccuuucucaguacaagcuuucaauaaaggggcaaguugcagugcccaaggauuugacuauggccugggaaauaacaaagguaggccuccaaugugagucuuccugcugaggcuucaggaaaguuuuguuacuuuuuacucauuuuuuuccuucccacaaauuguuauuaaaauguguucauacuaaaacuaagacccaaaguacuuaacagguguucuuuuucacaauauuguaucauauuaauuucugccuaaguuuccuagauuucuuacucauauugacuauuuuaaaggcacucauucuaaacuuguauucuaaagaccuaaaucacuaugucuaguaaauaguuuguuaacaugaccugugauuaggagaguaaugcaaaugagaaacaaagaauuuucuuaagcaguccauugaaauguacucuuaggaacguuguauaugagcuuuaugaguuauauaugguuuuaaaucucuaacuguuagauuacaguuauaugaaauuccauuugaacauaguauaaauaaugaacuagaaaucuauaaaaccaaaacuacuaaaguauuuuaauguaaaauguguauagcuguuuaugcauuaaugaacagaucaacaucauggagagucuaaagaauucuucuaggauaauuugguucagaauugcuuuauggguaaauucagauauauucuuucuagugcaccuaaucucgauuccuugaaaauuugcaauauugugagaaggcagccacccacugagggauaagggaggaggguuguugacaaggaaauaguuugaguuuuaaguuuauuuaagccagguauaguaucuuacuccaguaaguccagcacaagagagagacagaaggccagcauaggcucuauaauugacuugaggucaggcuaggcuacaugcauaucauacauaccuaucuccaaaacaaacaaacaccaguucuaaaaacuguauucaucugacuugcuguuauuuaaaaauuaauaaugaaaagcacaauugcauugauguaugauaaagucacauuuauaauuagguuuacuaauguccacaggcuuggcuuuccucuccugucuugacugagucgcuuucacaggcuuaugcagcuuccauucacucugaucucuguuaacuuacagagaaggugcuggcuggguuuucuuaauguucccuuuucucuaucguucaacucuuaaaugagaacuucacugcuuacuuacugccauugaugcuaaggagcaauguguccaaaucuguguuuauuuuaaugugugcuuucccugugagccuguccucucacccugcugacugcucucaggauagauaagucagucuucaaaauggaauucaaucaagcaauguaaaaauaaaaucacuuuauaagaaauauaagucuugcuguaagcauuuauugaauggaaauaaaaaguacuuuuaaagugcuuuuguaaaucuuaauuuacaauaacauucauuuaggaauauauguauaccuauugagaaaauauuacaaagguuaaauuugaugaaaugcgucuaacuacuauuuaacuuaacuauuuucucuugauuuuucuuuuuacugcacaaguuuaagaaauugcuugcaaaguauuuugauuuagaacaauucaaacaauucuuuauaaacuaaaauauuuucuggaaugugaaguauuuuuuaaaaaagaaaaacccagucaguacuuauguaauuuaaaugcauaaucccauagaaaucuguaccacuugagauuuuuuacuuaauuuaguaaauauauccagaaaggcacugucaguuucuucguugaccugacugaaggcuuucagcaucauguaaaguacuugaaaugcauauguuuucacaaauacaguuuuuuaucuaauuacauuauuucuguccuuacacuaguuuauuaauauccuucauguuuaauuauaacgaaaaaauaccgaucaaauuaacucauucauuuuuuuuuguauuauagaaguuacaaaauguagcaaaagaauuccugcuuuugcaaaaaauccaguuucccuagcagaaaucauuucuagaagaaauuauugacuuaugacugugauguaguugcauugcugaguugaaaacauacuuucucuaucuccauugaguauacauuucaggaaaaugaagcgaaggaaguacguauuuucugcauggaacauucugcagaugagggagguuggcauuaguucuuccugagcaccauagaauaaauaccuuuuaccauaccuaagaucuccuuuccucucugucucauacuuucucucaacacaguauuaauaaacuuaaguauccuuuauucugucauaaauauuagggaauguuauauaugaauuuuaguuagauuugcuucuguugacuacuauauaagacuggugaaguauguccauugaaaaccuccaaccaacucugauggagaaucagaucccuaaugugaggacagugaucaccggcuuucccuuuucugaacuggcauagcuuuauuuacuguuaauuuacuugacuguuguaaaagcaccauuuacuuugccauuuuggguguuauaaguaacaaguuguaguuuugacuguuuugccuacugcaggugaucaacugagugccauauugaauucuauucaaucacggcccaaucucccagcuccuuccaucuuugaucaagcugcaaaaccucccucuucccuaguccacagcccauuuguguucggacagccccuuuccuuccagcagcgucagcuucagaguaagucugucagccuccugccuccucaagccuuucugaagcuugucucuaguuacuggucagccuguuagccgugaccucgacucacugcuucgacuuuaguagauguuaucccacccauaguucugaaguauuucaacuguucagagcuaagauguucugcagcaaaggcauuuguuuuaaauaaauauaaaguacauagaguugcuagaucugaccauuguucuauuuuaauucuaguaaauucauacuauaaaacuuguuaagaaagacauuuuuuaaucucauuuuuuuaauaugcaugguuuuaguaagcauuaguuauaguaauaaguuccauuguuucauugaauuuuuguuauuugguacaagcccaaaaagaauaaaccugcuucacuauggcagugaggugagaagggagguacuggcuuguuuguucuacaugaacuugauaccuauccaugaacuguaaagcaguuuggaguuccaugguuucuuuaaguugccgucuccucaccaccuuugucuuuugucccucaugucuuaucuuggucacuugauuccaguuuuacagucuagggcuccucuacccuuuacuuaaccauaacagugaccuacacugguucaaaacaaacucagacaaaucacacuuaacugagugcucauuucucuuagagccuccugagccuuuccacagaaaaacugcacucugacaacaacagguucuuuuggcauuucaguucuccuguugucugauuaaacacacugacugaguacgaugucuauggaugccucacuuuccagcucuuuuguuuuguuuguuuguuuguuuguuuguuuguuuguggagaugccuggaauucaacucugaguuuugcaugugccucuuacaugaccucuucacuuacacugcauucauaguuaagccgaaguuacagcaagacuuugcuaacuguuguuaggauuacuuaagagaauacuagagucuaggcaaaaauuauauuauucauugguguaguauuauuaacauaaauuaaagacuauacaagaauaugacccuucacuugcaaacuuuauaugccccaguacaggggaacgccagggccaaaaagggggaguggauggguaggggauuggggggguggguaugggggaccuuugggauagcacugaaaauguaaaugaggaaaauaccuaauuuaaaaaaaaaaagaaugugacccuucauauaacaaguugauaguauacaacagguuuauaguauauaauaagcauguuuaguacaagugcuuuggacaugcaguuguguucacucucaaccuuauugacaugucuauucccuuaagacucuccaggaaacagacuagugcgagauacuuaguuuuccugucuaugauaagcaguauuucagaagaaugaaagaaaagugaacacuuagucuugucuuaguaauuuuaugaagcaccagauguuuuaucauuacaugugcucugguugcaggacguucuaaaggggaaaaauaguacaaucagaugaacaauucuuauuauagaaauucaaauugauucaaauuugauuguaauaagauaaauuugccuaauagugaucccauauguugggcuagggauggguguuugcuuaugauaaagcacuugccuuuucuauguaaggcccuauagucuucccccaugaagaaagauaacaguaaauuugauuuauccagcuaugcuauauuugcaaauguuuuuaugccaguauaauuuuauacacauuauguaugucauuaguaccaccaauucuuuuuauuuuaauuuaauuuuuucuuuuuuugcuuucucacuuuaugcacacugacccuuccagucacccccucccccaauaauccuucccucauuccuccucuccuucuccucccaguggguggggcccugugcauucucccucucugcuacuuuaagucugugcaagguuagguguuucaucucccacuggggccacacaaggcagcccagcuagaagaacauaucccucgggcaggcaacagcucuuaggauagcccuccuaguugcucaggacccucaugaaggccaagcugcacaucugcuauauauguucugggaggccuagguucagccuguguaugcucuuugguuggugauucagacucugaaagucccaaggacccaaguuaguugacucuguuggucuucauaugaaguuugauuccuccuuggggcccucaaucauuccucucauucuuccauaauaguccccaaguuccauccacuguuuagcugcggcugucuguaucugagucagcugcuggguagagccucucagaggacauguuccuguugcaagaauaacaggguaucauaaauaguguuagggacuggugcuugccugagggcagggucucaaguugggccuguuauugguugaccauucccucaguuucugcucccuccccugugccugcauuucuuguaggcaggauauauuuuggguugaaaguuuagagaguggguuggugucccaauagcuccacugggacuccugccuggcuacaggagguggccucuucagguuccauauccccaauguugugagucacagcucaagucacccccauugauucuugggugccuacucuaucccaguucucuguguugucuuggaggugcucccugcccucaccucaccucugucagcugcagauuuccauucaguuuccuggucguccagccaucucuccugucauucccacaccugauccugagccccuuacuccccuuuccauuccccucuccccaguucccucaugccaucugcaucuuauaauuuuguucucccuucuaagugagauucaagcuuccuuguuucagccuuccuuccucuuuagcuucuuugggucucuagaauguagcacggguaucugguauuuuauggcuaauauccacuuauaagugaguauaugccaugcaugucuuuuugggaguagguuaucucacucaggaugauauucucaaguuccauccauuugccugcaaaacucaugauaucuuguagauaaacagagaauucucaacagaggauggcugagaugcacuuaaagaaauguucaaagccuguacucuguguuggucagcuaagaaccacccacacucccacuuccaccacccagccuaagcugacuugcccacacagccacaucaucacuaacagacaaugaaacacauuuccacuguugccaauugcuguauuuucccuaugcuccuuagucauuagggaaaugcaaaucaaaacaacucugagguuccaucuuacacucaucagaauggcuaagaucaaaaacuggagcgauagcacaugcuggggaggauguggagcaaggggagcucuccuccaugguacccaugguacaugccaugggugggaaugcaaacugguacaaccaauuuggaaaucaguuugguauuuucucagaaauuggaaauaguucuuccucaagaucgagcuauacuacuccugggcauauaugcaaaagaugcuccaccauaucacaaagacacuugaucaacuauguucauagcagcuauuuucauaauagccagaaaccggaaacaaauuagaugucccucaacugaagagugcauucaaaaaaugugguacaucuacacaguggaauacucaacuauuaaaaacaaagacaucaugaauuuuucagguaacaccaguucuuuaccaccaccuuacagcaaacuugaacuguggccuagguagauuguaggauguaugcugagucacuacuuuccuguaccccuacaguggcagguccuuagaucauuuucuaauccacacagucucagcagaguaucacuaaacucugacugccaaaguccagaaaucagaagucucauuagcauaacguuaaggaaauaugggacuaaaauauaaucuuaauauuugaaaauaauuuauucuuauuuuucauaucauguuaggaaagucaguauaacaagcauuuauuaagacuagagcuuuaaugccauguaucccgcuauauuuuaucuuguuauauacuguguuguauuuaaaccagacuuguucucaacaccaaaugaggauuaucuuauaguuuuauguuaauaaaguaaaaauauuauuucagugauuauauuggccaauuuagccuauacugacagcaguaccacaguguauuucagcacuuuaaugcguccuuaucugaaaucauacucucucugauuuacuaguaaagcagacaucacacagacagugacuaagcgauugucccuaaaagguugacaguaaaguggccguggcugcaucagacuugcuacuggggacagaugccaggcuucaucuccacucucaucuucauaaacacggcacagccuauucuuuaaugaacguuuuaaaacuucuacuuagacaaauugacuccuuucuucuuaugauuuuacuuuuuauguauugcauuagaauaaaaggaaaaaccaauuuccuaacuguuggaacucagguuuucaguuaacuagacaaaaucaacaaacaaaaugcccacguuagcauuaacauuucucuuggcuuuauuuuuaguacuuucugggauauuugcuuuuacuguuaguuuuuccugaaggguagucuuucacugccuuuagaauuuacaauaaucaucuauacauuaaauuaauguaauugcuuuauauguguguggguuuuaugcauacuuguuucugucugugucuguguguacacacacagcuguaugugugugaaggcuagaguuuaacaucuggcuaccuuuugagccaggguuucucacugagccaggaaccggcuugcugacuguacuagauucucugaccaguaaguugagagaucagccuaucuaucucugccuucucagagcuggguuuauagacauguaccccagccccaaggcuuugcauacugggcucugaaccucacgguuccacaacaggcauuuuccccacucagucaucucucaagcccccaaauagauaauuuguuaauugucagaauuuuauaucaaauuauuuuagauaccaugcaaauacucuuuuuaugcaauagacuauuaugcaaauaacaauuauauuauagaauuguuguuuuagaagaaagauauaacagauuucccuuguguguguacgccaaguuuaggauuuuucuuuacuguucuacaguuaguaacuuuaaacuuguggaauuuaaaaaaauaauaagugcuuuaggaauaugguucuagugaauuaugauuccuaaacugagaagggucaacugugagugagaacaguacauuccuaaaauaguaaccauguuuuguuuugguugguuuuuuguuuguuuguuuguuuguuuguuugcuuuugagacagugucucacugucuaguccaggcuagccugggacucacagagauuugcuugccuaugccuccuacuuucuuaggguugguaauaauaaugugcagugugauuaagauaauauacacucuugaauugcucauucaaugcagcaauuuucauuauauuguccuuccuaaaauuucauuuucaguucucucaguauugccuaauaggaaccuagaaagccauugacagggucacagcuugaugcuagcacauaauaggaaauuuuaaaaauaaaauacaaaagugaauuuaauaauacauuuaucucuuucuaaaauaagugcucaaccuggauuuuauuucacacauguaacacuguguuauaacacuugaaacuuuucugucagaauccaugaagagucauucucuucuuauagcucucuaauggguuagguauuucugauaguuugugugcggugucaggaaugguccagaaaucaugcauucagacccaaaccacauguuuuuagaaugcuuuacuuauuaaaauguaaaaguuuuacuguuuacuuauuuuuaguacauggauaauagcuuuaaaguucaguuuuugugacaguaaauaaagugaucaggaacucugauacuacggauucagaacaaagaaaggaaagagguaaagacacgcuaguauagagaaaauguuguuguaaggguggguucucacuagaguggcugugacacaggccuggcugugaagaacuagugacgcccacagcagcacgguguuugagggggcuucaaugagggacagggacaugagauucaggcacugcagagacacuggauuguucuuucauuauuauuacuguuacuaucuuuagugaaguauuuaaugucuaaaaaauaauucauguuauacaaaugaauuaaaugacuggucucaccuguagaauuuaauuauuuuaaaaagugccuucuuaaucuucauaaaguauuuuacccauuaaccuuuucuuuugugaacaaucucaguaugucccuagucacacuuuauuuccuuuagucguuuuacaguaugcauuucugacucugagaaaaugucaauauuuauucugaaugauacguagccuggaaaacguuuacagguguuuguccucacacguaagacauuuugacuuacacacaugcuauaguuccucacaugucuauggaugagaacuucagguuagugacauuucuuuggcguucuggccccacccaucguccugauaagccugauccuacagacugaagcaaggcugccaggaaggagacagcuuucacagccaguagacugguccccugcagcagcugccacuuucuaguuugucucuuuguuguugguuccuuuuaacacugcaguugagccuaagcccaugaggcugccagauaggcucucuuaacacugagccagcuucccacaucuuaacacugagccagcuucccacgucuacuuuaggucuugaggaagagaaaaacagcaaacacaucacccuccuaacagucucaacaguggcuacaaacccugcagcuaagauuuaaaacccugucucugucagucuguaggaucaggcuuaucaggaagauggguggggccagaacaccaaagaaaugucacgcagaagagucucuuugcagcuccugauuuucauagauuuaugcaaaaagaaaaccauucaaaaguaaaguguaaaguuuuaguuuaugguggauuuaucacccugucucugucagcuuuccauuuuugauugaccccguggugugagacuuccuucugagcccuaggacauccucggauguucgcgagcuuugacagccuuguaaccuuacacuccuggaaucagauuuauuucccuguugaauguguucucucuuuggcgcuucauuucuaguuucgguuguuuguuuuguuuuguuuuguuuuuuguacccuucccacaagugugcaucauuuugcaccuguggguccaacucccugauggucguaagcagugcuguagucccauuaaugguaaugauaauuacguccaugucuuuugauaccuagcuucaucuuuucauucugucucacccuucacacaguacaggugccauaagagugaggacuucauuuucaggaguguauuuuuggucucgaggaugacugcugauauauaauacucaauauuguucauccaguuguuucucuuuuuuaauuuguaugucaugcaucuuuuaaaucaucuacaagaauaaaucagucaaaaauaucacucaugcuguuguagagguauaugcuauauauguagguuauuuuauuuguguggguauguguguauauguauguuguuugcuugugugugcaugaaugcaugcagacacacauguacaggcaagugucgaguccaggagucuuuccugagugcuguccuuuauggcccucuguugauuuuguuuaagacaggucucugacuggaacugggcucacuguuuccucuaggccagcaggccaaggaggcccugggagccuccugucuccauugucucagagcuagggcuaaagugugcucugcugcagccauacuuuguguuggugcucgcuagcacucauacucauggagacccacacucguggccucaugccuguggagcaagcccuuuacccacacagccguuuccccagcucucuagauuuuuauuuucaaaaaugcuuuaaaaaguuaucucauuaccaaaguuuauuucagagcuacugauuaauuucaauugccauuguugcaaugcaguguuaggggguggugaaaauucagcauuuuaauuauuuuuagcuuauucugcuuuaaaguuucuauuauuuacuacugcauugaaaauaaguaaaaugucuaacaugucccaaugaguuuuaaauaugcuuuauuuguguugugagacauuuugcccaacaggauuuaauaucuuagauaaaauaucuauuacaaaaaaacauuaaauacugggguuagccuuaagaaauguaggcauauguacauuugaacauugggccauucuaagauaaacauuuuggaaauaauaauaauaaaaaugaaaccauucauaaaacaaggaggcaauacuuaaacuacaaguaacauuuuuuucucuaccaucauuguuucuguguauaaccuuauuuacagguaagcaaccacaggaauuuaacaaacuaaagaaauauugcucuaaauagaaaugcucaaauuugaucaaucagaucuauaagccuuauuaauaguaacagcacauuuggacacacuacccauacaauucaucuaaauacauuaauuugaccuuuguuuuaaaucuuaauuuuaaaugaacauuuugaaaacuuuuagaauaguuuuaaguguauaauugcauaccauuugaaaugcuuuguuuuugcuuguguucucuaagcuuuuuuccauugaaucugugcugcuucuuugccaauguuuuccacuguagacucuccaucucgcaaccuugcuucucgugagcgcauuuacaaacauuuggguguagcugggccugccucugcucucucaucucugucucacaaacugcaggguggguaugcaugcaucgugagcaccugggccauucguagugaauggaggaggagccugcaaaccuucauuucaccauuguccugugugucccauuccagauguuaaauuaagcuuuaucauuuuauuuagaauuuuguguuugaaauuaugauguaucuguuuauauuauauuguauuauaauuuauccuauuauguauguuuaucauaccugggguucagauaucauuccuguuagucuuuaaagcuuuguaaggucuuaggaguaugaaaaggauugccacaagacgauguaugugaauuguaaaacuuggauaaaugugguuucucauggacaagcuggaucgcaaauuugcagugcuguauguagccugacuaagcagccuaccauucuaauuacuauagaaauauuuuggaaauuaaguuaaaagcuuuuuaaaaacuugauuauuaauaaguaauacaggcacaaguguccccacacacuaccccuuucuaugaugacucuuucuuacaguauuuuaauagugaccuaauuuaaaacuuuuacauuuggaagugcucagugauuaacagacacaguuucaaauauuuaaaaguaugcacuugguucuuuagaguauaacaaaugcuuacucaaguccuuuugccauaauguaaucuuuaauuaaagguaaggacacuugccgccaaggguggcauccucucuuggauaccuguaacuuacaugauggaaagagagauuguccucugauauccacaugcacacaugcccacacgcacacacacacacacacacacacacacacacgcgcgcgcgcacaccacagauaaauaaguaugaaacaaaaccuuuaagaaaaaaagaaacauauaaaugguaaaaauuaguacaauaaauaggaccacaaaucagauucauguaugauauauagacuaucaggucauauaaccaaauaauaugccauauaguaugacguauuuauuaauauaguauuacuuguaucauauccuagcaugauauuauaugcccugauuauaauuuugcuaauaaaaaugauauuaaugauuuaaugaauaaauccuuccuauuuaacauguucaguaacauuuaauuugguugacuauacaacguuuuuagcucauucuuuguaaggauuccuuauagguuaaaauuucuuuccuacuauuuaaguuuacauauuauaaacauaauuaugaaaacaaauuaacuucugaaugugaagguauguguuguccaauaauuuuaaugaaguauuuggguuuuuuuguuguuguuauuuugggauaucaacaugauaauuuuuaguaacacuuaauacaugcugcaaaauuacuugaaagccagaugaaaauuguaaacaaaaauuagcucacggguuuacuacccuuaaaauucucuuuaaaaguauuuuuaaaaacauuuugaagaucuauguucuuuaaaaggauuuaguugugauuugauaaauacaucuugggaagaaauucuccaucauuacuuaugcacuugaauuccaacaguuauuuguuuucacuuauagaacucaagaaaauaucaccucuacuagagacaugguuucuagcccucucaguguacacaugugcauauauaggacaagugauguucccaguacuuacagguucuauuauguagccaacaacuguggguguguacauuguacaacaaauccaguauuguggauucacacacuccugugauaaguuaggacucaccuggagcagcuguaguuaaucuugccagagcccuucuaauuaaguaggaauccuaaacucgaaguugcucuuuucuaugaauuagaaaauucaguuaaaauuuaauuuugaaaggauucuaaauaugaaauguacuacuuguuuacucugauuccucgauauggguugugcagcuccuaagauaaguuaaaggugauuuaaaaccuuccaucucucuccugaaacaugcaacaaccacaaacacccuaguaaccaaguguagcaagcuuaagauugggagcuagggcuaggcugaugcuaauucuaccaaauauaaugcauuuguuauaaauuuugcucuauacuaguacaaggucaauaagguaaaacaaacagcaacauugaccuuuuggggacaauuugcuagagcuuguuugucaguuacuuccgguaaucuuuguucuccuaguuagcauugacacuuugcaauuuuuauuucucuuuacaaguguauucuaaucacaaaauguauuuugagaacauuaaaaaaaaaaugagcauauaagggccaauagcaaaacaaaggagagacagggagggagaaagaaagagggagggagggagagagagagaaagugagcacaaaaccaacuugcauguuuaagaaagaagaaaauucaugauggaguagaaauaguguucaaaauacuuuuauucuuucaaaagaacuauuuaaaauuuguuugcuacauaucggaauguuguagcugaaguaaauguuuguuguaccacagugcucuccaagggcuuauuuugcccucucauuucacuacagaauuuuucaucuugauucuaaucuuacaugauugcugucacauuugcugugacuauuaaagaguggauucucagaaaaucugaauguguuggauagcaaaaggaaagaaaagaaaagaaaagaaaagaaaagaaaaggaaaggaaaggaaaggaaaggaaaggaaaggaaagaaaagaaaagaggaggaagaaaaaugaguauauauuguucuuccaacaaacugguugaacaaaaugucauauuccaagacugaaucgcugaagggucaaugacacaaaccggaccuggauuauuuuccagaaggaugacaaauucuguaacacuuacugcucucacauaaaggugacugcaguaugacuucauacacaggcaaaucagagcacuucucugcagcaccuacacuuacucccaucuccuuuuggggggaaagagagaagaggcuguguuuauuaccaggaaccaauucuguuuccuaggaccucuuuucuaaacacauagcuuuguagcuagcugcuuugcuuuuucaugacacuugaauagcuccaucagauugcucuucuucuaaaaccguccuugcacuacaagcaagagugcuuuugugguuguuugcuuaagaaggaaaaguaauguaaaucugaaccaccagcuagggacacagccugacuguauugcuucaaagaaaccauaauaugcagaauagugaaauuaagggaaggccgggauacccaaaccaaaugguaucuguguagaauuaucuagggauuugccuuagaaagagguuuuggauuuuuugguaguugugguuuguuucuguuauucucuaggcaugaagagcccaauucagacuuguaguacucaugaugaagauccuaugguuuuaugucagcuaagcuacuaagaucuuaagaugagcacuguuuucauauaacagagagagugacuggcuuacaugcuaauacacaacagcuuuaggacuuccauacuuuauuauuucauuguaaucaagacauuaaacuacgaugucuccuguauagagcucuucacuaaccuaauuguauuuauuuuuuacaauugaauacaauugaguuucuuuguucaacaagaccuaugcuguuacccuaaguaugcuaaguuucacucuccugaauaucguaacuugauuauuuuuguauggaggauauuuuucaaaauuuaauuuuuaaaguaguuauucucuuucuugucucuugcugaauuuaaauucuaauuaguugcauaagggcugugguuuauauauguaacacuaauagcucauuugggugaauacauacuguuuauucauauaaacauguauuguuguagcauguguaaugauagaguagaaauuuuauggaaaauauuuucauuuuauucuuaacauguuuuguauaugugauaaguagcguaaauuuuguagcuuuucuguuuuaguguuuauguugcauuuuauuaacaaguucacugugaaauggaucaugcaggugacagaggaacuaucucaacaucuucaagaccaguguccacaucagggaagucagagcugcccucuaagcacagcaggucaguuaaacccgacgggcaugugagccggacuccugcugaccagaagaagccacgggggacagaaggcuuaucugcuagugaaucccucauguuaaaaucugaugcugcaaaguugaggucagacucccauaguaggucccuguccccuaaccauaacacucugcagacacugaagucugaugggaggacgucuucuggcuucagggccgaauccccaggaccaggcucgaggucauccuccccuaagcccaagccucugccgacucccaggucuagcccaucuggugcaagcucuccacgcuccuccucaccacaggauaaaaaucuaccucagaaaagcacagcuccugcuaagacaaaacuugacccaccucgggaacguuccaagucagacucauauacacuugauccagauacccuccguaagaagaaaaugccccucacagaaccauuaagggggcgguccacaucaccaaaaccaaaaccaguaccaaaggauccuaaagacuccccagggucugaaaacagagccccuucuccccacguagugcaggaaaaccuccacagugagguaguugaagucuguacuucaaguacuuuaaaaacaaauggugucacggacagcaccugcgaugacagcggugacuugaagaguguggaugaagguucaaauaaagugcauuucagcauaggcaaagcaccgcugaaagaugaacaggaaaugagagcaucacccaaaauaagucggaagugugcuaacagacacaccaggcccaaaaaagaaaagucuaacuuccuuuucaaaggagauggaaccaaaucuuuagaaccagccaagcaagccauguccccgucuguggcugagugugccagagccgucuuugccucuuuuuuguggcaugaaggcauaguacaugaugcaauggcuuguucuuccuuccugaaauuuaauccugaccuuuccaaagaacaugcuccuauaagaaguaguuugaauagccaaccacccacagaggaaaaggaaaucaaguuaaaaaauagacauucauuggaaauaucgucugcucugaauauguuuaacauugcaccucauggcccagauauauccaagauggguaguaucaacaaaaauaaggucuuguccaugcuuaaggaaccgccucuccaugaaaaaugugaggacgggaaaucggaagccacuuuugaaauguccaugcaucacacaaugaagucgaaaucuccacuuccuuuaacauuacaacauuuaguggcuuucugggaagauaucucuuuggcuacaaucaaagcugcuucccagaauaugauuuuuccaaguccugguuccugugcaguccuuaaaaagaaagaaugugaaaaagagaauaaaaaaacaaaaaaggaaaaaaagaaaaaagaaaagacagaaauucggccaaggggcaauuuguuuggugaaauggcccagcuggcuguaggagggccagagaaagauaccaucugugagcuguguggagaaucccauccguacccagugacauaucacaugagacaagcucacccagguaagcuauuuugugguguguguauauauaugcuuuaguccugauaagcuacauccucugaacuauaucacauauguacaccuuuuaaacaguuagguacuugcucgggauuuuacuuugaaaagaugcaccuguugcugauauaauaucacuagugaaaaaucaaagacauucaaaauguuaaauguaugucuuauuuuuuuucaagguuguggccgauaugcugguggacaaggauacaauagcauugggcauuuuuguggaggaugggcugguaacuguggugaugggggaaugggaggaagcacuugguaccucguaugcgaucgcuguagagaaaaauaccuccgugaaaaacaggccgcugcaagggaaaagguauuuuuacuacauucaggcuauauuauuuaugauauggauuaguuguauguaagugauacuaaaauucagcuuauauaacgaaaaugaaauacuaauucaauauuagauaaguaaccuguuucuaauguaacagauagauacaaaugguauguugacggauguuugugaugucgucuuuaucauuguccccggcacuacagauguaugaacagcucacugucuuccuguccuguucgcuuuccuccucuuucucuccuguguuuuccuuaagacccaacccuaccauagaacucauggaaaguuaggaucaucccacuaaugccaccaagucagaccucugcuaaagcuuccuucccuacaugacucuucccaagcuccccacugauggguuuguuguuguuuguuuuaguaaucaugaucaugguuuuaaaauauuuuuucuuuuucuucuuuuuuuuuuuuuuuuuuuuuuuuguagaaacaacaaaaguuaaaaugaucuucuuaaauauacacaggaaagagucacgucucucucuuuuuuuuuuuuuuuuuuuuuuuuuuuuggccaggucaaacaaucuagaagaaagccaaugcaaguaaagacgccucgugccuugcccaccauggaagcacaccaggugaucaaagccaacgcccucuuccugcugucccugagcagugcugcagagccaagcaucuuguguuaccacccugcaaagccauuccagucucagcugcccaucgugaaggaaggcguuucugaggaccuuccuguaaaaaugccuugucucuacuugcagacauuagcuagguaauaagacuuuguuuuugauuuuuaauucccauuggguuuacggcuucugaugauuaaugaaccauccauaaagugguucagaccuugcucucagacccacacuagucagagauagugagcaggacgcaaaccuuggcaaugugcucuguccauugcccugacugacaugacugggaguguggugcacgcuguaugcuacuggguguggguacuuugucagucuguccugauacaauuaguacaaaacauaucguaaaaagaaggaccugcauuuuuuauucucuauuaguugacuuuagucuauuagucaaaaaugcugaagaggaaagaaacugauguuuccuguagaagucuucuuuuuucguuccuuuuacccuuaaacaaaaaccagcugaguaacaagggcacugaaaggaauauuaaagcccugaguuuauucaacagugguggaaagagagagcaucauuaccaccuucacagugccaugcuggcuuuacucacaggcaagugggagaggaugcuaaaagaacugagacagggcuugagucuuccucggcaaguaaugaagcacuucccagcggucugccguugccucucaccugauuaucgaagguccuuccacugaaaacugccccuuuuuuauggcaaaguuaugaggcuuuuaauaauguuuguacuuguuaaaauaagaaaauggaaagaaaaggaaaaugugaaacauucaagaccaggaagaaagcauaaggcaugcuaaauauaauaucuugaguuucaauuagacuacuauguguauuuagguuaacaaugucgucuucaaguuugaaaaagagugaaucuggugagaugguucaguggaugaaauugcuuaccaccaaaccuaacuggagccgagucugaucuccuggguccacagggucgaaggaguacagcagcuuucgcuaguugucuucugaccugcccucauguuccuuggcauauacuaguaaccacacacacacacacuaaauagacauguagcauuaaaauaggagucaaauuauaaaacauggaaggaaaaauucgccagcauaacauaauuaaggaacuucaauucuuaacucucuauagaauggauacacccuaaccaaaggaaugauuuacauuuaugcuuuucaaauuuuucaaaucugauauagaaugcaacccaaaaaagugacaccuaguucaacaauccaucaagaaaagaaugauacaagucuuuacugugacagugaugguagaaaaaugaggagagagagcgguguaaaaggaggugugguugguaucauagaccugaaugacuagugcugagugagguguaggccuuguccagcacagucauucucaccuaagcacccagauagucagugggaccauucaccaaguacuggaagguggagauauucuugaaacaaaagaaaaugcauucgaucucaguuugugguaccuaaaaagucauaucagacuuuuaucucuucuggucuguuucugccaucauuuuaauacuuuuauuuguauauucucauguacugcuuugccuuuuucaaaggagauuuaaaaugaagagaaucuauacugccacuguacucuuaaguuguuggguuuaauuuaaugcaggcaccaccaugaaaauuuugugggcuaucaagacgacaaccuauuccaggacgaaaugagauaucugcguucuacaucugucccugccccauacauaucaguaacuccugaugcaagucccaauguauuugaagagccagagagcaauaugaagucuaugccaccaagguacaaguucugucuuggagugacgaguguuuguuggaagaaaggcugaacuauaaaaccauguucuuguaguuccuuaauacagcuuucugucucaggagggucacugagucagcugugcuagcuguuggagaggugugagaaacuauguacgagaguucuugaugggcagcacaccacugggagagaaaagaugaacuagcaguucaauaaaagauuacacugaggccuauaacuuugagugaugcauuucaucagaguagggaagguugacuuuaaggcagcacuuacacccacaauaaaaauggcacagagcaucaccgaucaugaacugcagcuucuuguugucuacagcgucuucuuacuuagcuauugguuugguuuguuuuuuuguuuguuuguuuuuguuguuguugugugguuugggguuuuguggguuuuuuuauuuuuuauuuuuuugguuugguuugguuugguuuuuuguuuuauuuuucgagacaggauuucucuguauagcccuggcuguccuggaacucacucuguagaccaggcuggccucgaacucagaaauccgccugccucugccuccugagugcugggauuaaaggugugcgccaccaugcccggcuuagcuauuguugauaucagaccgagaacuucuuacaaagugaauguuguacguaaacacagugcacagagaaacuaguaucacagacuuugagaggaaaagcgugacaaaaugugcgcacagcacagugcuauuuaagaagcugcuaaaccagccgggcaugguggcgcacgccuuuaaucccagcacucaggaggcagaggcaggcggauuucugaguucgaggccagccuggucuacagagugaguuccaggacagccaggucuacacagagaaacccugucucauaaaacaaaacaaaacaaaacaaaaacaaaaacaaaaaaaaaacacaagaagcugcuaaaccugguaauagaugauagcuggguauguggcucagagugcacugcggcagacaugaagaagauggauaaagaagauauucugagugugacuucacugggaagugcgaaaguaaacuuagacugcaucaaaacucuaggcacaagcgacugagcauagugccacuggaaaggaaggccuuugcugaagagagauaguauacuuaccuaagauauguuaguguucuguaguauauagccaugauaguaaacuaaaauaauagacacuauuaauuauaauagggcuaacauauccaaguuagggauuuuuuuccaugaaaaauacuugugauuuuucccaucuucugugcgacuuuuucucagguguuuuuggagcugcucuugacauugucuccaaagagaacgauguacguuuuauaucuuuaaaggaauucagguaucucuaaagaaaaaaagcuaccugugaaaaagaguugggaaccauuguagucaaaucuggucaaugagauucaguggagguguuaucauguuccaggguuaaaaucauguagaacauaguuggagauaguaagagguaaagcaguauaagagaauauuucauaccacauacuuuuuaauuuuuucuuuaaaaaauaaauuccaucaguuguagaugaaacaagacauuauaaauguccauguuagccaugagaagacccagaaccugcuaagaagcugaaugagcucccagcuuguagacuggugggcgaggaaggaugcaaagcucagacggagagcaagacuauaucuuguaaccaauccuacgcccagcaucugccgucucugcgcucacagcugcuugcugccaagggcccauggaacucuuccacacagcagccucugccuuagauagaaagcaaagccuuguguuaucucuagaaggaauacuguguaucaaguaugauugggaauagaaguccaagaaaauccacaauacauuaucagaucaagcucagaaacuaaacugguuuaucauaugauaauaguaacuaauaauaauaguaauauuaauaagaccuugaggaaaauucaaggaaauggagaaaaugucuccaaguaauuuauaguaaaaaaaaaaaaagaugauuaaaaugauacauuaugaugcuaaaauaguuauaaaacuaaggaauuaauuagaaauuuauacaaagguaguuguugugaguaaaggaagaguuucgaauauuacagugggucagggguuccccuccagucccuccacugcccccuacuuucucacaaauucaccccauguuuauuguuuguauauuguguguguguguuuauguguauguguacacgcccacaccucccugaguucauuuaguguuucacauauguguguauuuguguguguguguguguauauauauauauauauauauauauauauauauauauauaugguugacuguuaagaauuggauuuucuuucagugggcucaaaccuugaaaagacugugucucccucccccggcggccagugauuacauauagcucuucaucgccuuuauaauuacuuaacagcugcucaguaguggggaguucaugcugguauuggaaaccuagccaacugcuugugacuggagagaucaucauagacucuggaagagaacccacuuuccuaaaucaauauauuuuucuaacugaauucuaaaaacguauucuucuacccaccgauaacuauagcucucgccuuuuuauugcacugugauauagccaugagcucucuugccagcacuuccuguggagaauguaauaccucacuuagccauauucaagugucuauaaugaagaaagcaucacuuuaucuaucaguuuuccuuauauaauggacauuucucucuguucacuauauuuacaauuauuccuucuuguauuuucacccucugaauaucuucaaacuuugaauuuuaaguuaugaagcuggagagguuaauuguuaagaacacuggcuguuuuucuagagaacccagaucuaguucccaguaccuacaaugcagcucacagccaccuauagccccgauucuagucgaucucucucacccuuuucuggccucuguaggcacagagcacacauauaaugcacauauaugcagacaaaauauucauauaugugaaauaaucuuuaaaaagaaaaugucaggacauuugcuaccuuuucuuccuuuucauuugaaauacaaacaauuuaagaaaaguguaaguuuaagauauaguucugaagucauucagaaugucacauuguuggaaacgguuacuuucuucuuuuuugagauuuuauguucacuuuaugaguguuugccugaauguauguauucaugcuuguggaacccacauggaaugagacaucugacucacuaggacagaagcagugucacugcacuugacgcacuugguucucacaaguauuuaccucuguucuuuccauaucugcaguuuggaaacuagccccauaaccgacacugaccuggcuaagagaacugucuuccaaaggucauacucaguuguugcuucugaguaugauaaacaacauuccauuuuaccugcacgaguuaaagccaucccuagaagaagagugaacaguggagacacugguagguauaauggcaaguugaaugcucaaacugccagacaaacauaggaaagaaagagagagagagaaagagagagagagagagaaagagagagagagagagagagagagagagagagagagagagagagagagagagagagagaaaaagaaagaaagaaaagaaagggagggagggagggaggaaaaauuuguuuucuuugcagauauuuuuuaagauguaauacuugaagugaaagcacuguauugguguguuuuaauuugggauagacuguuacuuuuaucucacccagucauaaaaagcacccacuauuuuuuauaucucagugagauggguaucuagaucagaauugacuuauaaagucuugguagguaucuaacccccacacacuacucucacuaucauccacugagugucaugaaccaacagguccugugugccuaagcacacaguuauuccucaccauccauagaagcuucuaacuccuacagucaccaugguucugaagggauagaaaacuccagagauaugaauaacuucuacuguuuuguuuuucuauguaaucugaaccaauugcaauucaugagcauuuuuuucccuaaguuuuagacacucacuauguuaccccaggcuugccccaaacuugcaacucucuugucucagccucucagguucauggauugaaggagcaugucaccauauuguuauguuaauauugaagaucaccagaaaaaaauaucauuuagcccaguagauaauuuguagguuuauucaauaaauauuuuagaguuuguauugagauaccgccuuuguuuuauuucccauugcuaugauaacauaccuuggcaaaagcaacuuaaugaagaaggguuuauuuggcccacagcuaauuaggcaagucacaucacuucugccuccaggaacagacaguuuauugauccacacaugcuagugcucagugcucucucuccguuucauucauuucugguuucauuaauuaagacaauuaagaaacucccucacaggaaugcccuuauaucaaccuaaccuagaccauuccucauugagacucccuuucuggggauugugccuguugacaacuauaacuaaccaucuuuuaacauacuuuacacauaacauaacauacuuuuacucagcauuuuaagaaguuauagaugugagguguagauuucagguagaauacaagcugcuuagcuuuuacaaugcugcaggaaguaugaacuugagauucaguuuuuccuucuaaaccuaccaguuccacauacucuguguagcucuaagaaaguaauacagcuacagaguaugguugcuuccuuaccacuaauugaaauuguuaugguuugugucacgugcaaaaguaaaagacguuaaagugaauaagcuagauguuuucaguaucuaauaugcuaauuguauacuaucuauggagauuacuaauuuuuuuuuccuuuuagaaguugggucuucccucuugcgacauccaucgccagagcuuucccggcucauaucagcccacagcucucuuuccaaaggagaacggaacuuccaguggccaguuuuagcuuuuguuauacagcaucaugauuuagaagggcuugaaauagcaaugaagcaggccuuaaggaagucugcuugccguguguuugcaauggagguaugaauacuuugauaaaauuauuauccacgcacuacacaaauacauaguaauucuauuuaauaaugacacuuuuuuuuaaccaaacaaauuacaucaaauuaaagccaugugccuacuggggaaaaaaguguucacaucaaaauaaaaauuuaaaguuuaugaacaaauucauuuggaauuguacauuuaaguauaccaaaucuuuauuuuuauacaacuuuauuacuugaaaaugagguuaucuucuacacauuuucguauucaggacauugcaguagaauaucaugcaaagaaggugauuagggcuuuggagucagaaauuuaccaagaguagcuuaucuaggcuuccauuuccuggaauagggaugaaguauuuccuagaccuauagauaauaaauguuucuucuaguaaaaauguacuuuuaauaagaaugugguacauaauuuguuacauucauuguugaaaaugauauuguuaaguaaauggcuguuuguguagaacuuggaaaauauucuauauuaguuuuaaaugcugguuagaaaaaaugccuagacuagaauaaauugauagcaaaagaauuuucauuguauuuuguaaacaguauauucuuguugcucuuuuuuuuaucacuagauugacuauuugauauucagugaaacaaggccacauuuucuaacaugucuaucuuuaaauaauaauuuuaaaacaacaacaacaaaaaaaaaaaccuuuguauuuuaauucacauuuuuccuuuuauugcaccucgauucacucaggcauucaacuggcuucucuguaaugucauccaaacaacaucucugcaugacauucucuggcacuuuguggcugcacugacgccuucucccguagaagcagaggaagaugaggaugaagauaauaaauccaauaaagaaaaugcagagcaaguggguuuucauuccuucucauuccaugguuucccugugaaauuauacauuuuauucuuuggaaguuuuguaaauucauauaauauauaccagucauacccuuucgccacugcuucccuccagcugccccgagugcagcccacuccacuucuccuccugucucauugugaucacgaacaacaaccagaguccaaauggugcucccuagaugugcauggcuauaugaccauaauuucauauauuuauagaacccaaguaguauguuuccuggugguguaguauguaauguuucacaugaaauaauugacagguaauuugacuugaaaagccaacaauacagugauaauaugggcaaaauguuagccauacuuaguaaaaguuuucugcuggcaaagaugcugacacaucugguuucucguugaaugccauugucacaaagcaagcgagcagaagacgcacugcaguauuacagucagcaucacuaguauauagugaagcuagagcaagaaagcucuccuuucuagccuaggaacaaaugggaugaaugugaugcccagaaaaacagggcgugcaccuuaucaggggguguaguacucaaauguaaagcaaagucggaaauaaccagucugaccacgugggugccaagccuugauguagucuagauagagaguaaagcguaguaugguuuagcaacacauaauguaaacuagaacugucugauguucuucguccaguagacauacaaagagagaagcaauagcagaacuguguguuacuuagcucacugacguaauucagaacguugauaagcaccuauuagcaauacaauggaaaaacaaagaaauucauauuugcuguguaguaaucgcaucuuggagaaaaacuuggcaaaaccuaugcaaauucacauuaaaaauuauuaguuauuacauuucuaugagcuuuccuauuaugugaauaugugauucauugcugagcuuuuuaaagcaaacagacaaacaaaaugauuguucugagguagacuaaugagaaaacugcacuguuuccauuugugggauaccauuggccagauuauugaguuuuguguacaugcguaauaagucaugauuauguuguaaacugucuauuauuauuguacauuaaaauuucugugaacuaggaguacugcaacuucuaaacauacauuauuuauaauauauaaacauauacauaaaauauauuuauguuugaauauaaauuucuaugcacauagauacauauaucaacaucuguauucaucuucuaaugauauguaaguauccuagaauugaugagaagaugugauauucauuuguuugcucauuuuacuuauuuacuuuuaucaguuuucucuggaaaagauacaaguacauuagaaauuuuacauacuguacauacaacuuauauaaaguuguuuuuuuaaauauuucuuccaacugaaaaccucauuuucaauuuucaucuuaggagaaggauacaagagugugugagcauccacugucagauauagugauugcaggcgaagcugcucacccacugccacauacguuucaccgguuacuucagaccaucucugaccuuaugaugucccucccuaguggcaguucauugcaacaaauggccuuaagguaauuguucaccaaaguauucuaauaggaaaaaaaaagauuuuauggaauauucaaaguacugaauaccugaaaaaauuugcuuaaauggcaaggugcagagaaucuguaaauuguggaaauagugacugcccucuucuuccuaaauuagaaccuuuuccuuucuggcugguaucgauuugcccuucuuagucccuaaaggguugcugaauccaucuuguucaccuuuccugcuccuauuucacugugaccaguguagagaaugaaaauuaaaucucagaaaccaaaacaaaguugggagggacuuuaaagcagacucuaguuucuaguuguaugcauccaauuuuaaaacugccuuaaguaauaucgcaucaucuuaauuugaaaauguguugagaauuuggcauuacauuacauuaugaacuguauuuuuagauugauucagugggcaguagacauaaauaaauccucugugguguauauaacaagcugaugagaaagauuagguuuccuaugucccuaacuauaaggccaauagaaaacagauauuuuuuguaauccucauaagauuuuugaagggcaagaaauauuauauccccaaaaauccuuauguaauuaucacgcagaaauuuggaaagauauuacaguugcuauaaugcuuauccuuaaaacagauucaucuuugcucuauggcccugaccuccauagcuccuuuuguaaauauauauacuuauuauguagauuuucuuuagaauuuaccuuaucaaaauaccuuuauuucucaaaacaaauaaaaauauauacaugauuccauccucugaaaauguucaauguuuagcuuuuuuacaaaaguaaauuucucuugauauauacacugcaaaguauuguagcuucucugaguauucauagguaguccuaguaaauaauuaauuuguauauuguuuauacuugcagaugcuggagccucaaguucaagcaguccgaucaccaguuccuccaucagagcaaugucuuccaucacaucaacaacaucuugucgaagucagacgauggagacagugaggagagcuucagcaucagcguccagucuggcuuugaagcuaugagccaggucaguggcuucccuaugugucuguuguaguagcuaguguugcuaagugugguaaaagacaagcuauaagugagucauacguuuugauuacauuguuuauuauugaaugcuugguuuuuuaucacaaaagauugcauuuuuaaugcuaugacuguuuacaugucuuucuguuaggaauuaugcauaguuaugugccuaaaggacuugacuagcaucguugacauaaaaacaucaagucgacccgccaugauuggcaguuugacagauggcuccacagaaaccuuuugggaaucaggagaugaagauaaaaacaaaacuaaaaauaucacuaucaacugugugaagggaauuaaugcccguuauguaucuguucauguggacaacucccgggaucuggggguaagaagggaacuuaguuucuggcuuauuaauucuuuuaaacuaaaaguauuagucuugggggaauucuccaaccagacaguuuuauaauccucaaauaaauccuaaaacaugguaugaucacaaauauaccuuggcuacagcuaaacaagauuaaaaucuacacuaguauuuucuauuucuaugcuuaagcaauucucuuggccuggaauuuccuuuaaaauggguccccacaauugaaacucagcagagguuucucuuuggcuuauagcuccuggauaaaaauuacuauuuccuccacggggcuuuucggguacuuuguuuucuuuuguuuguuuguauuacuuuggccacaguauacuuaguuucuggcuuuugcuucacauccucaguccuuaggguuagagguagacagucccugagcucauuuaaauauucaugauuuacaguuuccccagcccuaaucucucuaaucuuaucugaauucaaacauucugacauaaaagucacuaaagaacagaaaugaauccuauuaccugagcuggaaaauagcuucaacugccagacugcuucugcccuuggucuuggggaagaaaacuucuuugaguuuuugcuucagaguggaugaggcuuccuagcagaugguuuuaguggauucccaugaaccacugcugagcauauugcauauugauuuugcugaaaaagggaaaauagaaggguuuuuucucaaauaagcuggauguaaaacuaaacacaucaguccccucuucaagccaaguacaauaauccaccauccuuccaaccccagcucuugugcaucaguacagguucagugcgucucuggugccaauaggacaguggggaguaagcuaacauaucaucagcuuguuuccuuuuuauaaacagaaauuuccaauggguacaaaucguuuaccuuagaagaaaaaguccaagcuuugcuggcacgguuucacuucugacuaugaacuuaucuuagacucaggacauuuuucaccaggacauucuccucacaaugauuaucauaaucaaauugaauuucuauauucaaugcuuucuauacucaauaacguagagauacuuuauagcaauauuuauuguaaaagccaaaaucucuucagauaacauuugcucuccuuuuaagagacauccuugagcaaauacauugguuuuccucccaaccaccccccaguuagccuuauccacagcauuugugguucugaguucauaauaaacagcucaagaagaauuaauacuuguccauuuuaaaacuacucaacccuagugcugcggugacuggcuuccugugcugagacacagcacugguaguguuggauaucuauuuccugugugagcauugccuucccugguuugcugagcccuuuggaagaauagagugccccuuacuaagauauucuucuccaaagccauacaguaaugaugacacauacaaguauauaucaguuaguuaaguaacuuccuuucauguacuucaaaagcggggaguagggagagcagaauuuuagacucuacaugaaaauacagaauuugaagauuuguaauuggguuaaaacugggaaagucaaacugagaaaucacauagaggcuaaaaucuaagagaugacuggaauuggaggcacugugguugauuggauaagugguauggggucuaugaggacgauaacgcacauugaagcaauaauguggcaucugaaggcuauaagacauuauuguauauguaaauauacaagaacaagcauauuauaacuauuuugaauuucuguaacagaauaaaguuaccucaaugaccuucuuaacugggaaagcaguagaagagcugugcagaauaaagcagguaacugaaacgucauuuuccuucucagcuuucacuguugaguuucaguuuugccauucuaccaagaccguguaagaaaucauuucucacaaaacaguaaguugaaacuugucuguagccaagaaugaccaucccaaugcuagcuaucuccccguuauuucuuuaaaugcccucagccacgagcgugcagucugcagccucucauuguucuaugaagacuugcaugccuggaacuucccugauucccagccagaaacuucauuuaccaacacuuacguuaaaauugauuguuagccuaaacaaagucaaauaaaauacaaccacgccucuuacuucagcagcuauaucuauguugaaaaucaguuuacaaaacaauuguagaaaugaagccauaucugggcacaggucagagauuaugcauaaacucaagaacuuacagagcuaaaaccuuaccagagcuuugcuuuuaggguuacuugguaaugcaaaugucaguacguuucuuugaauuuuuuuucuuuucuccaaugauauugauuugagaguuaagaugaaaacacuuaaauacuaaagaaucuaggaaaauuauucuaaaaguaauuguguuuuguuuugauuuccacacuuaauuucucuuuuuggaaguauugacauuauaguuaaaguaacaaaggucuaaauaaaucaucuagaaggcugcagguuccuucuugguuaucaaauacaaugagaauaauuucaauuucauuggcgaacuagugucagaacccauuuugcuauauauugacauucaguccuugacacacaaacacucaucugaaauaucagcacaaugaaaauaccauuucuggggggaggguauaggggaccuuggggauagcauuugaaauguaaaugaagaacauaucuaauaaaaagaaaugaaaaaaaggagauaaauuucuugaaauaaaaauuuuaaguuuacacuuaaaaaaaagaaaacaccauuuccuuuugcgguguuuaauguaaggaugcauaaagcaacuccucguuacuuacguugucucugcugagagccaguguaggggccauguaaacucuguaauaguuugcucacaggauuuauacagugaaaccauguggucgucaggccuauagccguucucagccccauugccuccugaaagucucucagccuguguuaaccucacuuucuucuuuguucugucuccuguaaacaaaugacuuguccucacagaacuuaaauaggauaauggaaauaaccugauagucuuuacugucugugcaguuguuuauuugagcuuucuguuacugaugcuagcuaagcccagggcaaugauaaagugauucuguuguaucagguuccuguccuuuuucugcuccaccaggucgauuuggauuccaggcacauuggcugggucacaagugaacucccaggaggggauaaucagaucaucaaaauagaguuaaagggcccagaaaauacauuaagaguucgacaaguaaaaguccuggguuggaaagauggugaaagcacaaaaaucgcuggccagaucucagccaguguggcucagcaaaggagcugugaggcugagacucuccgaguguucagacucaucaccucucaagugagugaccuacgaguaaacggaccuagguuuuuagcauauggcagauauuuuacuacaauuuucugguuucaaauacagccguguucacuccuuuuaggccauuaccaauaccuaauguugauuugcaguuucagagaagcaauagugcgauagagagagaugcuauauuagacggaacccuucagagucaggcucaggaugggggcugagcuuauuguccuggcacucuagaggcuaagacaaaaggauagccagccuggacuacaucaugaguuucaggccaguguggaccacagauuacacccuguuucaaaauaaauaauugaauaaaacccuucagaauuagauaguccuccagcuuugcaggggcagugcuaucgucaauucuuucucaccugugaccguccuuugucagguguuuggaaagcucaucucuggagacgcugaacccacaccagagcaagaggaaaaggcgcuccuguccuccccugaaggagaagaaaaaguauacaauguauuuauuuguagacuaaaauuuuguuucucauuuucauuaucuuacuuuugguaagacgagcaacucuuguguuucuuuacauuuuaguggauauguggccaugguuuauaugucauagguauuuuuuucuuaacuggcauugggaagaagguaaaggaguccccugaaaagcaacucacucucccuauccaagcugccuggggguuuucaucuguagaagcugcucugugaggggcuugcugguugcuguuggcauccuuggcaucacuaaauucugccuucuccuuugcauuuucccucugugguccagcugaaaagagagggaagccucuuuacaauuuccccauagagaaaacagcuuucuuccaaucugcuaaaguugauagaaaucucucugugcuugugcauccugguuucuuuuaucucacguuuaucuacacuaugucuucugucucccacggcuucucaaagagcucauacauaccacccaccaugacaauuacauacaugugugggaaacuuacugaaguaacuacucuuuagugcuuuaugacuuuaucuaaaagaguuacuuuacucuuuuuuuuuuuaacugaagcagaccaccuaagaggcaagaggcaacuucuugaguuccugcuugugaggcacugcagugucgcauggagcggagcugcagggcaggcagcgugccuuguucuggauccagagagaaagagggauguuauuggaaggguuuuuauguuuuagugggguuuuuguuuuagauucuauaaaugagaucaaggguguuuucuucuucccuagucugccaagcauuuaccucagaauggguguccuuacauacuucucuucuguucauugucuaacugucacuccguagacgggucagggcgucuacgaacucuaaucaauguguucuugguguauagguaguuugauuuucaauaacaacaacaauaauaauaauuauuauuauacagcaauaacauuagaagaugauaagcacauagcacaguaucucuuuaaggaugaaaaugguccccaguuaacucagguguacauaucugugauuguaccaaaaacaauugaaauugcucaguucaaagagauauuuggcagcuaugucaacauaguuuuguuuaaaaauaaaaaauaaaugaggaaagauguaaacacagcuaaaaugaaaauaacuaucuggaacaaagcugugcauaauuuagccuacagaugauaaagggccaccuccuaggaauuugcuuuccuuacuaaauacgggacuauuucaguuacccauuucuucuugaggaaaccuugauaguuuauuaacuaaucuguuuguuuacggaauuuguuggcauaaauugucuacaauaguaucagugucuuuaauaucuguaaaaucuauagugaaagcucuuuuauuucuuauggugacuauuugugucuucccucucuuggguaauaaagagugagcuuacugguuuugaggaaauagcauuuaguuuuaugguuaccucccuuuuuuuccuuuuauuuauuuuauguauaugagugcacuguugcugccuucagacauacaaaagagggcaucagaucccauuagagauguuucugauccaccaugugugguugcuuggaauugaacucaggaccuguggaagaguagucagugcucuuaaccacuaagccaucucuucagcccgggguuaccuccuuuuaaguuauagaauccaucuucuuuaucauuguguuccauauauuugauuugauuucccuuucuuccauuucucugguuuauaaacagacaaagacccuuuuuuucccucaaauuguguucauuuuauaauugcuuuauuaaaauggcuuucucaaacuuuauccuuccuugucuuggaguuauaaaucuucaaauuaacauaaaugugcauauauauauauauguacacacauguauauauauauauauacacacauauauauauaagcuuaauuauuucucaaggcacucuaaaauaucaaauacacacauguuuucuaaagagucugcuuguuuuuacuuuucugugugaaggcgacaucugaugcugaccugaaggaacacaugguuggaaucauauucagcaggaguaaacugacuaaccuacaaaagcagguuagugucuagcugcccaacugucuuggucucugagguuuccuggggacuugcauuuuauaaaauguccucuaagucugggaaggcuuuuuaaugcgcccucuccauugguccuguagacucugugugugucuccuccuagagaggaauggccacauugccauagcugcaucacuuugaagaguugggcauggcguccucugccugugauugcugcacuuaaaaagcagagcauugagcagagguugcagagugugaggccagcccagccuauguagugaaaccuugucucagaauaaaggagagggaaagucuauuacaaauuuacaaaugcucucacuucacugcuuuguugcuucacuuguuagcucuguuuucaguagguggguagauggcuaccaagcaccuuuguggguggauggauggauggauggauggauuggagguggagcuacacuaugguagccagaccugccuuaaacucaaaauccuccucucuuaggaucccaaaugcugggauuauauuugggagcuguuacacccuccuggguacagcauuuuacuuuagucguaaauaaccaaguauaacaaacauaaaguacauuuuauuauacuccuuuuaacucucauuuucucaaucaggaaggaaagaacuaaguuaauaauguuaacuauaccaguguuaauacuuuuaaacauaaguauccagagaaguaagucuagauucuucauauacgggagugcuaggugacauaaaaauagcacuucagaagacagauggaaaccgggcacaaaagcacacaucugugaucucagcuauggagaugauagagaaaggaggacuugaauuuaaugcuagccugguuagcauaggguaacugcaucaaaaaaaaaaauagggagauaaaaaauacugauuuuuuuuuacccuuguauuauguuuucauaauguuaaaucuuuuuuauuaaaucuuuuuuaaagaaaaaaaucagcauaaauuuauauuuuauuuuccugcuucauuaacuuggcuauuuauaucagaugauuuaguuauuggaauuugugucauaguucccccuaguuuguuccauuacuuuuaagaugaguuaagaaaauaacauaauggagaauauacugccaaaaaaguauuaagucagacauuaaccugaguauuuugcauuuucugcucguuccaauaauaguaaagaagaucuaugaauaauguucuauaucuucucuguuuccuucacauaggugugugcacacaucguccaagcuauucgcauggaagccacaagaguccgggaagaaugggaacacgccauauccagcaaggagaacgcgaacucccagcccagugaugaggacgccuccucugacgcuuacugcuucgagcugcucucuaugguccuagcgcugagcggcuccaacguuggcagacaguaccuggcccagcagcugacucugcugcaggaccuguucuccuugcuccacacagccuccccgagggugcagagacaggugaccaccgugccacuuacuuuuguuucuucccugccacuugaaacuugaagugugacgaaaagauggaccaucuagugauugccauauccagagauccaucccaugaucagcuuccaaacgcugacaccauugcauacacuagcaagauuuugcugaaaggacccagauguagcuaucucuugugagacuaugccggggccuagcaaacacagaaguggaugcucacagucagcuauuggaugggucacagggcucccaauggaggagcuagagaaagcacccaaggaacuaaagggaacugcaacccuauagguggaacaacauuaugaacuaaccaguaccccggagcucuugacuauagcugcauauguaucaaaagauggccuagucggccaucacugcaaagacaggcccauuggacacgcaaacuuuauaugccccaguacaggggaacaccaaggccaaaaagggggagugggggggguggguaugggggacuuuugguauagcauuggaaauguaaaugagcugaauaccuaauaaaaaauagaaaaaaaaagaaagugauaucuaguaaaaaaaaaaaaaaaagaaacuugaaagucagaagaccuuaaacgugaacuuuuauuacucuauguuuuauuuccaaucaaagcuuaccuccauuuuuuauugcuuuuguuccaauuacuaguguaguguaguaaauagugcucuggguauggacuggcuucuugccaagagauacauuacgccauuuaauccagaacgaaggcagaaggcuuggcuuuuuugcuuaaauuauauucuucucaaaauuagaaguauaaauuauuaaaaguauuaaguuaauuucucuucucuccauggauuugaaagcuacagaauaguagcgaggcauauucuaaaugacaaguucaaagucacagcgguuaaauguaguuuuucaaucuuuugaucaggugaccuccuuacuaaggcgaguuuugccugaagugacuccuaaccgucuggccaguaucaucggagugaagucccuccccccagcugacaucagugacaucauucacucaacugagaaaggagacuggaauaagcuggguaucuuggacauguuucugggaugcauugccaaggcgcucacuguccagcucaaagccaaagggaccaccaucacugggacagccggcaccacugugggcaaaggaguuacaacagucacccugccaaugauuuucaacuccagguuugucauucucucaauuuuagcaucaaacacuuaaaacaucacaaauuuuaccuguucccucacucaacaaauaacaugcaacuggcuauauauauaaauggaaugucaggcagcaagaugacugcaggggaagacacccacaugcaagguugguaaccugcuuuugaucccccuagagguggaaggaaagaagagauuucauguagauguccuuaaaaguaaacuucugcacacauugugguaugggcacaucucuugaaugcaugaacacccucacaaacuaauaguaauauuuuuaauuauuuaaaauuacuaaacuagcugagcaguuguggcacaagcauuuaaccccaucacuuggaagcaaaggcaggcggaucucugagucugaggccaguuugaucuacagagugaagaaagccaaggcuauacagagagacccuguuuccaaaaaaaaaaaaaaaucacauuaauaaauaaauaaaugagauaaaauuaccaaaauuuuaaaaaggacuaucauagaauguagaaaauaagcuuuguagguaacauuugauauuuguguaucucuguuaaaaaggauugauucucacuguaaauaaaaaaaaaaacauaaauuucagguuuauguuaauauuuuccacaauaaaaauaaauaaauaauaggagauaaacuuucuaucuuaauauauuauaauucuuuuaaaacucuacaaagacaaauuauagaauguuuuucuaaucuuaaaguugcacuaaugccaaaagcuauguagaaaaagauucacagauuugauauauaacagugaguauauuugguauauauacuauaaaaauguuguguuugguuugguuugguuugguuugguuugguuugguuugguuugguuugguuuuucgagacagaguuucucuguuauagccuuggcuguccuggaacucacuguguagaccaggcuggccuugaacucagagauccaccugccucugccucccaagugcuggaauauaaaaauauuuuuaaauugaaaaaacuacuugaaaaauaucuaaaguuacauaauaaacuauuggccauaagagcuacgaaggcuugauagcugccaggacuuaacuuagaagcagcggguguggacccugugugcugucccagagguagaaggcagacagagaguucccuaaacaagcccagcagccagacugaucccaaaggaggggccccagguucagucagccuccaugcaaggugagagaugauaaggaagcuacccaggguuaguguugggcauacacacacaucuauacacacacacauacuaaagaacaaacauacauguauauacaugcaccacacacacauacuuauguaaaaauaauuuuauaaacagcaaaauauacauacagcuuaagaacauuauugaaagaauagacauuuuuaaaggaucuuguuuuuguguuugauguguaucagugcuuugcuuacaugugugugcaugcaccacaugcaugcaguacccaugaaggccagaagagagcacugcaguuacagcugugugcuaccacgcacugugugggaaguugacccaguaugcucugcagaagcaacagaugcucaaccacguggcccucucucuccaggcacuugcaucucacauaaauacuuucacaucuccacaugcacugggaacagucuguaguccauggccuaagaauugaauaguagugauccacaaguacuguacaaccaaaaauacuaggaaaggagcauaacuaagaacaccuguucuccugagccugaagaaagggacugaggguaauggucugaacuuucuuucuuuauuucuuuauugcuuuugcagaguaccaggguucucuucccagaacacauauggugguuauuacuccaguucaaagggauuauacacccucuacuggccucugugggcuugcaugccuggauacauauacaugcgugcaaguacacacacauacacauaaaaauaaaaaacaaagaaaaaagugaauaacaaaauaaaaugacuuaauuggauagcacaccuguaauuccagcacucauacaaauaaggaaggagauuaauaaguuaaaggacaaccuagauugcauagcaacacccugucucaaaaauuuaaaaaguaaauaaauaaaaauauccaaauacuagugagauggcccaguaagagcuccugcaaccaagccucccagccugagugugaaccucuugacacucacaguggaaggagagaaaggacucugaaguuguucuuugauuuucugaaucccauagcacacuuauacauacauaugcgcaccaaauaaauuaauaaacauguaauaaaaaucaaaaaauucuaauagauucagucaguuaaccaguuacaaugccgugugcugaaguaacgcuguuuucuuuguaguuaccuccgacgaggugagagucacugguggaugaagggcucaacuccuacucagaucucagagaucaucaucaggcuuaucaaggauauggcugcaguaaguccuugcucccaacuccagcagcagggacuuuaaaacauaaaauaaaaugucuucuuucuaagcgaacaaagaacuuguguugaaacuugcccccugcccccaaaaaggacaaaaaaaaaaauuccuagagguagaaguuucucaucaucugccguucugagguuuuagggcuuuaaauucuucaguuauguccuguaccacgaucuuaagguauuaccuuugggggaaaucugggguguauagggcagggaguuacuccacugaguguccgggcccacaaggucacuuugcucccauugcauugugucuuuaggagacagccugaggagagggcagagggaacauuuuaaaggaggacacaccaguugcccauuaucagauugaccgcauguggaaugagagauucuggggaaaaguugaaguucucauuuuuuucuuagcuguggauauuuuccuagacuucauagcaaauaggcauucucuaggaaguccacugcaugaaaucccugagaagcauguuuugaagagcuggauucuguaaugaaggauugguacucaaugaguaucuguguagcugcgguuggaaggauagcuccacagucgagcacuggcugcucguaaggauuaagguucaggguauagugcccacaugauagcucacagcugucaucccagcuccaggggauccagcacccaucugccacacacaccacauacacacaugcauacauucaaccaaacguacauguaaaauaaaaaugaauauaauuuuaaaaauauuuuuacuggggacugcacccagaauuacggggugagccugugugugcucuuaggcuccagagagagcaucuagggcaaugaauuacaaugucaaggcucccaagcaugggaaccuuauuuguaccuuuuauuuguguccaaguauaaaggaaaauguccuggaggacuaugggaaaacaguguugaggccauaaauuuuuauuugcuuuacaaucaucaaaguagagacuagcaacugaaauauuucguaagauuauaaaggauuuuuaguuuguguccuccucuaaaagcacauggucuugcuaucaauaaagauucucuuuugagcggagauuuucagagaaaaggguuuguuauaaugacacaauucuggauacuuaagaagauauucuuuccugcuuaauagggucaccugucagaagcuuggucccgagugacaaaaaaugcuauugcagaaaccaucauugccuugaccaaaauggaagaagaauuuaggucuccagugagauguauugcaacaacuagaguaagauuuuguuguuguuuuaaauuuguguuuaaaauuuguguuuauuauuaugugugaucaguaagucaacuuagucacauuuuuaauuaacaucaucaaaaaaugacuuaugaauuaaaugugauaguaauuacuguucacuguuggguguguaguaucaacuuuuguuauuauuuaggaagcugaggauauacugguuaaaaaagucuaaauuacacugugguuauuaucuuucuacugaccuauuuaccauagcuuaccuuaguaaguugaguaguaguugcauucugcugugagagacuggugauccuucaaagacaagacagcucuucacaguucuuccuaaugaaaacccuagcucaacugugagauuuguaugcuuggcuuuuaaaggagaauacucgggccuagaaaacuggccagcaguugagaauauuuguuccucucacagagcuugggcucaguucccauagucacuuagugggcacagcuacuguaacuccagcucuaggggacuuaacaccuacuucugaacucaccaugcaugcaaguggugaguguguguguguguguguguguguguguguguguguguguguguacaggcaaaaugcucaugcacauaaaauaguauaaauaagucuaagaaauguuuuaaaaacaauacauccuaauuauagguaggguugaacuuuugaggaaauaagguugcauucuuuaaaugagacaucuaauuuuuaagauaccagguuuaugagccguauaacucaaaaggugauuuaagcuauuacugaagagggaaguaugacaucauuaggaacaguacacacuacuggaacucauauagauuaauucucugaagucuguaaaagaaguacguuauauuuuauuagagcagagaaaccccguuuaugcuaccaugcuuaugggcaggacacuuaaaacaaguauguucugcuguuaccccuuccuaccacucaagaauucuuucauuccacauucccuuuucacuugcauagauuuuuuucaguguuuuauuaaugaaugaacaugucauucuguguaaaacugcaguucacucuuuauaucccucagaaauguguuucauagccacgugucuuggugugcguauaucugugaugauauguguguguuuguacagaugcuugugugcccuuggcacauguguaaaggucagaggaaagccucggguguugauccucacucuccaucuuguucgagacagucccuucauuguuuacagcugccgucagcaggcuagcuggccuccaggccugggcuucccuagucucugccccucaucuugcucaggagcacugugauuacagacaugcacucucucaugcucagauugacacgaauucuagcuaccuggacucagacucuuacacuuguauagccagcugucucaucaccauagauuuucuagaauuuccugaaaauuauuagacauguauuuauggcaaaguauacaaaguagggcucuugagacaacagagacuccugagaaacuguuauuauguacaguaacccaauauguacccaacuacuuauagaacugcaaacuagcuacuuaucagcucauuaggaguauagaacuucagacucuauacuagcugggaaaauauacaguagucaugcacgguaaauauuauuccuauaagugaauugcuuacaucauuaacauaaacauaacauaaagagguugacuuuaugucagguagauacagaaauagucauucuuggaguagcuccuggugcuuggcacauaggcaaggaaaugcaagugcuacuaaauaucugugcauguccugauggagcgagcacuuacuuggcagucaucgauaucagauuucaagcaucucauagcugugcuccuuccuccucuacagcucuggcuugcccuggcaucgcuguguguucuugaucaggaccauguggaccgccucuccucggggagauggaugggaaaggacgggcaacagaagcaaauggugagguugggagugugcugugagaaccugccuuucuucacaguugcugauaguuuguggggaagacaguauaucacacucuuggaaacguacauccagucuguccaguuugcucagaaaccugcuucaugcuuuagaaaaccuauaggcuuuuauuugauuauaugagaacuuuauccuucucugguucaugcuuauagcagcaaaauuucuagccugacugauuuuugcuaaaaugugauuauccuuaggaauaaaaaaaaagaaaaaaaaaagaagcaggaaaccagcaagaggaauggcauggcauacccucuccaaguguagucagaggaggcucacagggcacaauggagcgcucucagcauuucugauuaccuuuauuuuuuuauuauuuauuuauuuauuuauuuauuuauggugaauugcgcucauuuauuauucaugagauuuggaauaacucgggaauauuaagucucuaaauaaaaucauuuucucccuuuaaccauugacucuguauacacauuaaucuuauugaguaauucuuagagauuuugauaguguaguauauaccuacaguaauucuguuuuacauucaaaucuaaaagccuugcagauuuuagaauaaaggcuuucaguaucauaaauauacuaguuagguugaauucgucgaggcuuucuugugagucuaauguggcaugugaaaacaucugcuuccagccuaugugugacaaccaugaugacggugaaacugcagcuaucaucuuaugcaacaucuguggcaaucuguguacugacugugacagauuccuucaucugcaucgacgaacgaagacucaccaaagacaggugagcuugucuucauagccagaacucugaaauaacgugggagggaaccaggggaaaugggcucuggaaugaccuuacuugacucucaguggucgcacuaacugcaaaccgagcaaguacuuagauuuuccaagacuugguuagcacuugaacugcacacauggagcuguugugaacacaggagagaaugcugugugugucuggaacgucuuacacugcuuuauaaagaaagccacaguugcugaaagaugacauuugcuucugcccagaacuaaacacauuuaucccucuucuauaauggaacaacaggucuucaaagaagaagaagaggcuauaaaggucgaccuccaugaaggcugugguagaacaaaacuguucugguugauggcauuagcagauucuaaaacaaugaaggcaaugguggaauuccgagaacacacagguaaaagaauuaaaaguuaagagggaggaugaagcaugucugcaaaguaggauaagucagauacuggcuacgauggucuguaugugcucggcucagggaguggcacuguugggagguguggccuuguuggugugggcuuuaguacucuugucuuagcugccuggaagguagcacucagaugaagauguagaauucuuaccuucuccugugccugccuggaugcugcuauguccccaccuugaugauaauggacugaaccuuggaaccuguaagccagccccaguuacauguuguccuuauaagaguugccuuggucauggugucuguaaacuuccugucguguuagcaguaaacccuaacugagacaccagcuuaccuaucaggaauaaucuugaguaguacagaugcugaccacaugcuugguagacacagucagucaucuagauuagaaagggcaucagacuacaagcuagcaaaccccauuucccauuacuuuuuuguacugcugugaagagauauaaaagaagacauuuaauugggggguugcuuacaguguaagagguuaguccauuaucaucaugaugggaagcauguugguacaaugcaguugugagcuuuacauccggguucuugaacauccaggcaggcagacugggcguggcuugggcuucuggaauuucagagccaacccccaguuauacacguccgccuacaaggccacgccuccuaaucauucuaauccuuuuaaacuauuccacuuccuggcgaccaagcaauauaugagccuaugagguccauucauauucagaccacacagugacugaguaguccauuagccucuguaaaaucuuagacuacuuacaucuguguaagugagcugguagauauaccaugucuacacugugucuuaacugcaagguccuaugauuuccugauacuucagagucucuucuacaguuaguacuucucggggcuuaauaaauaguucuguuuuacuaauuguaauaauaaaggugagcagccagugccuuaaaaacauacuucuuguuaugucuaauacacuugaaccucagacaguuuucauucuaguuuuuuauaaaaugaaaccuuacauauuacaagcuuaauguguaaaacaugaaaauucuucaucauuuuuagcaaagcugcuaucugccauuugucauacugacacaauuauuucucauuggucuugagcauaaaucugaauuacuuaacuauauaaagaugacucaugcuacaacauaugccuuuucucaaacccaauuuuuuucuccuguaauuugucaauagucuacauuaauaaauguaauauugaccuuuccuuuuauagaaacacuccuuugcuuuuuccaaagaguguucuacagucauuucuggaaccagugauaguuacucgaauuuguguaccuacauuugaaaaugagcaaggucuuuaaucuuuguuuuaaagaauucugaugcuucuuucaauauuucaauguauuuaauuuuuuuugaaauugcagaguuccuuggguaaauuuuccuauuauucagguuuuauaaucuagucagauuuuguacugucauguaauuuuguuacauaaaaauauucaaaaacagcugggugugguggcgcacaccuuuaaucccagcacucgggaggcagaggcaggcggauuucugaguuugaggucagccuggucuacaaagugaguuccaggacagccagggcuauacagagaaacccugucucgaaaaacaaaaaacaaacaaacaaaaaaaaaaguauucaaaaacuucucuuuauuauauguucuuuauuuuuuaaauuauaauacuuaucuaguguugugcauuuuggguaaggguuugccagauuugcucauucuguucucuggacuagauauauagucucuuucuuuugcuaaaaugcuauaaaccagccaaguuuauuugguuuuagaguuaucuuuauuuuuuuaucccuuuggugauuacuaauuagggcagcuuaaagcuuuuaauaacugaaagaaaucuagcuugcuauuccaaaauuacuguauuaaaagcaugacuuucuacaagacuuuuuucuucuucuugaacguaggcaaacccaccacgaguagcucggaagcaugccgcuucuguggguccaggaguggaacggagcugucugcuguuggcaguguuuguucugaugcagacugccagguagggaucuacucagagguuaggccaucccaggaaggaagaguauacauauucucacaaggcuuuuguuuucuuuaguagggguugucauuuugccucaguacaguuuuccuucgucacaacccaaaggugacauuuugugcugcuuguucauucauuaaguaccaccauuaguacucaauuuugcucuggaaacagcuaagguaucugacaacuuggggcugaagagauggcucagggccuaacagcacucgcuacucuugcagaggaccugggcuugauucacaguacaggccucacaugaguaaacacaaacacgcgcgcacacacacacacacacacacacacacacacacguacaguacacagacagaaagacagaaagcaggcacauguacaugcaagcauaauauaaaauauacaucugcccagaauuccguugccuuuguucauuuguuugccuaaaguaaacuucuagugucugaaagguuuugaauccugaacuuaaauauuguggcaugugguuggcacuccgaugacaagacauagguggggauuuguuuguuugggauuuggccccugguuugggacagagggcugguauuaggagacauuuauaucagaacguuauguuugugccuaugucugaugccaaaucaaguaaagucguaguucacuuuuuaucaaugcuguucuuuuauguuggaugaaauucuuuaauuacauuaaagaaaaacacuguuaguuaucaaagcauaggaguaauuauuguuguuuuauacuaauagguauuuucuguuuagaaaaaguuguuuagagaaauuaauauaguuggucuaacccugagguuacaaaccuuuuuaaucacucuaagacugcugcaauucaucuucaauaggaauaugcuaagaucgccugcaguaagacacaucccugcggacauccguguggagguguuagaaacgaagagcacugccugcccugccugcacggcugugauaagagcgccaccacacugaaacaagaugccgacgacaugugcaugaucugcuucaccgaagcgcucucugcagcaccggccauucagguugccucggcuuuuaaaugugccuagauuuuaacaggaggagauauaaucacauuucucaaguaaaaagaugauuggagcuuucuuuagauggccaaggggacauguccuguuccuauguacucguuagugucugcugaggacaaguucgcuggcucuauguucugcuucccguuccgcagguucagccacugugacuuuugugagugugcguauaaagugcuuuuagggagaaauggucagauuaucaaguagcuaaccucuccuuaguuucugaaauauagaauauguuguagcauauauagcgauucuguauguagcaauguauaccucaguauauaauagaaguuagugcuauauuugcuaaaucagaguuugugacuuuuuugacauuuauaauuucuuuucucuauauguuggcuaauugaauaauuucauguuuuccugaccuagccuauuuuauacauguaguuguuauauaaguagcaucaauacaugacuagaaaaaauuagaguugaaaaccuagucaauaaugauugucucuuaaaagcccuggcaugccuugguuuaaagugcuugguuuuucucguccccacgucauguagcucuccuacauuggagucuccccauuccuucaguguggccauggcugcauucgcucacucucguccguguuucucucuuucaguuggacugcagucauguguuccacuuacagugcugucggcgaguuuuggaaaacagauggcuugguccaaggauaacguuuggauucauuucguguccuauuugcaagguguggaaagaaccugaccuuaccuacuugucugucuuuuccucuuuguucucgucuuggauagguacuggcaucucuuggcauccuuccugagucucuauuagugucuguccucaucauccacauagaccccgaaaacaguguguggcuucucuagagugcuuacuguugaguuaguagaaguauauccaguggucaacuguccccuuaccuagaccaaugauucuuaaccugucgauugugaccccuuuggguaucgaauaacccuuucacagggccaccuaagacuaucaaaaaccacagauauuuacauuaagauucauaacuguagcaaaauuacaguuaggaaguagcaauaaaaauaauuuuaacauuggggcucacauugaagagucacaguauuaggaaaguugagaaacacuaacugagaccuuuguugggggaaggaacauacuaauugucaccuaauugucagauaaaagcuggcuaaauugaaguaaauauuucauauauggcaugagaaauguuaauguaaguaacauuguguacuagugauaagugcagcacuguuucagacccacuaagaguuacgucacacagcugugaggcacuaacaggaaaaggacucugcugcuugcaggacaggugaucugcuauuaagaugcccacgccuuuaaucccagcacucgggaggcagaggcaggcagauuucugaguucgaggccagccuggucuacagagugaguuccaggacagccagggcuauacagagaagucugucucgaaaaacaaaaaaacaaaaacaacaaaaaaaaugucauucagugccuuuggaacagaugcuuuuggaacuaguuaaaauaagaacauuucucugaaaugugccgggcaguggggugcacgccuuuaaucccagcacuugggaggcagaggaagguggauuucugaguucaaggccagccuggucuacagaguuccaggacagccagggcuacacagagaaacccugucucaaaaaaacaaaacaaaacaaaaagaccauuuaccauuucucuggcauuacaacacaucucuauaaaaguagcaguggaaguagagaacugcgaaggcaacuagagugaugaugaaacccuucgcuaaagaauguaucacugucuuccacauuacuuucucucugucuugcuuucugaagcucuuccuguuuuguuuuguuuuguuuuguuuuguuuuguuuuguuuuuaacuuucuguuuacaggcagcugcaauggaguuaauaugaaaaaucucagcccagucauugcuuacuuagacuagugaauaauaaaaaaaauuacaguauuuuguucucccuucucauggugcccacagaagacagucacaucuacaagccuggaaaaggcagagaagaugguauacagaauaugaucaucucuuaccugacacaaccccaucuccaaggagccaaaacacauucacaacccacacaugagaucauaugucauauuuguagaaacaagauagccuuuguuccaagaacaguuaagacugagaaagauguauuucgaucagaaacuacgaggucaagaaauggaacuguuuugugcaaaguccugauucuucuguuuccuugcucuuggcaaaauggaaguuuuugaggacuuugcaguagugcuuuauagacacugaguuuucugacuaguuaucuccuguuacggugguuggcacuugaauguacacuaaguguuuguugggacucuuucauaaaugcuucuguuaaaaauauacuuuuuauuucagaacaagauaaaucauauaguauuaaaagaccugcuugauccaauaaaagagcucuaugaagacgucagaagaaaagccuuaaugagauuggaguaugaaggucugcauaagagugaagcuaucacgacuccuggugucagguuuuauaaugaugcagcuggcuaugccaugaauagauacgcauauuaugucugcuacaagugcagaaagguaugcuaugagguguacuaaaauguuaagauucugagauuauccauagaauuaacuugaacuguauagugacacauaauuauucuuaaaccuuaagcuaggauuuaaaaaugagaaaccuugaugaaguguuucaagcugaaguaauucaccuaacugggaagaggagaauacuuuuuaccuaaacaaacuuuuucuaaagcuuguagcuuuccauacaaaggauacgucacaucugaucugauccugguacaacuggcucuuccccgggcugcucuaacguaccagccuacuggucacucauguguuuuaccagcguuccuacuuaagacacuguuccuccuuguuucggguguucgcuacuacauucaugacuuuaccugccacguacacccuuaugaccuuccagauuccuugagguuuauuuacuagacauugaaguucucauggauacuucaguguugaccucugauaugauacaccagccuucacuuuccaguguguaaugugugucugucuguuuugugacuguauuuucucccugagcuuuucugugguguuccuaagcuccaugucuuugcuuauacuacugcaaguagguuagcuuuucuaaaucucaggucugccugggccugucuucucuuguaaccuuguagcacugucugccucuccugccucaccuccaauaacauaccgaacagcuacauuucccagacucagccaugacugcugccccaugcaugcuagcacaggucacuucucuuucuggagucuucuucccuccccugcugcacauuuugccuuggcuguaacuauguacacacaguccaucugacucuaccugaggacccggcuccgcuuccuccacugcagcaugcucacuugccagcaccaccaccucugccugcaguaguucugcugccuugcguccaugcccaucacaacacauggccuccauuccuuuacugcucuacuugucucucugcccuguuucuuaagcuccauaaagacaaaggauggauguauuguuucuguuuaucuaucucuagucccugaugcguagucagcacugugaauacuagauuauaacuagaggaugaauaaaugaaugaaggaaggauaugcaguccugaaauguaauaaagaaaauuaaugaauggaauguaaauagauggcaggcaagcacgugaauauacauauguacauacaaggaaagaccaagagcauacauuugucaaagcuauaguguuacaaaaccucauaauaaaacuccauuauguauaauuacugugcaaacauuauaaaugacuauugugcugcuacuaggguaacagccacgugcuuaagaagacacagaaaccugaagcaagcuagaaucugcagggugaccuggcauaucuggcacacuggaaagccacauuuagcuagcagaugagcauuuauagacucuguguccgauggagccugccuucuguccuguuuuucuaguacagauaauagauugauauugacucaccuuguuuacucucaguuuggaccuagcguuuugacuguagacauacagaccaugcaaauugucccaauuucuuggccuccuuuacuuuguauccaaacaaguaaaaauaaauuggccaucaacauaguugcauucauucuggugcuuauauuagauauuuaguuuuugaauauagaguagacuuacaaguaugaacaguauucugaauacaauuucuuaauuuuuuguucauuucaaaaauugugugauccgaagauguuuaaacugacuuuuuuguugcuuucuuauugaacuaagaauuuuaauucuguucuaauuuaugccaggcacacuuaauuguauauaauugugacuuaggacuugaugugcguguuuuaagcaauagaagggaauauguuguguaagauuuuaaaaugaaaaaacucacaacuuuucccagaaaaagcaucauuuguauuuacuacuugauaccuuauuccucauacuuguuugaauauuguauaucuucucaucauguuccuuuaauagcaugauuuuuagauguucuccuucugaaagaagaauguucacauuccagaauugaaauuauuuuuaagccagacguggugguacacaccuuuaauccuagcacucaggagacagagagcuacacaaagaaaccuugucucaaaaacaaaauaaauagauaaugaaugacuagcuucauguguaccccugauucucccugcagucagcaguguagacacggcuugcuuggcauugugagggaguguugcauagucacuauggccacacagucucccccaugcuguugcuucaugagcacaugguuucuccacaggcauacuuugguggugaggcucgcugugaugcugaggcuggacaaggagaugauuacgaccccagagagcucaucugcggcgccuguuccgauguguccagggcccagguaggcagacgcuagacagacacaccagacgcuagacacgccaggaagccgccacugggccugagagacaccacugacuauccuccagggaacccgaguuggguucacagccccucagcaggcaacucauagccuucauaacuccaacucugggggcugggcagccuccgaacuaacauacaagcacuuacacacaguuuaaaauaguaaaauuaaaccuuuuuuagucaaaauucugucuuuaaaauaagauugaucuccacgaucccugcccugacacccauguagucucuucugacacacuucaggguugggcauggguuuccaaguguguucaugauguuauuucuuguuaauauucucauuguguaguugucauuucaugaagugagcacuauauuuaagcaaugggaacauuuacuuauuuauaacccugugcucaagcuuuuaggcuuucccaucuuuaaugaaguguucacaggaccuauggacuugguggagaguaaaauauuauugggcagcuuucuagcccaauaaagcauugaugaagaaauguaguuucuuauuaaucagauaaacugugugggagaccgaacuuaaacuugaggcuuugguuagaucuuuuggaacacacauuuacucacugaucuuugaaccuaugccauugcauuuucagucagcuuuuaaagcuacaugugcucucauaguauugauuaacaagcuauccacuucuuaaauuuacuauacaugucuucagcuaucauaaguguuguugaaauagcucacuauaaccuuguguuucccacgucuuuugauauagaugugucccaaacauggaacagacuuucuagaauacaagugucgcuacugcuguucgguggcugucuucuucuguuucggaacaacacauuucuguaaugcuugucaugaugacuuucagagaaugaccagcauuccuaaggaagaacucccacacuguccugcagguaggguuuaagucugagagcucuguuucuagggucaguuuaugguuccugaauaagguaagaaguugaggucauguguuaggagcucuacugggacauccaagagcaagaaaaauuagaggaagcaaauaaaagcaagccaugugauguuuaaugucuuaaauccuuaaauucuuggcagaaucaugggaaaggauuauguuuuaauucuuggggcagggaagggagaugacuuaacuguggugccuugcauauaguagcaaauaccaagcccugaacagagucuuuguaguuuuuacuugaugacaaggucucaggaaauugcccaggcuagccuaaagucacucuguagcccaggcagaggccccaaaccugcaguccuucugcccagaguaugacuggaugggauuacaggccucuccaucaggcccagcuugugauguuuugggcuauuggggucuuuuuuuuuccucuuuaggaagauuuccauaaaauaggaagaagauuugagguagaauaccuaggaaguggcagcagaguuagaaccagaaagcuaaaaaaacuaaaauauccacgaaaaauacagaggaaaccacuguccuuggagaucaggcaaagaaaacaaaugaacacaaaacccaggagucugaaaaaagaaugucagaugucaggaaccuuagcaucauaggggggaaaagugauggguugggagagagaaaugagauuggaggaagaauuguaugugagcugagugugguuacuguaaauacacgcacacauauggugaugguagcuuugcugaagcucugaagcacacccucccacuauggcuucuuaggauacagaugguagguccccucaagcagggcaguaacuucacccucagucacaacccgcaguccuaaccaugcuauauacccacuaacaaagagacuacaaaagggcaaaaggcuaaaaauagauuaaauagacaaaauauauagauaaaauagacaaaaaauagauuuuuuuaaaaaggcaaaaaaaaaaaaggcaaguuucuauucacuguugagaauugggccaaaauuuuagagccaggagaaugaacaggugacugguaaauaacccugcaacacucugacuuaugugcaauauguugucauuuguuugugaucuuuauuaauuuguagcagacugugaaagaagcaaauggagacuguucugagagggcagaguguuagggagucaggaaagaugagagccaugacagugaggaugaggagugaggaaaggcaggguguuaggcugacugucaagaaagaugagagccauggcagugaaguggcguaaaacagcgaaugcagugaggaccacagacaaucagagaugaucuuucucagagagaaaggagagcacucagcagaagcuguagaucaaagucuggaaagaaacaggaaccaaaagaaaguccaucaugcuuccaggccuuaugacaugggaggagcccagaggacaggccuuaugacaugggaggagccuggaggacaggccuuaugacaugggaggagccugggggacaggccuuaugacaugggaggagccaggacaggccuugugacaugggaggagccuggggucaggccuugugacaugggaggagccugggggacagccacuugcaguagaaaauuuaaaggcagugucaucagggaaaacccaacuuuuacugguuauugaaauuguauuuucuuaaaauaaaaauucuaaaaaugaugaaguuugcaaagaaguaagugagcuaaaggacacaguuguggggcauaagcugagaugagagcucaggccaaggcuuccacugcgagggacugagucgggcuacauggaggacuuuguccuuacucaacuucacucccaagaguaaguuagggugggucugugguaaugcugguuaagagcaucacacagcuacacugugccguuacuagcauaucauuuagauauuuagauagaaaaggucagguuuugcuuugacauuuguauaagccuucuugauuucaaaccugugucuuucccacaguguuuccagaugacuacaguccguuacguuauuguaauguucauguuuuaaacucaucuggacuuugcuucagauacuuaacaaauggcauugucagucuuaccauuuugguagugugcaauuaguuucucuucagugaagguagauaaaggugaacaugguuuauuuauaguaaguuugauuuuacuuguaaaaaaaaauacacacaccgccccccaugggcuggagagauggcucagugucagcacugacugcucuuccagagguccugaguucaauucccagcaaccacaugguggcucacacccaucuguagugagaucugaugcccucuucgguguuucugaagacagagacaggguacccacauaccugaaauaaaucuuuuaaaaaaaaucccccacaaaaaucugguuuggguuuguuugucuauuuguugauguagaauaguuuucugcuagacuaagguuagagauuuuugugacugauuuugaucauugcuccuuaaaacuuucuagcucagugauccccuggguaggauguuauggucgggggccauuuuacuuccuguuacaugcauacauguguguauaaugcugaagcuugcauggggaacauaucuguacuaagaagaaaauuguuuuuagcuuguuaauucauagacauguuauuucuuugaauaacuugauuuuuauucacaugaaauuuaugugcauauuuuaaaauuacauuuuuuuaaccuccuucaaaauguauacaggucccaaaggcaagcagcuagaaggaacugaguguccacuccacguuguucauccgcccacgggggaagaguuugcucucgggugcggcgugugcagaaaugcucacacguuuuagaacuuucagauccuuugucuauggagaggauaguuaccuucauccaccgggaggaugcagugaacuuuaagcucugcucaggauaagaacgggaccauuuuacaucgaaaaugaaccauuuacagugcaggaaugaugccaaauaccguguacauaauucuugcuacgaacguuuccccuuuauuuugguuuaucuucuuugaaccaagacaucaaacuugugagguguuugcauguggccauucccgucacuggccugugacgcacuggacauuuauagauaacugauauagaaggaucuccaugcucauggacugagaaggaugcuggcuuucaagcaaaagaagaaaaagaaucacuguuuauuguauacugccuuuuuguaauccuguacaauugcaucacggguggguauaaaaaaaggaagauucugguuucuuuccuagacuguuauuuaaaaaaaaauuguguuaguaaggccuauaaauguaauaaguaucagacuguauauaaagcuaucaauguuuguccuguauaagaauuacuaaauuacaaaagcaguuucauuuaaacuucuagguuaaguuugagccugaaauuuuaaugaagugcaauacugagugugccucauuaucuugcagcuguaaacauauuggaauguacaugucaauaaagccacuguacauuuuuauacagugauaaagucuaau

SEQ ID NO: 7629 - RNA, 54711 nt, Mus musculus
cggcuaaaacccggagccgcuagagcagagcacggugcagagcugcgcggcugcuucuuccucggccggaggcugggcccuggugcugaugcugguaggcugcgcgagcugggcccgcguagccuccucgccgcggcgcucggggcucccgcgaugauggcggagcaggugaaaugcgccucgccgguggcggccuccggcgccggcccggggccgguggugaacgccgagcuggaggugaagaagcugcaggagcuggugcgcaagcuggagaagcagaacgagcagcugcgcagccgggcggccagugcggccgccgccccgcaccugcugcugcugcagccgccgccgcccuccgccccgccgccagccggggccugcagcccgcucgccacgcacagggccccggccagcacgaccuccccgggcccgggggcgcugggccccgcguucccgggcaccuacugcuugcccagccccgcgcccucccugcucugcagccugcagccggcugacgcgcccuucgucuacuccaagccggcggcgggcuucuucggcggagguggcagcccggaaccggggaccgcagggaccccgccgggggaagccgccacgccgccguugccgccuccaacgcugcuggacgagguggagccgcuggaccuggagagcuuggccgccuggagcgaggaggacgacuacaccugguauagccgagcuccgccgcccccuccccccggaguugggaggcccagcacgcgggggcggggcgugggaggcaggggacccagaggccuagcaggugccaagcccugagcagaagcuuugcauggaggcagaaaccuguuuuagcauugugccuauugguccgacuggggacugccaucugccccgugcuuugcucuuugcugauuacggggucccaagcgccucguuagccuuaaaugcacaacucaugucaucuugucgcucagcccugcucucuucucucucucucucucucuguguguguguguguguguguguguguguguguguguguggugaaggugcuugucuucugcucuccuccacugcuuaccguucuuuccuuacaaacgaacgcugcacaggauuggugugcagccccccuuuggucacaucggaagccgccuagugaugagccucuucucagacaucugcuauugcaguugaguuguguaguuauauaugccaucucucuguauuuucauagauaaccuuucagauaccgauuugauuauuaaaggugugccauccugguacgucagaggcaaagguuuuuuuaaggacuggagggggcagauggaggcgcuacguucuuuuaaaaaaauugaacuuaagaggaauuuucauuaauuuagaaaugaaaccacauugaagaaaaaguagguaguuuuauguuaauuugacacaggcuagagucaucagagaggcgggaaccucaauaaugccuccacaagaucagacuguagguaagcccguagaacauucuuaaugguugauauuggagggcccagcccauuguggguguugccaucccuaggcuggugguccugagguuaaauaaggaagcagguugagcaaguccuggggugcaacccaguaacuagcaccccuccauggucucucauuuagcacuugccuccagauuccugccuuguuugaguucuugucuuguaugaguuccuguccugacuuccuuuaaugaugaacugugguguggaaguguaagcuaaauaaguccucccuugucgucuuucccccccccccuccccaaguugcuguguguguggguccugguguuuaaucacagcaauuuuaaccagaggauggcacuauuagagacacuuuauuaucuaguuuuagaaacuuuuaggguugauuguaaggaugguggaaacuggacgugucuauucaauggacucugguuagcuguguguuucugcucaugaaugaguacuuuuuugaggagacaggugccuaagccccugcugcuugcucauggaaggcuuggccuuggaguaucuucuguuaggaaucgcuugcuuggucgcuagacauccucuaggcguguaggcauaccccaggagugguuagauaaaguggaguguggguucaugcaaggagguugagcaguguucacaucgggguaacaguaggaugaagaguugcauccuuuugccuguuauuuaagaaaaucagauuuuuauuuauuauuuuuuucauuuuguacucuuguuacugauuguauagaagggaaaugggaaguggggaaucuuauuguuuugcuauugggaacuacagucuuccuuuugcaucgauacccuacauggcaccuaccuguaaacuuucauugccaguugcucugauuuugaaaauuaauaacauaaaucuauaauagacuuuuuugugggcacauguaucaucugccuucagcuuugauuuuaggaacuguacagggauccuauggugugcaagucuaacagcucaacacuuccuggaacuuuaagccauucuuucuaaacaacacgcuuggguggggguacagccuaaguauagucccgccugaguauaguauuggaaaauggucuugcaguggcuuuuguguuucacucacgccugucaacccuaugcuaauuucaaaucaguugaguuuuugauuuuuaaaugaugauuuauacaaacaacggggagaaguugguuucuaaucugauagaaauacaaaggcgcaaucccuuuaaauauggcauauuuaaaaauuuaguauuauuaucauugcuguuguuguuauuauuuugucuuccugagagaaggucucacacuguagcccaggcugguccugaagucugugucuuaccucuuagcuuucugacugcugggauuucaggcaugagccaccaugauuggcuuucagauuuauuacagcauugcuguuuauccgguuaauaauagcacauauaugccaaauauaguuugucacaguuauccaacuauccaaguauauuguugucuaucuuuuaaucuuuuuacuuaaaacaucaaaaaaagaaaaaaaaaagcauugcaaugagucuuaaaaagugcuauuuaauaggucagcauguuaguccuuacugugcucugaagugacucugaauugaaggaaguuuaucuuuacucaugagauaugcuggucaguaauaagaacugacccuucguuacuuugaaacuguuucuguggcuuacagcacgcuauuuguagaaucccuucuuuaaacauggaggggagcccagguggaaaaacagagagggucguuaaucuuagucggaggcaccaaugauuuugaggucaccuaauuuacagaauuaaaaaaaaauuagauguuauuuuuguauggaaacauuucacuuguuuucugauggaaaaguagccaacacccuuuacuuuaaacauuuggaaaccaccugcuaauguuuucagagcacuccagguaccugcauggcuguaaagucuucauguccccugccuggggugccacagcagugugccuuuccauaggauaauagguuugcagcacaccucagucguuucuuaugugccuuaaggaacagcuggagugggaauauauagucuaaguuaaaaugccuugccagcgcauggugugcaaacaucuccaaacacgagguuugccucuuaaccuuuuagcaguguuucccaggggagaaggucuuauuuuggguaaggcucaaugacaccucucauuuuucuggaucaugcuugacgucagucuuggagauuauagugaaggggugcuugcccaccuugggcuacagacuuacaccuaugguuucuaacaaaaagaauuuguuuucaguuucaguuucaguuugguuuuguuuuuaaguuagcuuuggauacugugucacggccagagcucacaguuuugugcucgacuguccuuaacaccugcucagaagaccaccacccuuuguugaauuuuuuugcucuucgaaugcugcguguucugggcuugguuccauuuggggucuguaauuuuccuguugcuguaucuaccugcaugcugcagguagugagcuguuuucaucagugucgcuugccaguuagugggaacuccagcuuuguuguuguuggcuauugaaggaucuuuccauuuccaugugaauuuuaggaucaguuucuauguuaacacauacacucaccccuccaccuccccaacaccucacuaggauuuuuauuggauuuuuuuuuuaauuauaaaaauaacuuuaaggacaacccacaccuuaacaguauuuagucuuugaaccagaaaucugguauauaucuccccauuaauuauauguuuauuuucccucagaaugauuuuguaguuucucuuguauaaaucuuguagacaauuuuguuagauuuaugcauggcuuugacaguuuugaaaaugcucuugcaaauggaaaagggcaaaugugaaaguaucaguauguacaggagcagaauuaaccagcacuaaccagcacuaaccagcauccuacagaacacugcuccuacacuuacuaguuuuaaaucgauuauauucucugugaaacccauauaucugugauauauagauaaagacagauuuacugcuuuuuggucuaauuguucuuaguccguucagccugaugcgggugggaaauccacucucuagggaugacuagaaacaggagcccaguguccugacuuugcucugugggaaguguuagucucagauagcuugucaguuggguugaggaaguuuucacugggauuuuuuuuuuuuuuuuuggcuguuaaaugcuuuuuuuucuuugucuauugagaucaucaugugaucuccucccccccaccccccaauuuuaguuaauauagugaguuacacugauguucgaauguuaaagcaggcucucauuuuuggaauaaacuccauguggugacgaugaagagucuguaugugaggcucaauuucuaaaauauuuagacucugcaucuguuccugagugauggaggucauucgagauuccacccccaccauaccccugucccgguaauguuugugucuggcuauagagucaacaaaacauuguccucaugcaggacauguccucauguuaggauguugucccuccucuguggcagaguuuguaaagaguuguucuuuuguucaggugucugguaaaauucaauaaucaaccuuucuagcuuuagcuuuucuuuguauguaggguaucuuuuuucuuuaaaauuuuacuuuuuaacuuuucucuacaucuccauuuaaguuacuuuucuaugaccaucgcccagaugccguuuguauuucuguauuccuggauuggcuuagauuggcauggauuguaucugaggcguggguaugaaccaggcucucagccaagugggacaguggaauuuccgugauuggcuuagcucagagauuccuaaguguguucuugacacuagaggugccaucauugucugggaacuugcuaggcaucuagauuccuucaacuuacccugaaucuguugacucggaaagagggagcugcuguaugcuugaggauuuguguuggaagcacugaagagaagagcaaguaguuggccuaaucuuuacuugcacgagaaagaagcagcaggcacuggacgcagcaggagacugcaggccagggaugguagaggggagucuuacccagcugugugugucucaggauagggacagcauuagggaagaggaaauaguggauuaauggagacuuaguggguacagcacugugggccacauuccaagaaaucuaggauguauugcagcuaccaugaugugaauuaaaaagauauuuuagauuccucaucugacauaggagucagcugcuuuauagggcuggaaagacagguuuucuacuuuuaaaugauggaguaucagcagucuaaagaacguaaaaguuauuguguaugauuuuuuugagacaaggucucacuaggucgaagcuggagaucuauagagaucacguugaccuuaaacacacagaucggccucccucugcuuccccagugcugggacuaaagcuugcaggaaugaagucaugcuuuuuuaguuaaguucugaugccggugcuugugggcugcaagagugggguggaguaguuguagcaauaauugugcuuggaagccaaggaucauaacuggcuagucugucauagaaauuguugccagccucaaagguauucaagggaguugccaaggcagaauacauccuccaccucugugggccuggcucacucugacagguggcaaucuugucugauagugagaggguaaauaaugaaguuugaugugucaagaauggauacucauuagaaucacaguagcuugggaggauacuguugcaaacaggagccguggcuuuaauuucuaugcuugccaagugaugucuuaagauaacaguucaguuagcagaggcuucucucagagcuaaggggggauuuuuagauguguuuuugaaguaguucucagcaggcuuuggaaaguaaccuauucuauuuggggauauuugccuguuaaaaaugauucucgguacuuugaagcaaucaaaugugguucuguuucuaugggaacguucaaugcaugcuguuuuccucccaaagagaggcacuuucuguaaucuauaucaugccuauaauguagauuucuuucuuuuuuuaagguuauauguuggcucuucaaagacauucaccucaccagagaaauccccgaguccuuugcagugguguagacauguccuagauaacccaacuccugagauggaagcagccagacgcucucugcgcuucagacuggagcaagguacugugagugugugcacucucugucuucaaccuuggacugugcucuuggcuucuguuucugguuugggaauagacuucagcugauaagcucuuaaacugggguacagguucuugucacaugugauccgucuguccugaggaacacacaguuccuuacugagggcucugcucacuggccucaggggacuaacuaccuuuaguuagaguuuuagcugaugauauggaucauaucuuuuuuuuuuuuuucuuccuguuucagaaaugugucaguaagugaaaugagucugucuucacuuuccuaaauugguaauuaggaccuguggcucaauucuaagucacacugggaguuucuugaggucuacuuuguuguauuccuucucugucuaguuggauggaugacuggaagucuuaaccuccguaugccagaagcuaauccuaguaguguaugucccauuaguuaaccgguagagaccagcagaagacacauaccacacacacacacacacacacacacacacacacacacacacacacacagagacagagagagagagacagagacagagagagagagagacagagagagagagacagagagacagagacauacaggcagagacagacagauagacagauugacagagacagagaagcaggcagacagacagagucaggcagagacagacagacagacagauagauaggagauagguagguagauagacacacacagaguuagacagagggagagagacagagacaagagauggagagaauugugggagaaacagcuaaaggaauuuguggucuguagcuccuuccuuuuccucuguguccaguacuucgaggcuguaaaaguuugaccuuucaccuuguucucuaaccucucaguguccgcucacuuuccaggaacacccuuucugcccauguaccacugcaucucaaguccuguuugaacuuuugaaagcacagggcccgcccccuccaggggaaagaagguguuugugugaggaugggcagagggcaucugccuuggugagucaggagcacugcucaggcacacugaagguuagacucugcuucucaggcucuucagggauaauggaugguuccgagacacuugagaggaggacaagcuagguagaguuucuuugccucuuaauccuacaauagucaguacuucauguugaucagaggcagguuuuucauucaccuguagaggugagaaggguaaaguugagugaucgagagguuugcuaagcaagaggguacuugggugauggggucgguguuggggucucccugacaucaggaagccuauccuuagcaguauagauucuguacugccuguuguauuggcacggccauaaguuaauagccacagaagucuagcuuaaguauuuggggaagguggacuuuaaggcaucuguuuuguuaacuauugauguauugauagcaaguggaagacggucauaggaacagggauaugcugggugaacacuggccauuagugcccaugcuguggaugguacccugauguccagagaaucuaccaucaguuccuauccugcucaacaaacaaccaaguccccgucucucaccuucuuucucaaguagacuuauggccuuacuauguggacauuuuguuguaugaguaugguuugaaacagaagucaaaugagauucaaggaugacagcucuuuagcucagaugucaaugaaccugcuucugcuaagggugacaccuugagauuuccaggcuacacacuguugugacugcacgacccgcuugucacccagaagcaaccauagaugucagauuaaguagacacaguuuguuccaauggcaccucguucauuggcacagauucgaauuucaagagauuuuuuuuuuucuguaaugaaacacuccccuccccuuaaauauaaaaacugcucuuaacugauagauaucaaagagacagaagguggcuggauuuagcccaccguggccaugguguagcagucucugggucaggugacuggcacagaguuaaauugcaggguugauuuuugacacagaaaggaagcuuuuaguaaauguaauguaaaucugauuaauauuuuugaucagaugucugaucaucuaauuuugcuuuuuauuggcaaaugagaagucauguggacaugcagugaaaucagaccauuuuauuugugcuuugguuuauuugaguuuuauagaaaauauuuuagguagaaaacuaauuuuuuagaagcaaaaccaguggcugacuaaauuuguuuauucgucugcaaacuuuugcuguaagacuaaaugcuuucguuucaaagauuuguaauuccuuguaacuuacugauuugagcugaagaccuaggccgggguggaguugaaaacauugagcuccuugguaguguguugccuggcaagcaucagacccccgguuccugacccugcguucugcuaaggagaggcuguuuauuggauggccauucauaaaaugaucuuuucagcuugaaaaauauuagucgucucauacuuuccugcuuauuuuucggaugaauuacguaacagacacuguuuuucuguuuaugucuuuuaauuuuucauuuguuagauggcuguggaguuacauuaccauuuuaaaguuucuuaaucuuuugagaauuuuagacaugaauaguguauguuauucucuuuuccccccaacuuuuuucuguuucccccuacuccucaaauucaugaccucuuuuuaaauuguuguuucucccuucucucucucucucucucucucucucucucucucucucucucucucucauacacacacacacacacacacacacacacacacacacaggcuugcgaccuuggguugugagguuuaauuucugguuccuccucaucuccuuauauauuuucucagcacagcuuucuaacuuggcuuuuuaugaauuauagcaugcauagauguuuuugugauagugcuuauaugcaggcauugcaauaucuuaucauauuuugcaucucacuuaguuuuuacuuugcuacacaaaggugauuuucucaguucuguucaucaguuuacuccagacucucuggguccucucugaguguaaggggccugguguccuguccuguuccuggccaugcacucucuuccauucuuuuuaguuccagaugucuguugccuuccacagcggccauggcagggucuccucugucccacgcucacauccuccuggcuucuucucgguggcuccucagaugcccgcccucucuuccagccucuccuccuuuauuggccugccaccuuuacuugcugcuugggaugagaauaggcgagggagugugaggggcugaacuuugagggugccauugucuguguaucuuugucccagugguuggggacacgcugaguucuuaggucaauguuccccagaggacguagaaggugucaccuucaggccagaugcugcaguagcuguaacgcuguucuucuuaggcguucuuuacaugucuacugcuuaaaauaacaugggugggcguuuuagaguauuguccuguauugggggcauuaugaauuuauccuuuaauuccuuuguggugcucaugcagaguuacuuccgaucuggaaacuuugccugcgcaagcaccuguugccuuauuucuguauaagcucuuuacccgcagcccguuuucucuguucuuucuggguccuccugguggccauguguucaguuucccucaaccgauggucaagauuucuguguuuuccuuuugcuuuauccuauccuugaguuccucuuuauauuucuccuggcauuuuaagaauucaucguccagguuguugccacgugaucgggaguucccguagcggccucucccuuucucuucuguaagguguccuugucuguguuuggugucuaaugagucuguuggaauuuauucagauaauuagauuggucuuuguuaaagucugagcgguaccugaggacuugagugcuuuccuaccuguuucuccacacaacuuccuucccaccguggaccuugcagcagcagcuccagacccuucuagagucuuacucguuucccuuguugugggcuuauuaaacagugcugaaauccaaaccugucacccagucgaucucugcucucuaagaugcugcgacccucuaggccagggguucucagccuuccuaguucugcgggagucuuugauacaguuccucauguggugacccccaaccaucuuguugcuacuuuguagcuguaauuuugcuacuguuacgagucacaaugucgauaucuguuuuccaguggucuuagacaaucccugcuaaggggucguuugacucccaccccagagggggucaccacccacagguugagagccccugcuguaguccgaugcccuuauucucuguuuuccuguuggucuaaaguuuuaccuuuugcccuaaugugguuuuguagaauuucuaccuagucuuuccucuugaaaacuuacugacuucuaauuaaaggacuuuuuuuuuuuggucagugacaguagaggugagaauuacguuuuagcugcuaugugcaaacacuagaaucgcgugagcucccagcguuuuagaaguuucaguggcucuaaugcagcaucuuuuuguguggguaucaaucauuucuccccugggcagaccacgauuuccaagaguagguuucaccgagcgcuuucauagagacuagugcgcuuugcaaaggcagcuguaucgugcccaucaccaaacaccaggcgaaagcuugcgcuuucuuuuccugugaucuggacacgaggggcugcucaccagagagcggguguuucagaugguugguuucuaguucuugcgcaugaugguuuugaaaagaaaagugcuuaaaacuuuucugucaggacaugugaggggcucuggcccugagccaccugaggguauuugguguacaggccucuuuuggacuuuccuuuuucuucugcaucagaucaguguuggugaccagguagcuauccugcugaggaaugagccacugcagggaggugucuccaaaagacuuugucauggucugucuccaucuccccucacuugacgguuuguuuguuuguuuguuuguuuguuuuguuuuuuuguuuuuuguuuuuguuuuuuccuuuuccagacaugcucuuuugugugguccagguuggccuggaauucacuaccuacccauguagccaagccgcccuggaccuggucuccugugcuagccagccaugcugagacugaggccugggcugcacaccugucuaggcuugguuucuucuguaggcacauuuggcugcccuucuucaggauucucuucagguuaacucuuccagggccgguucagauucucaguucuuaaaggguaguuaagcaccugcccaccgcacaagaucacaaauccuggaaaaugcugugagcuuugcagaaaguucccaagcuguggcuugaagcuaugagaauaaacuaacaaucuagcccuucugaagaaaauagagagggaagaguguuuugugagauauucuuaaggagauaacaaccacacugucgcugucuuaaauauuccauugaaauaauguugaaaguaaaauaauugcucuuuuccuaguaucucuaagucccaugucuguugguauaaagguaguuaauaaaggauggagggacuuuuaguuuuugagcacugauuucacuguacagccuuagggaaaguucuguccaugauuccuugguuugaagauuggauggagaauguuuguucucuauucggaggaaaccuguuuuguucauucuuaaaugucugacuuuucugagcagauaaaggaucugcaucccagcguuaucuugaguuaucagugccugauacggcuuugagcacacguuaaauguuggccguuggguuuuacaguugacugacuggaugcauuuagguuuuuuuuagauguacacacacaccgaaguuuccauugaacaguugguauugucagugacauccuacucaucaagacaaaagcccacaugucauaugguggugcucauuauugugagccccguggaugaugcuuaaaucuguuuuguucacugcuguagcccucucauggagaguaguugccauggcaccguggguguuggaugcuaauuacugaauggaugagucuggggcuaggaacuguaacuagugacuaggcucagugcuucagcuuuacucagcucugugugagcuucuagugugucacgugguaggaaggagcgcuuugaaagacgucgcugggccaguucaaagagucagccauacugaauaugaguuagcuuaaaaaccucugaagugauguaaacacagauaucucugcugugugggucuuuguguuucaggacuugaaccuagcacacaggauuccucuuugcaugacuacuuauucucagagaagauacgugcuauuucuucuuuagcagggaucuguuuauucuacacauggacgaagaugcuuguuugaguuagggaucauaaucuaaaauauuuuagaaggguaguuaaguuauauauaaaaauagaagaucccaaacuuucccuuagucuguucuuucucuucugauucuaauuagaacuguaggcacaagcuuggcaucccuaaacugaagaucuguuuauaaaacgcuccaaaacuggggagaagauuuuugaaagccaauaaaauauuucaaguagaaaguuucaugcuauaacucuuauuucaugcacaaaauucuucaaaauguugcauaugaccuucagucuguucugaaguauauaugagcaagugauucuuguguuuagacuuggguccuuccuguucaugaauuaaaaaaaaaaaaaauccaggucccaagccuuucugauaagggcuagccuacccauugccaaaaggcucaucucuauucuucugcccuuuuggaaugcaaaucgcaaaaccacauagaacuuugcuagguaggaucaacuccuugauagccuggauugggaucauggucacggagaagucaauccaugucacgaggcugggauguugaccaaauaaugaucagaaagcuuaucuaaguaauuugaagugcccaauauguggcucacuuaaucuggguccaguuaauaaaagcuuaucugucuuaaggugcucagaugucucccugaaucaggacagucacauuuggggcguaugagugucuuacacagauagcccucacagauaccguccacagucaugucuugcuguggccucuagggccuuaugcugagaagucgaacagacacuggccucuguugguauuugagugauccuugccucuguucuucucucaguuaugguguuguguucauuccccagucgagucagacaagagcauuuggugugacccagugaucagaaagguggccuuuucauuuguaaaaaaccacacagauugagcagagccauucggagcuuaucaaguaucugucuccuggagccuggccagugucuccuugcguggcccaagaugcuaucccugccggcucagguuuccacucuugaggugcucugccacauuuggaacaccaauuuaaagcuuugcaaaggagaguucauuuuagguaagcuuuccccaaagaugcucuuucuuguuggaaaaaaauaauuuagaaucaugcuaagguuuuuuuuuguuuuuuuguuuuuuuguuuuuuuuuuguuuuuuguuuuuuuuuguacagagaagggucuccugguauguguauauuucugugugcuagaaauugaagacacauugccacagcugugggguuccaucacgugcucgcuuugcuguucuguucaaaauuagccuccaugcaugugcgccaguuuggugaugauuuagugaguugcaaauauguaaggacugggucucuguucaguuugccauuucaauccauuauagccagcaaccuggauauguuugccaaauguccuuagauagcccuuuuuucccuuucuuccucccucccuuccucuccccucccucccuuccucuccccucccucccuccuuuccucuuccccuuccuucuucuucagccaauuacauguguguuuauaugguggugauuuuguuuugcauuuccaccaagguuagaaagauauuuguuaaaauaaucagaaauucauggcagugcaaaguaguuguugcagugagcuuauuauugauuuucuauuuuauuacucauaaauuaaaaaaauagaguuccuccaaggcagucuguguguguguauguauguguguguguguaugugugugugcuuguguguguguauguguguguguauggugagucucaguguaugcgugugugcauguauguauauaugugcauaugugugugugugcacuggcugguuuugugugucaacuugacacaaacuggaguuaucagagagaaaggagacuuccuugaggaaaugcguccaugagauccagcuguaaggcauuuucccauuuagugaucaaggugggagggccccuuaugcgugguaccauccuugggcugguagucuuggguucucuaagaaagcaaguugagcaagccaggggaagcaagccaguaaggaacaucccuccuuggccucugcaucaguuccugcuuccugcccugugugaguuccuguccugauuuccuuuggugaugaauagcaguguagaaguguaagucgaauaaacccuuuccuccucaacuugcuucuuggucgugauguuuguauaggaauagaaacccugacuaagacaguguguuuguguguauauaugugugugugcaugucuauagguguguguggugugucuguguguguauaugugugugcauauguauaugugaggugugcauguuuguggguauauguguguguauguaugugcacguaugugcacgugugugugcaugcagugggaguugaaccuaggcuugugcugcgguaaugguuucuagcuccaggucccucaauuggcuuuuacugcuuucacacucugauggcugguuagcuuuuauuauaaaacaauaaaauuaguugugguagauagucucgcccaguucuuggggcuucugaaauguacagcuacacuuaagaauuucuagguucuccucuuuaguaggugguagggcuugacuggagauggcgaggguaccuguuaccagcugcaggcauggugcugagugcugcuagucagaggagcucagugccuggccuuugcaugucgccagacucauucaugaaacagaagauggagguaacagcucucucuaguucuucuucuuccucaaagcaagcauaaaugggccccgagaugguccagguguuaaggugccugaugaguugaguucagucccagacgcagguggugaagagacccaguuccugccugcuuucuucugaccucaacauaugcacuguguccugugcccuccucccagacccaggccaaucacgugaaugucauccaacucuacuuuuacaaaacaaacacuaugauguuagcagaaaaccugcaccucagggauugcuagggaguacuuuccucggggugugacuugucagaagagaugugagaaucaguggggcccucagcagcuggcucuaggggcccaggucaggguggaggggagggcugcccuaggugucugaacagcacagagaaaggccuagccauggggcccacgugugcagugugagcucgauuggcagggcacaauuguuagugguugugguugguuagugugcugguaggaaaugagcggcucuaaauaggugauucauucagggcuuucagaggccuuaagggcuccugagaugggugggaagcccuuaggaguucaaagcaaaggcgggacauaacuauccaggaaagcugcaggauggugucugaauuggguuagaagucauuagaagucagacacaguuuuuuuuuuuuuucuuuuuuaagguaaaauaaaaucaagcaagacauugauugacuggcugccggucuggcauuguucuucaccuggcgguuaaguccugcgcuuaucacuucaguuuaauauuuguaggcuacuucuaucaugcucuccagucagaaugcagaggaagcgcuuguaggcgaggagaggaacgagaaugacucacauucugacucuuucaguguauuuuacuauuucccaugcagguaugauaauaagcuaugaguagguucaaacauuuucccuugauggaaacuccacauuuaugcauucacuuuaugccaucucuuggaugaccgcuggaauagaaugcauguguguugccucccugaucgggagaagaacaagcuagcccaggagaugcugggaaugaaggacuguaaaacuccagaucucucuccuuuccugugcuuucccauggcucucucauuacaucauggaccauucaucuugugggagagaggcuuuacaagugaucugagcuaaccuuccuuugcgaauggaaggacuccguucuuuucaguggugaguuuauuggcccacuucuccuugagacggaagugguguagugucuucaguugucuugucguugcugcuauccggcuggcugcauggcuuaccuugugucuguguguuaccugugugaccacaucagauccaugacaagaguuuauuuagguccuucuucccuguuggcucuggauugaauuguuaccgucacagaccuccuucaugcauuccauggccccuccuacugucuuuauuucaaacuauagcucugugugguuauccaaaaggacacagugaucaaacauggccuuggggaugcuuagggccugagaaauagaaaagagcuaacauuuuaacugugauaacugggaacaucaaccgcucagcuauauuagccauuaggaccuaggacaugccugaucugccgaauuucauguuaagauaacuauaaaaaucuuaagauaccugugaagugucauuuugcuauugaauaauauaccuuaaguuuauuaaacuugauagaauuuuauagcucauuuuaaauaaauauuuuaugagcucauuguuaccuucaucccaaauauguauaaagcuuaaucuucauauagcaagcaacuuucuuugauuuacucuagauauuuuagauguauaggcaaaugaacuuguauuagacuuuuuuuaaaggugguauguaaaucauauuuuuauagaauaucacaauaugaauacagaauuguuauaaugucuuggacucauaaaucuuccugcauacacaucauagugauuuuuagauaauuagaugugucaugcuucaaaugaacaagaacuuguuaauucuugguauuucuagugauacuuugagaagccuggguagaaugauuggcagcccuauuuauauaaggcuaacacagcccuaccccuuuacuagcuauuuggguugccucccuacacaggacagacaggcacguuacacuugcguccaacucuuucaccuucuguuuguuaaggaaagugcaucgaggacaucuuccucaaaguaguaguaggaccuuguauaccucccugguccccauuuguuuaucaggucauggggugcugugaagaagagacuaaggcugcuuaggguuccccugggagaaguguggaucagauaagccacagaccagaugcugccucuccagggguuucuuaggucaacacgaccgacauauugaagcagguguuuuguucagugugguugguuuacaagagugaaaugaaaaaaagacaauaaccuucaccuuggcuuuaagacucuucuguuguccagauauuugaguaugucugugagcauuuguggaggcuuguaaagacauaacaugaucacuaagggccuuuguccuggaggggguuguagacagagaugaaaggccugcuaucccagugguguauggguauagaucaaaaugcugugagcuccauaaguguuuguaaaaagauuauaguaucugaaaguguuaggagcuuguaaugaugccucuugugccuucacuguucucagacuaagcuuucccugcuaguaagggccuugugguuggucccaucuaugugucauaaguagaggcccagcuucucauugcagaaagaauaagacagaagagcuggaaguauacaauccuggccuuacuuuccuuucccuuccaggacuguggcaaugaacaauguuguuugagucaacuuggagccuaugguuuugaggaaaccaucuuuuuuuuuuuuuuuuaaauauggcauuuagagcauuaguuucugucuuagucauuguucuauuguuguaaagagacacaugaccauggcaacaccuacaaaauaaagcauuuaauuggugcuggcuuacaguuuguuuauuuuauugucauuacggcgggcagcauggcagcaugcaggcagacacggagaaggagcugagagcucuacauuuggauccacaggcagcaggaagagaaagaaacugaggcuggcugaagcuuuugaaaccucaaagcucauucccagucacacacuuccuuuaacaaggccacaccuacuccagccaggccacauccccgguccuucucaaguagugccauugccccaugacuaagcauucaaauacaggagccuagaguggccauucuuacucaaaccagaucaauuucccugagguggacuuugagccaauacguguccacuguagaaacugccagaggcucacacauaauucagugcuuguuucuaggguaugaacaccugaggaaacagacacauccaugaaauugccuggauaaaauaaaauguaugccuauaaaauaaaaucuauuuuaagaaggcucuaauuuuaacgcacuaaaauucagagacagaagauaauuccuagagacacucuuugcuuuaccuaguuuuuacccauuuuccucaggauguugacuguguguguuacaacgcucaggaauuuuccacuuaugaaaugcauuauagugagagaaucauaugcgugguauacuuccauacuguauauaccauggucuuaucaccuucccacagacuugcuuuuuuuuuuuucccaaacaagaauucacuagcuugaggguuuugugucauugcucaagccuagaaacuaaccugugguaggaaggagcuggugcccaggugucugcuucucauuccugcauccuuucagucuggcguugaccuuugugcuauggaagacuguaguaaagaugcuuucucgcuggguguggugcugugugucucugcucuucacgcucaggcuggagugggggaaauuuugaauuccaggccagcuugugcuacauacuaaaucuugagaggagccuagguucuguagggaaccccugaaccagugcuuucugucuuguuuucuuuucuuuucaucagcccucacuggucauuuucuuuucuuaaaaguaauuucuaaauuuaaauauguuuugaucguauucuuccaaugcccaaguucuuccagacccucuuccccucccuacccacccaacuuuaaguuucuuuaaaaacaaaacaaaacaaaacacaccuccaauacagcaacaaaauuccccccaaaccaagaaaacaaaacacuaccccuaaagaaauaaaaaacuaccaaacuguaaccaaauaaaaaccacagaaaaccuuggagucuauuaaauguuggucaacugcugugaacucgaagccuguccuggaaugguguguaccuuucuacuguagaaaacugauuuucccucuccuagcagguaaguaaccuuuacccuaguggcuagguauucauucauucauucauucauucauucauucauucuauccuuccaucuauccauccauuuuuaaaaaauaaaauacaagacaaaguuaucacauugaaguuggacaagacaaaaacaaggaaagaaaagagcccuagagaaggcacaagaaucagagaacugcucaucuguguauuuaggaauaccauaaaaacacuaaacuggaagccauauuauaagcacauauuauaagaggaccuggugcagacccaugcugggaccgugcuugcugcuucagccucuguggguucauaugagcuuugcucauuugauucagagggccucauucuccugggguccuccauccccucuggcucuuauguucuuucugccucuucuuccgugggguuccuaagcacuagggguugggaggaauuugauggaggccucccauuuagggccaaguguuccaaggucugucucuguguagugucugcuuauacggcuguauuuguuccagucuguggcaaggggaacaugucugacgcuggcucaacaaagcgcugaucuguggguguagcacaguaucauuagacuuuuuaucaccccaguuuucuugguuuuggaccaguaguauuugguuucacccugggucccuuucuuauagaacccaggaccaccagcccagaggugaccccacccacaguggacugggccguuagcccugaauugcucauuaagacaaugcacuacaggcuggccuguagcuaaguuguuuucucaauugaggcucccuuuacuuaggaacuugugucugguugguagaacaguagccagcauuggagguucuacuguauuagguuucccucaagugugucuuaauguuagcuaucuuuccccauguccccuuccucagccuccuuguccucccacugcccagaugaucaugucguucccccauccauaucugucuauuccauuucccuguccuagcaagaucuaucuguucccucaagucccucacucugucccugcccucauaguuguauggcuuguagcuugguuaccaucuguuucacagcuaacauccauguauaaguaaaaacauaccauauugaucuuucugggucugggcuacuucacuuggcauggucuuucuacuuccaucccuuucccugcaauuuuucuggugucuuuuuuuuuuuuuuuuuuuuuaauggcugaguaauauacuccauuguaccauauuuuccuuauucauugauucuacuguuugggacaucuagguccuuucugauuucuguguaucacuaauagagcaacagugaacaugguuaagcaagugucucuuuggguaugugcccaagagugguauaacaagaucuugagauagagugaguuccaucuuccugaggaccugucaugcugguuuccauaguggccauacuugaccauaguggccauacuugagucaugugcuuucuugauuaucuaguuuccugaggguuuuuuuuuuuuugguugguuuuuuguuuguuuuguuuuuaauaucuuuuggauguuagcccucucucaauuauguaguugauaagaaucuuuuucuguuccauagguugcugcuuugucugauugaugguguccuuugccuuacagaacugucucaguuucacaaggcccccauuuauuaguuguugaucuuagugccugugcuaacacccuucuguucagaaaaccuuuccugugccagugaguucaaggcuguuucccucuugaucuucuaucgaauuuaguuugucugguuuuauguugacgucuuugaucuauuugaaguaguguuuuguucaaggugauaaguauguauccauuugggucuucuacaucaguguuucucaacccgugggucacaaccccuuuggcaaauuucuaucucuaaaaauaucugcacuacaauucauaacagcaaauuuguuacaaaguagcaaccaaaauacuuuuuauagcuggggucaccacaagauguauuuaagagucacagcauuaggaagguugagaaccacugggcuacaugcagccauucagguugaccaacgccauuuguugaagauacugucuuuuuuucccaguguguauuucugaccucauuaucaaaacucaggucccuagguguguggauuuaugucugggucuuguuugcuccagcaccaugcagguuugcugcuacagcucuauaacuggggauggugauaauuccugcaguuggucucuuuuuuuuucuuuucuuuucuuuucuuuucuuuucuuuucuuuucuuuucuuuucuuuucuuuucuuuucuuuucuuuccuuuccuuuccuuuccuuuccuuuccuuuccuuuccuuuccuuuccuuuccuuuccuuuccuuucuuuuuuaaagcuaucuugauuuuuauuguguuucucuaugaagcugaaaauugcccuuucaagaucugugaagaaauguauuggaauuuuuauggagauuguauugaaccuguagauugcuuucggcaagauggccauuuuuauuauguuaaucccacggaucuauaagcaugggagaucuuucuaucuucugauaucuuuucuuuuauuucuuucuucaaugucuugaaauuuuuaaucacacaaaucuuucacuugcuuggcuaggguuacaccaagauauuucauauuauuugaggcuauugugaaugauuuuuuuuccuauaucagaaaucuuuguauauaggaaagcuacuaauucuugugagguaauuuuguacccagcuacguugcugaagauuuuuaucagcuguugguguuuccugauggaauucuuagggcugcauacucuaauaucaccugcaaauuaugacuuuuugauuucucccuuucuaauuuguaucuccuugaucuccuucaggcgucuuaucucucuagcuaagacuucaggugcuguacaaaauggguauggaggaguagacagccuggucuuguuccugauuuuaguggaauugccuugaguuucccucuauuuaaguugauguugacuaugaacuugcauggcccuaguaucuaucccuaauaucuccgagauauuaaucguguacugaauuuuaucaaaagccuucucugcaccuaaugagaugaucauauguucuuugucuuucgguuugccuuuagaguggguuacauuuaucaauauacguauguugaaccaccugggcauuucuagguugaaucccacuugacaguggucuauaguggucuaugaucuuuuugaugugcccuuggauuugauuuucaaguauuuuauugaguauuucugcgucuuugcucauaaggaaaauuagucuguaacucuuugcugggucuuuguaugguuaggguaucagaguaacuguggccucauaaaaugaauuaggaaauguucuuucuguuucuguuuugugggauaauuugaggaguauuggcauuaacuuuucuuuguccaguagaauucugugcuaaaacuaccuggccugggcucuuuuaaaugggagacuuuuaaugacugauucuauugugguuuguaguuugcuuaaauugcuuaucugaucuugguuuaaguuugguaagugguauguaugggagugugugugugagugugugguguauguaugugugugugugugagagugagaauguguaugaguguguguguguguguguguuugugugugugugugucugggaguugugugugugggaguguguguaauauguauguguauaugugcuucccgucuugugaugcuacuagucuggaauuagucucaauuuuucuugggauguaguuaacuucuuuagguuggacuuuaucuucuagcaccuucuguaaggcuggauuuguaaguagauauugcuugauuuggguuuuauuaugaaaugucuuauauucuccaucuauuguaagugaaaccuuuucugguuauauuagucugggcuuccugugugcuuggucucucagaaucuucagcacauuuguucagggcauuuuggcuuuuauucuccacugggaagucagguguaauucuaaugugucugucuuuauacauuuuuggccuuuuucccuugcagcuuuuaguauucuuucuuuguucuguacauuuaguguuuuggucauguacugaagcaacuuucuuuucuaguccagucuguuugguguucugcaugcuucuuauaauuuaauugggaucuacuucuuuggguuagggaaaucuucuauauuucuguuaagaauauuuccuggaccuuugggcugaccaccuucucuuuuuucuagcucuaauguuuuuagaucuggucuucucauagucccagauuuucuggauguucugugccaggagguuuuaagaucuaacuuuuguuuguuuuugaccauuguauuguguguuaacaugcccgagacucucuuucaucucuuauuuucugucaguggcgcuugccucugugguuccuguuugagcuccuaauucuuuucuauuuuuccagauuucccucagcuugggauuucuuuauugauuuuauuuccacguucaggccuuggaugucuuuauucauuuccucuuuaaacacuugcaucaugcucauaaaggguguuuuuaaggucuuuacuguugagcgccggcugugguggaauugcugggcucuaacagagacaugcuguccuggcugcucauucauuguguucuuacgauggcaucugggcgucugggauuggccagauugagauucuaggugcugguagcuaggcuugucuuuguuggguggggguuuuguuuguugguuuguuuccucucugguuuuuaggagaaugugguggcuguauguugucuauagcaaugggcuccugauagaucugggcacuuuggguuccagguaaaaugugguucugggaccugagacuuuggaugcacugggagcugugggggucauuacuggauuaaggaaagcuggcuggcagggucugguaguuacuccccugggaacgggauggggugaggagagggcccuguggaaggucugcuggacagcuggggaugagacuggggauuggucuuggagaaauggugggaggugugaagcucugucgucagccuacaggcuucucuuccacaaguggccuggguaaccaaggagugcuugcugcagguggcgcuugggagagccacaguggauguuaggaggguaagagcuguguaguccacuggaauuggaggcaaggaggaaggggcgucuaugauagguguucugcugcagagccauggaugagauuggggauuggacuuggagaaauggaggcaggugugaggaucugcaguucgccuacuugcuucccugggcggagucagcccucacuguuacucugaggaucugacuuacgaaaugcugucucucccagugcguggccaugaacaaaggaugccuuucacauuuuuaaaugguugaagaaaaucaaaagaauacuucacagcccgcgaguaugcuacuagauucaacuuucacugugugcgugggaaguuucucuuucacauagccuuauuuauguauauauuaucugggcuguucuuguaaucucagaaguagcuaugacuccaacauuaaggccagcaaaacugaaguauuuauuaguuggugcuuucuuaaaaaaaaaaaaaaggcgcacuggcacacuggccauuuguugucaucuguggacuggccguuuguugucaucugugguagggaguccucuuuagcccacugugugacuguccuuacuuuuaccugaagucauagugggguuaucuuccaucacuugcauucguuuuguuucucuuauggauuuugacaauuccauuaacaacauguccaccaaauaucaguuguauaaacuugagccaauaagacaaaaaacuugaagguaaucauaagacagacacuugauaacaucuucagaugucucacugauguuuacauauuaagauuaacccugagauaugcugaaccacauuuucuaagcaaucucuuuacuuuuccaugguuagcugcuucuguccuguuguuguuguuggcagucauucccgacuguuguuacugcgcauuggguagggguguagucggugcagaggguuacugcgcguuggguagggguguagucggugcagaggguuacugugcauuggguagggguguagucagugcagaggguuacugugcauuggguagggguguagucggugcagaggguuacugcgcauuggguaggguguagucagugcagaggguuacugcgcauuggguagggguguagucagugcagaggguuacugugcauuggguaggguguagucggugcagaggguuacugcgcauuggguaggguguagucagugcagaggguuacugcgcauuggguagggguguagucagugcagaggguuacugugcauuggguaggguguagucggugcagaggguuacugugcauuggguaggguguagucagugcagaggguuacugugcauuggguagggguguagucggugcagaggguuacugugcauuggguaggguguagucggugcagaggguuacugcgcguuggguaggguguagucagugcagaggguuacugugcauuggguagggguguagucggugcagaggguuacugugcauuggguagggguguagucagugcagaagguuacugugcauuggguaggguguagucggugcagaggguuacugugcauuggguaggguguagucggugcagaggguuacugcgcguuggguagggguguagucggugcagaggguuacugcgcguuggguaggguguagucagugcagaggguuacugcgcauuggguagggguguagucggugcagaggguuacugugcauuggguagggguguagucggugcagaggguuacugugcauuggguagggguguagucggugcagaggguuacugugcauuggguaggguguagucagugcagaggguuacugcgcauuggguaggguguagucagugcagaggguuacugugcauuggguagggguguagucggugcagaggguuacugcgcauugaguagggguguagucagugcagaggguuacugugcauuggguaggguguagucagugcagaggguuacugcgcauuggguaggguguagucagugcagaggguuacugugcauuggguagggguguagucggugcagagaguuugcuucugugugcaagggccuugauucagcccccagcacugacaacuagaccauugcugggagaaacccuuuaugccagccucugccuucuuauaauauuuauugcucucuaguuuacacauaacagguccuuaugacucacguucaucuccugugagccccuuuccgaggcugugccccuuucuccucccugucugccaugccucugguuagcagguuugccuuccuucccucugcaaugcuccccuucucacagucucugugagccguagaugcacuugcuccuccugcacaccaccccuucccucaucucugaggucccccugccccccagcucauauaucuccucacuuuugguaagcaagcgcuccuuaaagacuuuuuucuucaucuccuaucugcuccaucucuucguacuagugucucuggcuugcuuuguaauuuguauucgcuggggucugauuugcccuggccuuuuccuaguucuccucugccacaucccucugacaggggcuauagcuccuaugcagaccauucccuacuauucucuugucuugcuuuauuguguguuugucuuauauccguuuuuuucuuugagccucuucacccuucaagguggccuuucucagguuccuugacggauucuccauacauucuuuccucuuaccacuuucccccauugguuuccauggaauucaugauaauuccucugccucagccucucaaguucuuggauuauaaaaucuugacuccaaauauccauuuuuaaaaaagauuuauuuauuuuauuuauaugaguacacuguagcugucuucaggcacaccagaagagggcauugaucccauuacagauggcugugagccaccauaugguugcugggaauugaacucaggaccuuuggaagagcagucaguucucuuaaccacugagccaucucuccagcccuccaaauauccauucuuaauuagccgucccuuuaaucccuugucuuuuugucuaugucuuuccccuucaucuagcaccuguuugcuguacuuuucugugucugucugcuguccacuccugaaugcuaagucuguacucggagccuguccugcaccaucucagcugagcucagcuuugguuuuggcaugugcgucuuguguucuuuguuugaguggguggugugacugcguucgucuuucuccacucucauguucccugggugguagaugucuccaccugagcccagcugauagcucauugugcccaucugaccagauguuccgagcaugcuuuagugaggacugugccuuccugaaucugcugggaagucuccacaguuguccuccuggccaucagucuguaugucuuuaguucauuugcauggcugucgucauaagauacagaucuaauugugccucucuaucugucagaauccaaccguguauauauacaguguacgagucagugucgucagggacucccuaguucuaccagcgugucccucagcugaggccuaaauggacacuugucacucaaggcuggaagcugcucuuuuaugccuuugcaccucugcugcucuucuccaucccaggagggcauuuugcgacacaaaggcuccuccgcugccaagggcccuuuuaaacaucaugccuucuguuggaaacuccucccggugugagcuucauucugacuguguuccucacucugcuccacugugcuuccugcaaggccuuacuucccugccugccugccugccugccugccucucuucugcgguagcuacuauuuagaaacuggagugggaaggagggcgagcauuccccauauuuuauucaucucaguggcuguggcauccggcacucuacagugugauagugggugccuguucaagggaggggagaagugauuuuucaaaggcgggggugggggggaagcauacgggcucagcaggcuuccccgcaugggagggagcaggagaaccuccguguguuucugugaggaggagucagucgccacuggagacugaccgucagugcuuucuguaucucuuggcaaauacugaauggcucuggacggguuuuguaaauagugauggucugagacauucuguagcuuuucuuucauuucuuuuccuuccuccccaccacccugucugucucucucugugucugucucuccucucgcuccagaauugcacaggccauuugcauacagauaucgaagugacacuuggucagccccacaaggcuaaacuguagaagacugagggagaguacauuuuagguggucaagaagagaagccaugagcaagagucacaagaucaugacuuauuuagaaagugggucuguguaaacuuugaggagccagugcuaggcucuuuuagaaagccuguuugaacaggaucauucugcccuucuggggugacacugacucuaggucaccugacuucucugagggugcuuaggagacgaguggguuaagaguugacauagugucugcgugcuacagcuuugccuuguaugugugaguguaguaagaaggcggaaaggaugaaguggagguuagaaaugugaaguggugcugacagauagauuuuccuagaaagaucaaagcucuguccucccugggcacuccaccugacuaaacagcacagaugucgggcacccgaagcagcgugccuguaaggaucgaaggucugggcccuuuuggagauuuuagaagauguuuauuuuucaagacugaggaagccugcuugcguuuuugugugguuuacuaucaacuggcuggaguuuucauuuuaacugugugccccagaauucuucagugacuccccuuuagcuaauuuuuacagguugguuuucccagucacagaucuucaccaauaguaauauaaaaaucauuagcugggguggggguggggucacaagauuaauacugaugaauucagggaguuaguuguuucuuaugagugugggggaguguucuacaggcacguuucuuucacugaaccuauuacuggcuugaaaugucuaauuauauucaccuuugucuucaaagacauuaugcugaacacuguuauuuuaaguuuaagguacuggauaaaauaguguagcugucagaguaggaacgguaggcugguuuuaaaguaaguagacauuaguuuaacauguuucacguuguguguacugcccucagcucggaucccaaguggcugaaaggaugucaucugcacaugagcacacaguaugagugcggcgguuuauagaauacuuggccgcauuaguuguuuucuuacguuguucuuuaugugaugugggagucugggauuguguaccaugugugugaagcuguggaaaccugaagagagcaucagaucccuuggggcugagguggugguugugagccaccggugucggggcugggaacaaagcucaggccugcaccaccucucuagccccguauuucuugaguuuuuaacucuguuucgugcagaacugaccuccuccgaggaugucacugagauuuuaguuagaucaggcuucucuuucaugugaauuagaucauauugauucuucaguuugccuuugauauuaugcagagacauauacucaguaaaauuugaauauucccuauuuugugugugugugugugagucuaggcaaagcugauugauggacuaucaguuuuuccgggaauuucucugucaugcacccacacaauaacuguggcagugggcugcagaagcuagacgucuuuuucugaaagcaauaacugccugauaucuucccaggauugucuuagugugaucccuggagggacuuauguaggauuuuuuuuuucuuguauguaugagaagguauaaaacaacuucacuaauauuuauuuuaaauuggaaaacuuaaagaugcacagaaaauaagcgagcagaugacugagcacagucggccuuuccuuccggcagggguuggaauucaguaaaaagcacacuucacgucacguccaggaguuccuacaacgaauccuuuuguagaauaggagugaaggaaaaucauuggagagcagccaauccuguuucugccuugggaagauugucuuccuccucuuggggucauuuugggcaucuuuaagaaucaaacaaguuaacaucuuuguauuaagaaaguccacucugcuagcuggguaugacggcagacauuuguaacuccagcacuuuggccagagaaauaggaccaggaguucaaggccagccucaauuacauaguaaguuugaggccagcauguccugugggaaagaccuugucucaaaagaacaaacaaaaacaaacuccaaagcaaacaaaucaaccaaaugaaacugccccuuuaacuguccuguguuguuuguuauuuaggaaguuguuucugguguggauccuuagcuccgcagaaaggaauggagaggaagugucccuuccuccucuugcucccuccccuucuccuccacagcagagccgugggcauuaauagagcaacauuguuuugugagauugccuuuauaauaauucuccucccucugcccaaauacccagcuccuuucugaagaacaauguaguguucuugcuugcaauagaugcuaucuguuccuaguugugaucuugcugucauagcugcgauaacugugccauugugcaggaaggcugggccacuguaguuauuguguagaauaauggaugcuguuugcuugugauguguugucccccugcaucuguggaugagaacacgaagucauuguaauuggccuggcgcaagaucaaacucauauaaaauaucauugucuguccaccaaguuagcagucacaaaggacuauuggcuuuaucuucuguacacagaauuuguaaugacagauacccugcaauugagauugaaggugguaagagcaaccaccucauguguguuaacugcaauuucaugguauauuggggguggggauggggucaaguucugagaguccaugucugcuccgacucaguaagaacugauggagcacaggcauacaaguagaauaaaggacucacaagaucugugucaauuaggaaccagaccucaugacagcgucucccaggcaaccugaggauucugaauauaguugcuuggcuggcuucccucaccucuauaggaaguaaaaucauauuuacaugacugaaauaguacucaucucuuaagacgcuggacggaggcggaaacaguucugcucuuuuaaaugaccuuagugggauuuucaaggauccagcuuacuguuugcuugacugcccacauucuccaugcuccccaucccaggggccaccucacaaacuucucgguggugggcgagugccccuuagcaggcaccguagaaaggcccuggaugcuuuucaggguuggucuugucuuuuaagaaugaauuuguuuaauuugugugaguguuuuuccuguguguaugcaugcgucccgugugcaugccuguugcucacagagcuccgaaccucauccagaacuggaguucugaauaguugugagccaccgugcagaaccacggggucucugcaagagcuacaagcgcuccuaacugcucccaucucuaaagauguaucuauauaaaaguuuuugaucaguauguucugaaauuaacugcauugaaaguagaccagauaauauuuagggcucugaacauuuacuauuaagaacauguccuuaaacuuuuagaaauuucaaguuuucuuguuuuuuuucccccuuugauauuguuuuaugugaucacaaaacacuuaauuuuuacucagaaauagaaaauacuucuaacguggaaggcugaauuuccccuuuuauauugcauuuaaucagaaugaggcagacuugcuauuucucaguaguugugugaauggggccuaacucauaaauggcuuguuuuuacauauucuccuuaaauaaauggaagucaguuaauguaugaaaaguugcuuuguuuuccuuucuugaaaaaaaaaaaaagucuccuuuucccccugaugaaccagcaucugccuguguagcgcuaacugcugcuguuuuugcuuccgugacagcgagccgauggcggagucucuucucuucaccugccucccuggcuuucccuuauagcccuguugcaagacucagcccuuauagcaauggcauuaguacucccagcuccucuaaaaccuccaacaaagcaauacuaacaccugaaagaacagguaauauuucaauuccugaccagcugcuugcuuugcuacuuagccaugaaacaggacacacacguccaucugccgugggaaagcccgagggugaucuagugucugagagguuaugcugcacgcuuccucuguguacggaaagcgcaugcguccguccgugugcuuguucacugcuuggcuagguuguguuugguagauugcccucucuagcgaaagcgccauguagguacgcguuuccgaaugcuugacguggaugggaucuggguugagguauuucuuuacugauuucaagauuacacgacuuugccgggcgugguggcgcacgccuuuaaucccagcacucgggaggcagaggcagaaggauuucugaguuugaggccagccuggucuauaaagugaguuccaggacagccagggcuauacagagaagcccugucucgaaaaacaagaacaaaacaaacaaacaaacaaaaagauuacaugacuuuaugucauuuucuagaguuuguguuuucuguuagguuuuugaauccaggccucagcagaagcaauguuggaucuuuaugagauuagagucucuucaccauugccuuuuuugucucagcauuggugugaauccaucgaaauaacauuugaaaaguugcucuuucguucgacuccuuuccucuuugguuccuuuagauuaucccacugacuauuuuucccuggggaucagcaagccuccugugauaguucacuggucacaauuacgaaguuguguaugauuuuauauaaauguuucuuuuaugcaugccauuuuccauuuaugacacuacugugucugcccacuaaacauggacuguguuaaauuuaauugugaaauauauaaucaguuauugccagagacagucaucugauuaucaauuaaaaguaugcauauaugcauauauuauauguacauguaugcauuuauauacauauaaauuuuguaugcacaguuuucuuagcauguguguguguguccucaaacacugcucucuuagauuuuggcacgaauuuuuuaguaggcaguaucgaaugauuuugcuuucauucuagaaguuggauuugagaaaaaagaaaacaauaaauaaauuguuuuauacuuauaauuuauaaacaaguaaagauauauuuauuguuugucaaauggugucaugucagucuuuugugacauguaaacaaggaaaaugccacuuguauaugaguuauaacacauguauacuuaugauuucaauaauaauaauguauuuccucuguguuuuagguuauaccuccaggggcucuccacuuaguccgcagucauccaucgacagugagcugaguaccucggaguuggaggaugacucuauauccaugggauauaaauuacaggaccuuacugauguucagaucauggcucgucugcaagaagagaguauguucuuuuuaauugagggaccccagguuccccacuuagacaauaagugcuggagagucaugaaccuuucccagggaguaggcagacaagcggauucuuuguuucauaucagcuuccuuuguaguuggaagaguuacaugucccuuaagugcugaagaacauuggagguguuaggccaacucucagcaucauugaucuauggagacuguaggcauuccagaacauucugcucauagcaguagguuaaaaacugacacacaaagguucucagcaucuuuauuugcaguagcuuguaucuguuacuuuucuguuguugugguuaaacaucagaugcacagacagcuuaaggaaaaaagaguuuauuuugcucaugguuccagagggugagaguccacuaugacaugguggaggauggcugcaagcagcaggcaugguaagaggagaaggaagcugagagaucacaccuuuaacagcaaaggggaaacaggagagugaaccagaaggagggccaggcuaugaacucucaaggccuguagcuagugcuguacuucccucagcagggcucacagcuccuaaaugucuccagacagcacccucaacuggagaccaagugcucaaaugugggagucuauggaggguauuucucauuuagaccaucaccuucuagcuggaguguguuuagaugcccuucgguaaugaaggcuuaagaaaauguggaauauccauauccuagaguguuacuccucaguaaacaggaacacaugauuauugauaggucaccuuaggugggcucuagggaaucacaagagauugcaguguaacuauuucuguaaccuuuugaaauuauaggccuugggaaguguagggcagauugguggguggggguggggcugaaggaccuggaaggaagaugauagcagaugggcuuugauacuacaaaaggguucgugguguagagauucuugguauugugaguggcauacacgcaugcagcgaguacaauaauuauaagaaagauaauauugaccuguacauacauaaguauaugaaaaaaaucugaauaaaauggguagauuauaacacuguugauauccuaauuauuauucuaauaaaaaauuugcaaaacuguuggaaacugggugagguccuugaauuacuuccuagggcuuugugggggcccauaguaaucuuuaaaaacaucaguaaaaaugauuccuaugcuccaggcugagugacugugggagaucacuggaacuacagcaguuuaccuugugugaggcacuucagaggcauugguaucgagggcgcaguaaggugugcauugcagcacuggguaaagcuuguuuaggguuuaucucuucaggccagcauaguggaaacuuaaacacaccaauuuccucauuuuagaauuacucaagagcccugugaaacacauggugauacuuaugcaggguuuaauaagauacauggugaagagcaaggcaguuacuuuguaucauuagcugugaauuuaagugcuuagcccaaaauguggaaaaagauuggacucauauuuagauauuaaguagccaggaagagacuacuuuaaaacuuggcuacaggcaauguuaggaauaaaacacugcaucauaacaaauucauaguaaugaaaaacaaagacagugugacugucuauagggugaaugcuacugaggauggugaggauggcuuaaagcuacugaagcguugaagcaucguggugcucugaagaaauuauagcuaguaacauaaaagaaagugagagaugaccuuguuugaaaauauucgcuccucagguuuuaaacuuucuuuuuagcccuggacaucaguagagggagcagguaccuuacugcaucagggauuugguuuuuguaauaccuuuggcucacaggaauuuguaguuauagugauuauuucuuccuaaacucuguuuuccuaacuguauucaaaccugaaaaaggauaauuuggacauuuuuauagguaaugauuucuggagccauagcagauaggucugaucuucacagccauggggauauaguuuuuucaaaauugucugaccuaacauuagauaugugacugguagauaaaugugaggcuuuuuuuuuuuuuuuuguuuguguuggugguuauuuaauguccuuaaacaaaaugcuauguccuuguuugagugacuuauugccauuuuaaaauaaaaaugucaaguacuguguguuucacuaggucucaggcaagacuacgcuuccacgucagcaucaguguccagaaacaguuccaguguaucccugaguucagggaaaaaggggacaugcagugaucaagaguaugaucgcuacagccuggaggacgaggaagaguuugaccaucugccgccaccccagccccgucuuccgagguguucaccuuuccaaagagggaucccccacucacagacuuucuccagcauccgggauugcaggaggagccccaguacccaguauuuccccucaaauaacuuccagcagccacaguauuacccaccucaagcccagacugcagaccagcaaccaaauaggaccaauggagguagguuaugcguucagccggugaggccggucuaggcuuauccuccuugugcccuugucaguuuggucuaaauuuacaucuaacguugacuaccuccuacccuaccuaugucucagcuuauagauuuccgacuucaggaaaacugccaugaugauccugucucagaauggucuuuuguguacuugugugugugcgcgcgcacgcgcacacacacacacacacacacacacacacacacacacaagguggccucacaccugugcugcaugcauuguacugacugagccaccucuccgccccuuaaugugggaaacuuuauguugcuguuuguccagcaugagguggcuguauugggcaggcuggaggcuuccuggcugagcuccaugugguuaaagaucccuuauugcccucacagccucaauagccugucacugugggguuugggcuuagagcacccaaagugaagauuugggagccugcugcacccucagauuuaggagggguuuggggaagcaugugucuaauucccaacuucaaauugauagccacagagcaguaggaugagggagacagcugcuccguguuugaagcagaaacugguugguaauucaccucauugugguggguuauaauucuccuucauauuauuuacuguucucuuccucguaucccaagaaauuagagucugacuuuucggaaccaccaagagaacaauuggguagcacuccaaggcuggugugcguuuguuuguguugcugaucagccagaaccuccaugcagaaccuagaaaaguggggaaacuacuuggcuauuuuggacuuacauaguuagagccuuuaauuauaaaaucguacuauuucucaaagucuguaaguagguaaauaguucuuuaaaaugucaguagggugaauacaaauuggauuagugaucaaacauuccuaguuuucaccuuuccuuccuccguacuugaauuauuacugcagacuagaaguucauuugaaaauauugaaagcacuauauucccaauauuucucuuaacacacucagauuuuaacuugagaguguuggcuaaagcaagucuuagcagcuaauaucuccgagcuccuacugccaggcaguuggcacuacauucuccacgcguguguuuacugggggguguggcaucaugucgcagcugggugggcaccugggcauguuaccugaaggugcuuucaagcaccacaguugaguucauccugcaagcucuggcuccgcaucuuggcaucgucaguggauugugcuccucugugccacugccucugccuuggaaaagugauaccacuuagaaaggacuggguuucccagaagccccagcucugaugcugcucacgggagccuggaugcacaccgcaguccaggauuuggcugcagugguuuuauuuuuccuaaguguuucuucacgcgaggggaccugggacacaaagguaauuucuugucugugcuucugagcagucagcuuuacagcugcagucacaggcucugaggucaccaggcccugaguuccaguccugcccucccacucagaucuuucaagcuggaguuucucaggucccuauagcuuugguguucuuagcuguaaaaugaagaaaagauaacaucuaacucucagaaaauguuacugugauuucacaucgagccaucugguguauuuuucccaauuuaaauauguuauaaggaaugaauuaaaugauggauauugcagugccugggguagaugugcugaauaaaaugucucucccacuccaccuacacuuuuugaacauuuuuaaacauauggcucagauaucugagcuuucaauguuauuugaaccaacuuauagaagaaaaugguaacuuugagaguaccgauguuuuucuaaaacaauauagaugggaggagauuauuagcucuucagucuauuuuuuaaaaugguaaugagaaauuuaaaagggcacauaaccuugcaaggugaauauguuagggggacucugggggugaaucaggguacaaaagggaggaguagauaugauaaacauuguauacguguaugaaaaauuuuaagaauaaauaaaauauauuuuuaaaguauacugaauucuauagaauugcugggaacaauaaaccaaacuggcauuguggcauacacuuuuaaucccagcacucgggaggcagaggcaggugaaugucuaaguucaagaugugcuuggucuacaugguaagaccacaaccuaaauaaaacagcaacaguuuaaaagguagaaauagauuuuuuaaauuuuauuuauuuauuuauuuacuuacuuauuugguggcuccauuucugguuucaaaagacuacuugugaaagauauugacauguuuugggaaucuuugaauugggaauuuauuugucagacagcaaauaacuaaguuuugcagaucuuuucuaccauuccuguauucuuuaggguuugguggugugcugcacagacccuuccaugggucuaugaugacuggcaggugaaacuagugucuucuugguuccugaguugucuuuguuccacagaaggcugaguuuugcugucccccccccccccgacccccgaccgauauccgaacucuuuucuugcucucuuccaccuuucaguuguauauugguccuugaagaugaaauuccugaauucuuaggaagauggaauuaagacauugcuuuucaauccuuggacuuuaaaguacuacuaugaaucuauuccagguuguuggcuaguugaagugagccauauugccagauggucggauucaaccagagaccacagcucaccuggaaguguuugaguguuuauacuuggacagcuuauuaguaagggcggauuccaggauuaugguguuaguaaauugacugguaccuaaguacaugaaaagacugcuuuuaaagacuagugugucuggaucaauggagauaacagugugugugcuucuaucuagaucaugguuugagggagaaauguaacaaaugauauucuugggaugcuuagaaaauuuuguuuaugagcuauggugcugugcuuaaaugugacaaaagucuugugauuuuauacacaucucuucaucuuaggagagccauaugcauuuaagguuaaaguaucaagagugucugaagguuuuguacuguugaaagcacacagauggcuguguuauaaugaccugacuggcaggaugagguagcucacagcucuaggaagaaaacauguguacucauggugcaguuuuuaauuuugcuauauuaaaaacauuuaugguagauuucuggaaauaagcacauuugaauuugcauuaauuuauaguacaguagacuaacccaggaacuaaucugugcuaggcaaaugauucuaccccugaaccacacaaucagcuccuggaauuagauuuucauaccacagaaguucaaucuucuaauuaauagaaagucauuguuucccuauaucucuaugcuaucgaauauauauauuauauuaucuaauauauauauuauauauauauccauaacauauauauauuaugcuaucuaauauauauauuauauuaucuaauauauauauauauauauugaaaauaguucagcagcauagauucuucuucgccacaccagguuugugaugccaagagaccuugcuguggguucugagaauuuauaccuucuuuuaaguucuggcuuacaccacacaaguaagagugccuacacacacacacgcgcgcgcgcacacacacacacacacacacacacacacacacacacguacacacacacacacacacacacacacacacacgcacacacacgcacgcgcccacacacacacacacacacacacacacacuguugaauguauuucauugcuugcuguaaggggcuagggacuuuagaaauugggagauacacuaugaaaagccccucaaguggggcuggggaugaagugcuuugugugagugagagcuugugucccuugugaagcugggcuuacucucaagugcugggagucugggggagcauugaggagauagucuagucuccccuucaucggagagucugcuuucugggcuuuguuacccuguuuacugaggucaaaggauuaaauggaaaauauuagaaaucaacugugcuggcuaguggcuaguuuuaugucaacuugacauaaggaagugucacuggugaagaggggagcccggauggagaaagugcuccauagauugagcugcaggcaagcagguagggcauugucuuaaucagugacugaugugggagggcccagcccauugugggcauucuuaggcaugcucugugugguucuauaagaaagcagacugagcaagccaguaaguagcauccaucccuccaugggcucugcaucagcuuaugccuccaaguuccugccguuugaguuccugucccggcuuccuuccauaaugaauagugauaugaaaguguuagccaaaaaucaucaaccuuccccccucccccacagcuugcuuuuggucaugguguuucauaacagcaauaguaacccuaagacauaaacaauagauuugaaauaacuuuuauuaucgacuugcuuauaagcauuuauuaguucuuuaucauagguaugaauguucaagaaacaccaugucuguacauuuugguccucuguaugguuuuagaccuuugagauuuuggaaggaaucucccgagagcagaguaaggggaaauaacuguaaugaggaaaauaagcaugaaauagaagaaucuguggcaggguacuauagaacugcacaggcagggaguaugggagugguagccagcguguguagagaagaguuccucuaugaaggaggagcuguagauucauguaguguauuagcaagaguuugcagguugguguaaacacacuggucuucuaucauugcacuuucuaaaauuucuuauuguacuucauuauacuuacugugugauaugcuuauuauacucuauugguuuucugucuauucccuagacaacaccagaaggcaaaaagcugcuagacagaggcacaguuaaagaacaugggcaauaaaggugaugcagugugcaagggaggaagauaaagggaucuggcuugauucgcaucaugaggagucaaguacaucacugguuccugacuuagcuugcaaaaaaauaugaccaucagauuauaugccuugauacacacacuccaguguauugggguauauaauaagauaauucuuaauagauuugagcaaagaaaaucauuaaaaacaauaaaaacaaauuuagacauuaccguguuuguggucuuuggaaaauucagcccuacuuuuuaaaauguuauucuuuaauauuuaauuucuuucaucuuggagaaacugaauuuaucuuagauucuccucuggaguugcuaauggaacuaacuauaugaaauucaguuuuaaagcauaaacuugaggagacuuggcaacugugguggucucauacacuguggcguccccaacauaaacggggugcgugccauuuaacaggugcaccacagguauuucccugcucauucgauggaaugaaggaauguguucaauggaggaacugcuguguccaguuaagggaguaguccccugucccugggaacagguggauggcaggaauaggcaucaggagauagauaggccuggugguaucuugggcccguagccuggaggcuuaaucugacccauguucagaauuugaggcuuugggguggcggugacagagccaagcuggggcuucucaaauguguccuuguguucuagaagagugcagcagggucugagggaaccgacuaaguguguuuuguggaguggguggcaaaaaugagcucugagcugcagugguagaaggaauauuagaacugacuggauuuggacaaguguguggcucuacaugauguagaccuaaaaggaaagaggagagaaguccaguuuagcgcuugcuccagcuccaguuuagagugaaccuuuguuuucugcuuagagugaacugaccugugugguaauggaggaaccuauuaccuucaacugguucuugaggcuuucaaaucugagccuggcuguuuguaacucucugcuaccuccugguggcagaaggugugccuagcaggagagaaacaaaaauaaucaggucauucagucuuuuggacuuuuuugagaguguaaacagcuuguacauggggaggguuaaugcuuugaagaaguuugugauagugacuggcagcuauccuaagagaguucaaauuggaauuuuauuuauuccauuuuaacguguuaccaaaagauuuacuaaguuuugguuuugaguuucauauauauaugugcacacauauauaugcauaauauauguauauauauuaaauacucaaauaucuuuauuuuuaguguuuuuauuuguaaauaguugcaggguuauuuucuaaccuuauguuaauucacuuacugagcaguaacaaaaaaguagaauuguuuuuuucuuugucauagaauguguguuuucccuugucaacuauguaucaguuagaauauucuagaguguccauugcccauauaagagauugguucuuccuuagucuuuuuguaauggacaugcuguuguuucuguguccuugaacaaauugccuuuuuauuuauuuacuucgaaagcaaauguuucuauuggcauucaauuuacuugugguuuuuaauuuaggaaaauccuuucuucuuuuagauaagcuacgaagaagcaugccuaaucuggcccggaugccgagcaccgcugcggccagcagcaaccucagcucuccugugacagugaggagcagucagagcuuugacuccagcuugcauggagcuggaagugggguuucucggguaccguccugcaguaaguauaacagagcgauggcucuaagcauccucguuagucgggacaccaggaggaaauuuuucuaacauuucuuucucaucuuuguccaugaggggagucauuucuaacuuagauuuagucauuuuaacuuagauuucacuacgaucagacagugcucccuccaguguccauguuuucaacugcuacaacuaauaaauuauaggaggccuuuagcucaaggauagcaggcacacuggauaauccccagcgaacccaugcaccuuucccauacaaauccuuaucuuuccuucugugagccugccauuuucacucaagagaggcacaccaguuugguccagcuguaacuguggucaugcuuucacuauuccaaagcauuuuccuccaaagaugaagauaguguuguauaagguaauguuaucuccuccguuccaguguagcuguauggauuucuucacagcgccuguagggauagagugguuccagaugcucauuccauuccuccugugaggucugcugacgugagccuuacaaagaccccaagccaauauucacauacuguaagaggaccacagagaaugcaaacuguuggcuaagaguuugcaucccuagugguuuuuaaguuugccuuccucaaaccuagauuuggauaucaguuuauuucccaaacaugugguugucuuuuauuucuuuauguccugguuccuaacaacaaaacgacuucauuuauucuguguaaggagcugcucuagcugauuuauaguuauuaucuuaugucgucuaccaacaacucugugacaaaguuucgauuaccauuuuguuaaugagaaaguuucaaauggguaaaguaacagucuagccuaagguggacaggucagaggugcagaguuagaaacaaugcagccuaagguggacaggucagaggugcagaguuagaaacaaugcagccuaaggugggcaggucagaggugcagaguuagaaacaaugcagccuaaggugggcaggucagaggugcagaguuagaaacaagcucugucuucugcuagggcuuauguuuucugcuacacagguugagcuucugcaaccuagaaauaaaauauaaaaaauguuucacgaucugaaacuugaagguugugugauaccuuaagugggaaauacacuuaaauuucacuauucugugaaaaauauuuacaauguuguaugaauuuaucauuaaguuaugugcauauaacugaacuuuguauuuggacuuuaguucaacuacaguguguagaauuucucuugcugagaugauuuaaaaagaagaaagaugguauaucauuuauauuuucaaaggagcauuuuugcccaaggcuagcucuauugcuuugggccugagacaagaggaaaauccuggaacauauggaggaguaaucugggcacgugguggcaagggcacagaagauaaauagagaagaggccaggggcgaagccuaucagacacacuccugcagugaucuaccacauguagaucggacucaaggccucuuccagccuugaguccgaaaauuucugcccccuucaaaauagugaccaaggcuuuaauuacccauaccugagagugagcuuucauaaugaccaucugaugaucccaaagguauuuaaucuaucuccaggaauuuccauggucuucacaguuaacggaauucucaaaauguccgcaugcaaaguuccccuaagaccucagcagcaguaaacuacuaugaaaucaagaaaacgugacauacuuccagcauaaaacaaugcagagugaacauuuccaucccagcagggaagaauagggauagaaaggcaaggcccaaucccagccaagucagcaacuacggccacaggcucaagcggucugacacgugacgggcaggagcaaaggcucuugguugguccuguaucuuaugguucuguagugugcagaccauacggcuucucccugggccagcuccucucauucccugcagcuuuccuuggcacauguaccauguuuaucagaucuguaauuccugaagucucacuacaaggcuucuggcccucccccacacugcccaaucugucuccuucaccguccuuugagugcuuaggcagagucugugcaccgauugcucuuacauucugccugccuaccugcagaacaagcaccaugugagugacuucagagucuucugcugaguucuuuuggacccuggcagcaggggucugagucucagcagacuccucacucccuucugcaccaaaaacacagucuuuucugcuguccugucuaacuggagcucuggccuucuacuaugagagucauuaaaugcaaauuuuuuguuguuguuguuuuguuugccugcuucuauaaacaucuuccaaauucacaaauuccuccuugcaaaccaguagcagaggcuuaggaaccacaaggucauagggucagagcagccacccagcuuccaguguuuuguuagguuuuugaucacuaugacacauaaccaagagaagccaccuaaagggaagaaaaguccauuuugguucagugaugcaugugucagcccaugacugacuggauugcucucggucugaggcauagcagaugucauucugugggaacagguagaugaggaaauuguugacugcccaguagccaaaagagacauaggaagggcuuagggacaagguaugucuuccugggauaugaccaaugaccugcucuaucccaguaggccccaucuccuauuguuuccaguaccucucagaaaaaggccaccagcuaggagcugaggcuucaacacaggauccuucuuggugacauuuuauggucaaaccacuaacaugaaagauaugucuauguauaugcaaauguucuacaacaugcggggcuggagagauggcuaagugaugaacuggcugcucuuucagaggacuccaauuugguuccuaggccacaucauagcucacaaccuuuuguaacucuaguucuaggggauaugaugccguccuuuggacucuggacacuaggcauacacagacauacauucagucaacacacccacaugauugauugauugauugacagaugguagaaauauauauguguguguguauaguagaagauauauagauagaauauagaagauagauggauaguuggauagauagauguagaugauagacaauagauugauaauuucucaaguuugaaaacaucccaaauguuagucuaaggcuuguuucccagcauuuuagauagagcacucagccugugucaugguuuacugauuuuuaccaggcugugagcucuggacuuggaccuugguucguugugaaugaaugagugaaauaaacaugaguucaugaaugaaucuauauccauuaaauaguuaaauuaguagggugucuaaugaaggcaaagcugauucacgaauuuacuaaugaugcaaaacagagaggccuguucacugacugaugucaguuauuuuuagacagcaggcuaauuaugaagaauuuuaccugaggaaaaauauacauucuaggucugaguaaaugaagacuaacaguguaaguaugaagcaauagaaaaauguuucgucuuuagcaaauauaggacgauaaggaauguguugauuguaacuuuguguguggacaauagucuuugagugccauaauaauuaacacaacacaaaauaggaaggaguguucaugauuuuggauuucuagcuuugaaauacuaaaaaacuaaugcgagcauguuggaaggaaauggccuguggccagagcugagaccaucugaacugcagaguaaauaauaauagauuauaauugauagugccauauaaauaucucuggguccaugcuuaacaaagcaaaaaacaagggauggaugggggggauucucuauaggcgggauucuauuuaaaauacauaaagaauuaagauagaaaagucacguacaggaaagcagaacaaacaagaggcauuacugugcauuaggucggucacucugcgguuuggaugggaauggcccccauagcucuacauuuggaugcuuggucaacagggagcaucaggauuggucgauagcauuagaaaggaggaggagaaacagccuugucggaggaagugcgucauugggggugggccuuguuggaggaagugcaucacugggggugggccuuguuagaggaaacucaaagcccacaccagaccagucucacucccuuuguucuuguggcuaugguccccagcuccagccccagcaccugccuguaugccgcccugcuccugucaugucaagccucucaaacuguaagcaagcccccaguuaauugcuuucuccuuugagagugccauggucauggugucuccucacaguaacucagauguucccauuucagguuuagggcuuaggauucugcagaggcuggggagaaaacuucaucaacaaaggacugugucgucagacuggaccucggguuuuaugaaauccaggcaucauaaccuuccugacuuuuucauuucuuacuuauaaaacucaaaugaugucuaucuuugcuauuuucuucugguagcuauuauuucuuuuuaaugugggucccuuacauauuuugacuguaagggacauaguucaucaguaggacccuucuuuuuuucuuuuuuuucuuuuuuuguuuuuuugagacaggguuucccuggcuguccuggaacucacuuuguagaccaggcuggcccggaacucagaaauucgccugccucugccucccaagugcugggauuaaaggcgugugccaccaccgcccagccaguaggacucuucuugaaagcuacucuguacugucauuucaaaugaaauuggacuuucauugaguccaccagacacuuuugggugaaucagcagcagucuaagcauuccauauuaauauguaguaagguuuuguugauuuaaaucuuauucaaugugucuuggcaauguuuuauagacuuuuguuuugagagauucuauagcucuaaaauuaagcuuauuucaaaguauuuacuuuuuuauaaauaguggguuuuuuuuucaaauuuagcuucuacuaguuuuaugguauaucaguuuucuccuuucuauaauaaaacaccugagaagcaauuaaggaaggaggaguuuaucuuggcucacaauccaucauggcaggaaggcauggagcagguggcuggucacaugacaugugcacagggaggcaauacaggugcucagcuggauguuuucuuucugugcagucuagaacccagccgauagcauggugcuacccacauucaggagaguucuuuccuccucaauugaagaacuccuggaaagccuucuuugcccagggccuguguuuccauggugauucuagucuggucgaguugacagugaagagucacagucacagaugcuaauuaggauguaauuguucuuccuguuuugguuuucuauccagggaccuugcugaauucacuucuccuaacaguugaggggcucaguauguacucaacuuaguagguucacauuaccaacaaagcagguugaagaauguuccuaaaauugcaacugagacaaugcagucuuccauugucaugagaacagaccaccaugugcuggaacaccacauaguaacaccauagcacguagggcucucaugcaccuaauaucggguaaaaggagcuccacacgaaaaggaacaugggaugggauuccaguguagggaugggcagcgugcagugacagaagaggaaauguguucucucgggagauguucucccugggguggaguaugggagucucugagaagcucgugacacuguccuucuugagaugggggaucaugagcauguucacugaagaaggucaccagcauguguacuucaggcugauuauagauaguguuucugagaagaugagccagauucacuuacugcacuguguuaauuaacagauuucuuuuaauuuaaaaacguugguaaaauguuaaggauucuaaggaauauguuugugccuacagauaucacuccugacuuccuuucugugaugacaacuaucaaaucguccccauguuuguuuucauguggccaucguuagaaauauaucaagaaauuuucacgggggcuggagagaugacucaguuuuugagggcacuuguugcucuucuagaaccauugaauucaguuuccagcauccacaucagguggcuugcaaccaucugaugcacacauacacacacauacacacacacacacacacacacacacacacacacacaugugcucgugagcacauauacacacacacucauacacauacacacacacacucauaggcacacucacacacacacacgcauacuguaugcaugcacgcaugugcacgugcguacauaaguaaaauaaauaaaugaaaaugaauuuuaaaagaaauucuaauaucuuuuuaauagaaaagcaaauucgucuuguaacaauucagagacucuuaaauguuagagucaccuucugaauguucagaggccuuugagcagcucugacgggaucugaucagguccucuuacaugucaguguucuguuuuuuuguuuguuuguuuuguuuuguuuuguuuuguuuuuucuuuuccuugagauuuggaauuuuuuuuaaaaaacaacuuguagguaaaucuuacaacucagaaaucucaaggaaguugagaaaagacuauguaauacauaagauaaagauacuugcuauucuauuuuuauuauuuaauaccauacauauuuauaaaccuguuaucauuuaugcuuacacuuagaguccauccaugaccccauucauaugccagagaaauggaaacgcaaagacuccguguaaagccugauuauuuuaaguguaauaagacauguucauuguuaagguuuugggucaaggaggguacugacugaaguuuggggaaaccaugaauuacaguuugauuuuugaccguuaugcuguucauagaucagcuguauucaggcggacagaaugggaagagucuuaucgggauucucgccuacugaagggucuuagcaccuguacgucacuuaccucuuacauucagggaauguaggcuccucugcggauaacagcucuaauuaggaggcaguggcgaguuccucacacugacauuauuuucucccacagucccgucaccaggacagauucagcacagaguucacagcgugggccacuucccagugcccauccggcagccccugaaggccacagccuaugugagcccaacuguucaaggcagcagcagcagcggcagcagugguagcagcggcggcagcggcagcggcaugccuuuauccaauggcacgcaguuauauuccaccacgggcaucccuacuccgaacaaagcugcggcuucugggauccugggucgcagcgcccuuccgagaccuucacuggcaauaaaugggaguaaccugccucggagcaagauugcacagccugucagaaggugagaacuccguucacgggacugaaucugugcuuggaaguugcaaaguuucuccagcucacccucaccuuucccuggcucaggucaaccacgggucauuguccuacaggcgcauccugggucccucuuucucagcaggugauggaugucucuguguagucacauucugcuuccucucacuugauucuuaucccuuggcccacuguacccugccccagguuccguguguggcaaguuuccucccuccuucaggucugcucacagugacacuucugcucgagguuugaaaagucuuaguuugauucaucuggaacccguuuguauuguuaaguuccagauggcucaggcaagcuuuuuuuuuuucagccuaaaaaugccaaguucuuuauaggguacguuuuagacaaagguagugacaguagccuggcuuauuuuccuugguaaauaaagagaugugacaugcucauggcuccauauccauuauuggggacccuccauuuuuuucuugaaugcauaucuugaaggaggaagauuucuaucgucauagaauaugaagaggauuuguuuacuucaaacuugagaaaacauuggauuuucaaaguuauuuuucaaaauccugaaauauuucaaaauuacuuuucaguucuuuguugcuaucauagaaaaaauauuucaaaugcuaagaauguaugcaugugcucaacaaagcugcuuuaugcuuguagcuguuuuuccaucaaggaucguaccuuuuccuuucuaucuuuuuuuuuuuaaccuugugcacgugcacacaugugacucugcucaggccucagcuccagcagacaggcagacacuaggagaagccugaaggacauaaccugauacacauuugugacagugccaacagcuuguccuuaugggaugaaggaaccccgaugggagaggggaccagagcaagucaugugccuggcgggauuacuaacagcgcgucugccuuuuccucucuucauagcuuccugcagccucccaagccucugucuucacucagcacacugagggauggaaauuggagagacgguugcuacugaugcaguuuuacggacccuugaagaaugggaagaagugaaaaugaggguguguuaccuagcuggcuggguaaccauggaugcugggaugcuuuccccuucacgcuaaccacacgcacggcaucguuuucaguggaccaaucaccagagacuaacgagcucaccuacucucugccugagauacugcggcguucccaaacccgcggccgcgguaucguuaccuuagaucuaggaaguuuuuguagaacugcuccguaucugaauacuuuuugagagagauugaggcguaucaauaaugcuuugccauaugagguuuuuaaaaguaccuuguucauuuuaccuacauguuuuaaacaccuuccauuacauguucugcauuuuaauacauugcauauuuacaacuagguucuauaacaugguuugaauuuuaauuuuuuauaguuuacaggaauuuuauuuuuugugccuauuucuuuuuaugccuaugugaaccacuauggaacaacuuaaauuuugugccauaaaaauauuuuugugguaagguacuauuuuuuuagcucuagggauauaucagcaaaaacacaccauacgauuugagacauaauuuuacguugaacgagcacaauuuaaucuaaagcguugcaaggagacagccagacggcagaguuaaacggucuugucuuuuucauuguuaauuuauugucuuacaugaguuucauauuuaugaugguaucacaagcucauugcacuuaagacccgcaauguuugcuacucaaccacacaauugauuuucaauacuuuauuacaaaggaugaaacuguaauguuuuauuaacaaugcuucuggaaacgaaugcauuuuaaauaaaucuuuuugauagaccuuuuacaaaaacccauuugcacuaaugaaugcuuucuuagggucuaugacuuacuguuuguuacuguguacacugcuguuuuggaauguucggaaauaaagacucuauuucagcaauauca

SEQ ID NO: 7630 - RNA, 6462 nt, Mus musculus
agauuugaaauaacuuuuauuaucgacuugcuuauaagcauuuauuaguucuuuaucauagguaugaauguucaagaaacaccaugucuguacauuuugguccucuguaugguuuuagaccuuugagauuuuggaaggaaucucccgagagcagaguaaggggaaauaacuguaaugaggaaaauaagcaugaaauagaagaaucuguggcaggguacuauagaacugcacaggcagggaguaugggagugguagccagcguguguagagaagaguuccucuaugaaggaggagcuguagauucauguaguguauuagcaagaguuugcagguugguguaaacacacuggucuucuaucauugcacuuucuaaaauuucuuauuguacuucauuauacuuacugugugauaugcuuauuauacucuauugguuuucugucuauucccuagacaacaccagaaggcaaaaagcugcuagacagaggcacaguuaaagaacaugggcaauaaaggugaugcagugugcaagggaggaagauaaagggaucuggcuugauucgcaucaugaggagucaaguacaucacugguuccugacuuagcuugcaaaaaaauaugaccaucagauuauaugccuugauacacacacuccaguguauugggguauauaauaagauaauucuuaauagauuugagcaaagaaaaucauuaaaaacaauaaaaacaaauuuagacauuaccguguuuguggucuuuggaaaauucagcccuacuuuuuaaaauguuauucuuuaauauuuaauuucuuucaucuuggagaaacugaauuuaucuuagauucuccucuggaguugcuaauggaacuaacuauaugaaauucaguuuuaaagcauaaacuugaggagacuuggcaacugugguggucucauacacuguggcguccccaacauaaacggggugcgugccauuuaacaggugcaccacagguauuucccugcucauucgauggaaugaaggaauguguucaauggaggaacugcuguguccaguuaagggaguaguccccugucccugggaacagguggauggcaggaauaggcaucaggagauagauaggccuggugguaucuugggcccguagccuggaggcuuaaucugacccauguucagaauuugaggcuuugggguggcggugacagagccaagcuggggcuucucaaauguguccuuguguucuagaagagugcagcagggucugagggaaccgacuaaguguguuuuguggaguggguggcaaaaaugagcucugagcugcagugguagaaggaauauuagaacugacuggauuuggacaaguguguggcucuacaugauguagaccuaaaaggaaagaggagagaaguccaguuuagcgcuugcuccagcuccaguuuagagugaaccuuuguuuucugcuuagagugaacugaccugugugguaauggaggaaccuauuaccuucaacugguucuugaggcuuucaaaucugagccuggcuguuuguaacucucugcuaccuccugguggcagaaggugugccuagcaggagagaaacaaaaauaaucaggucauucagucuuuuggacuuuuuugagaguguaaacagcuuguacauggggaggguuaaugcuuugaagaaguuugugauagugacuggcagcuauccuaagagaguucaaauuggaauuuuauuuauuccauuuuaacguguuaccaaaagauuuacuaaguuuugguuuugaguuucauauauauaugugcacacauauauaugcauaauauauguauauauauuaaauacucaaauaucuuuauuuuuaguguuuuuauuuguaaauaguugcaggguuauuuucuaaccuuauguuaauucacuuacugagcaguaacaaaaaaguagaauuguuuuuuucuuugucauagaauguguguuuucccuugucaacuauguaucaguuagaauauucuagaguguccauugcccauauaagagauugguucuuccuuagucuuuuuguaauggacaugcuguuguuucuguguccuugaacaaauugccuuuuuauuuauuuacuucgaaagcaaauguuucuauuggcauucaauuuacuugugguuuuuaauuuaggaaaauccuuucuucuuuuagauaagcuacgaagaagcaugccuaaucuggcccggaugccgagcaccgcugcggccagcagcaaccucagcucuccugugacagugaggagcagucagagcuuugacuccagcuugcauggagcuggaagugggguuucucggguaccguccugcaguaaguauaacagagcgauggcucuaagcauccucguuagucgggacaccaggaggaaauuuuucuaacauuucuuucucaucuuuguccaugaggggagucauuucuaacuuagauuuagucauuuuaacuuagauuucacuacgaucagacagugcucccuccaguguccauguuuucaacugcuacaacuaauaaauuauaggaggccuuuagcucaaggauagcaggcacacuggauaauccccagcgaacccaugcaccuuucccauacaaauccuuaucuuuccuucugugagccugccauuuucacucaagagaggcacaccaguuugguccagcuguaacuguggucaugcuuucacuauuccaaagcauuuuccuccaaagaugaagauaguguuguauaagguaauguuaucuccuccguuccaguguagcuguauggauuucuucacagcgccuguagggauagagugguuccagaugcucauuccauuccuccugugaggucugcugacgugagccuuacaaagaccccaagccaauauucacauacuguaagaggaccacagagaaugcaaacuguuggcuaagaguuugcaucccuagugguuuuuaaguuugccuuccucaaaccuagauuuggauaucaguuuauuucccaaacaugugguugucuuuuauuucuuuauguccugguuccuaacaacaaaacgacuucauuuauucuguguaaggagcugcucuagcugauuuauaguuauuaucuuaugucgucuaccaacaacucugugacaaaguuucgauuaccauuuuguuaaugagaaaguuucaaauggguaaaguaacagucuagccuaagguggacaggucagaggugcagaguuagaaacaaugcagccuaagguggacaggucagaggugcagaguuagaaacaaugcagccuaaggugggcaggucagaggugcagaguuagaaacaaugcagccuaaggugggcaggucagaggugcagaguuagaaacaagcucugucuucugcuagggcuuauguuuucugcuacacagguugagcuucugcaaccuagaaauaaaauauaaaaaauguuucacgaucugaaacuugaagguugugugauaccuuaagugggaaauacacuuaaauuucacuauucugugaaaaauauuuacaauguuguaugaauuuaucauuaaguuaugugcauauaacugaacuuuguauuuggacuuuaguucaacuacaguguguagaauuucucuugcugagaugauuuaaaaagaagaaagaugguauaucauuuauauuuucaaaggagcauuuuugcccaaggcuagcucuauugcuuugggccugagacaagaggaaaauccuggaacauauggaggaguaaucugggcacgugguggcaagggcacagaagauaaauagagaagaggccaggggcgaagccuaucagacacacuccugcagugaucuaccacauguagaucggacucaaggccucuuccagccuugaguccgaaaauuucugcccccuucaaaauagugaccaaggcuuuaauuacccauaccugagagugagcuuucauaaugaccaucugaugaucccaaagguauuuaaucuaucuccaggaauuuccauggucuucacaguuaacggaauucucaaaauguccgcaugcaaaguuccccuaagaccucagcagcaguaaacuacuaugaaaucaagaaaacgugacauacuuccagcauaaaacaaugcagagugaacauuuccaucccagcagggaagaauagggauagaaaggcaaggcccaaucccagccaagucagcaacuacggccacaggcucaagcggucugacacgugacgggcaggagcaaaggcucuugguugguccuguaucuuaugguucuguagugugcagaccauacggcuucucccugggccagcuccucucauucccugcagcuuuccuuggcacauguaccauguuuaucagaucuguaauuccugaagucucacuacaaggcuucuggcccucccccacacugcccaaucugucuccuucaccguccuuugagugcuuaggcagagucugugcaccgauugcucuuacauucugccugccuaccugcagaacaagcaccaugugagugacuucagagucuucugcugaguucuuuuggacccuggcagcaggggucugagucucagcagacuccucacucccuucugcaccaaaaacacagucuuuucugcuguccugucuaacuggagcucuggccuucuacuaugagagucauuaaaugcaaauuuuuuguuguuguuguuuuguuugccugcuucuauaaacaucuuccaaauucacaaauuccuccuugcaaaccaguagcagaggcuuaggaaccacaaggucauagggucagagcagccacccagcuuccaguguuuuguuagguuuuugaucacuaugacacauaaccaagagaagccaccuaaagggaagaaaaguccauuuugguucagugaugcaugugucagcccaugacugacuggauugcucucggucugaggcauagcagaugucauucugugggaacagguagaugaggaaauuguugacugcccaguagccaaaagagacauaggaagggcuuagggacaagguaugucuuccugggauaugaccaaugaccugcucuaucccaguaggccccaucuccuauuguuuccaguaccucucagaaaaaggccaccagcuaggagcugaggcuucaacacaggauccuucuuggugacauuuuauggucaaaccacuaacaugaaagauaugucuauguauaugcaaauguucuacaacaugcggggcuggagagauggcuaagugaugaacuggcugcucuuucagaggacuccaauuugguuccuaggccacaucauagcucacaaccuuuuguaacucuaguucuaggggauaugaugccguccuuuggacucuggacacuaggcauacacagacauacauucagucaacacacccacaugauugauugauugauugacagaugguagaaauauauauguguguguguauaguagaagauauauagauagaauauagaagauagauggauaguuggauagauagauguagaugauagacaauagauugauaauuucucaaguuugaaaacaucccaaauguuagucuaaggcuuguuucccagcauuuuagauagagcacucagccugugucaugguuuacugauuuuuaccaggcugugagcucuggacuuggaccuugguucguugugaaugaaugagugaaauaaacaugaguucaugaaugaaucuauauccauuaaauaguuaaauuaguagggugucuaaugaaggcaaagcugauucacgaauuuacuaaugaugcaaaacagagaggccuguucacugacugaugucaguuauuuuuagacagcaggcuaauuaugaagaauuuuaccugaggaaaaauauacauucuaggucugaguaaaugaagacuaacaguguaaguaugaagcaauagaaaaauguuucgucuuuagcaaauauaggacgauaaggaauguguugauuguaacuuuguguguggacaauagucuuugagugccauaauaauuaacacaacacaaaauaggaaggaguguucaugauuuuggauuucuagcuuugaaauacuaaaaaacuaaugcgagcauguuggaaggaaauggccuguggccagagcugagaccaucugaacugcagaguaaauaauaauagauuauaauugauagugccauauaaauaucucuggguccaugcuuaacaaagcaaaaaacaagggauggaugggggggauucucuauaggcgggauucuauuuaaaauacauaaagaauuaagauagaaaagucacguacaggaaagcagaacaaacaagaggcauuacugugcauuaggucggucacucugcgguuuggaugggaauggcccccauagcucuacauuuggaugcuuggucaacagggagcaucaggauuggucgauagcauuagaaaggaggaggagaaaca

SEQ ID NO: 7631 - RNA, 9476 nt, Mus musculus
uauguuucucgccccuccgugcuacaagacggaaguucugcaaugcugcacaggggacagaaggccuuuaggggaggacaggcaugcugucucaccaacucagaaauuaucccuuccaccuuccggugagucagcucucuugguggcuuggagaccugaccaggugacugacacacccagaugcacuaucucucuuaagggaggagacaauggcaugcaguauuucuaucuuuggagcagaucggaaugcuuugucuccacucugggcgagcgguagcuuauucuuucagacuggacuagcgguuuagagggaggccaagcggauuuuacuugguugggauuucccgggaagccggagguguguuccaaagcugacagugagguggaggucaggcccaaggcuauuccgacguucugaucucaagaauggagacgcgaaaaucauuuaagaagcagaauagaaacaguccuggcauuuccccuucagccaggauaggacaaagugcauuuuugguuucugguuaaggauaccaaugcaggagcccaccguaaaccgccuguaugcguuuaucuccuguaguccccacucggaucuuuaggucacuuuguacucuguguugugcuaucaaguuccuuauugacuuacaauagagcaucuucuuccuuugagcuucuuuuaaucacuggggcaucguuguuaaauguucauauuuuagucucugaaaguguauuacuuccuaccauaucugccuacaguauuacuuccugggaaucaaaacugcauaucuaaaccuucaacaaucuacgacauuuguuuggccauugaugccaauacuaguaaaaaagacauggugaggagcuggucagauggcucagugguuaagagugccgacugcucuuccgaagguccugaguucaaaucccagcaaccacaugguggcucacaaccauucguaacaaaaucugaugcccuuuucuggaguuucugcagacagcuacaguguacuuacauauaauaaauaaaucuuaaaaaaaaagauauggugagucuauuguuggauaguauuaaaguaaaucuaaacaaaaaauaagauugacauuuucaggcaaauugcccaagccagaauucagguaaauagaaucauuggaaucccaaguuggcaccuggguuaaaucauaacuaaaagaagaaaaugcacuagaagguaaugugaacuucauuauuuaggaacaaguucugauaaaagauucagugucacagagauagagauaguaccuggaggauaaagaguuaaggaagugguuuuaaaugacaaaagcgggacacucucucccacuacugaacuuugcuuugagcacacuggacuugggcuuucuccgccacucgcuccagauccacaccccugggaggagcuuaacugauuaucucacaccugugugucuuguugauaagcuuccugcucccuaggggagcggggaaaggaaacaccccagggugggaaucuagagaaagggucacacggggcgggguugcugaauuuuaacuuugaaugaccucuguaaagcaucugaaaagacuuucugauaaugagaaauagggaaaucugugaaaaccugugauuugugacugggugcuugccuagcuggagugagguauugaguuccauccaccacacauacauacauacacacacacacacacacacacacacacacacacacacacacacucacacucacacucacacacacaguggaugcuugagggugaaccuuuuaagucgucagugauacaaauuuuuaauguuuagggcuggagaaggaaagaggagaaaaccggaauauuuuaucacaguagaguacucuguucuccaucauuaauagaauuugugaaccaaaaauguucacagaaaaauuauuuuaauugcaauacucuuauuaggaaaucuuuguggguuuacagguaguggugcucucuuuauuuggcuccacccuccgcuuuguucuguuucugagggcacacaacucaauccaacaaaaugaauggaccgcuucugaucuucccuuuguaaggcgaaauacaguguguucucauauucauuaaguaaagagcagcgcauagaagacaggucccuaugaguaaugcacaccauuauuaauggugguuguagucuagcuuuuguuuuaagagaaugccaaagaccugcuggcagaagcauagcugugaucuucucucaggagaguuauacauuucccagagagccagaggaaauuuuaauguuuuucuccaagcuuuacccaaauucaaccuucuaauauucuacaauucuauaauucuacagaaacggauuaagaugcaaacuccuuugaguuccaaaggagagggagggagaaacuggggaagcugucuuucagaauguuacccaucagcuagcaguccggaaaugaaagguuagacuagaaaucugaggucauuguucaaagucuguauccauucccuuggcacugauggcucagauaaacucugcugggguucuuuuguuucuaauacuaggcuaauuauaaggcauguaguaacaaguuuuuuaaaugccuuaagcaauuuuaguuuuuuuuuuuuaaagaggaggauuauucuguuauuauuagcacaaaaauuguuuaauuuacucccgaauucuucucaacauuacugaauaaaaaaauaaauaaauaaaaaggaaaggaacuugaccaguccgggcuucagccccaagugaaugggaaaaacaaaacaaaacaaaagaaaacaaaaaaggcaaggaaaccugaguacuccuaggugugguggaggagaaacuucauuagagacuugugagagagcauagacagaggcagggaccccugggaaaguccagaguguacaugaccuugagcugggccacgugaaagaggggauggaggagggaggagaggaggggaccagaaggcccacagaaacaaagacuuuagguaaccaaaaugguugaauugcacugggaagagcagcccagcccccucugcgguagcauuuacgggaagggugggugggguaugccagucaggagggcugugugucaggaagggacugagggauuagaagggggggggggaaucaguaggcagguccacuuugauuuguuaaauaggcagguccgccuuuuguccaggguuugaaaccuaccaauuucuaaagccacuuauaccuacuguucuccuaaacuuuguugauuuuaucuuaagaaugugagcuugcuaaguucauuuuaaaauacaaaugcauauguuacauaugcaaauacccaaccacuacaaaaacaggaagguagaagucuccguuaucccugcagucuucacgaguccucccagaggguaaggaucuacuuacagcucaaugguacaauccuugccucgugcacgcaaaagcccaggguguggucuuugcucaccgcaggaacuaaggccuaucuuuuaucucuuuuacuguuuauuuuguuauuugcuucaugcauguuuguuaauauacuuugugccaaguucugucagaaccagagaugccuguaucucaggcaugcugggauuacaaaccugagugaauaccuuugcucuaugcagugcugagggcugaacucagagaucccugaaugcuaagcaacacucuggccaacuaagucacagugugccuuaauuauuaauuaauuaauuacagggucucacuauguguaacccuggccuggaacuuucuuuucuuuccuucuuuuuaaaucuuuguguuuuuguuguuguuguugcuguuguuguuguuuuuguuuuguuuuguuuuuuacuuagauauuuucuuuauuuacaggccuggaacuuucuauaccuccugaaugcugagaucacacucuaagagaaaauucagaaaacugaguaauguuuggucauccaaggagacuucauuaguauuugugaaaaugagcaauuacacuuuccuuacacaugcacauaccuacacacauuucuuggccagaauugaacuaacguagcaggagauguucuccaguaucucuauggcuugaucgucaaggaagcaugaucagaggaugucuguggaacguggagagucuaaccugugggaggcugugaggaugaagucuuagcuacaauagagacacugggagguuggcgaugccagggauaugaaauguuugcugaggaagacugcagacaacagagugaagccagagagaggagggagggagaaagagacagacagacagacagacagacagacagacagacagagacagagaggcaggccauauaggauaccaacagcaaggccauaggggcagaauuguccauguauauuggaguuuauagcuucccacuacaauggacagaggcuggacagggcucuguagugcuucauguuugcugugaugauuuuucuccuuacuuuguucugccuuccuugguaguauaagccaauacucauuuuggaauggggauguuugguauguguuacaaugucucugaagucuaccacuugcuuuaugaauuuauaggaguucaaagcuaaaaguuugacuugagucuuaguaagacuugacugugaacuuuugccuaauauugaguaucuccguagccauuucagcuauggagauaacacuagggacggaauaauugcauuucgaauuguaagauggauaugagccuuugagacugguguggaaugugucgguuuaggagugacauguccuuaccauagccucauguugggugguauauacuauuuuuuuaaauacuugcuauaucuccuugaugaauuauuguuaucucuauuuuuuuaauuugaaaucuaauuucuaaauuuauugggaauuaaagcaccauuauucagcuacaggguuuugguuuguuuugagacaggcaggguguggaacucacuauguuuggccuuaaaguuacaacaaucauauuauguuuguuuguuuguuuguuuguuuagugugugugugugugugugugcgcgcgcgcgcgcgcgcgcgcacgcgagcaugcauguuauauauguguggacaccugugugaaaugaaaaguguguggaggucagaggacaauuuauaggagucaguucacuccuucuauuauuugaguccugaggauuagccagccccuuauaaguaguuuaacugaaauauauauucauguauuuuuucaugcuguguauguguugguacauaucuguaaucuaggccuguugggaagcugagccaagaaaaucaugaauucaaggccaaccuggggaaccauaucaagacccuauauuaaaauaagaaaaaaauucauaauagaaauaguggcuauuguuuccuuuucagaaaccagucaaaccauuaauuagggaauaguaaaaauauauuugugucugcaugguaguagucuuuauaagauguucuguucaauaucuguuuacuguauaucuguauaaauuaugaccaaucagugaaauuuggguuaaaguguuaaaauuauucaauuugauauaggcuuauucacuuuguugagaaagacuuauauuucaaacauauguaaaaaucacaagaucucauauauuaacaaaauauuuuguguguguauguguauguauguauguauguauguauguauguuuucuucccuugcaugcucuuaucuauacuccaaugugugcuauagaaggaacagagggaaacaugacaagaguccauuaguuaugacuagccuuuaacaucucagagaguggaaagguuuugagaguacaacgacucgugugccagucagccuuggugacuuugugaugaaucugggaaugccuguccuccguagcaguagguauuaaaugaugagauuucauugugccuacuuacacacuaacugaaaacuggacugcgaagccuccauuaucuguuuugcaucacuguaaaaguagaaagaaguuucuaugugcagccacugcgaaccuaucuuguuggggacaccaaaugugcagagaugaauuugauguggccaugaaacacccaaauuagcugguaacacuauuggaauaaaugaaaugauaagcuaacaugaugacuuggugacgggucugcgugucucugucuguaagaggagagcuuacccaugaaggacugcaucuuuauguuaacuguaccauguauaagagccagagugaaugucucugcauguucugugaagaaugaaacaauuugcauccuagccagacucugccucacagagcuucucaaagaaaaaguguuaugccgcagaagagaggugacugggagaaaauauaguuacugggaauggaauucuccugcuugguuuauuuuuauuagcguauagagugggaacuuaaggguuccuuggaaaguugauuggaugguguucugcuggggcaaacacgugaagaaacguuuccuuaaaguggacacaggugugaaaggcuaaggcugacuagugaaggaaucuuuggcugaagcagacacaggagagaggauguucucuuaaagcaagcuugugaaaggacacaugaugaaagauucuuugcuaacgacacacauguauugguccacuuuacacugugugguugagcugcauuuguggggacuccauagagagaaacgcaccaacaaaccuuugguggugugcugcagcuucuugcugcuuccaaggacuucaaaauagauuuugaaaaaaauuaaaguuacaaaaguaucucagaaauuggagcuacuuggauaauggguuucugaacuaaacacccacaucugcacagcaagcauuuuacucacuggcuaauuuucuuagucucaccuugcuuuuguuaagacuucguuuugcuuccugaugguggugguaggacccuacucugauaccaaggcuccaucucuaacccaugugccugcuuuucuagaaugcagugcucugaaaggcauagcucuuccugacauagaaucuggcacaaaaaauauauuaacaaacauguacugagugaauaucagaauaaauaauaaaauaguagagugaucaguguuaguucuugcaguguaauacagaaacaauggccaaacccuggccuucggcaagaaacagaaaagucagcuuacaugucucacuaagacaguucaauaaauagagaucuaugagauggcacagguacaauauaagugaauaaaauugaaagucuaaggauauacccgcauuuuauacuucaaauaacuucuucuacaaacucuuuuaauuacaaagaaacaaaauaaacucauaacagagaaguuugucagacaucauuuucuucuggauuuaaagugaacaccauuaggagcuauuggauacagcagggagaacacaccuucguguuuguaauaugcuuauugaaaauaaguaacaugauucuugacaagaagaaaugaucaaaaauuaaaaucagagaauaucauacaauaugacuuuagacuuuaaaauuauuauuauuuuaaaguguuguuuguugcauuuuugaaugaggaucucaauugcuagcugaccaggaacucacuuaccuaaaggcugguuucaagcacacaucuuccugucucagacucucaguugccagaauuauagugacaaauccugacaccaaauuuuguaauguuggaaaauaagaaagaaaggccgcauacuccuuccucuaauccuagcaucuaggagaaaaaggcagaaagguaggcagagcucagugacuucauaagccagucugguuuauguagcagguucaaggauagccagggcuuuguagagaaacccuaucucaaaaaaaagaaagguaaaaaggaaggaagaaaugagagagagagagagagagagagagaggaaggaaggaaggggaggaaggaagaaaggaaggaagagagaaggaaagaaggaaggaaggaaggaaggaaggaagggagggagggagggaggaagggagaaagggaggaaggaaggaagagagaaggaaagaaggaaggaaggaaggaaggaaggaaggaagggagggagggagggagggagggagggagggagggagggaggaaggaaggaaggaaggaaggaaggaaggaaggaaggaaggaaggaaggaaggaaguuuaaauguuuuuguccuagugagcguacugaacagauaucagaguaaggcuaccuuccuaccuuagugcuuacauggaguuuacaugaaagagugccuucauauguaugaauuacaacauguucauggcauggcuaucaacuuagugcuguugugguucccauggguagcuuauccacuaaugcagcaggguaaaggguagaaccuuuaagaggcuguaaggacugucucccaugauguugaggauacauuaagagugugagcucucucagaaagcggugcucuccgacuuccucaugcaaccucugacccuucugccuccaaccauauggcaaagcauaaagacccuagcaagaugccggugccuucaccauagucuucccaagcuucaaaaccguaguaaacaaauuucacauggcuauaaaccacucaaucuaugguucuguucuagcagcaaaaaaggaguuaagauuuucucagaagguucgggaaaguggagcagcagcuaacaagcccagagacagucuuuugcacuggccacgcucacauauugugagauccuuuaaagguaguaggauacguacuuauuuugggauucugggaguuagacccaaaguuucacauacucuaccaucaaucuccacacccugccccacacaauauuuuauauuccuaaagaugaaaaagaugcacauacacacacacacaaaacauacacacacaugugcacacacaaacacaaagaauaaaugcaaauuuaaaaauauguaaaagaacuucaugugaucucuaacuauuagaaaauuuuauuagaggccacuuccacauuuuguggauuuuuuuuuuucauuuuccuaauuauaauaaaaugcccaauuaguucucauauaaauggccacaaaguagaagguauauagauugauuuuuacacugaaaagugaaguacuuaaaaaucuuuaaccauuugguacuauuaucuacuaaccguauuuauucugaaugcagauaugucuuugcagaaacuccaucagaagagaaacacagugaaaguguguuauguacacugaugcuucuacaauaacaauagcugaugucacaagaucuaacuacagaaguguucaaguacaaauucauuuucacuggcagaaacauuauggauauugcagugauagagacugucaccaacagucaccagaucaacagcaauaauggaauugacaaacuuucauauucaggaggcugcaguugcaauugggaaauuuuguuauggugaagaaaaagaaagauguggcguuuguuuuuacacguugccaugaca

SEQ ID NO: 7632 - RNA, 686 nt, Mus musculus
aucaggacuugugugcugggcuggcaggaccuuugaucuucucuccucccuccaccaaaggacucugagauuucuugccagacagcuccugaugggcaggcaugggggcugggacaagccagcccucagcagggaaggcgaagccugccugguuggccaugguguagaaggugugcaccauggcagucagagacucugagagcugugugagcugagagagcugcucagggcugagccgggagccauguugcugcuccugcaucuggacugugucucuauaaaucuccucagucuugccccgcacaaaguucaccaggcucuuccgaaucaguggugggccugugucccgagguucugggcaaugggcuaauccaucuuggugaccgugagcuuuuggcucagccuucuucacggaagucuugugucuccuuuucccaugggagcugcccucacuuccuguucuggcccgacuggaguccccggaagagcaucuucuuuuccugggugguuccaccaucugagccgauucuuuggucuucuuucuggaauugcagucugaucggcuggacucccgcucccuuuuccuugguuuggaucgugauguccugucagaggugcucuguggcgcgguagggagguccagcgguugagagcaagggccuggaugggggguuucugcauccauc

SEQ ID NO: 7633 - RNA, 686 nt, Mus musculus
cucaggacuugugugcugggcuggcaggaccuuugaucuucucuccucccuccaccaaaggacucugagauuucuugccagacagcuccugaugggcaggcaugggggcugggacaagccagcccucagcagggaaggcgaagccugccugguuggccaugguguagaaggugugcaccauggcauucagagacucugagagcugugugagcugagagagcugcucagggcugagccgggagccauguugcugcgccugcaucuggacugugucucuauaaaucuccucagucuugccccgcacaaaguucaccaggcucuuccgaaucgguggugggccugugucccgagguucugggcaaugggcuaauccaucuuggugaccgugggcuuuuggcucagccuucuucauggaagucuugugucuccuuuucccaugggagcugcccucacuuccuguucuggcccgacuggaguuccuggaagagcaucuucuuuugcugggugcuuccaccaucugagccgauucuucggucugcuuucuggaauugcagucugaucggcuggacucccgcucccuuuuccuugguuuggaucgugauguccugucagaggugcucuguggcgcgguagggagguccagcgguugagagcaagggccuggaugggggguuucugcauccauc

SEQ ID NO: 7634 - RNA, 6580 nt, Mus musculus
agucucuuuauuuacgccuaccucccaguccuuggcaaucugacuaauaacaaacugagcuaacuagaaagacucgaccgagaggaaggagagcuguacagcagucuggaucuacaaccaaagaaagcaagagugaacacccccgggucuccgcaaagcgucuuguuuauuuacagugaucagcagcuugucaaugguuaacuauaugcaaaacaaagucagcauagcugugaaguaugcugugaauauuaauugggggagaaagggacucuggcuucaggaugcuccaguguguguucugccugcaagacuuucaaugaaaauuaagggcucaguguuucgccuucgaccagauguuuuaacuuucugaagcuaugagacuugagaaaaagugauauuugaggagaaagugcacugugguccugugguugguguuuucuuuuucaauaaagaaccugauugacuuuggacacuucuuccagcugggcauuucauaucgcaccaggaagugacugcuuuacagguaagaggaauguuugcagcuuuuuuuuauaucgauauuuguauuaucuugaagacagugaaaaucucucucucucucucucucucucucucucucucucucucucucucucucucucucucucuuucucucucucucucucucucucucucucucucucuuccuuaaaggauacucauuuuaucuuuguucacuggccaagcgaaugccgaagcagaugcuuugucuccugagcugugggcauuuaguucaacagcuggcugauuccauaauaugcgauucuuucuuuuuaaauacgcaguuuguuguuagaagcuaaaagugugugccuucugaggcacagcuguaugcuaugguugaauuucaaguauaggcacauuaggcaaugcuuugaacuucguaugauacuuuuauaugguucugucaugaaauuauauagucugaaaauaugccauuggaguuguggcuauuuuaagauuauauuagauaugggcaauagaggcugauucuugauagcuauacauuucugaaaagauuuaaaaauacaccaugcacauuuuaaauagcauaaauugcuuauaagauaaaaaauaagcuguuaacaucuggaaaauauuuacuggguucucaggaugcugcuguugaugaaauaaaucaaacuccuuguuaguaauuuaugaauuacuuagacuuucugugagccaaagcacaagcggaaggcuccaauacaagcuccuuccuucugagcagagugcucuggacuguuuaaaauuagucuuucuccccauggaaauguagauccuccuaacuuugccuugacaugcaaaggcuuucuauuguuuuguaccuucaguugccuuuugccuuccagaaacuuuggauuguaaguuuccaaggaaacaauguauuuucagggaccaaaguuuacuuucaggcuuauugacucagucugggauauuuaaucugauuguaauuaacaucaaaguuacuauuuguuuuuuaucuacaaaauugaaagcauuaaucagcauuguaaugcucaaugguuaugaacuauggugcuugucuuucaacuucauuuaucuacuuauggccaaauauuuaaagaaaggaacaaguuuauauauauauuuagauuuguaugugguucuccuugucucugaaaucauuucaaagugagucugaggacugcugauauacuuguaguguugugggaauugauggcuuauauaaaugguugcuuacuaaucuaucacuuuuuuuaggcaucuaaagauuauccugaaacauuuuaaaggugugcaguuuauuucagaccucauuuuuugcaagugcaugccuuauggaagguugaguugugaggugacauucaguguccaacauccugcuuaguguguccucugcaagucacuggccagaccuucagagcaggcauugcuugcuuuguuguuucauuuguuuguuuauuuagaaaauauugauauacauguuaucaauucuuuuuauuuaacuaaguuuuacuucauucaugaggaaauuuaaaagcagcagaaaguuucucacaucuagauauccaagauaaagugccuuuuuaaaaaaaauguggguauuuuuaagcauauacauuugaugcucagaagcaucguacaaaaagccucaggggaaaaaaaagagccaaaacaaagucauuuuuauacuacuauguuuuauuauacaaugaaagacacaucuuccuuaaucuuuuaaagugaauuuucaacacuaugcauauauucugcaaaaccaagaagaguuaaaccaaagauaugcuuauacauaaauaguuaucucagguuuccugagaacauagaugcacuuacaagugcauacauguuuauacacacauucacaacauugugucauguauuuaucaccagugcucuacuauuuuaucucauuucacacacacacacacagauacacacacauaauuuucuggcauucauagaauuuuuugcaagggaaauuaguuaugguauauucagaaauucaguuaugaaccaaguugaaguguccaguuagccaggaagcauucucuucucugugaaaagaacuauuuaauacgugugaucacaagugcagauauaauauuauaauguuuaauuaaccuuaauuuugaggaagauacaaguuaaaguacucuguuuaaauguugauucaaacuaaaagaaaaugaagaugcagcaaguuauucauaguuucauggcaauuuucuuuguauacauaucuuuucagacacuucucccugcuuuugcauuuaaaaucccuuguuauuaaucuuuuuuuuacagagucagauccaaucauaugacaaaaugaagcuguggacuuaucuccuuuauccaucucuucuugcuugucugucucuacagucccagucaccaaugcccucagucagaggcucuugcgacacucuuuguaauugugaggagaaagauggcauaaugauaauaaacugugaagaaaaaggaaucaauaaauuaucccaaaucagugugccaccaucacgaccuuuccacuuaaguuuauuaaauaauggcuugacaaugcuucacacgaacgacuuuucuggacuuaccaaugcccuuucaauacaccuuggauuuaacaauauagcagacauagagacuggugcauuuaauggccuugggcuucuuaagcaacuucauaucaaucauaauucuuuggaaauucuuaaagaggauaccuuccaugguuuggagaaccuggaauucuugcaggcugauaauaauuucauuacgauaauugaaccaagugccuucagcaagcucaacaggcuaaagguguugauuuuaaaugacaacgcuauugagagucuuccuccaaacauauuucgauuuguuccuuuaacccaucuagaucuucgugggaaccaguugcaaacauugccuuauguuggcuuuuuagaacacauuggccggauauuggaucuccaauuggaggacaauaagugggccugcaauugugaauuguugcagcuaaaaaacuggcuagaaaauaugccuccacaaucuauaauuggugaugugauaugcuacagcccuccaccuuucaaagggaguguacugagucgccugaaaaaggaaucuuuuugcccuacuccaccaguauacgaagagcaugaggauccaucaggaucuuugcuggccauaacaucuucaacaagugacagccgccuaucaagcaagaauacauccauuuugaaacaaccuaccaaagcaccagguuugauaccauaccuuacaaagccauccacucagcuuccaguaccuuauuguccuaucccuugcaauugcaaaguucucuccccuucggggcuucuuauccacugucaggagcgcaauauagaaagcuugucagaucuacagccuccuccacacaacccuagaaagcugauucuugcaggcaacaucauucacaccuuaaugaagucugaccucacagacuauuucacuuuggaaaugcuucacuugggaaacaaccgcauugaaguucuggaagaaggaucguuuaugaaucugacacgacuccagaagcuuuaucucaauggcaaucaucugaccaaacucaauaaaggcauguuccuuggucuccacagucucgaguauuuguaucuugaguacaaugcgguaaaggaaauauuaccagggaccuucaacccaaugccuaaacugaaaguucuuuauuuaaauaacaaucuccuucaaguuuuaccggcacauaucuuuuuagguauuccucuaacuagaguaaaucuuaaaacaaaccaauucacccauuuaccuguaagcaacaucuuagaugaccuugacuuccugauacagauugaccuugaggauaaccccugggacugcucuugugacuugguuggauugcagcaauggauccacaagcuuggcaagggcaccaugacugaugauauccucugcacuuccccagggcaucuugacaagaaagaauuaaaagcccucaacagugaucuucuuugcccugguuuagugaauaauccuuccaugccaacccagacuacuuauguuauugucacuucucccacaguggcggcagauacagcuaguacacucuucaguucucucacugaugcugugccccugucaguucuaauauuaggacuccugauuguguucauaacuauuguauucugugccgcggggaucgugguuuuuguccuccaccguaggagaagauauaagaagaaaaaaguagaggaacaacugagagacaacaguccuguacacuugcaguacagcauguauggucauaaaacaacccaccauacaacggaaagacccucuuccucucucuaugaacaacacauggugagcccaaugguucaugucuacagaaguccauccuuugguccaaagcauuuggaagaaguugaggaaagaaaugauaaagaaggaaaugaugcaaaacaucuucaaaggagccuguuagaacgagaaaaucauucaccacucacagguucaaauaugaaauacaaaacuacagaccaaucaacagauuucauauccuuucaggaugcaagcuuauuauauaggaacauuuuggagaaagagagggaacuucagcaacuuggcaucacagaguaccuaagaaaaaaucuugcucagcuccagccagagguggagguuaacuauccuggagcccacgaggagcuaaaauuaauggaaacguugauguacucacgaccaaggaagguguugguagaacagacuaaaaaugaauacuuugagcucaaagcuaacuugcaugcugaacccgacuacuuagaagucuuggagcagcaaacauagaggggcugcuugugggcuuuugcagaaaugcugggauucugacuuaaguucacacuuuugaaauaagugccuuacguggguguuaucaaucagaauucagcacagccguaauccuaugagagaugaaagaagaaagugaaacucagggacaauugaggaagccauggcauuaucaucaggcaauauagccuguuccaaauaaaacaaguccuugcauauaacuguugcaaggaguacguaguauugcuccauaugcuuacaaguauuucauagaauuucucuugcacaccuaaaggguugaacacauaaaaagcuccaguuuucuuggauacucuauucaugacuaaauacaauuaaauuucaucaguuaagcauauaccuguauauauauacauaguauguaaggaauuuauucauaaucacauauaugucagaaauuuauacugucaaucacacuaaauuuucucacaaaaagugaaaggggaacuggaacuuaaauuuaaaaaguggcaauaguaagugaaaauguacaauuuguaauuacgugcaccauuaacgauuccgaauuuucaacaaagggugccauugcuaagguuucugaauucagacucacgauggcaaauaguuccugugggauaaauaagcaaaugugugaguuuaaucuacacauuuucuguggauaucuuuugauguaaugcugcugugaaccuaagguaugugauuuguguucgacauucuauucuucuugggauauuuuuuuuuaaaugcuacugagauucuacuguauauaugauuagagcacuuaguaaguuugcuucuuuucauaguguuaauuauuuguacaacuggaugauaaugauaagaaaacaugucuuuuguggcauguaaaucaaagguauaaaaugaauaguaaaacuuauuuuauuuuuauugacauacacugauaggucguguagauuaguagcaagaggcguuucuacagguaaguguucugagcuuccucaggagagggacaguguagcuuuauuuuacaagaagguaucacuagauuucuaugaacuauuuauucuguacaguuuuguauauuuuugguucacaagauaauuauacuugggugccuuuuaagaaaguuuaagauuauugcucacuucaauaaaaguaaaaugaaaacauuucucaa

SEQ ID NO: 7635 - RNA, 2132 nt, Mus musculus
auuuuuuuuuuuuuuuuuuuuuuuugaucguggagggacugguucuuuauuucaaaaugucacuuaucgauauucaguaucaaaacaguugcucugcgggguucucuuucuccagucggucggucggaggagaguacaaacaagccaggaaucugcagggugcccaccuaacaggccgagaagaaaccaccugaacauggcaauuggguggggacacuugaaagaucagcacaccacuagcucacagacugcaaagaauucucagagccaauggcuuggccaagcuaacccaaccccccaaaaacaaaauuucaaaauaauauaaaauuuaaaaaguuuuuuuuuuuuguuuuuuguuuuuuuacacauaagcuauucaagauuucuccagcacugacugauacaaagcacaaugagauggcacuuuagagaccgcagcuucaggagagggcgaugagaugauguucauguggcuaaaucaguggcacaaacauaauuuuccuuucucugucucccuugggggcaggugaccucuaaggggucuccacaacacuaaggggcggcaugauccaucuuugagcaguuaggaaagggguagagcugcgacaaguuugggcucagggcuggggcugaacgguagcacgcuugccuaacuaacaugcaugaggcccugggagguggggcugucucagacgucucauugucuuauuuggucacaucugauggaaaaaguaaaaaauaaaaauaaguguaaaauuguucaaagacaccaaagcugaaaaccuucacagcccggaacaguuuuuguuuuuggcuaacuuccuagaaucccccuguuguuuggcuaagaguuggugcagagcacugaggucucccacaguggagccugccugggcucugcuggcucucaggaaggcaggcccaauccuggguuucuccuccauggcgagacaguauccauuaggcuaaaaugugcugcuccaagcggcagaagugcuuggaauguuaaaaaugguugcuaagacagaaaguaaucacaaugugcguaucauaacugcaucgaagacacugcguugugcucacauucccuuaaauauuguucccaaagguguucagccccuccaacuggaacucugggaaaaggcugacacaguuuugugaaaaagacaagagggguaaaaggggguggcaggagggaaagcagccuucaguuaaaaagaucagcccucaguuucaaggucagcuucagggaggcuggccucuggcggagucaaggucagagggaggaauggccgcggggcagggaugggggaggucuacaucucguucagguccagcagggucugguccagcauccuuuguguacagagaugcuccucuuuggugcacuucaguuuaucuuccaggucaucaauggucuucuccagcuuggcuaccgaucuuucagcaaacucagcacgggucucugccuccuugaguuuaucaguaagaaucuuuauuucuucuucauacuugucuucuuuuugagaguacuuuucuucagcagcacucagacacuucagguucugguccaucagucugaucuguucauccaucucucggcaacgggacucugccagcucagcacguuccuccgugcguuccaagucuccuucaauaaucaccaacuuacgagccaccucuucauacuuccuaucggccucuucugcaaugugcuuugcuuccuuuagcuggauuuccuggaguuccaucuuuucuucaucuuuuagagcccgauuuucaaucaccuucauaccucucucacucucaucagcagccuucucugcuuccuccagcuucugcaaagcaguggcaaggcgcuccugcgcacgguccagcuccucuucaaccagcuggauccugcgguucaaggaggccaccucagcuucagccugcuuccgggcccgccuuucucccuccacuuccugcuggaggcgcucggcccuuuccucugcaucaucagcuugcugcugcagaaccuggaucuugcgcuuuaccgccucgauggugguggucccggccauggugccuacaagcugcuucuggaaaucagguuccuaccuccuccgcucggcguuguagccgcuuuuccu

SEQ ID NO: 7636 - RNA, 12058 nt, Mus musculus
aaggcaaggcaguaaacaaguggguuucucggggccugugcucucacccgcuucccgcagguaugaaguucaagaacuauuuuuauugcuaacguugucuuuaagucaaugcaauguaaggaaggcuuuaagaauaugaaaaacaucagccaauaaaaaauagccuaauaccaggugaacuauuacaggcuauuguuagguaaauguuuguagguacuuaagaaaaugauuccugcaaagaaaaauuaucucaguaacauggaaauuaguucauauuguuuaugcagccaccauaucaguuacacauaagucagguguaccuuuuacauguacacagcuauguauaggugaucacugugcuaauauuuuuguuguaaauuuuuucuauuuuuuauuuaaguucauaaaugguaagagauugauguauacaucuuauuuuguacauuuaaaccacguacacaagugccaaauuauuauguaaguuuugaaauguauaauaaggauaauauucucucagcacuaucacuaacaaauucucugcccaauuccaaaggcaaacauuauugauuuaauagguauaauuucagaaugcaugcauuguuaaagcguagguacuacuucuaaacacuuguuagauuucaggaugcuguaaauguguguauauauuaacagguaguugguagauuaagaucaauuauuauuucaacaacaaacuaaucaacuccucaaggaugaaauaaucauuaucuucuauuaaugugguaaaggaaguauugagcauugaguacaggcuagcucuuauagcagcugaacuaaugaugcaaaauauugugaaugagaaacaauggaguugauuuuaaauuauuugaaaauaugaaagauuauuuuuggaacuuguuuuuaaucccuuacaacuuaauguguugauugguuuuaaaauugaaccuugagucuaauucuuguaucuauguguaaccaagaaggaaugguacacucuuauauaagagaucuaacauagcacacuuauauauuaaugcuuacaauguaauuauuaacacuaauuuagaaaauagcacauuuacauucuuaaauaacagacugaauucacaacucaaaagugaaaaugauagauaaugcuuagacauuuacaaauguguguguguguguguguguguguguguguguguacacacacacacacacacacacacacaaauacacaaaugguguggguguguguaugagugaaggagagagaaagacagaggcaaguaggaauuauggcauugugguuuuguaaagaacagugaacagcuuuggguguuugaccuuguccucaacuuuuagacagaaucuuucuagguauguccugcugcgugaaccacagauccugcaauccuccuauuacucucuugcaucaugcuagaauacuaggguuguaaaaaguuauugcuacauaugucuucuaccagaguuuugagaguccaaacucagaucuuaauaguuuuacagaaaauguuucacccauuggauuaacuuagcaaucucauaauagaauuuagauuguggacuuauaacuguugucuuguuuugaguaguauuaauuuauacaauaaaacacaugugggucuguuguggauagcgcuggggcuaauuauauuugauaauucuguucuccugugaguggauuugaacaaggaaugagucagcacucaggugauuuccuguaaaccuguuucccaccuuaauuuguaaaauaaaggagaccugaugauugggcaguuaaaagggaagguagaacagaagguaagggagagaagaaggagaaaauggaagagggaaaggacgaaaaggaggaggaggaggaggaggaggaggagaaggagaaggagaaguaggaagaaggaggaggaaggaggaggaaggaggaaggaggaaggaggaaggaggaaggaggaaggaggaaggaggaagggagaagggagaagggagaagggagaagggagaaggaaagaaggagaagaagaagaagaagaagaagaagaagaagaagaagaagaagaagaagaagaagaagaagaagaagaagaagaagaagaaaaaaaaguggagcagaagcacauggccuggagaaacugcaaguucuaaaguucuaaggggucucauaaauguggaaggugguaguguagcagaagaucugcccaaucuagaugcacagcauauauuaauauuguguuguguucuuguugccgggcauauuugggcuggaaaucuacugcaauaaaauggugcccaauguauugauuuguuuucaacaauccugaaauaaagguucagaacuagauagggaauauuaaccacugacuccaaguagagagagaagugauaauugccugcuaagaacagguauuaauuaauugaagucuguggcucuagguagagagauagaugguauaacaggaaggcugcucuaggcauauagcuuaacaauuaaaaacuaccugcuuccuauaggcagauauuaguggaagcuugaauuaauugcuuuuaagaugguauaaagauauauugcucuaauaaguuuuacaggauacucauauucugucuaacaugggauccagaggaauuuuggguuuaaauaauaguuugacaagcugccucuuauaagcagguauaguacuuaaagaugggaacuuucaccugagcuucagaacuagauagagaauauuagucaaguagagagagcaaugggaauugccugcuaugaacagguaauuaauuaauagaagucuguggcucuagguagaaagcauaacagauagguauuauaauagguauuaauuacacaucugugcguccugguagagagcaaaacagauagauggcauaacagguauguauuagugaaaguuugaauuaauugcuuuaaauaugauauaaagauauauugcuguaauaagucuuacgggauuugauagagggagacucaccgaaaacuagaucccagagaaucaaaggaaaaguuuaucuugaugauaguaaaauauuguuuugagguuuauauauuacagaauauacagccuuggugaauuucaucaucagacaugcugaacugaccugccugaacuccugaugucuugguuuuucauccagauccagacaggacacagacaucagagacuaauacaagaagguguagccuucuuaaaaccaacuaacucccccuuuucccuacccucucccccgcuucaaaaauaucucaacacccauauucagcuagaagaaguuaguucccuaaauuuugaaguauggggcuuagacucaguccuucuauuccuguuguuauaaaaagaucugagauguuuaagccugugaguuaagggccaaaugggaaauucauggcucugaguuuauuauuaggguguuuucaguuauuuuaauuagaaauggccgagaguaguuaacagagaacagucuagauuacuucacauaguuaguugucaaaaacuugagaaguccacagaaugugauguuuaauguuaauuauucacuuguuguugagaccagucugcuccugacaauguuccgugucuuggauucaaagaagaaacugagcaucuuugaguuacuccaguugugccaaaacagccgcuaggcacaaauugccucauuucaucuacauacauaauacuguccaaagaaaggacacaauuacagguuagugaaaggaaauaaaacuguaauucauguaauguauguuaaauagcccaaagaguuguuucugagcuuugaaaccuggggcugagaacauagcagaacagaccaggacaugcccgggcaagcccaucgccucccuagcucccaccccucugaccuaaguuaaauguuacaggcugcugauguuuaaauggaccaaucaugugaaaccgcgccaauuccucccccagccccacuccuuuucuauaaaaaccccuagcuuccaagccucguggucgaauccacugucuccuguuaugugagauacguuucgacccggagcuccgccauuaaaaaaaccucuuguuguuacaucaagguguuguguucuauucgugauucuugggugcacgccgaaucaggagcugaguggggguuuccccacugaguucuuucauuuggaggucccaccgagaucugcgugacacccaggaaccccgaaggaccccuuggaggugcguuuguuugugugagucuuguuauguugucuguugucuaagugucuaaguguggcacugcugaauuugugucuuaguuuuucaguucugagauuguggguuugagccccaccuguguuaccaguucugguauucuguauucuggcagcugccacugcggaccauaaggacccuaguggcugugggaagacgacggucuauuuccccacaggcugcacccuuggaagacauuccgagggagacccuggagugcccgggguacggaacagucaggaggaccuggcuguugccuggcagagugaagaagagugagugcucuuccugccagaggaguggagcggaaucccacuccaucagagguagcguuuggcugguuguguaaguccagacgcagacgagugugcuuggaugucuuaguguuuuccgucucugucauuguguuguguuuacucuuauucuucacuaugggacagaccgugucuacuccuuuaucuuugacuaaggaccauuggacggacguuagggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaagggccaggguugcauccagaccaacaaccguacaucaugguaugggaggacuuggcaugcuacccacccccguggguucgcccauuccucccgccucuccgcccuggcaccaagauucuagccauccgagaaaauggugagaaagagaaaccgaaaccaccgcucgggagagaugaugaucgcagcacaccagugacgaaaccccccaagaucuauccagagauugaagaacccccugaguggcccgacaccccucaacccccaccguaugcuccccagccccaaccuuuagcucccucgggaccccugccucaggccccggccggaggagggggucccuccacaggaacaaggagucggcgaggagucaccccugaggggccugcggauucaacuguggcgcucccccucagggcuauuggggcuccuccugccgauccaaauagucuacagccccuacaguauuggccuuuuuccucuucugaccuuuauaacuggaaagcuaaucaccccccuuuuucagaaaacccugcaggacucacuggguugguugaaucauuaauguauucacaccagccgaccugggaugacugccagcagcuucugcauacucuauucacaaccgaggagagagagaggauucuccucgaggcucggaaaaacguccgagacgaggcugggcgcccuguccaaacuccagcugagauagaugaaggauuuccgauaacccggccccgaugggauuauaauacggcaucagguagggaacgacuguccaauuaucgccggguccuaguggcgggucucagaggugcugcccggcagcccacgaaucuggccaagguaagagagguuaugcagggagcgacugagccccccucagucuuccuugaaaggcucauggaggcuuauaggagauauaccccauucgaccccacgucugagggucaaagggccucaguaauuauggccuucauuggccagucagcuccugacauuaggaagaaguuacagcgaauugagggcuugcaggauuacaccauaagggauguaguuauagaggcagagaaaguguaucauaggagagaaacagaagaugaaaaguuagagagagagaaaagagagaaaagagaagaggaggauaggagagacaggaggcaagaaaagguuuugacuaggauccuggccgcaguaggagaaagagauaauggaagaagagguagacagucagggaaccugggagacaaaaggcagcagggaccaaggagacccagagaaggcgggcagcgccuggagaggaaccaaugcgcguauugcaaggaaaugggccacuggaagagcgacuguccgaaaaaaaaacaagagguaaaggugcuuucucuuggggaagaugaagacuaggggaaacggggcucagcuccccuccccgagccuaggguaacuuuagaaguggaggggaccccuguggacuuucuaguugacacaggagccgaauuuucaguacucaaaacaccucuaggaaaaguaaagaaaaaugaaaaaaccuuggugaucggggccacgggacaaaaaucguauccauggaccacaucccgaguaguagacauagggcgaaaucgaguaacucauucguuucuagucauuccagaguguccuaugccuuuauuggggagagacuuacuaaccaaguuaaaagcacaaacaacuuucaccucucaucgaccggagguuuucuggggaauaaaagcgccccagacucuagagcugucuuuacaacuaggggaggaauaucgacuuuaccaaaauaaaguaaagcccccugagggauuacaggacugguugaaucgauacccucaggcgugggcagagacgggaggaguggggauggcaaaacugguccccccuguggugauugaacuuaaguccggggccaccccuauagggguccgacaauaucccaugaguagagaagcucaagaggguauacgcccccaaaucaacaaacugcuccaacaagggauuuuggucccaugcaaauccccuuggaacacuccucuacuuccaguaaaaaaaaacagggaccagggacuaccguccaguacaggaccuuagagaagucaacaagagaguucaggacauacaccccacggugccaaauccuuauaaccuccucagcaccuugccaccuggucggacaugguacacaguccuggaucucaaagacgcuuuuuucuguuugagguuacacccaaacagccagcccuuguucgcuuucgaauggcgagacuccgagaguggacaagccggacagcucacauggacgaggcugccucagggauucaagaacucgcccacuuuguucgaugaagcccuacaccgagaucuugcucuuuuccgagccaauaacccacaggugacucuucugcaauauguagaugaccugcuccuagcugcagaaacacgcgaggacugugaaauugggacccaaaaccuccugggcgaguuagguaagcugggguaucgggccucugcuaaaaaggcucaguuaugccagauagaagugaccuaccuaggauaugucuugagagauggacaacgguggcucacagaagccagaaaacaagcuguuaugcagaucccgaccccaaccacugcucgccagguaagagaguuccuggggaccgccggguuuugcagacucuggauucccagauuugccacacuggcagcucccuuguauccacuaaccaaagagaaaggggaauucaccuggaccagagaacaucagcuagccuuugaaacucucaaaaaggcacugcugcaggcuccggcauuggcccugccagauuuaaacaaaccuuucacccuauacauugaugaaagaaauggaguggcaaggggaguccuuacccagguuuugggaccauggaagcgcccgguagccuacuuaucaaaaaaacuggacgcuguggccaguggauggcccuccugccugcgagcgauagcagccacggcugugcuaguaaaacaugcugacaaacugacuaugggccagaauguuacuauaguggccccacacucucuugagagcaucaucaggcaaccaccggaccgcuggaugaccaacgcccgaaugacgcacuaccagagccuauugcugacagagcgaguaaguuuugcacccccagccauucucaaccccgccuccuuacuaccugaggcugacgaggccccugcacauaacugugaagaaauacugguagaagagacuggaauccggccagaccucacagaccaaccuuggccaggggugaugacuugguucacggacggaagcagcuuugugguagaagguaagcggaaggcuggggcugcaguaguggauggaaaggcugucauaugggccagcagucugccggaggguacaucagcucaaaaagcggaacuaaucgcaucaauucaagccuuaaggcuggcagaaggaagggcucuuaaugucuauaccgacagccgguacgcuuuugccacggcucauguucacggagcaauauaccgacaccguggacugcugacgucugccggcaaagauaucaaaaauaaagaagaaauucucagcuuauuagaagcuguucauuugccccguaggguggcaauuauccauugcccaggacaccagaagggaacugggcccguugaaaagggaaaucaaauggcagaccaagaagcuaaaaaagcagcccaagggccaaugacucugguggugagaacccaacagcccgcugcugaggaaauaaauaaaagaacccucacagaagaagaggggcgagauuacuuagcuaacauacaccaucugacucauuuaggaacuaaaaaauuacuaaaauugguuaguaagucccccuauuacauuccuggauuaaaaggaauuguggaagagauaguaaaaaacugccgugcuugugcacuuaccaacgcugggucuagcaggcuccaggaaggaaaacgacugcgaggagacagaccuggagccuacugggaaacugacuucacugaggugaaaccggcuagguauggaaauaaauaucuccuaguuuuuauagacaccuuuucaggaugggucgaagcguuccccaccaagaaagaaacggcuaauguaguggucaagaagauacuugaagaaauccuuccccgcuuugggauaccuaagguaauggggucagacaacggaccugccuucgucucccagguaagucagggauuggccagacaacuggggacaaauuggaaauuacauugugcauacagaccccagaguucaggacagguagaaaggaugaacagaacgcuaaaggagacucugacuaaaauagccuuagaauccggcggaagcgauuggacagccguucucccuuaugccuuguucaggguucggaauacaccuggaccccuuggccuaacuccauuugaauuaauguauggggcgcccccacccauuuuuaugaccguaggggauaagaaucgcccggaugugucuuucucuccuucuucuagucuuuuggcucgauuaaaagcucucgaaauaguaagaaaagaggucugggaacagcuaaaagaaaccuauguugcuggugacacacaggugccgcaucaguuugaaguaggagacgcaguccuggugaggagacaccgagcgggaaaccuagaaccgagguggaagggacccuacuuggugcuacuggcaacgcccaccgcggucaaaguggaaggaauccccacuuggguccacgcaucccacgucaagagagcacccccuggagucagccaugaugaguggacuuuggagaagacuacuaauccuuuuaaguugcgccugcuucguaggagcgaucccaaaagacuucaacccccacaguccuguucaacaaacgugggagguacucaaugagggggguaggacuguauggacaaucgccgagguacacccucuguggacuugguagccugaucuuuucccugacaucuguaaguuggcuauaggagccccuccuggaugggacugggagggguacucugacauucagagggcaccuuuaacacccccuccauacguagaaaaacauucgagagacccauggggugguugcucuaaccaaagggauagaaguaugcuucgaacccaucccuucuaugucugccccggaccccaccgaagucagucccucaauccaacguguggagguaaggcugacuucuuuuguaagagcugggguugcgagacuucagguacagcccgcuggaagcccuccucgagcugggacuauauuagaguaacagccaacuauucccuagcgucuuacguaccuggaggauuugaccuagacgaguguacugacuggugccauccgcuccgugucaccuucacugaaccagggaagagagcucugggauggacaaaaggguauaccuggggucuuaggauuuacaaggaaagauaugaugagggauuauuguucacuaucagauuaaaaauagagacccccuacaauccuuuaggucccccaaccaaguucacaccccucacccauacaauuacucagccuacuccagugauugcggacccccuuaauauggccgcuaucacccaaccucccacuccucagguaccucuaacuauuacccccgagauuccuucaagacagaggauguuuaaccuagugagaggagccuuuuaugcccuuaacagaacugauccuagcgcuacugaggacugcuggcuaugccuguccuuggguccgccuuauuaugaaggaaucgccuucaauggagauuucaacagaaccagcagccauacuuccugcucuugggguacaggacaaaaacugacccugacugaaguauccgcgaggaauccaggucucuguauagguaccccaccuuccacucacaaacaccuaugcggacaaauacaguccguguccagaacggaagcuaauuacuaucuuguaccuuccccgguuggauggugggcuugcaauacaggacuuacucccuguguaucaacuaagguuuuuaauucaucucaugauuuuugugucaugauccagcuguuaccccgcguauauuaucacccugcauccaguuuagaagaaagcuaugcuggccggcggucaaaaagagaaccaauuacuuuaacccuggcugcauucaugggaauagguauggcaguaggaguggggacgggagugucagcuuugauagaaggaagacagggaauucagucuuugagggaugcugucaaugaagaccuagcggcaauagagaaguccauugacgcuuuagaaaaaucuuugaccucccugucugagguaguuuuacagaacaggagaggucuugauuuguuguuccuaaaggaaggaggacugugugcugcccuuaaagaagagugcugcuucuaugcagaucauacaggaauaguuagagacucuaugcagaaacugagagaaagauuagagcgaaggaaacgggaacgggauguucaacgggggugguuugagucgugguuugaaucacgaccaucuuggauaacuucuuuaauuuccgcuguagccggaccaauccuuaugauaugcuuagcuuuaguuuucggcccuuguauaauaaauagaggaauggcuuucauccagaguaaaauugauacaguaaaacucaugguucuucaaaggcaauaucaaccuauaguucagguagaugaagaguuaggggacaccaaucucuaaaauucuaugauuagaauuagucuaaacagaagaagaggggaaugaaaggaaauaaaacuguaauucauguaauguauguuaaauagcccaaagaguuguuucugagcuuugaaaccuggggcugagaacauagcagaacagaccaggacaugcccgggcaagcccaucgccucccuagcucccaccccucugaccuaaguuaaauguuacaggcugcugauguuuaaauggaccaaucaugugaaaccgugccaauuccucccccagccccacuccuuuucuauaaaaaccccuagcuuccaagccucguggucgaauccacugucuccuguuaugugagauacguuucgacccggagcuccgccauuaaaaaaccucuuguuguuacauc

SEQ ID NO: 7637 - RNA, 2128 nt, Mus musculus
ugauuaauuuugucgauaauuacaaaaacacacgugcauuuuacauaugcauacaguaucugcucacuccaaucccauguucgcauccacucccuuguugcucccaccccuauagccaccaccccuucuccuuauccgagucucuuccccacauuuaggacaucugauuuuuauguucaugacauauguaguuugauaaugacauuggguugggaccugguguggccuccaguggauacccagaagcccuuucuuaugcagaacagcgcugaagcagcugcaguacauucuaagagcacugucuucuccagaggaaggcuauugcugccucucucccugucuuugcauucuuauccucuuugcaccccaaguuuacugcuugagcauugauuuggggcacuccauuccuuauuccaaacaaacagcccuucguugucaguggguuaguggugacucugaaucugugcagaaaugccugcuugcaaagcaagccggauccauuuuaagugaacuuucuagaguccuguaccugccagaugccugaagucagggccucagcagguccauugcuccuacuucucugcaggccuaggucacauagaucccagacaaggugauauugagccucaauagcaguuguguucuccggaaggauauccgccaaccucuguuagcaaaggaucgaguaacaaccaguuagacacuuugcuggaggugucacauuaaacuuuaauagcaguucccuguuuacagggcucuuugcucuucaacuugcagccucuacaugaucucacuucagguucuccuacaaggaaacugugucugguuuaggauugaauugcagugacagagagaaagagcaaaacguggacaggaguuauuacuuugcugagcaaugguguuuaauaggaaucggcuggcucucuuucguaugaaaaauucaaaagggcucagcuucuaaccguucuucaacccucugcuuggcuguuuaagguuuagcagaacaacuuugccugguuuucauccugguauuuagagaaacaagauaucuuuuccugcuccccuucaucauuccgacccuaauuuuuggccccugucuuauauacuuacaggugagccccaccccuggcugcauccgggcucucaugaagaugcuguacugcccauacugccgaggcuugcccacugugagaccuugcaacaacuacugccucaacgucaugaagggcugccuggccaaucaggcagauuuggacacugaguggaaucucuucauagguaagaggcauucaacagguccgauaaccaagaccugagaccuuaaagcgaucaggauauuugauguuucugcagguucagaaguugugaugacuuacagagacugaaacagcuuucuagcaauuuuaaaauauuauuuugcaguuuucccuguugucaaauccuccaaacuaggauuuccuuguauuauucaaguaaauucccaguaaagauaagcacaccagcaagcaguguucaaccagcuuauuuuauugaguuuuaauuucaugacgagaaguaaguauaaaagaguuuuuaccagaaaacaaauccacucaugauauuauuuuuauuuguacuaaauuaacugggcaaagauuuugcaaaaauacuuucucaaauugccagaaugaaaagagcguacuguuuucacuaacacgugcacauugccaucucauccuggaggaaagagagcucugggcacaggcggguucagaaaucagaggagaagacaagggggaugcaggaaacagguucuacaucguggcucugcucaaagauguuucccaaauagcucucuaaggauaaagggacagauuuuauaggcaggcuucucccaggaaaauacacaagccuugaaagaguaaauguguuuucuuccccucugucaaauggccuucaaguaaaaggacuuucaguugcauuuacugcaauuacagacugacaagcagagacuuggaaauagcggaugaauuugucauccucagagggcccucguggaugcaagccccuaagcaagaagcuccaggagggccuccugacaguuugcaggauuuggcuguggcaguggcgggauuuaggagccaucuca

SEQ ID NO: 7638 - RNA, 776 nt, Mus musculus
uguagaguuccuggcggcggggaccgggguagccaacggcuuguggagcaucaugcccaaguuuuauugugacuacugugauacgugucuuacccacgauucuccaucugugaggaagacacacugcaguggucggaaacacaaagagaaugugaaagacuauuaccagaaauggauggaagagcaggcccagagccugacugacaagacaacggcugcauuucaacaagggaagaucccuccgcuccggucucugcuccuccgccugcaggggccaugaucccaccuccccccagucucccgggcccuccucggccuggcaugaugccugcgccccacaugggaggcccucccaugaugucaaugaugggcccccccuccgcccggaaugaugaccgugggaccagcuccugggaugagaccacccaugggaggccacaugcccaugaugcccgggccucccaugauaagaccuccugcccgcccuaugauggugcccacccggccuggcaugacccggccagacagauaagagcagaagcgcucuugaugguuuuguauuucuuguucuguuccaccaggagcucuuggugcugagccugaguguuuacuagaugcauggaaaggaaacuucccuuccuaacugaauauuuuuggagagagaaauaauacaaaaaagugcaguuuucacuuauauugugaaaugugaaaugugaaaauaaaaucaucagcucuuuuaguuaaaaaaaauaauuaauuguaaaaagaaaacacaa

SEQ ID NO: 7639 - RNA, 3801 nt, Mus musculus
auuuucucuuuucccugguucaggcuuuauuuaacucuuuguucaaaaaaaaugaacggagugauaguaggguucuaauuuacagauauagcuuagacgcaucuaauauuaaauuagaagaucgcacaagaaaaccauuuacacauaaaaguuaaaaccaauauuuaaacuuuuaaaacuuuaucuuacauaaagccaaaacgaaacugaauacauguuagcaacuucauucacaaacauuagucaaaauauauacauuuaaaagggaacaaaaagcuauaauuucaggaagguuuuuuuuuuuucuaaaauguguuuuauaauuugcaagugaauugcaggcugucuagaaaauaagcuaaaugggaagggagcucugaaaaacaggccaaaacaguucagcuugggaggaguacuaguuggugagaggcaucuuucaaaaacaauucugugcuuucuuucuguccuuuuuuuccccaguuuugcuaaguaauaaauauauaauuacggcccagacaaaaaagucugauuuaauauuagauaaaauugcgauucugaaaguuccgcaauucuuaaaaguuaacuuugacauuugcucaacauguauugagucucaaaccgacucaaauuuagggcaacgaaaauaacacauuucccaagacucaacguuuucacugacauacacacauuuacaaucuuaaggugaacucagccuugaggggaaacagcuuguguacuuuccacgcguucguaaacugugucacaaguccaagccagcggacucagagacuucuagcugauauuucagggguagaauaucgaacugacaacuuccaccucacauguauuucuuugcauuucuuguucuugggaaagaaguagaagaaaaaccaaaaaaggucuugcuuugauuugcacaugggaugaaacaaaaggaacggcggucaucucucauauacaggccggauucgagcuggucauucacuggucaagaagagauccgggcuguguucugcagaggccuacagaauucaacaguacaaucagaguaaggcugcccagagccacccuacucuaaaaagcuaaagacacgagucaccggcucuccccuuggccagcuauuucagaccgaacaucagaaccgagcucaugcaacacggaccaagugggaccgggagggaggaaggaugagacgcaaaaagcaaaauccaaccaacaaaacuggaaagcccaacguaucguaaagcaccgccccucccccucugugggucaaaacgcaacagguuccgaagugcaaagcaaacaccaacugcuggcgcuaacaaccgcucuccuuuaaaguuggcugcagaagugcggcggcuggggaaugaugcugcgaaauccacacgcucucucgcccgcgcccucgaaggcucggccuuucaagcccggacuggcaucuccgccucugccugacaccuauacaucuauguacauacaaaccgggcccccugucgcccgagggcgcagcggaaggccgcgagucucgaaccuauacauauguacacgugugugcacagguccccgcggggucauagcgcggcagcguaggccgcgggguagggguccagcugaggcuugcccaugccuggcagcaggauguaggcgagcggcggcugcagccccgggcugggccacgcgcugcaguugcacgggaucauguagccgggguugccgggacuggggugcgagugcgugugcccuccggcggccgccgcggccgcagcagccgccgcggccgccccguggaaggcgcccgcacccgccgugggguaccccagcgacgacgcguacggcaggccggacgacgacgacgagaucucugccaucuuggagcccaggucgagcagugaguaggggcugccagcggcggcggcggcagcggcggcggcggcagcggccgcagacugcgggaagaagacgcgcgcggcggcggcggcagcugcggcggccgccuucucgggguucgcgagcagagacucggggaccaggccgccgcccgcgcccgcgugcagcccggcucccgccuugagcgccgggugcucggcguccgccacgcugcccaggccguagggcacggggaaggcgaacuuguccuuuuugagcagcgucuugggcuugcgccgcggccgguacuuguagucgggaugcuccuucaugugcauggcucgcaggcgcuucgccucgucgaugaacggccgcuucuccgacucggugagcagcuuccacucggcgcccaggcgcuugcugaucuccgaguugugcaucuuaggguucuccugggccaucuuccgccgcugagcccgcgaccacaccaugaaggcguucaugggccgcuugacgugguccacaggcuuggacaugcugucgccgugccgcggcugcagcccgccgccgccgccaccggggcccucggccuccgcccggaggaaaucaauguuggcugccagagggaaccggcucagcgggcggccgugcguccccgcgucguucccgcgcgggaagagaggaccagacgaccagcccugggucggggcgcugcgucccggaccgcuuuggucugucuggucgagcucuaagaaaaaauccucuccgggacccugaaacuucuccucgguguccccacuccgcggugucacucugcccucugcuuuuuuguccucugucccguugcuuuggcucgccaacucccugcagguggccgcugccugguucugcucuccccucuccucugucuucagcgccuuaaaagccaagcagccccgaaaguugagcggcggaggauccaccaaguugagccgagaagcccgccgccgcgugcugccaagugccaaagggggcucucggcggcuggaguguuuggguucuccccggugacuuucucauuugacagaagcagaugggagugggggagggguggccgcgaagaggaagaggagggguagggucggggcgcgcagagcagggcggcggacagaaacacaaacacugcagcggcccgucuucugugucggggucagggcgcgcugauggaacccccaauccuguaguucugcugagggcugacgcuguccccgggcaccugccuggagaaucuugcugccgggcuuuggcacaggagaggagaggaaggaggcgggcugagguuuugaguuagccugagucgccgggccucaguggagacuguccggguucuccgacucgcugcugcaggcuguccccggggccaugcuugcuccgcuggcucccagcuuccccgggcgcacugaaggucucgggcucccggagcacuccagaagcggagggcugcucggugcggcgcggccggccaggcccgggcgccuucucccagcuccggucgcagcagccagacacuugcaacuaacuucucccaaguuuccggcccgggcucagccgcgccccucucggugagcgcgccuccgagcgugcgcccgcgugggugccgcgcccgcgagccccugggucccggcuacuccgggcgccgcaggcuggaaggaugcagggauccagguccuggaggaggacggggauuaaagaaaacgugcuauaucaccucagaucgcaggucugcucuggggcugcuccugcuuucccagcuccgggcccaggcuuucgcuccgccgcuuccgaggcgacugcagcccggcucaggugagugucgccaccugcgaguguuggcgccggcagcgggcgcugggugugcauguccagccgcggccgugugugagugugugugua

SEQ ID NO: 7640 - RNA, 3801 nt, Mus musculus
uacacacacacucacacacggccgcggcuggacaugcacacccagcgcccgcugccggcgccaacacucgcagguggcgacacucaccugagccgggcugcagucgccucggaagcggcggagcgaaagccugggcccggagcugggaaagcaggagcagccccagagcagaccugcgaucugaggugauauagcacguuuucuuuaauccccguccuccuccaggaccuggaucccugcauccuuccagccugcggcgcccggaguagccgggacccaggggcucgcgggcgcggcacccacgcgggcgcacgcucggaggcgcgcucaccgagaggggcgcggcugagcccgggccggaaacuugggagaaguuaguugcaagugucuggcugcugcgaccggagcugggagaaggcgcccgggccuggccggccgcgccgcaccgagcagcccuccgcuucuggagugcuccgggagcccgagaccuucagugcgcccggggaagcugggagccagcggagcaagcauggccccggggacagccugcagcagcgagucggagaacccggacagucuccacugaggcccggcgacucaggcuaacucaaaaccucagcccgccuccuuccucuccucuccugugccaaagcccggcagcaagauucuccaggcaggugcccggggacagcgucagcccucagcagaacuacaggauuggggguuccaucagcgcgcccugaccccgacacagaagacgggccgcugcaguguuuguguuucuguccgccgcccugcucugcgcgccccgacccuaccccuccucuuccucuucgcggccaccccucccccacucccaucugcuucugucaaaugagaaagucaccggggagaacccaaacacuccagccgccgagagcccccuuuggcacuuggcagcacgcggcggcgggcuucucggcucaacuugguggauccuccgccgcucaacuuucggggcugcuuggcuuuuaaggcgcugaagacagaggagaggggagagcagaaccaggcagcggccaccugcagggaguuggcgagccaaagcaacgggacagaggacaaaaaagcagagggcagagugacaccgcggaguggggacaccgaggagaaguuucagggucccggagaggauuuuuucuuagagcucgaccagacagaccaaagcgguccgggacgcagcgccccgacccagggcuggucgucugguccucucuucccgcgcgggaacgacgcggggacgcacggccgcccgcugagccgguucccucuggcagccaacauugauuuccuccgggcggaggccgagggccccgguggcggcggcggcgggcugcagccgcggcacggcgacagcauguccaagccuguggaccacgucaagcggcccaugaacgccuucaugguguggucgcgggcucagcggcggaagauggcccaggagaacccuaagaugcacaacucggagaucagcaagcgccugggcgccgaguggaagcugcucaccgagucggagaagcggccguucaucgacgaggcgaagcgccugcgagccaugcacaugaaggagcaucccgacuacaaguaccggccgcggcgcaagcccaagacgcugcucaaaaaggacaaguucgccuuccccgugcccuacggccugggcagcguggcggacgccgagcacccggcgcucaaggcgggagccgggcugcacgcgggcgcgggcggcggccugguccccgagucucugcucgcgaaccccgagaaggcggccgccgcagcugccgccgccgccgcgcgcgucuucuucccgcagucugcggccgcugccgccgccgccgcugccgccgccgccgcuggcagccccuacucacugcucgaccugggcuccaagauggcagagaucucgucgucgucguccggccugccguacgcgucgucgcugggguaccccacggcgggugcgggcgccuuccacggggcggccgcggcggcugcugcggccgcggcggccgccggagggcacacgcacucgcaccccagucccggcaaccccggcuacaugaucccgugcaacugcagcgcguggcccagcccggggcugcagccgccgcucgccuacauccugcugccaggcaugggcaagccucagcuggaccccuaccccgcggccuacgcugccgcgcuaugaccccgcggggaccugugcacacacguguacauauguauagguucgagacucgcggccuuccgcugcgcccucgggcgacagggggcccgguuuguauguacauagauguauaggugucaggcagaggcggagaugccaguccgggcuugaaaggccgagccuucgagggcgcgggcgagagagcguguggauuucgcagcaucauuccccagccgccgcacuucugcagccaacuuuaaaggagagcgguuguuagcgccagcaguugguguuugcuuugcacuucggaaccuguugcguuuugacccacagagggggaggggcggugcuuuacgauacguugggcuuuccaguuuuguugguuggauuuugcuuuuugcgucucauccuuccucccucccggucccacuugguccguguugcaugagcucgguucugauguucggucugaaauagcuggccaaggggagagccggugacucgugucuuuagcuuuuuagaguaggguggcucugggcagccuuacucugauuguacuguugaauucuguaggccucugcagaacacagcccggaucucuucuugaccagugaaugaccagcucgaauccggccuguauaugagagaugaccgccguuccuuuuguuucaucccaugugcaaaucaaagcaagaccuuuuuugguuuuucuucuacuucuuucccaagaacaagaaaugcaaagaaauacaugugagguggaaguugucaguucgauauucuaccccugaaauaucagcuagaagucucugaguccgcuggcuuggacuugugacacaguuuacgaacgcguggaaaguacacaagcuguuuccccucaaggcugaguucaccuuaagauuguaaauguguguaugucagugaaaacguugagucuugggaaauguguuauuuucguugcccuaaauuugagucgguuugagacucaauacauguugagcaaaugucaaaguuaacuuuuaagaauugcggaacuuucagaaucgcaauuuuaucuaauauuaaaucagacuuuuuugucugggccguaauuauauauuuauuacuuagcaaaacuggggaaaaaaaggacagaaagaaagcacagaauuguuuuugaaagaugccucucaccaacuaguacuccucccaagcugaacuguuuuggccuguuuuucagagcucccuucccauuuagcuuauuuucuagacagccugcaauucacuugcaaauuauaaaacacauuuuagaaaaaaaaaaaaccuuccugaaauuauagcuuuuuguucccuuuuaaauguauauauuuugacuaauguuugugaaugaaguugcuaacauguauucaguuucguuuuggcuuuauguaagauaaaguuuuaaaaguuuaaauauugguuuuaacuuuuauguguaaaugguuuucuugugcgaucuucuaauuuaauauuagaugcgucuaagcuauaucuguaaauuagaacccuacuaucacuccguucauuuuuuuugaacaaagaguuaaauaaagccugaaccagggaaaagagaaaau

SEQ ID NO: 7641 - RNA, 731 nt, Mus musculus
uacaacagcagguuacaugucuauauuaaauguaugcacacaugugauaauuauaauuaaagcaaacuauagagauaauaaugaaaguaggaagaaggcuugggaguagaggaagaggaagcgggaggaagaugcugagugugguggaaggagacuggagaggauccgaguaacuuacauacguauauaaaaugucacgaugaagccugagacuggagaggacccagguaaauuauguacacauagaagaucugacaacggaaaacugaaggagggaacucaagugagcagcagccucaugauggaagaaauugacaggaugauaguucaaaugcgcuuaaaggauagcaaaacuguauuaauuucaaagacggaguugaccgaugugcaguuccagaagcuaagaaagcacuucgagacagacuguuacccuaaugaggaaacucugcaggccuucgcugaggaacucaaacuacagaaagaugucaucagauccugguucaucacucagcgucgaagaaugaugagguacagaugguuuuucacgagcuacuacagggauuggaaaacguccugugaguacucuacaacaagaagauucgacaggcagaagaacuccaaggagugcucccagaaugacccuggacuccccgaagaguuggaagccuugaagaggcucaagcucucuucuggguaccaaagcagagauggcaugucacaagauuucugac

SEQ ID NO: 7642 - RNA, 3207 nt, Mus musculus
cuaaucuugaguuuugauguccuuugaggguugagaugaccggauuugcugagcaguuggcugaggugcaugaaggaggacgguagaaucgugucagccucaggagggauggugauguuggcuaagaggagggagccucuagagaagcaggucugagugacaucaggaauuuagucucagaaacgcagacugugagacgccaggagacaugagaggaaauaccaagaagcggggugacccuccacauacacgacuggaaagagcuugggugagcaaggcacauuugugguugucuggguucgguauaaauccacaggacaagccagauccuuuaaggcugcauaaagcagagaagggccagguccagcucccaucucacagccaagacaagagaacugacagaaaacacugucaggcuagaguauaugggcaagagaaagcccaggguaagaaccucugaccaugugaggaagauggucuacgggagaucauauggggccauugauauggccaggcauguggagaaggacacacagcugggacuaaagaggacaccaucuaagucccaauuaaccuugacuaaagcugccucaagagagagguugggguggucccuuuuugaguagcucagaaggauggagcacauaggaggaaacgagucucuuuuaaggggagagguaaaaaagguuggaguguaggagucauggagagcuuguaugugaguauguguguguguaugugugugugaguguguguggugagugugugaggguguguguacguguguacguguguguggguuuuagugggagugaguguguguguuugugugguaagaaauaggugagggccuucugcuuuucaaugaugauuucggauaauuuuuuuaaagauguccuuuaucuaugcagcugggauccugccccagggcauacauuccuuggagguuccuaagggcagggaccacaguuggccauaaucauggaaccguuccauuuagucucccauagagaacagacagacggacacacagcccagcuccugguggaaaacaguucagaugcagcuuuuucuucccaauuuccauccacuggacuuugcacgaugguacuuuaauuuggagucauuuaaaacauaauaagaugugaauuuuauugcucuaaaaugcuagaguuagaaaguacucuucaagguuauuuaauuuaguauuuucaggugaggaaaccagaauccacaggcgacuucuuaauguauauuaugucaucaacuacauguuggaauagcauaucaacuggaucaacauuuacauauguccauucucucaaaaagugugaauuugaaaacuuaucugagcucagugcuggagaaaagucggacucaccaugagcaagauuuaaauaacauuugaacauugaaggcuaucauccuccucccagauauaacccugcugguaaaaucuuuguaagcaugggcuuacgcuaugguucagcgaguaaagagacugaggcagaagugggaggagcugagucuggacccuccacaaccuaugugaagccagguguagccugagaucucaccguaucuguccugguuaguuuuauggcaacgccacacaaauuaaagucuucagagaggaggggacuucaauugagaaaaugccugcauaagauccagcuguagacaaacauguaaggcaguuuuuuacuuuaguuauugacgguggagggcccagcccauuuuagguagugccacaacccugagcagguggcccugguucuguagaaagcaggcugagcaagccagaggaagcaagccaguaagcagaaccccucuauggcuucugcaucagcuccugccuccagguuccugcucuguuugaguuccuauccugacuucuuucagugaugaacaaugaugaggaggcauaagccaaaugaacccuucacuacugugaugguuuguacaugcuugguccagggcguggcaccaucaggagguguggccuuguuggaauaggugugucacggugggcauggacuuuaagacccuaguccuagcugccuggaagccuucagaugaagauguagaacucucagcucccccugcaccaugccugccuggaugcugucaugccuugaugauaauggacagaacuucucaaucuguaagcaauucccaauuaaauauuuuccucauaagaguugccuuggucauggugucuguucacagcuguaaaacccuaacugagacaccccugacaccuccccaaguuguuuugcucauggcuuuuagucacagcaacagugacccuaacuauggaaguaccuauggcaaaaugggaggccaagucuggaauauugggaaacucaugagccagcuagccuagcaaacacagcaucgaacaagagacuguuucaaacaaggaggacaucaguggucccuaggagaaugugugaccccuuggugcagaaccagccgacucuagauaacuaaacaguaacccggaaaaggaaacagcuaugugcugaaugccuacgacucgguagaaaagagacgcgccccucugugguuccgaacaauggcuguuucuguuugauuuagggucugugaggguuaagagcugaagaagaaagggaacaucgcauuuuaccuguuauuauuaugaacgccacgccucuaggacgcggugguggccggggcuggggugaaucuuccuaacaagaaauaugcccgacgccagcaacuuccccacacaauuugucugucuguguaauccucggguguuuacaauggcuuuuucgcaccaccaagaacacaguaugaaagguuauauuguaauucuuuuggcacagucuauacagcagcccaugaaauuugguuaagcagccugaaugccguucugugugcccuccagacucucgaguccccauacugugcgggagaaaagcaaagggcagaacucugcuauauaaccugcuugcuuccagaugugacuaagaggaguaaaaaauuaaaauauggacaccagauaaaugggauauuauagcacgcgauaguaacugaacugaauuuuauuagucaaaaggauaaaugacuuaaaauauuggacggaacauuaaguguaaacuuucaaaauaccuccuguaauugucuaauuuguguucuuuguaaauaauauccuaugaauaaacacucucuagcuauaau
